United States Patent 9,328,346 (POLYCOMB-ASSOCIATED NON-CODING RNAS) - sequence listing, part 16

SEQ ID NO: 2517 - RNA, 139415 nt, Mus musculus
ggaaggagggagggcugcagggcugugugugugggggaaguagcgcggagaagacaagccacccaggcgcucguucgcccgcccgcuugcucgcucgcucguucauucgcucgcccgcccgcccgcccgcggucccugcuugcgguccccgcucagacucggucuccccagaggaagccacuccaggcgcacucccccggcggcuccuuccggacgccugcucggcuuucccgggcacggcguucgcgcuccgccucgcccccccucagcccucccgcucucucucccucccucccuucccucccucccucucuccucccugccgccaagcuccccgcccuuaguaucgcgagacgaggugagagcuggcggagcggcggcggcggcggcggcaguagaggugaccgaggcgguggcggcggcggcggcccggagcgcugugucggccccggcgcgaccgaagucgcgguagagcggagcccccccacgccccucccccguccgcgucccccacccccucuucccgcggggauggagaaggcgacgguuccggcggcggcugagggagaagggagucccccggcggcggcggcaguggcggcccccccccgcggcggcggcggcggaggucggcggcggggcucgcccggccucuucuccucgugggauggugcgagucugcgaccugcuccugaagaagaagccaccgcagcaacagcagcagcagcagccgccgcaccacaaggccaagcggaaccggacuugccgacccccgagcagcagcgaaagcagcagcgacagcgacaacagcggcggcgguggcgguggaggaggaggaggaggcggcggcaccagcagcaacaacagcgaggaagaggaggacgacgacgacgaggaagaggagguuucugaggcaagggccugguuucaccucgaggagggcggaagggaccguggagggccuaaggugggaggggacucgcggugggaccgagcccucggggcuuacgaucugcccugagggaccgggcuuucggcugcccccuuucuuugcucggccugagucgugagguguggggacgugggggaggguagcugacacgugggggugggaggaccggagagugcacggaguugccgagaagcuggcuagccgaggaugcugcuucgcagggugaaggguggagggauugauuggucggauucccggguggcacuuuggggccgaaggguggucucucuggggccaguaaggccaccucauucccggggcgggggcggagcuaaagcgggagggguaagauaauagguaggagagucuccgggggaccgacugcgagcuugguaguuuucugucaguggaagguggccgggagcaguuguggaggggcgguaagauuguaauggacucggagcuaaguauuuguaucugggagagacacgugagaggcuguacuuuuccauacuguuuugcugcagggcuuuuucuuuucucuuucucucucucucucucucucucucucucuaaacucguggcugcugaaguacucuucgcuuccucgauuugugaaagauuuauggaugagccgaucuucuaucccuccauaugcguuuacaagugacuuaguacguaaaaauuguuaggugcucugcguguauguguaauaauccaucggguucucccuuaauaagaaauaaucaaaccauaccccgcuuuuauuuaauuaacuuuauuuauuuaucuauuguaaaguaagcagggaugaagugucuguuuugcacccgggcaugguugugauugggauagggaggccuuauguucuagugaucugguuucauaacuccuuauaguuuuuccugggucuacagacaggcggcguuguaggaccuuauuccuuuuaacccaaaagcuuaaugaaccauacugauagcaaacuaugaccuaccaguuguuaguucuuuuagaacaaacccuuuugucaauauuaggaaauggaagcuuuaaacacccaaauauggaggaaauaguaacucgaggcagcagagggaaagaagcuguaaaaguugauucuaaagagaagacuaauugaauuauccagaaauacugcgugccacacuagagccugguaaaaggcugcuuuugaguuaauuugauuucuucuuucccauccagguucuguuuauguagagaccuuggaaagagacuugaggcucaccuguuagcaauaagacaaacauuuuuucccuaaccuuagaugaagcuacaucguagaaaaaaguucuaagaguaggaauauauauaccuccaaacuugucccuucuguuauuucuauugggccuauugugguaaauguguauggguaguuuguacuugcuuauugauugauucuggacagcguguugcucaggcuucauuguaagcaauguaggcaaggcuuagugucuagcaggccuaaggcccuagacacccuuaaaucaaacaaacacaaaagagaaagcaaaacuuuaauauugaaacaaugaugagaaggacgugauggaauccuuuucuguuuugguacuuagaauuggccagcuuuauaguucucagaagugggaaagacuuuuccucugcagcucagccucuuuauuuuaaaaauaagggcagcaagguuuaaaggauacuggaggauagugucugauaguugcaaaaguaggaaucaaaguuuuuagagacucagugacaucuguacauuuugucucccuucugaccuauuucaaaaacuggugcugaauuucagguuuagcaacugugaguaaaccaccaguaguaagauuuuaaguuuucuaacauuaagcucugguuuggaacaaggccguauacuuaauguaauacuuaaagaagaauucugcuacaaacugcaccucccuagguaguuuuguccaugaccugauauuuccucaaguuguauagauggcuugaagcauguggguauguuccuuuuguaggucugaguuuuucaucugagaauauguacaauauguacuuugaccagcuaagacaguguugauccuuacuguguuuugcacugccaucuucacaaguaaagcaauagguuugucauuuguugggugaaauauauguaauaagaaagcugagccauuaaagaaaugucuguaacacaugaugagaaaugggcaugauagaaaggacuggccugcaugcugugaucagagugaaggggugaagcucugagcugugugcugcaacuuggagucaggugggcggguuggguugugcaauaguuucuuuucucuuucacugucuuuacaugucuucagaaguuuaauuuucaggacuugggaaguguacuuuuuuuuuccccaaaauuauuuuggccuacacaguuuacaaaugcagauaaucugauccuugaacuaauucuccuguaaaaaucaucaaaagguuaggagagcaucugaaaguguauacuucugcggugucucacuugaagauguugaaggaugacaacaugacaaaaagaaauguuagcuggacauccuaugucuggugaaagaggaaaaaugggagagaacauggauuuaaguaagagcuuuauuuguaaguuuuaguaccuaguugcaagcccuauuuauccuuuagaguagguaucuccaaaguaucuccgauuggauggaaugguuuugaugcucguauagccucagcuguaccuggaaagcgugcagaagauugaaaacuuuuccucucuucccuucuuuuggcacaagacuuuaccucuaaguugaaagucuaauuugcucagcuuucaaugggcuacugacuaguaaggaacaaaauauauuucccaacauagaaacacguuguacauuggauugaacuaaauauuuacaagaaaaagguagaauuggaagaguuuauacuucauuucagaaauaauauugcauucuauugaacacacuuugggauaugaguggaaggcagcuuucucugaagcacaauucaaagggaggaaauguuaaugauagaacuuuuaaguucaagagcaauguuguugaagagaaaagaauaaaauauaaguauggugagagucgaucagaauuccaccuauauuugaggaaaaagaugugcuuuuuuauuuuaaauaagaaagaaacuuagugaagaacuuuagacaaugagggccagugaauuaguguugacaguacugaggaucugcaaggccaggagacuugcaucuguaaaagagguaggguugaggaugagggagaaggggaaacuaucauuaagacucuggacacuaauuucuuguuucauuucuuuuguuuuuaauggaaagaugcuaggcuccacuguuguaaauacaugagaucagaauaggccagagaaccuugccuguacuguuuccccaguucuguuucuucaacuaauguagcauuauuuuuaaaauggauaaccuuugaagaauuucucucuuaauuauuuccuuaucuucuauuugaaaaggacuugaucaaaaagaaaaaaaggggggggggggacagcauacagaucuguuccgucaacuaguaucaguuuuagggagaauccagaauucauuuagggacucaugaauggaguuccuucuuccuuucuugucuuccuuagccugugaauagcugauguuuggacaccgucaaccccccaccccccaccccaacaccaccaguuuuguuuuguuuugaagacagggucucacuguauagcucuuucuguccuacagcucacgcuguagaccaggcuggcccugaacucaccaagauuaaaagauacaccauuaugcccagcagugucuuuuaauuucuuaauuacugugaguuaugaaacuugccuagcgagagaaaacaaguuaaacuaaucaucauuggcuauugaaugucuaauaggugcuuuaugccucuaauauucuaacauacuuaaaaaaauaguacuugagugcccauuguguaugaagacuuaacuaaugguucugagcauggacuguauguggaguuuguauucaguuuuuugacccaucacucacugguguuguggucuuggaucaguuacuuaaccucucuagcucauuuucuuauauauaaauggggauaauagauccuacuuuacagcaguuaagaaagugaaaggaguuaauaguuuucauguuuucucauuuuacaucuccauaacgcuaugaaguaggugucaccauguuuauuucauuauucaaaaaugaguucccacuggguauguuuuagucugcauugagcaagcaaugauaaacaauguuuuuaaaagacauguacauuaaaaaauguaccaaugaguaaagagagguugggaaaaguguaagaaugagguuuaaugguuauauauucuguuuaaggaaugaguuucagaaguauaaaacuuuugcgccaggaccaguuugcugugaagccuggaacucccaugauagaaaggagagaacggagagaacugacucccacaaggaguccucugaccuccucacccccagucagccacugaguuuugagacauugauuuuacaggcagagauacuaguuuaaaagagguuuacgugacuuugugaaggauguauaucuaaugagugucauagcaggauuuaaccucgguuugauuccaaacaugcucauucguuuaucacucauuuuuuauuaugcuaaaagaaagauauuuccuuuaaaauagagguuuugaccuggaaucuggauaagguuuauguaaucauuuauuuugguuuggauuuucuuuuuaacuuuucccauagacuuguagcuuauaucuagcuuuuuauuagauacccagaaugauguuaaucuggcaucccuuuauuucggucuaacuuguauaaacugcuucagaggaagucagugguaacagaaggccuaucaggagaaguagugcccucucuuucuuuucuugugaaucuuuaccuuuaagugaccuagcaguuuauaucuagaguauuaggacuauuaggucugaaggcagaaccuuggcuuugcuuuuuuaugucuucuacaguacaguaguauguguccuauaagucuuaagagucuuaaccguuugauuuucaugaagccaaauuucaaguaugaauauuacauaaauauuccuuauuaucuacuuuuguuuuuagauuuauuuaucuuauguaugagaacacugucgcugucuucagacacaccaauggaggacaucagauuccauuacagaugguugugagccaccaccaugugguugcugggaauugaacucaagaccucuggaagaacagccagugugcucuuaacugcugagccaucucuccagccccuuauuagcuacuuaaucuggaaaauguuuggaacaucauaucuuaaagaauuuauuuguaccuauuuauauuguacccauacaaacuauuuuuuaaauuggauucuaauucuuaguuuaauugcccaagcuuauagucagaagugcaugagaaguccccuagaugggauuuucuuuuuuucucuuuuuuggggaguuggugguuguccuagaaauugcucuguaggcuaggcuggccuccaacucuagagaucccccugccucugccuccgcagugcugggaucaaaggugugugccaccacugccuggcuaaaaauaguauuuuuuuuuaagauuuguuuauuuauuauauguaaguacacuguaacugucuucagacacuucagaagagggagucagaucuccuuauggaugguugugagccaccaugugguugcuaggauuugaacucaggaccuucggaaaugcaguugaguguucuuacccucugagccaucucaccagcccuaaaaauaguauuuuuaucuucauaacugucaacauugacugguuuuauguuuuugcuuagauuguuuuugagaauuucauguuugauuucuuuauacugggcuuuuuucuuggugauuuguuggugcuguuuauaaguauucuuuaugucauuccauauauucucuuuguuuucacaguauaaaaacaguauuuugcuuaguaaaauguacuauuauuuuaugacucauaggacacuccacacaagagaccuuccuugaccccauauauaaagauuuucuagaguuuuucuuuugguaguaaguauucugguucccagagaaaacuugguacacuuuuuggauacaggguuugauuauuuuguaaauuucucuccuacuguuuuuuuuuuuuuaauaugaauugccaagucuucagagaacuuugcccuuuccuucuuucccucugguuucuauauuuacuagcuagucuuuuguuggucuugcuucccucuacacaccucacugcacauccuuugaugauuuacugcuucuuuugggucuuguuuuuaauuugaucuuacgugauuuuugucucuucuguuuuguuauguugucuauaagccagucagucaccuuaaaauugguaucuccagucuaaacuuguugauuucaaacuguggccacccaacauuugcacacacuuuucuuuguacaucuagucuucuggcccuucucccuuuuuuccugacugcuugaggacauuggaaauaauaguuuugaaugauuaucagucaggaauuaaucagagaaguggauuuauacaugauuggcaacuaccugguuagcuagauagcauucagagauuuauuaaagggaauuaauugacuuauaagaugguaagggcugccuaaggaagcccgucuggaaggcaguuaggaaucgaaguacucuccagugacuccuauauuucacacauggucaagaaaaagucacccaaggacauaaacaacagucaaaagaacacuccuccaaagggccaaaauguggaaggagcuugcacaggggccagcacguagccuuccacagcugcugccccagaaggaccgcagugacaucugucuacuaccuuuuucuuccucucuaaagaaacuuugagcagaguuacccuguucuagucaccacuggacagugcauuaggcaaaagaggauuugcuuucuuuuuagcuugcagaguacugaacuggugacuucuacuuuugaguuguuuguaguagcugagugagauuuugaauugauuuucuuaaaggaaggaaagauaauuaagucugagcucacuuaucaaggacaaguuuagacuggagguacaaauuuuaaugugaccgacuggcuuauagacaauauaucaaaacagaagaugagacaaaaaucauguaagaugagauucaaaacaagacccaaaggaagcaguaaaguaaauaaucaaagguuaugcaauuaggugggugggggaagccggccgaacaaaacaacccuaggacaucauugcuuuguagcccugugcaucauguaguucagguuggcgauuuauggugguauacauguuggggucaggggaccacuucucuccuacuccauggguccugggaauacaacucaguuuuucagguguggcagcaagcaucauuagcaguugaguugucuccuggguccugaucacaacuuuuugugaucauuaaugcaguuuggugauaaaacuuuugucagaaauuugagagauuucaauuuuuaugugacauaagcaauauaguaaaagaucuauauuuuuuuuaggauuuauuuuuauuuguaugcguacaccuuagcugucuccagacacacgagaagagugcaucagauccuauuacacaugguugugagccaccauguugggcgugguugggaauugaacucaggaccucugcaagagcagucagugcgcuuaaccacugagccaucucuccagcccgguuuuuuguuuguuuguuuguuuguuuuuaaauaaguaaagaaaaaaauuuugauuauuccugugguaagucugacccuucucccuuauguuuccuggccucuugaggacauuggaaauaauauuugaaugauuuuucagucaggaauuaaucagagaaacagaacagguaggggauguauauaugauugguaacuacuugguuagcuagauagcauucagagauuuauuaaagggaauuaauugucuuauaagaugguaagggcugccuaaggaagccagucugcaaggcaguuaggaaucaaguucaugagcaagcugaaacugauggccaaaggcuggaguuguucuuccuagacacuuagaaacaaaucgugaagagagaacaauuaucgacucugcuuuugaucagaguuugauuuuugguagcaagaacaagguuucuuuuaggagcucauuugaguaggucaugcucacuaagaaaaaaucaacuuugcuuuaguuaauugauuagggauuuacaucuucaaaaucucaaggcaggacuacauuaguaugugauugaagauacuguuugcaaaagagugggugcugcccuccuuucucuuuuuuuuuuuuuuucggagacaggguuucucuuuauagcccuggcuguccuggaacucacuuuguagaccaggcuggccuugaacucagaaauccaccugccucugccuccggagugcugggauuaaaggagugcaccaccacgcccggcuuccuccuuucuuaaucuauuuagaauagcuaacuagauugucugucucaucagaagccaucaccgguaggaaaguagcacgucuuaguccgaucuuugcuacuguuggcagaagaaagauugcuuuacagcagaacuacuacuggguauuuuagaguaccacagcauccuuguuuaggcugaaaaguagcugaccacggggccucauggaguuugggacuggcuccuuuaggcucccuuagucuccauuucacaggcugucuuugcuugcucgcucucuguagcuaaacuuaggaauuuguuguugauacauagcuagcacccuucaauauguuuuucugcuuucuugagagcuguguacuuaauagauauguucugggcucucuuuacuauuguaggcaagggauuucccaguguuuccuaaguauaaccagaggccauugcuuuccaucuuggaacuuuccaaguucugugacuuuguaguuuaaguugaugccuucugauugcuguauugaggaauuagaugagugauugauaugaaaacacucagacaugugcuacacacaggguagagugggguuuuuuguucuuguuguggaguauuuuguuuguucuuuguuuccuuucucugacacucugggcagagagauccacggaucuaaggucuagcugucuuaacuacuuacuggaucaccccauaaguuguguugccuaguacgguagucacugguuacugagcccuugaaaugugguuagugcuaucugagagucugaguuuauaauuuugcuuaaauuuugaauuuacuuuaaguaguuaugcacggccacuggcuaccauaucaaagagugcagacagagaacauucccaucagcacagaacauucugauagcucuaccuugcaauguugauuugaucuaaaaauuaguguagcauagcuuaccaaccaaaaugccuguguuccagaugaccaggacugaaucuuguaucaggcaaugucuguguuuagugauaaagccuuuaaagaguaauugagguuaaaugagggcauauggauacguccuacucuaguuugacugguuucccuauaaaaggaagguuagcuacagaaucagaugugcacacggaggaggauguaugaaggugaaggaagaacgugagcaucaucugcaagcaaagcaaggggucucacgagaaaccaaacugcugauagaaaacugugagaaaaccaucucugugggaaccacccaguuuaucuauaguauuuuauaugauagucuuagugaguucauauguggccuguaaagaauaggaaacagaaggguagucacggauagccuccuuuuauaaggauuggccagggagaguaaauguugcuucuugucuauauccccauuggucagaacuuaguuucauaauguaguauuuaguuguugcuauuuggcucugugccuagauaaagcuuauggggaacuggcuuuauacuaaaagaaggacuauguggacuuuugggaauaauuaguaucuuacaaaguucuaggaucaccuugucuuuuuagcuaacaauacaagagaaaaugucucuacugguuuucugaaauagucuuguuggccuagcugggcuguggcuucauucagaacuagcuucuauucacuauguaaaaggugaacuagaggaguuuauucccaccugagucucauggaaugguuuccauuacuaacgugacuagaugggaaauggaaagggaaagcauagaaccucaaaacucuauauaucuugagcccuucuaugucaugcuuuuguuacuucccgcuuguuaucauacuuagauuucauagaauccuccuaauuuugucucugccuggcacauuaacuuacccucaucuuucuuuuucccuuuacuaucuuuucucccaauaucucauucaguucucauuuaauaaauggcuacucuuucugaaaugaaggucauuacagaauaaaacugaagcuccuaacuuggucugcaagacuucuacuggcugcuuccauuaucauuuguacccuuuuagcugguccuuaucuuuuugucauucugagcuagaagguucuuaccuuagaaccugcgauuuuguuuuuguauguguguguuggggucuuuuaccuagacuguucuucucuuggcucuugguuuuucugcaucuuuuaaaaauuuuacaauuauuuuaugcaugaguguuuuaccuguaucuuugucaaugcacaccuuccaugccuguuauuuauggaagucagaagaagguguuggaugcacuggaacugaaguuacaggugguugugagcugccaugugggugcugggaauugaauccaugucuucuggaagagcagccaguguucuuaacuccugagccaucuuuccagccccucuugauuuuucuuauccuuuagguuucgagguagcuucuucaacucucucuagguuauugagggagauuggcacaucuacaccuuuacauuuuuaccacuaaguugacuaggaugagaaacagaagucccauauuguuccuucacuaaacuuuagcaauacauauuugaguggguuuuaaagacuauugacacuuuuuaaaaagguguguguguguguuuucucauuuguguuuauguuugccuauguuaugugccuuguuugucgguacugacgacauggauauguguuuguggagguccaggauguauuauuccucgauugcucuccacuggaugaaagcaguucuuacuugaacccagcaguguaguuaguuggcugucuuguuccaggugucuacccagucugccucuuacacauugggauuaccagaugagcugccugccugcugggcuuuaacaugggugauagggacacagcucugucuaucaugcuugcacugcaaaucuucuauccacagagccaucuccucaugugaugcuuuuauaaagugacaaaucagaagugucugugguuucauaugauuaaguguaguauuuuaggcugcuuuaaugauuuagaagauacgguuugucugaauuuuuuucauugauuuguuuauucacuuuacacccuauucacuuugcaucccacacccucuuucuccucccacagcuccuuucuccuuucuuccuccccuucucugaguggguggggcccccugguaucaacccuauccuggcacaucaggucuuuguaggauuagguguauccucucucccugaggccagauagggcagcccagcuggauccauagacaggcagcagauucagggacagcuccugcaccagcaugaagaccaggcugcacagaccagacugcuggguagguccagcucaugcuaggcucuuugguuggugauucacucucugggagccacccccaagguucagauuaauugaugaaauuggauucuaacuugccagaauuaucuuuugcaaugucagaaauauuuuuauguguuugauaggauaugcauucugccauuauguguuacacaaacacaacaugcucuuuuuguuuuguuuuguuuuuucgagacaggguuucucuguauaguccuaccuguccuggaacucacuuuguagaccaggcuagccucgaacucagaaauccgccugccucugccucccgagugcugggaguaaaggcgugcgccaccacgccugguguacacaacaugcuuuuaguuuucaggcucuucaucuucuucacuaaaguuacacagcuuccuaggauaguguguguguguauguguguguguguguuuaauaauucaauuuuauguguauggguguuuuaccugcauuguaugucugcgaggaugucauccccuggaacuacuuacagacaguuaugggcugccaugugugugcugggaauugaauccugguccucugaaaaagcagccagugcucuuuaauagcugagccauuuccaguuccaggucucauuauguuuccuuggcuauccugggauuucccuguguauuagaccagguugggcuugaacucacagaguucuccuugccucugucucuccagugcugagauuaaaguccugcaccauuaugucugccaaguuaggcaguuuucauacagcuuuuaaacauuuguugugaauuguuguaugguucuuauugccaucaugaauuguauuuuccuuuauaucuuuaaauuaguuauugaugaaguaugaacacuauuguuuuuaucuucugcaugacagcugaacuuuuaguuuauucuauugaguuuuaaaacugucauguugagucuaguauauuuuuuuugucuucuuagauuuuuaugccaaguguuuuuccuguucugugccaguuuuaaaaggccacugucagggcuaacacucugucagacucucuccuugucuccccuuacuguauuaaagcuguguccccauuaauuaugaugccaauaucuuuuagcauuauaguauaucguuuucuguaagcucauucaaauuuuaccagaaaugauaagcuuaucaaaaaaguuuuuauaagaaaguugcauuuguaggacuuguuuguaugagauagggucuagucauacugucuagacuagcuucaaacuuggaauccucuucccucggguuuuagugcugggaauaaagguguguguguuaccacagccaauugaaaugcguuuuuaacacauugggcuugauuucagaaguauucuagcuuacguuuugugaagauuauuuauuucacuugacuauccuggaacucacucuguagaccaggguggccucaaacucagaaauucaccugccucugccucccaagugcugagacuaaaggcgugcgccaccaaugcauggcuuggauucaucuuuauaugugcccauuuguauauguuaaagacccacacacaaaauauuuaggggcugguaaaaacugaguacggcaugccugugaucccagugcugaggcuguggagccuggaggaucucacucuagcugagcuccaggcuaaaugagagagcugccuuaaaagacaaggagcugcuucaaguuuaccuauggccugcauauuaauuuacauccauucaaagugugcgcauguacacagguacauucugugaaucuuucuacacagaaaauuuauguacacaaaugaguuucauauguucuuugauaaauugacaaacuaauucugucugguuuucauguaacccaggugugugugugugugugugugugugugugugugugugugugugugucugucugucugucuguuuguggcuugcuguccuggggauuaaaugcauauuaagggccugaguuaaaugccugauuuuguuuguuuguuuagguuuuuuggggaggggaaaggucuuaauacuagcccagauuguuaguucugccucagguuccaggauugauuacaaguguguauguaguagcaugccuuucucauggaguccccuuuuguuagauauuuuuuuuuucuuccuguguaggccugauuucuuuccuucuuucuccuuuuuauagauuucuagcaaaacaaacaaaacuuuuauuaagaagaguugcagccacucguaguguccuuuuacguggucauugguuucaucuagaucagugauuuucaaccuuuuuaaugccgugaccaccuuuaauacaguucuugauguuguguuuagccccggcugugauauuauuuagucgcuaauuaauaacugaaauuuugcuacuguuuuaaaucuuauguaaauaccugauaugcacgauaucugauauacaaccccauugggcucacaacccacaggaugagaacaggauguagauuggcuguggaccuacuuagugcaggauagacagugacuauuuuguaguucucuugacuguugcucuggucucuuuuaaauuuuuuuucaucuuuauuuuaaaguauucuauuuuuucccacuguuaaaauacugaauuuaaagccaauauucaauuaaauauuuaguuuaaaugccaggcaagcacucuuaacacugaagucugcagcccuccuguauauauucagauaaacuguaaaugguuuaaaacucacacaguuacucuucauggaauaaugagacuagaacuucucuaagauuuaaaguggauauguuuccuucuguggagggaauaggacaacauccuucaaagaaaaccuuuuaaaaguuucuaccagaaauaugaaauuguugguagcauucaauuuuauguuguugcaaucuuaaagauauauuaacuuucuuuguuagguuacauaguaaauguugucugaaagaucaaaacaguagaguaaaauagagaauaauaauaauaauuauauaucagguauguuuuuaagcuuuauuuucuaccuuuuccucuacauuuucuuacauguguauaaauaacauuuauagaaucaaaaguuuuguuuugcauaaauggagauguuuaaaaaguaguuccugaugcuucuuauuuaguaucaguuucuauguguguguguaaguguguaaagaggucaggacguuuugugggguccacuuucucagccuuuaugugggccucagccuuuagaucaugcuuacauggccauccagcaccuucaucugcuacugagcaucuuguuagccccaugcucugguuuuuaacucuuacuuuacuauugguggcaacauacauuuuugaaacuguaauauuuggagagaauuccacugacugaucacuucucugcauauuuaguaguaaaucaaaaacauaguuagugcuuauuacuaaguccuaagcagaguuuugauugcuuuauguauauuccauaaugguagggcucaucacuccauuuuauaguugaaaaacaaguuaagacauggaagugauuuucuugagguuagaguaaaugguagaauugguauauguacaguauccacuaaaacugacuuucuuaaaugcuuuugcucuacugccuccuuccugugaauugcuuaaaaaauggguuuuguauaaauuacagaauccagcaaauuaaucucucaucugggucuuuuagaucccuaaggauggcuuuagucuacuguagguguaagaacuacucccuaccagacuuugagugucuuguccauuguguucuguucuuucauccuguugguuuccuaaccuccaucuugagaauauucauguaacugaucuugaugcuugauguauagauugugaaggugaucaguaaaucagauucuucucuuuacacuuuuguuaaauaucguauaaaaauaccacuguguagauaacuugguauuguacguucucaaaauguaaagugggaagaauggccauucugccagguaaauaugacaugguggcugaaccuuucagacccucuaacaaaagcuuuguuaaauguucuuaaaaguaauaacugauuguaaaugaaaccuugugaacuuaguguuucuauaaauuguuaaaguugaaagguaaagaauuuuagagagccuugugaaaaauaguuauuuaagguauuuggcuauuuaaaauguuuuuauuauguuuacuuguguauguuugccauggcacacauauggaauuuagggacaacuuggaggacuuguggguccugggaauugaacuugggccaccaggcuuaaguggcaagcacuuuuauccucugagccauauuaugugccuuugacuaaacuuuuaaaacauuuauuuagaacucucuuuauuucucuuaaguaaaugggcaauguuaagguuugugugccuuaaugaaauacuaggguccuccgguccuccuguccuccuguccucaguacuguaacaguuuaguuguuagguuugaguuaugucugucugucugucugccucccugccuaucuauccugcuuugcuuacauguguaucugugcaccauuagugugcugguguccauggaggcgggaagaggacagcagaucccuugaaacuggaccuagaaaagcugugagcugccaugugguuguagggaaggaauuggaccuagauccucuggaaaaagcuagagcucuuaaccacugaggcucccacagaagaagaguggucauauucuaauaccuguaaaaucugaguacuuuacagauacuguacuuaauguuguguuugauuuugaagucaucuuugcacuuuguuuccuagcauuaugucuccuggauuuauaauuugaaauugagcuaucuuauuuuagaguccuucuuugguacuuccugauuugaggcagauuauuuaaucuuguuuucuucauguucaaucuaaugaauuuuuuuuauuuuuaacaggaucucuuuaaauuggaguuuuuuaacuauucagcuuaggauccuuuuucuguugaagacuuccauauccaucugcauacauagguauauaaaauagguguacauacagauaaaacauguauugauuccuuugcugaauaugugugugugugugucuauauauauauacacacauauauguguauauauacaauuuaucauauuuguaaagaugaaggcuaauuuaaauacuaguaggguggaucugcuuauucauuuuuacaaaagggguugaaucuugauugaauauuugauauugcaggacaugguauuuucaauauuuuaaagauuucacugaugcauugauuuuuauagucaucagugcuggaaagcugcuuuguauaaacgaagaacacagaauagcaaaaaugugucuagggccaccucagaaaucuuugaaaauucuguucuaauccagagucaaaaucauuaauauuuuuauaugauacccauaggcaacucagacagcaauuuaaaaaaucaaauauuauauugcaguacuaucugaaaaauauuaauucaauauaugaugaagaaugauaguaggaaaauauugcaagucuuuauuuucuauauuuaaguauauuuuuauaaguucagaaaacuguauguacaguaaaaacgcuuuaauccaaaacauauaugauaguuuugagucauuguugcuuuaaguuuuauguuauauucagaaucaaggacuguagugaaguuacauaggcaacgugguugaaagcugucagaaacacauuaaauucauucugaauuugcuuuagaauuuuuguugugcguuuagaagcuuguucuuuugagacagcaucuuuaccauauaacuggcugacuuggaauuggcucuguagaccaaauuuaacaaagcuguacuggauugccaccuaagugguaguauuagcaguaccaccuugccuauuuuuuuccuuguuguuuucuuuuuccaaacuuuugauuauuucagaaacuacuuaguauugccuuuuuuuuccuuuucuuuucuuuuuuuuuuucucucucuaaagaaugaagauacuuuacauagaugacuuaauauaugguuuuuuuuuguuuguuuguuuguuuguuuguuuugguuuuuugaaacaggguuuuucuguguaacccuggcuguccuggaacucacuguaaaucaggcuggccuuaaacucagaaaucugccugccucugccuucugaguacugggauuaaaggcgugugccaucacuguccagccuuaauauauaguuuuacauguuacuugcuaacucauuuucaacuuaaucugaaguuuggauuaaauuuuuuuuggucaggaacaauucguuuuaccuuuuuaagguugcggucaacuauuuccuuaccucagcccucaguaauuaugucaagcaauuacagaaauuuccauuugagagaaguugccauauaacauuugagaaacuauaguugauucaaauguuuuguuuguuuauguguauauggugugugagugcauuccugccugccgugguguggguguagauguuagaagauaacuuuugagaaguugguucucccggucuguggauuacagagauaaagugcaagucugauguccugcccagcaaaucaucuuaccagagccaaugaguaaauuuuauuuuuacucuaauuuuuuuaagacauauuuuaucuagguguguguguucauguccacagaggaggcuuggagaagggugucagguccccuggagcuggaguuccagggguuugccaaggacccagugugggcccaugauuaagcaguaaacacuuguagccacuagccaucuuucuagcuccuaauuaaaaacaaaaaaguuacuaucuaccauccuuucuuuuucuuugaucagccaggaaagaaaaaguccugugugagaauuagcuuuuguaacugcuguccucuccuuggauagaugaagggcuacauggaaagcuugaguuaugauuaauaaagugcacaguuauugcaucauauucuuagccaccuaugaaguuauaacuaucuuauugauaauugaugaaaauuuucuuugaaauuaguagacuuacauaaaugaucuaacauuuuuuauacuuccuuucucacaguguugauuaaugauaguagucuugguuacucuuuuguuccugugaagagauaccaugaccaaggcaacucuuauaaaagaacacauuuaauugugggcuugcuuagaguuucaaagguuugguccaucaucagagcagggagcguggcagcaugcaugcauggcguggagcaauaguugaaagcuacauccuccuaauggagacuggcuacuucuccaauagaucaauagguuuguuucuuagcauuuacauggucugguauucuugagcuuguguauggacauacaugcaggcaaaaaacucacacacuuaagagucauuuucuuaaaaauauagaccagugguuuagaagacugaucauugagaaguugcauacugaugggaaacacuaaagcugaguuuucucccugugacagcucuguagugaucccucaaagggguaaugccucuuuguaguuucuagcccaggccuagagacaauuuaauguaauauguuucuuaauacauuguaguaggaguuugaaaagaagaguaucaagucucguuauugaaguaauugcuugcaggucagccauucaaaguuuguuaagauagauuaggcuagaauuagcauaaugauaauguaucuugacaucauacuauugaacaauaucagggaaccuagaccagcaaagaaucaggggaagagagcuagugacagcgaaaggagucucuaagcaucugggauuguuuuauaucucacuucuucaugccucuggcuuuuaagauuuuuucccuuagaauuucaguguauauucccaggucacuuccaacuuauguauguggguaaggaaguguguguauguguaugugugucugauuuuucuucguuagugguugcuuuagagaagggaauaguuaaguacauugcuagcuagaauaaaaguacuauaccaucaguugauuuagacuuuuaaaaacccaaaacaggggcuggaaagaugguucagugguuaagagcacugauuuccagagguccugaguucaauuccuagcaaccacaugguagcuuacaaccaucuguaauggaaugcccucuucuagugugucugaagacagcuacagaauacucacauacauaaaaaaaaucaaaaucaaauaaaaugaaagauugaaauaauuucucuugugccuguaauuuuuuauaugaaaaucuugcacagugcuaauaaauuugaaaaguggauggaacuuaaaaauagaaaauauuuugucaguuuuaaauauacauagauccuauuaugugacuacuagaaaaauaaugaauucaugguguaacuacuugucaugaggagagguaacaaauaccaagugucacacagacacagcuauuacuucagaugugcugggggcaccaguugaauucuuugcuuugcuuacuaugucgcuuaaguuuauauaagacugcuuaaaucauauucuguauacgggauacaucaaguuuagaauauaugauauuuaaauauaauacuucucuucugugcuguucuaaguugaauuuuauguuuuauuuaguaguuagauuugggaagaauagaaaaggacuguaaugagaaaaaaaugacuauauuagacagaugguaaacuuggccaggaaucauguagauggaguucauguagauuaugaauuuauaaaguacacuuuaaaaaaaaaucauuguuuaucuagugugcagucuagaucuuaaaaccugguaaguacucaguaaguguauaaaugaaugcucaaacuguuaaugaugaucuuuaaaaagaaaguuacuggcuuuaggccaguaaggcuuagauaguaaagcccagcuucuaacaaacaaacauaacaaaaauuacuuugguuuugggguuuuuauauaagccugagaaaaauuuuauuuagacaauaaaauuaagucuuuuaagauauuuaauauagagagaccauagugucguauuuagaacauacugucaaauauaggauauauguuagaaaacggguagaaguuacauagugcuccguggucaagcucuuucaguacuaggacuaguagugauaccaugcacucuggggggcugggggugugugugugauuaaaaacaggaguaucaacaauuucccagccauuuaacauuuuguaugacagccuguaugccagugcuguacaagacugucucaaaaauacuaaaacagaaacagaagacucuuuaauguugcccauucuuccucuuaguauauaugcaugggaagauuacuuuaaaauuucuccuuugcaaauagaugcuuuggcuguguauggugguagaugccaguaagcccagcaauaauaagaugaacucuagauugagcuacuguucucuguuauccuggacuacauagugaggcucucuaaaaacaaacaaaaaucuccacaguaaauagaaaguaaaucacaagacauaaguuaaugcauuuaaucauauuuuacuuaauaagaauauacucaaauguucaugaagguucuggaauuuuaguauuauugaauucuuucaaagauaucuauuuauucacagucaauuucaaguaaagaaagccccagcaccaaaccuuggaugcaauuugcauuuuaacaguagauuacauuuuucagaccagauuauuuuaucccauucuucuguucuccaaaugcguacauuuugauacacuucgcauuguagcacuuuaaacuaauuaauugaaauuaauauagcaagaauuuauauauauauauauauauauauauauauaaagggaagaaguuaaacauaagguguagcuucugagccuuuaguauaagccaagauacuuucgugaauaaugcugauuucagaucuaagauuugucauagauuuguguuaguaauauuuuguacuuguagagaaacaauaucacuaucuaguuauauaauacugaaacauuuuuauacauaugucucuuuagaaaguuacuauaugguuuauucugacauauacagagaauauauacugaaggcuguuaaauauaguguuugagauguuacggauaauauaaauaccuuucaguaguggacugaaauauguugcaaugcugauuuuauuggaaauuagaacaguugucaaaaauagauuuuacaugugcaaguuggaacauauguuguagacuauuucuuuuaaacagguuguuccacauacaguuugcauacacaguccgguaugguuuggagaacuggggccaaaauacuccuagucccuuauauaaaauguauauagguguauaacuuuugugcagcuuccuauacuuguuuuaaaagguuaagagcaguuucaguaggaaaaugaaugugacugauugcuaacuugaacaguuuagcuguagaagaaagauaugaagguucuguugaugucuuucaagauuucaacacuauuaucuacaucuuucuccagaccuagaaauaaacagcuaccugugauucagcaaguguugauucuucuccuuuccauggacaaacucuugauggucccucagauaauuccuuccaaucagauuuaacucuucgccccugccccacccccuccugcuuacuuaagucaucuuuagauuacuuagauacauauaguauguguguuauguaaaugguugcauaguugccguuuuuugucauuucuguuuuggaguggauggaauccauaaguguagaaccuguagaaacagggacagcuaugcauagcacguuuccauuuguguaaaaauagucuuacacuacuaagguguguauggaaaauguuauaaacucaauugguuacaccucuuaaggaggauaagagguuuccuuuugucugcuuuuuaagucuauuucguggugcugacacagcucagagucuuacauaugcacggucaguguccuaccauugagcugcaucuucagucuugugauguauucuguuguauguuuguuaguguuuucaaugcuuauauauuacuuuauauggaaagacuauagcuaguagaagauaaaauaacuuaaagguaauuaaaaguaucacugugauaaauuagacauauauuuauacucuugucauuuuaugacauaaccagauuaggacagauauggaguaaaacauaauacacugacauaguuuucuuucaaaaaaaucuguauuuuguaaccauuuucacuaaauuauuuuuuaagucuuuauggucuuucacuuaugcuugauuaggcuauucucuagcugguauuuuuguauaugucucuaaacugacauauacaauguaguugauaauguacaacauuaucugauaauauaggggcaaaauucaaauacguuuugagaaaugaauuuuuuucuuaguauguuuuucuguggauuguaucuuuacagaguaccucuuuuguuugaaaauguggauuuugaaaucucaccagguuugcuugccaccaccaaaaauaaacaaacaaauaaaauuuagggaacaccucaauauucaaaaugguguucuggcuaauuaacacauuugugcauacucucugccuuagcugcuguuuuuuaguuuucuuguuaaggaaaccaauucugagccuagaugcuaguaaacuuuuggcuguauacuccuuuuuaaugugaaacuuuacagaacauuugaauuuuauuuuaguaaauauuuuaaacauaaauaauucuguaaauuauuuuuauauauuaaaauauaguuguuuguauugucauguuaauuacuuuaauaucuuuuccauuaggggggaauggucuuuuuucauugaaaucuuucugaacaacugacaugggauauuuuuuccccuaaaaaauaaaguugaacugaagaaugaugaaucuuaaggcugauguguaugcauauccuuucauaguauuuugcuuguuuuaacauuaaguuuauauuagcaagauggcuuagaaaggaaaguuaauggaaaauaaauauuuugauguauaacaaaauauuacagaacauuuggaauguguucucuucauccugaauuuuguacaguugguuuucucccucuaucuuuaugugguuucagacuuagguuuguauagcuuuuacccacugaacuaucuugcuagcccugagugaguauuugguuugaguuuuggaggaaccuauuuguuuuugaauaagacauuugagaagccuuuaagaaaugagaaugaauguucuaaccauugaguccuugaguuuaaacauaucugauagugaaguucugaggguaagaaaguuugaucuuuaguuugaagaugaaguuuauuugaagcuuaaagauugcuuaaagaaagcuuaaaguugaccuugaagguaggagguaaugaaauucagauugcugguuuuacuuugugcugcguuccaacggggagauguuuuggagaagcugccaaguaacuuugccacacauaaaugcggacaccgcaugugggccaagggcagcagcauuuaugauacuacuuguuugccacuagcuucacuuagucccacaguucuagauuaaaugugguuuuguuucuuauguaauucugugcccagccuggggcauuguuuccuuauugauaaaauguaaauaauauuaucugcagaaaggcuucaguagcugauucugagaguaauauccagaaccagcugccuugauucaccaguuuuaguuccucagccaagucaguuuagcuaggaauaauuggucaagcagcuuguauucuaugcccugcuuuccacaucuuuaaagugguaugauaauagcacuuuaagacaguggaaauugugugaguuaauagacacaaagacauuucaguggcauauaguaaacccacuguacuuaacuaguguaaguuacugucacauaguuggcuuauuaugagggcaaaauaacauguuucuguuguuuuuuaaaucacaagacgaaacucaugugugaccugccacaguaaaggugucucuuauaccauagauacuuuaccucacuucaucucuuauagacuuguuaggaagaaacccgauauuggcuaccccuaacauacuuucugauaugcagugauuacgccagaugcuuuacaauauuuauauuaauagggaagcuacauuguugugauuaaugaaguuaaaggcauuaccagaaaaaagaauauacacugcaguauuuaguagauguuaauuuuguacuaacaggauuuugcaaacagaugaguuuauaggaaagcaguuuacuauuuaaaaagucugcauuaagauaauucuuacacucuuuaagucagguacgauaguuagguauaugguauacuauauagucuauuugcuuggugccccaaauuccuaacuuagcauuaucaugccuccuuugcaucuuuaauacagcaguuaaucucaguguaagacuuuacaaaggauaaauugcuguguaacccacuuggaccucuuuuguucaaucaggaagccaacauguuaaguagcuuaaaaauaaaaacacauacauauucuuguaggaaaauugggauuuuauaauuugcaaugguaaaaugugagcuuuuuaccuaugaaaaugauuugacagaaguuugcuucagaauagagcuucugugucuuuaaagacuacggccugagucacccccugcucuuuugguagaugccuggcuggcgaacagcuacgcugcuuuaggcauggaauagaacauuccauuuccuguucccuugcugacacagaggaguguuccugcuggcaaugaucuaaucauagugcaguaagaaacauggcaguuugauaaaacaugguggagacagcggcugaaauggaagcauaugugcuagaagacauucuugagguaggguuaggucuguaaaugaaaugaaaguugaaauuugaacaaagaaaucuuaucugcuagaauuguuucacagaugaauagauuagggagcagagagaagcagagcauaaaaagcaagauccggacagaccuuauuuccugugaggaugugucaaucugcuucacaugauuauuaaacugucuaaacaucagguuuuauaaauuguagauguguuugguagaaaaaagagagagaggguuuggacuuaauuaaaagccuugugcugguggugaccuuuagauuaacucauuagaagguggggucugcaaagcagcuugaaguagguuuaguaucauaugucuuaggauucauuuacauaucuaagccuaaagcugugcuugcaauucuuauaaaaacuguugguuauuuuagccugguaauauaauugcuuaauuuaagugguacacucugauccuacauuuuccaugugacuuuauuguaaaauaaauuaggaauuuaauuuaaaaccccuaaaauuugaguugugaugcuagaaugcauauuaaaaucuacucugacuuaagaccaugaguauuucaaauuauacauuuuuuucuuauuacauuaguuuuaaaugacacuauuugaauagaaagcaguccaaggaaaugggugccaaagugcaacuguaauugauuauggucuugguuguagcaugcuagcaaaaacuguauuuacguaaaucccauauccuuaucugugaggaugcaggguuguuauuguggugggcacuguuuuuucuuucuccucuuuaagaaaaggaauaaaaagccuggcuauucagauaucgaggcuuuauggugguguaagaauaauuguuaccauuucacugucuucaaaagagagauuucauuguggggaaagggcuugggagcugcugcaaagggaaacuaggcggggccaagaggagaaaaaaaagccuaugcgcauuauaaagugcugcaugaucaaugagcauuuucuggagucuuucagugugugccuggagcugacauugcagcaagucucaggguucugcagagugaaaacugauuccauuguauuacuaccuccuugcagacaccugccaaccgcccccccccccaaaccuuauuguguaaguugaauugugugguuaauuuccauucucuccccuacuuggccccuagcuuugacccuauuaguuaguuuccuuuaaaaugcugugaaauuauuuacugugaaacagugguauacagguucaguaauuacaggcggucacgugacuucuuuggcaauccaguuuaaacagaccuaauuugauuuuaaagggcugguggugcuuuuuaauuuguucuuuaaaagauuugcuuguauuuuauagaaaugugauucauggaguuuugauaaaccuauuuaacaguuuucuuagaacauuuaagauuauaaaauauuuuagaagucuucauuuucuuaaggaaaaaauacuugauaagaguuuuauacuuuacagauccuuuccuacuggcauagcaguugcuuauaauuauuuccauuaaaugccagguuuagaugcugcaucauauauuuauucauuauuaucuguuauuaaagucacuguaauuuuguuuaucuuaauuucccaccuauuuuaauuugguuucuuuauaccuguugcauuaaacucuacagaguagguuucuguuuaaaauacuacaauuuaauuuaguuggcagaauagaugugaaaauuugcaaguaacaagaggauuaccuuucaaaagcgaaaguauuuagaacaguacaaggccagaauaaauaggcaaagaauauauuuucuaacucugaauugcaccauuuucaaaagugucuuaauaguguaaguaaguauacagaucuuauauaaugagcuuuccagagaacuaaccuuuggcuccccccccccuuuuuuuuuuuaagagcuuacuuauuauaaauguccaugauggauaaugaaguguaucugucuagcagugccauucuuauuguauauaacauuaagccaguaacuuuaagugugcuauuguauuuuugccuuuaccauuuuaaauuuauuaaaaauacagauauuuaaauauuuagauauuuaaauuuauauuaaauaaauaucaacuuuuuuccugguuuguaacuugacucuuuaaaucauauaacuuuuaaagguucucuuauuaaaucuuagaaaaaagagaacuuaaaaccagaaauacagauguauccauaguacuguggcucuguuuuuaaauuuaauuuuuaaacuuuuuugugauuuacuuuuaaaccacacuuuuaacaucuuaaacauuuuaaauacaaucacaaguauauguauauauauauacacauaaacaugaagaauaguugacauuuuaaaucuuuaagaucuugaaugaaauaaauuucugaaauuuaaaauaaaacuaaaagggauuuguuauagauuauaugauugcuuuuucaacuguccaguuuggugaacaagaauaauuugguuaacuaaucgguauuuaucuuuccaaacuaaaguugucaaaaugguucuguucugcuaaacuucuauaaaaggaacuaauaaugcucaagauaauagaaaauuauuagaaauaggauaggcuuucauccaguguauaaauacuuugguuaaucuaauauuuguuguuuuguauagacgugguucuaauuucagaaugucaugguuuuccugucagugauacgcaguagccugucucagaauccucagaagaucaauggguagaaaauaccucaauguuaugaggcagagaagccugauuuggagugacugagagcuguguguuuguagaaacuugaggacuauguauagguuuuguaaacaacuugaaauucaggaaauuauucaucuuuuaauuaaauuccaaauccuuuaaacuauauucuuugguuuuauuuauaaauaauauucuuugguuuuauuuauaaauaaauuucugaaagcaagaauauugaguauaauucucaugcucagucuuguaucucuuugucaguuaaagcuaggauuauugauucauguuugauguuauaggucacaguauuuacaagguaaaagguccgucuccauguucauggcuuaagcaguugacugcacuccuuuaaguugaagcugaaauaauaaguauaauauugaaauuaaguaaacacauuuaucauauaaccccauuguauuauauacucuuacuugauaugcaugggguuuuguugguuuguuuguuuuuuuuaaaguaagauugaaaaagccauaaagcaguuauuuauuuuucauuugucaagagguggggcaaaugauaaaucauucuauguguaguucaaguagggaaucucuguguaaaugacuguuuuuggaagugguucuaagucucccaugcaaguagucucuccucaguuacuggcuauauuucuuuuuauauuauaaaacauagcaacacauuuaacacauauucuacuaggaagaacuggauggaguaacccuuaggucacaaauauaagugcuguaaauaagcuuaaguauguaaauuguuucaguugauccguaauuucaauucagaaagguuucauaauuaaaaugaaauauguugggugaguaaauaucaugcugauucauuucugguuuuguaaaguacauguagugugagcagaugaauacuagaaauucaguaguuaacccagauuauuuuguuucacaagguuaaaauuuaagaguacagaggaagaaauuuuugccauuaaagucuaaaauugagaaccuaugucgauccauguuuguuuacuaacauuuacugucuaaauaauuugaggucuauuuuuagaaguaucuuuagaaagcugaaauuuuucauuaauuugauuacucuuuaccuguacuugcucacagcugccuggguaagagacauuugucuaacuguggaagaguccugggucgcuuugaacucaagaguucucucgugccucuaguguagcugcaucuucuaaacguaccaccaccauucuugcuuaaauugguauucuaaauuuuuuauuguuuggauuucauuguaacauuuucauagguugccuuuuuauguguauauguauuuauguauauuugugaggggcugccaaguaucacuuuuaacacuuaaaacuauguacauauaauacauacaugcuuaaauauaaugcacacacauguucuuuuggcuauaauuuuugauauaaaccuguuauuagccuaguuuauuuuggaauaguaagcagaaguugccacauuacuuucauaccaacuuugggagugcaaaaagaccucuaaaagcuaaguuuaugguaguaauuccauuaucauuuuagaaacauuuuaauggcuuauagagguccaaacuguuuacacaaagguagaaauaaauacaauuacuuccacaggagaauaucaguuucagaugaggcuaugcagugagcuucuaaucucacauugauuguuguaaucuaguggucagugcauuguguggaucauggcguagaaugaucugugugauccaguauuugcaugcaugcaacaaccuugagaucuuucucauucugcauuguugggaaauucacugaagagcucaguuugguaggaaguaaacuugauuguuaguuggugagcaucagaguucugcuuuauuacucguuuaagugugaaggccugugagaugacuuuugguuucaugagugauuggauuaauauugacuauuaauaacuaguuuacagaugaagucggacuuucaguaauugguuaggaguuauaaauaguuuguuuacauuaguuaccacuaaugaugaacuauauuagcuauuuguugaauauguaaguuauuaucaaagggggaauaauaugccaaguacugcauaagauguuuauugcucuagugaaucuaaacaguucuaugagggaccgacuucauaaaaggaauaaugaaguaaccuauauaaacauugaucacaguaacauacauagucaacaauuaauucuuagacuugcuuuuaaaguagcaguaacauuaugugucauguuuaugcuaugauccauuugacagaugaaaaguugaucuugagagcuuauuuaaauaaucuuuguagccuuaacauucaaaguacuuaaaaguuaagggcgcaaaagaguuuuugauuaugaguuaugucuaucaauauuuguaguauuagcaauaucaguauuucuaauauugaaaguuaaaaugccuaaaacuuacauuugcauguuuauuuaaauacuauauuuauuggcauauauauauuuaaguuauuuuucagaaaaacuaaaacguguuuaguguugcuuuauauuucugcagauuuuuuuuaagucugccuuaauagaaguaacuaaaguaucaucugcuuguauauucacuguauaauaaauuguuuugguaaagucucaagaaauugaagugagcagugauacagguuuggaaaaaguguuaauaacucagauaauuguagguauucuucuuaaugccucucacaacuuguacaggugggaguuucuuuuuaaaugugcaugcacuuauguguauguguuuguauguuuggacccucgaauaaggaugaggagacuguagacaacuuacaaggagucugcucuuccuauauuuggguucuagggauaaaagcuagguugucaacaagaacugguaguuucuuaaacauggaaucugauaaauuauucuuguauuuuauguuauuauaaacuucuguacuuugaauaugucaaaaacauuuuuauaacauacuaauuauuugugggguuuuguugguaggcugagaugucucagccuucaaaggcaaaugaauggcuaccaaaccucacaaucugaauuuggucccuaggaccuacuugguggaaagagauaaucgacucccacaaguucucuaaccucuucaccaguauuccauagcaugcacacacaggugcaugcgcgcgaggugcgcgcgcacacacacacacacacacacacacacacguuauguaccuaacauagaaauguaauuaauuuaaagaaucauauuguauaauguuaucaguacugucuaaacauugaaaacuuggccaugcuguguuaugguacaguaucugauguuuuccagaaucugcuucuuccgggaagccugaauuuaauaguuaacagcauauacugugaacagucuuucuugaaaugacauucucggcuucauucauuuuugagagaaugucuaccaacugaaucugaauaaaaauuucuuuaaaaaauggcaucucauguuuuguucuggucacauccucagguuuuucuugagguagcuaucauacacauuuaagcagaaaugccuucaaauuuacuauauagaauuuuuuaaaaaugguauacucaugguuaaagauugauaaguugcuggggcauaauggcagaacgccuacaauccuugcugaaauguccaagauucugugagcucuaggauaggauaagauagccacaggguucuggccagccuggacuuccaagagaaaccuugacuaaguaaacagaugggggggggggggcagggaggaaggaggaaggauggaaacaaaauaggugaacguuuuuuacuguuuugcaaaagaaaccgacauuauacuucuuugcccucacaucuacauugauaguaggaaaucuacuacuauaguaggaaaaauacuacuaucuaguauagauuuguauguagaguggucuucauuuguagaauccagcaguuuuaugauccauuacuuuuuuaguguaugaucuguaugaugaauaagcaaauaacaugccaggguuuauguugugcuuagagucaacugagagcggcggggggugggguggggaugauugguugguugguugguuacaggcucauaucagcaugccagggcuucuguacugcuuggagucugcugcugugcuuugugugcacuguacaagaagacugcuaccugagaccaucuccuaaaaguaauugugaccuuacaauacuucuugagagagucuuggguaucugaagagguagauaaccuacuuuacugaaguuaggucccagugaugacauuugaauaacuauuauuuauauuuuagacuuagguaagcuucauucuaauguauuuugucauuuuauugaauuuauuaauucaccgcggucuaaauuugaguccugucuuuguuacucaggauucuuggaaguaaggcaucugagggcuuaaaguagugauugguuacuuuucuuuuaggaguuucuagauuauuauguguauuuuugagugccugcaugcauauauguacaugaugugugccucgugccuauggaguuucugaagagggugucagauccccgggacuaguaacacaugguugugacuagcuaccaugaggcugucaggaacugacgcugauucucuagaauagaaagugcucagaacugcugggcugucacucaagcaccuaggaacugauuuuguuguaaaacaguauuaaauaccaguuauguuagagauauuuagaaacagaaaugauuuuauaaauccuagcagauaccauuuuucuuuaaucuacauaauuagggauuacuuguaaguugucugaucacauggucugggaagugagaguacaagagugcagugguggcacaagccuuuaaccccagcauuuaggaggcaagggagguggaucucuggguuuagggaaaaccagaacuacacagagaaacugucuuggaauaccaaagagagagucagaagacagagacaugaaacauuuauuucaaguuuaaaccauuuucuuuuucuuuccuucuuccuuuuuugggguguguggggugauccuuuauuaagccagguaaagagagaagguggcagaauuugcauuaaggcagaaacagcucugaacaauuuucaccuugaaggcuguagauuucuuuuugucuuugugugcugacaugaaugcugcuuugguuuucauucacuccccaggcuuuuuaguuuuuugguuuuguuuuuuugguuuuuuuuuuuuuguuuuguuuuguuuuguuuuuuaacucagagacuacuuugaaaauggcuggcaaaaugacuuuguggguaaauugccacaaagucuaaguaccaggauucaguucccagaaccacacggugaaaaagaaagaaccaguuccugcaccuccauauuuauauugugguaaugaguguguguguguguguguguguguguguguguguguguguaaaccaguuccugcaccuccauauuuauauugugguaaugaguguguguguguguguguguaaacacuaagccagggcagaaagugcuuguuacacaagccugagugccugaguuuggaucuguagcaccuaagggaaaucugugggcaaaguggauuccagcaauagaaggcaaaaagaacaggauccuuggggcucuuugcuaacuagccagggcaguaggugaagaggaccauuuucucacacacaggacaguguguguguguguguguguguuguuguaguaguuguuguuguugggauuggggggacagcaaagcuucaaacucaguuuggcucaauaaacacaguaugguauuggauaaaucuaacuugucuuuacagucuuuggucugucaccucaccaauguagucaacgugcuacugauagacacgucaaaguccuaccuuaagcugaucuuccccuugaauuuuucugucuaacuuccuuuuguucauuuccuucuccuaccuuuuuuauucugaaaaaguaaugaaacacuuuacauuuaagauacuuuauaguuuguguuacaucucugauuaaaugguaauagacauggggauuuugacuccuagauuuaaaaaguaguuugcauauguuuuacauguauuuauguaaagcauuauuauacuuaugugauauaauuagacaaaaauaauuuaaaguaauuuauagagcauauacuccauaaaaacuaaaaauaaaaccaguaugaauaagauaagauuagggcuaagggcacagcucagaaguguauaugcaauaagcguuuuucauguuaacugacaaccaguucuaaauguggaauuggaugaauuuugauacgugcauaguugauagcuucuugguacaugagacaaucuggugaacucauauuucucccaaacuuagaucugaggaaacauuuuauccuuugaccucaauaauggaaauauacagcaccaagcuucauuuguuucuauagaguauuagccaaagauuuauuaacaaaaugaauuuggucaaaaaauaaugaagcacucaguuaucauauguucugauuuguuucaggcuaguauuuagaacuucuggaguagaggcugcaaauugguacgguugugguaugcuuuugacccuugaggugaacagagugcacacacugcauuuucuugaacuucucucugcauuggugugcagucuucacaguuagcacuuuaccuugcaaauaguuuggugaauuuuacaaguaucuuaucuguuuaauguuguagaugcuaauucuuauuuaaaaauuaaauucguguguucauuuuauuaugugugugguguguggcagcucacaugugccauugugcacaugcagaggucagaggacagcucuugggaguuaguucuguucugucaaguuaugacgcagaucuuuagguuuggugcaggugucuuugucugcuaagccauucugcuggcuugauaauuguuauuuucuaauuguuugcugcugcuucguguauaagaacacaguacauauucaccuuguagcuuguaagguagcuaaacagcucucucuauaucucuauaucuauauaucuacauauauagauauauaucuacauauauagauauauauuuggaauuucuguauuauuuuugguguucuuucaucuuauaagaaauuguauguuuagucuuaaauaguugaguugacaguugcuagggaugguggucguguuuguguucaucuuuguuugcuucccugacaguaggcuaacacaugcaucugcugucgagccccgcuuuauagggccucaugauugacuagcuuucuaacuuccccacacccacccuugcacuuccaguacuggccguuuguucucuugcuuccuuugcaccaacauugguucacauuucaucuuacugauauuguuucaucuuguauuuuauagauuuuugccaaucauugucuguguucucauguuauauuuaauuuaguuuuguuuccuaguuuauggcgaaaccuuucuguuuucuuuuuauuagccuucaugagcuauacauuuucuucuauggacugcuuuauguauauaucacaucuuuugauacauuuuuugggucaauuuucagguuucaguguuuuuagcguucucuuaacgcuucauuuuugauucauuuugucuuguucaguugauuucauuguacaauuaagcucuucugccuaacaguggggcauuuguuucuauauaaugucuauauaauguuuauaugcuguuugggggaagaauuugagaauauaauuauauagaucauuuuuggucauauggucaaauuggaaaacuuacuuggaaaaguugugugagcuguuuaaaguugauuguuacauuucugaauauguuagaauauuauggguuuccaauuuaauuauauguaaucaaaaauacacuuagaguucauuuuauuuaaaucuguugaaauuuguauggaccauuucggugaauguuugacagguacuuuaaagaauguauuaauuguuaauguguaccauaaaugugaggcagauuagauuaacuaaugaugcguagaucuuuuacauccuuauggauuuucugucuacuuguucugucgcugaaagacaugcuagaauuacaauucaauuauaauaauagagagguucauucuuuuucugucagcuuuuacuuuguguauuuuggagcuucacccugacauauuugcaaauuugggaccauuuugucuuccugucaaaaugauccuuuuaauguuacuguagcuuucucuuuaguuuuguuaauguugucuugaaguauacuguuacuaauuuuucugugagagaugcucauguguaauaucuucuuuauguaaaggauauuuccuuggagugguuugccauguagauaauucuugcuuuuuucuuuuuaaaucagucuguauguuuuagcugguauuuaguucaucucucuuauguaauuauaacuuuuguuuucuuuuuuugucucauuugucauuacuccuuuguuucaugccuuuuuuguguguaauuuuaugcauucaaauuuuaauugacaagucaaaugcauauuuauauuuuagaauaugcuucaaaauauaauuuaacauuaaaauauuuuaauauuuuauuauuaaauauuauguuucuguuuccauguucucaugauaguuucuguauuuuuaaagguuaaguagaguauguccauuuuuuuuaucaauucgucccucuguggaugcuuuguuugaagaguacaaucucuuugaaguaaagaaaauacagauuuauuucucuagagugggguuggugaaucaugguaauucuguuuuuaguauuuugaggaauuucaauacuauuuauauuaauggcuuaauauacauuucuuauaguaucauaucaguauucuuuauucuacacauucuugcaaaccuucauugccacuugucauaauuuuuugguuuugagauaccaguuuacuaauguaguccuuccugacuucagauucacagugcuccugccucccagguucugucauuaaagcaugcauuaccuugcuugacucgguuguuuuaauaauugucauugaagcagguauaaggcauaucucaugaugauuuccaguaacuucuuagagguguacugacuucucuguguauuuguuggcugucaguuuucuuuaaaaaaaaaaaagucuggcagaaugucuaaaugcuuuuuguucaagauacuauuuuaaucuuuauauaauaaacuucaugguuuaauuauuauccuuuaucuguccaucauugauuuuugucuugaccuuacauuauuauuacuauucuuauguugaaagcaugucccaagaugauuaaauuggaaucucuugaggggguggagaagaagaaaagcaaaucucagugucccucaucucugguaaugugagaaugauuggaaauagaaauuguacguagacauugccaugucuacaguuuccucaaggaguauuucauggucugucacaguaggcaucuucaguauuuaaagaauucagacaaagguguccuucacuaagucuuuucaguagucaucucuguaaaauacaguucucaugaaauguguuuacuaauaguacaagcauaucacuguuacaagaacaauucauaauuuauauugucuaguuuuguaaaagacaguaaauucauacauuuuauugcaacacugagacacuacacaaagaagcugugaaucuguucucagagacuuuuuagugcauuaaaaacaaacaaacauggaaaugguuuagcaucuccaaccaaaggccuuggcaaaguuaaguguccuuagugaaauuagguacguuaaacaagcugccuuccagguuuccugugcuguuuuuggcuugaacuacagccagaaaucagaugaaguuccuacauucaugagguuuaugagguuuauauuuuauuuggcaagacugacaauaugcagcuaguuaagugaaugcccuuuuacauaugaauaauauuaacuagaauuauuauaaaucuaaagcuugagcagacuguaacaagaggguuuguucauagggacuuagugacaaauugagcagauacuugaauguugaauuccagauaaaggaaacuguaaguauaauguuucugaggaaagccuccaugauugguaauuugaaggggaagaaacugagagacaguagagaggaugguaauuucuauaaagaaauaggugagacuuuuuuccccucaauugcauagaagauugcugugagguuugugaagggaaauggagugugacuuguuaaccuuucuggaguuuucuccccuuccuccuucguuuguguacacgcagugcacuuggcaugugcacauauggaaccaagcuagccuaugucauuugggggaaccuguggagccucugaccaauaauguguaguuaucucaugccugacacuaagauugucauuuaauaacaccugucuucugggaauagcauuguuuguucacuuaugcaggauaguuccauucaaacauuuuguuguuuuaaauuacauuuuuuaauuaacuuacaaacaagaguguuuccauaagacuuuuucaaacaucuuuguuuuagucagcuuacuucuuuuccugucuccacauccagaucccagugccuuaauuucuauaauguaaacacuacucaaccauaucaguaggaauauaaacugugaugugguaacauuauaacuugauuuccuauuuucuaucacaggaccucuccuuuuagaagcugagaacuaugcccacccaagauaccuaauuaauuuguaguuuaguugguaggaaauuagcuugacuacuuaauacauagccacagacaaauagaacauuggucaaaugggaaaugguauagaucucuuaaaauugaauguauugauuuuuuucauauauuuuagauguaaaaaauaaauucuaguacuuuaaguugaguuuuacauauaauacugugaaacuuugauguagacauucaguggcuccaaccuaguuugccugcuaauacuugucugucaagauaccauaauaaugucacugaaaaauuaugcagcaccucuuggauugauggauuuuuuuuuuaguuuaauuuuaucuuucuagaaaaaaaaauauuauaaagaauuacugugcuggcaagauggcuuaucaaguaaagccuguagauauacguuugauagcuggaacugacauaaaugugaaaagaacaaaccaacucugcagaauuuucaccuaaacucugcacauguauacauaccuauggucugcauucucauauacacauacauauacacaugcauacaauacuauuuuuucaaaguacaggaaaauccaaugaguuacugugcacuuuucaaagcucagcauggcggugcaugccucuagucccagcucuuggaagcaguggcaggcagaucucugaguuugaagccagcuugaucuuuguagggaucucuuuggucagauugguuuuuguaggcuucuuaagccuacauggugagauccaguuuuauaacuguaccacucuccugaauuacaauuuccagggcuuguguuacuaaauugaaaaccauuuuauuagauuauguucuucccccaaaccuugcccaggaugaauagcaaaaaccuuuuaguuacagaaagcuaguaauacuucagacaugugaaaugguucuuugagaggguacuaaacauggaagccacaauccauauucauuauuuaaauguguauuuuagaacauaaaagaaguauuuaaagguuggauuuaaaaguaaggaauguugucuauguuuuaugaaacaauucuauucaaaaucuauaguuguuaauacuuuuaauauuaauugcuguuuugauuuauuuucauuuuauguguuugaguauuuugccugaagaggacaauggauccccuauaacuggaguuccagaauguugugagcugccauguggguuuuggggacugaaccuguccucuuccaauacaucaagugcuuguaacagccccuaaaauuacucuuuuagguuaucuggcacacuuuccagggcuuauguaacuacuauuuaggauuuuccagguaaaccaguuucauaauaaguauaaugcugcauuucaauuugcaaauucuacaauuuuauaacucuaaaguauuuggggcuuuccauuuccuccuuucuugaccacuacagugaagucaguguauaguuaaaauauaauacuuaaaagguuucuguaauaauaauagaauugauagugaaccuaguuccuuuuuuuuuuuuuguuuuguuacuuugagauagugucuuacuauguaguucuggcugaccugaaacucccaguguagaccuggguggccuugaacuugcagaucugcccuccucugucucugcaggcucagaugaauggcaaguguaaccaaaccuauaucaagaauaaauuuuuaguaaucuuguuuaguuccuuaaauuuuuuuccugcuuuuugaccuuuucauaagccaugcauauuauuuuggacuaaucuucucuaaacagaggaagcaaauguggguaguugucauaucuucugaugugaaggagaggaacacugcuuuauaucuggguguuaugaaacuuaguaucuauauucccacaauuuuuaaaacuaaucuguauaggaaaugcaguuuauuuuaaauuuaggauuucucauucuaauuuagccuaaauuuaugcuaauauaaauauucgaaagacuuaccauaaaaguggcuaauuucuucccaguuuuauuacuuuggaauugaauagauacccaagcaagcauaauauaguauauuuuucagcauauguaucuuuagauuuguaugaaauaaguuaaaggucagagcaaaaugcuaguuuaauuuaucuuugcagugggguuugccacgcuacacaugucggggucaagacaaccugaggagggagucaguucucauuccuacuguguggcucuuguggcuggaacacaggucguugggcuucauaucaaaugauuauuuugaggugccauuucaugggucaggaaauuguguuuugaaugacuuuuuacuuuugagagcaaguuuguucgacugguuuuggcuuaucuuucuaacccagaaugcccuagaaaguggaauccuccugaguguugggauugcacuggugagacaucauuucugguuucuauuuuguugaauaccuguaauguucuuggggaugguaacagcuuggguuguauuuaaguauuuaagaacacaugcaggaaaagguaaucuaggcauucuguugauacagagcuggagcucagcugagaaauuacugagagacauucugcaaaguugguagugaaguaggucauuguuaaaaugugcuguuguugaugaagucacccugccauacaguuuuaaaaauacaaaaggaaaugguguagaggucacauuuacauaaguuggucaaagaauagaaguuaaucaaaaaucuaaaaguucugcauuagaaaaccggacaaaaagaguaaauuaaagaaaaguucugaauaaaggaaauggugaaguuuaaaaacagaaucucuaaaggaaugauuaaaauugaaagagaggcugggcggugguggcgcacaagaaggcgaauuucuuaguucgaggcuagccuggucuacaaagugaguuccaggacagccagggcuacacagagaaacccugucuuggaagggggggggggggaggugaaagagaggagggaagagauugaaaggauacaucuuguuuguugacuguguaaacaugauguugucaggaagccugacauuuaauauuuauuaaauggcuaguaacagggccagugaugccucaguguacaaaaguguuugcugccaagccuaaugccuugggaacaaugacugcuaauaagugugauacucaggacccacauggaaagagagaaccagcuucuuacaaguuuuccuccgaugucuacacaagugcuaugacacauuccugccuacacacacagauaaguguacuuuugacaagauagaccuuaguaguacuuuccuaacgugugaaaagcuaaguuuugauuugcaacauuuagaaaauaaauaaaauuaacaagggacugcuaugaauagcuuuaugcccauaagguuauguuagaagaaaugaacaaauucuagaauaccccuaacaccaaaucuuaagaaucaaaacccugaaaaaucuguuugagaaauuguuuauaauuuaaaaugcucucacauagacaucuuucuguccagauggcuuuguguacaaacuacacggaguauuaaagggauauucuccauauauauacauauauguauauguguguguguguguguguguauacauauauauaguggaaaacagacagcauuggugaaucacagucccauguuugagaucugcaucaguuuuauuccaaacaauuauaagacaguuacaagggguuuaugagauacuucuaugguguaggcaccuuuugccaagucugacuaccuucuccagaauccaacuguuagagaacugaguccuccaaacuaucuuuuucucuugcccguguguacacuuacagaguaaguaagcaaaugugauuuuaauauguggaaaacaauauguaucaucaugguagaaaaaaaucuuaguaaaauaguagcuaacagucaggcaauacagugugucagauuaaugauguguacguacaguaaguaaacuuguuugaacauuaguugaccaguguaauucaugaugucaacauacuugaaggaaaaauauuuuaauaucucaaguagguacagaaaaaggucaaacuugauacccaccgauuaaaagcugauuauaagaaucugaccugauaagcaucagaaaaaccuuuguagccaguguaacaccuaguauuggugcaaguaccaauuguaauaccacugaaaaauguuaaacaguuaggaaucaaauuuaauaaacaauacuuuauauguugaaaucuaaaaaaaauugucagagaaaacagguggcuuaaaaaaaugagcauauaauuggauuauaaaccuaauauugugaaagaugucuauuccccucaugguauauauacauugaacacaauuccagucaaaaauuccaagcauuuugaugggauggagucuuuggguuuagcggugacauuuuaauauuuguauaggaaaagcuguggaauauccaaaauacuuuugaaaaguaaagaaaaaaauuaagauuuacuauaaacaaaguuuuauuaaccauaaccauuauaaagccauacucuuaaagacgguuuguuccauugauaagagaaacauaacuuaaugaauuaguuugaaauucuggagaagauccauaauacacaugauaacuuaguuuuugucagaggugccaaagugauuuaauaaagaaaauaguuuucuuaaugguaccaaaauguucaaguaucauuuuuauaggaagaaagauaagcucaaaacucauauaugcaaaaacucacuacugaauuauggauguaguuguauaagacaggacauuacacauuaggaaaaacgcauaggagaaaauuuuuauaacuuuuggauauuuuagauaggauacagaacaaacauaaaugaaaaugagaaauuuggacuuuaacaguauuaaaagccuguuuuucagaugcuauugagaaaaugccuacaagagaggaacccaccaguuaaaaaacccaugguaaaccacaugacuuauaaagggcuuuuauacccugauaaucagauuuccuacagauccguaacgaaaaacccaauaaaaauugagaacgaacugcaauagacacuuuagcuuacagaauauuuuuuggauauagaaguagacauaauaugaauaaagaacacaauacuuggaauuuuaaaacuuuuauauacaaauagcauugauugaauugagucuuaacaguacgugauuugggggugcuggagggcuggcuuggugguuaagaguauugacuggucuuccagacgacuuggguucaauacccagcacccaaaagagggcuuacaguugucacacagaaauacauguaugcaaaacaccaauauaugcaacagaaauaaauuuuuaaacaguauuugauuugauaccaacaccuuucucauuaaaaaauaaucaggcugggcaagguguaucccaguccucuaguggcagagaugguuucucuguauucaaggucaucacuauguucuacauugugagcuccagggcagccaaaacuucauagagagacccuuucucaaaauaguaguaggauuaauuggggaacaaugugguggugugcaccucuaauuccagcacuuggaaggugaugguugaaggaucauggucuaccuggacuucuuggaacucuagcuaaagaccaaaagcaaaguuacauguuuuuaagugaauggcauguaccagcgguuuaaaaguuaaucuuauauguuucaaauaacguaaacugucauacuagcuauugguauuugugcuaaauauauagaaauagcuagauaauuccuuuuuugggaucuuugagguuggagauaguggugaaacaucuuuguguagcucacuugggccuaaaaccaauaguucuugaaugcuaagaucauaagcacgggugaaugcuaggaucauaaacaccugagacuauguucuacugugauucuuuagugccugaacucccaaguuuuucuuuugcugaaaccacauuccagaaaaaugcacggucauuuuuguuaguuuuuaaaaauguuuuauuuauuguuguuucauguacaguaguguuuugcuugcauguauguaaguacguugcauguauguauuguucaggagggccagaauagcgcuuuagguaccuuggaacuggaauuauguuugugauguuugugaguggucauaggggugcgggggacugaaucuggggccuuggaaagagcaguaacugcccuuaacugcuagccccuaauuuauaaguuaaggaauacggaagaguauagauaacuaagagacaagauucccucacggauuuaaauuuuuuuuuuuuaucucuguuaauaaccuugguuuaucagucuugacuguguauacuuuacuuuagauaagauaaacacauuuucugcaguguaguuuuacuaucuaauauaacuauagauauuuaauaguauagaaauuuuuguacuucaauauucauauauucauuugauacauauuuuuaucuauuaugcuuaauguuaaaacucuagugcaaaaaaauugggcuucuguuagauucaagugagaggagguuaacauacuugaggagccagcaguaguauuuaguaugaaguuuugcaggcuaaaguggugaaaggugacaggcacacugaaugguuuuugaagggggggagccaugguuaugcuagguaaguacugugccucugagacacacucacaagcaccuauuguuucauuuucaaucuauucacccacuguuguauugauguauaugaagguaauguauagccuuuuuuuccgguaagaucaguauuguaaugaacaaccauguacauauauaucuuuguuuuagugugcaaauauuuuuguagauauaauuucuggaaagaaaaauuuaauuguugaaauuuuauauucuaccauccaucucaacuuuuagacauuauuugccaguggguauaaaauuaaaucuuauuucaauuuguauuaucuuauuuuucaauaaaguugagcauauuuaugagaauuuuguuucaauuaaaaauuauucacaaacuuuguacauuuuacccuuaguaaaaauuuaaaauuucuuucucuuacuaacauaauaugcuauaguuugugauauuuuaaccuacccuaugaagucucuuauuuuguagcacuuuuagauuuauuuuuaugcugucaaaacuuuaccagucuucucaugugucuuucccaaagaguucuuaucaacaguaucagagcacuuuaguucuuacauuuucuuguucaauaguuuuauuuauguuacuaguaaauuuauuuuuaauaaucaugguaguggccaaguuaacuuuucaugcuucauaaucuuuucucccacaguaaauuguugauugauacuuucuuuucucccacuaacauggaaaucaccuugaucauauuuuaagucccagaucaugugcucuagauucaauauucuacuguuuugauuauuuucauuucauauuuaacagcaccccuccccacugucuuuuuccaaaaauuuuuuuggcaauuuuuguguauuuucucuuccagaugaacuuuagagucaacaugucaaguuccauuaaaaaucccuuugggauuuugauuggaagugcauugaauuuacagauuaauuuggggagaauugacaucuuuacacuauugagucuucccauccaagaccaugguaugccucuccauuucuuuagguguucuuuuauguccuacaguacaaauuuuauacaauuuuuuaaaaauuuauuuugauagauuuuuacacacauuuuuuaaagguauuuuccugaauaucguuguuauuauugugaggaauaucuuuaaaaaaauauuuucuaaugggcuauugcuguuguguaggaagucuauuuuuuauuauuauuuuggucuuaguuuaguuuugcugauuucuauuuaaauucuggaaagauaauuauguuuucuguaaauguuauuucuuuuucaauaucuaugcuuagcaguauuuugguuuuuuuuauauuuuuacuuuuuauuuauuuuuauuuuuuauuuugguagguuuucagaauagcugcuguucuuucugauuugaauguccuauucuugauuuaaauuaaaugcuuuucauuuuaaagcuaaugaacacucaaauuuuuaauagagaauagagcgauuuuuuuuuccucauucaacaggcacuuuuauggucguugacacuuuuuuuuuuuuaaagauacauuuauuuuauguauaugaguacacgguacuaucuucagacacaccagaaagagaggaucagauucuauuacagguaguugugagccaccaugugguugcugggaauugaacucaggacuucuggaagaguagccagugccuuuaaccguagagccaucucucuagcucaauacuuuauuuuacgaggaaguuuuaaucauguaauaucgggugacuaugaacucagagaccuaccagucucugccuucugagugcugggauuaaagguguaugcuaccaugcagggcaguagauguuuacuuuaaccauacaguuuuguugagaugacacauguucuuuuucacuuauaauauuuaauguaaugacuuacguguuuauaauaguugaucauaauuuuguuuauuuuaaauauuccuucaaggaucuauuuagauaaugucagaaacugccucaaguuaauggcaggauaguugccaccacaaugacaaguauuuguauggcucuaaaaccgauugcaaguaggugagaaggugguauuuuaaggcugguguuauauuagguaggaagugagagaauggguguuguguagagugcagaggaccagacagagcccguuagugugacuugacguguaaugccagcuaggaagguaagagggcacggauaaggaggggaaagcaguccccagagggagaaaacaguucgugcuuuggaauuucuuguaucuucuuucuuauggauacccuuuuuauaguacugauaccauuugcuaguauauuuauuuuauuuaaaaaaggauuagguguguuacauuuacuuaggaggcuucuucauagggcugugugugaugcgcuuggucguauucccguguauuuuccagcguuuguaaguaagauacccuguuuguugauuauuaugauacugcaguuuuaaugagaaccuuuuguaggauacuguccaucucucucucuuacgcuugcuucugcacuugugggagcaugcgucuccucaugcauuuucuuugaaaccucguccaugacgauugacagagcuucacuugcuuuugcuggacucguccuacaaguugucuucgcuuuauucauccugauuuguaauuuuaaaaucuuagauuuaaagcucuaauguuuuucuuuaaggaaaaggguuuugaucaaaucuuucagaaaguaauuucuuuuuagauuuuuauuuuuucuuauuaauggauauuuucuuuuuuaaaaauuucaaauagaaugucaaacuauuaguauuuaauauucuguuucuuuauuuucuggaccaagaacuuaaccucauacauaaauugcaaggucaucucuuucaaaucuuuugaguuucuucuuuuccuaacguauguucagauaucauaaugugcauauucaucauuuucuuagcgagguaauaugcaaaacuugccacauugguguuuuguuuuguuuagcugcauauagugguaguagguuguuguaugcucaugacugaaccacccuggauauacucacugucugcuaacauuauaagauagauacucuuccuguguaacuuguuuugcguuauuuuguaacugauaguaacuacuauccuuugauugugauugcuguuucaucuauuuucaaccccuuuucuuuaaaaguuuuuauucucuguguguguguuaaaugguaagaguguuauagaaaaaucuacuugaaauuuuagaccauauaacuuuuauuuuaaacaugauuagucuacuuuguaaaguuuauacuuuuuaaaaacuuaaugcuagaugacauuagugguuuugacugacauguagacagauaaguaccucgaagcuuacaaauagaagucauguuuugugucacuucuaucaagaaggcuauguuacuaaucacuaguacauucuuacauaauagaucuuagugaaaguauaauauuugugacauggauaguuccaaauguaaaaauacaggacuggacuaguaaugauuuguuauuuagucauguucacuuucauuuugcuaacuucuaucucaaaaccaugagucuugcuauucaacuuaacucucccaccccucuuuaaacaaacaaacaaacaaacauguauauguguucaugucuggugugaaugugggagccugcagaaaccaaaggcauucuggauccucugggcgugaaguuguuaagugguuaugagcugcugauguaggguguggggagcugguuuauccugggucuucuggaauagcaauacgugcuuuuaauuguucagccauaucuguagugccaauguguuccuuucucugguucucgggauuuauuuauuuguuuuguucuggcuuuuuaagacauagaauaggguugagaugacaguguuagcuguucuuugaauaucaagacucagauuguaugcagugacuuaugaauccacuucugcauucuggaauccaguccacucgacuuaaacacucauccugaaguauuuuggaugugaggguggucugugucuuguuaaucagcugacccaucaccaaagaaccuacauacucagccuguguggaaaacaguagcauuuaaacaccuuuuguggcuucaagcuaccagcacauaggcaccucucaacauccuucaucuucucagcuuuucucugaagaauuuggccuucgccauaacaugcuguauaaggagccugccuuuccccagaacuuacaguagccugcucgcacaucagagauggcaacagcuucagccuuguuguuuuguagaaugagccuguuuccggauuaguguucacaauuuggauagguugccaguuggguagaaauccugauucuuuaaguggugauuccucacaccaacuuucccaaaagucgcccagauguuuguuaaaguugauuuugcuaugcaugccaccagcaacccccaucuuucuaggugcuuguggcauuuauugauugcucuggcagccguggcucaagagguccugaaauguccaggucuucacuagucuccuuggcauggugggagcugaaaggaaagaaagucccucuuuuaaccaaaaaaaagaaaaaaaauguuuaaauauuuguuuguguuugcaugagugugauguguguggguauaccauuguucugucauguauguggaagucagaggacaacuugguggaguuguuuuucuccuaccuuucuauagguucuggggggcaagcugagccaccuccuaaccccauugauuuuauaagauuucaaguguuuuaaaaauauuuuacugcugaaaaucuuuggaauuauauuaguuuaaaaaugauuaacucaauuaacaauuguaauauuuucugaagucucacucuuacaguacugggccauguguaaaagaacauuguaaugacuaauuauaaauacuuauauuuacagugagucuucacuguauccagguaacugggaaguacaaauaacuuuuuuuucuggcuuugaaagacagaaguuaggaucaaacaagauuuuacuuggaaauuugugggcuaggucaguggcacaccacuuuacugccuagccuguuuaaggcagguuaucucuagcaaucagccacuuugauaacauuauagauucagauuugucccuuaaauuuguuuuguguuuguuuuuugagacagguuucucuguguaacauccuuggaacuuacuuuguuagaucaggcugaccuugaacucacagagaucugccugucucugccuccugagugcuagaacuaaagguuaauauauuaaaaccauguuggccuucauuccuuaaaguuuuauaucugccauuuugugcugcuuuuuaguaucuuuuauaugcaaaagauauuuucuuaaugauuaauucuaucaguauucagaaacauguuaaauuauguuuauuuaaccugucauacugaauauuacuagagaaucuugaguuuaggguuuaguucaugaucacagcuucaaauagcugaugcuuuuauguuuuauuauauaauuauuauaguuguuagagguucuauauguguaaauauuccauuuuuucauugaaauuaucaaauugauuauaagaaucacauauagauacuaaaaguagauucauaaaaaaauucaucagagacaaauaacuuuuaauuguagacaccuuguuauggagcaaauggcaaaucauuuguuguuguauaggacauucguagcugguuaugguggcagcaaaacauaccuguagucucagcacagaggagguggaagcaggaggacuauucuuagccagauggaguucuagacuaaccuggguuacauaggacccucaaaacaaaaccaaagaaagggacuuuuccccuaauguuuauuuauugauggacugauugaguguacagaugcacaagagagugauuuugggagucaggucucuccuuccaaccaugaggguccuggggauuaaacucgggucuucagcuuuggagacaaguacuuuaacccacugaggcaucuuugcuagccuggaaauuuuuaaugagccuuuuagucaaaauaugagguucuuuucuugaagccuacauuuucaaaguguaaacuuuugccagaagagaacaaaauugguaauaauggugacuaguacugccaaaagaaaugcagaauguugaauuucacauagucccaauuugaauacacuuauguucauagccaaagcuucucuaguauaauaacucauacuuuauauguaauauauuaaaacuuucuuaauagguuucaucuuugaagucccguuuaucuaaaacaacugcuuucaugguaucuuaauuaugugccugaaaauuuuugccuaaaugaagucuuucgguagguuuuauaaacugaauguuucagcauuguauaaaggugcccuauuccuuuaagcaaugcuuguagagaauuguuuucuuccuaucuauuuaauguucuuuuuuuaaaagucuauuucauacuccuuugcacuuagcauguuuuucuguauugcauauuuauggaagacaaugauuauaauaaaaguacucuuguguuacuaauagcuaacuuauugcuuugaauacaaggaauaauugguggccaauguuugcugaguggaguugugaaugcccauuaauuaauguauacuacuuucuuauucuuuggauuuagcuacaagguuaauagaguauauuuugagaaaagaaauagcuuaaauuacugauguucacauuugguccagauuguuuugcuacuucaaaucaccauaugacaugucuuuuuguuuugaguauaaaacuacuaguguuaauaucuauuuggauuuuaccauuguuaaaauaucuuuuuggguuuuuuguuuuuguuugguuuuuuuuuuuuuuuuuuuuuuuuuuuuuuggguuuucgagacaggguuucucuguguagcccuggcuauccuggaacucagaaauccgccugccucugcuucccgagugcugggauuaaaggcgugcgccaccacgcccggcuuugguuuuucauuggggaagauuuaauagacuacuauuaucacuacugaaacugagcagugguguugcacuccuuuacucccuucaccugguacacagaggcaggcgaaucucccgaguucaaggccagccuggucuacagagugaauuccaggaccaccagagcuacucugagaaacucugucuugaaaauaaaauuuuuuaaaauuaaaaaaaaaauggauaaaaacauacuuccuaauauucacaaauuauuaguaccuaauauuugcuuuuaaaaacaaauuaaacugaagcagucuuugcaguaaagucacuacaaaguaagacuuuaacaaacacaaaaagagaccaguccaaaaugccuuuauuauacauauauguagcucuaauugaacguucagaacuuucuagagcugaagacgaagcuuauuugguggugugcuugccuaacaugcacaaagcuuaaauauagauaaauauauuaauuauauuuauauacauuuguaaaguuuaaauauaaauaaagcauugaugcauaaagcauuaauaccuaguuggauccuugguauugcauaaaacuggacauggugguauacauuuguaauuuuagcaaguuauccaaguucaggaucaucuuggcugaauaagugaguuugaggccauuaggagauacaugagacuaucucggcaaaacaaaguaaguuuucccaaaaaauuccuauuccuucucauaucucaaaugcccucuuucucuauucggcugguucaagccagguuucagauaggaucuguauuaugauuuauuguuguugcuugagucuuguuaacuuagaacaauucuuuaaucuuugcucccauucugcuuaguagaagaaaauaguuuuacucuaacuguuguacauuuuugauuuauguuugcuucugucuucuucagagguucacuaccuccucaggucuguguguuuguuuuugugggggaaggaauugagaagguaguuuuucuuucccaaggagacauuuggcuguuucuggguucgguuguuaaauuacuacuggcaucuggugaguaaaggcauuuuauccagaauaguuguagugcuuagguuaagaaaaaaagguucaucuccuggugugccuuaugacgauuuucaaaacugaguuauuucuaaaagcccuacuaaauucuuauuuauugggaaaggggugaugucaagacaaccucauagggaaggggugguucaguggguuaaaggcauuugcugccaagcuugauaaccugaguuugaucccaggaacccacauaauacaagaagacaauugacacuugcaaguugucaucugaccucuauacaugcacuguuggauaugucuccaaauagaaaugaauagaauuuauuaagagaacaguacuuccuaggagagaugcuucacauuguauggugcauccgggccuaaaauguuugauuguacuacuuuuacuuuuagucauuagugaugaggucauuuaggaaccuugauguuuaaauaaaacauuuaaaguuagaauuuuuagugcuuuauaagcauacagcugcuucuuguucuagcguagguguuuguuguuuuguuuuguuuugggggcguagggaauacugaaugaguugggucuagguuuuaacuggucuucucuacuacauugaguuuuuuugaacuuuuuuuuuccuuuucuguuacacugaauuagaccugugauuuauuucuaagauuuuuaauuuucuuuuccagcuuucugucuuuaaauuugucaggaauuuaaugcaggcagauuccuucuccagggacaagcucccacuuacauauuccaucccuaguggucagccuugggcauguguaaauaaugagcaaagguaaauaaucucacaugcacguguacauacauuugugugugauguugacuuaauaauuaagaugggaucaugaagauuggaggacacacuagaggaguugaaaguuacagaaugagagacaggagugguagaaaugcagugcuuacauaugaaauucucaaaauggaaacaaaacagugguugcauuaucauuuuuaugaaauacuacucaguucuaacaauacauccaccauauuuuaaauauaguaguugucauacuuaaauacucauuaacuuugauaccuuuuaagggauaaacuaguagcauuuauuuacacuuuaugaaagucuguguuucauuuaaagaaagaaaauaauugaaaaggcuuagugcauggcuuagugccagagugguuacuuaguacacaaacaaggaccggaauucaucuugcaagcugcaaaaauuaaaauacuguuuaauuuuccuauuuugaucauuugaaauuuuuauguuuucaaacgugguuauggucaagacuuacuuauagaaauuauauaauaaaaugaguuagauuucagugcaaacauuucaguuuuuaaucugcacuauuuuaguuuagaaugugauaaggagguauacaugcaugcauaaucuaguuuaaauuugaauaagaggcuauuuugaauauuuauaagauuauaucucucgugucauuuuaucuguguuuauuaggaaaagcacaugccuuaggguuuuacugcugugaacagacaccaugaccaaggcaagucuuauaaaugauaccauuuaauugggguugaauuacagguucagagguucaguccauaaucgucaaggcagcaucuaggcaggcaugaugcagguagaacugagaggagcugagaguucuacaucuucauuugaaggcugcaagcagaauacugacuugcaggcagcuagggugagagucuuaagcccacacccacagugacacgccuacuucaacaaggccacaccuccaauagugcuacucccuuucccccauaggcuuauucaaacauacgagucuguggggaccaaaucuagccauaacauaauacguacauuuaguccaaaguucagagucucuucugagauccauccaaucacuuaacuguaauccagaaucaagacaggaaaccagguaggcaaacuccagacucugcaucucugagucugaugucaaagcugucuucagaucugucaacuccuuuuucaucuuuguugacugcaacaaacugauuuuccugggcaggauccacucccuguuagcagcaugccucaggagauauccuauggcuguaguaucuugaaaaucuucaggucuccaaggcaacuucaguaucacagcuucuuguuucaaugucugugauccacacaugauuuucugggcuccuccaaggggcuggcgucacuucuccaauucugcucucuguagcacuccaaagucagauugguccauucuacugccacugcuguucuuggugaucaucccaugguacuggcauuuccaguaugcuggggucuuccacaucaccaauagccucuuaugggcucucuucacggugccaagccacaaauccuugcaugaccccuucaguccugggccaauaccaccugagugacuuacacauuaccaaguacaggugcaacacaagguacaaccuugguuaucucuggaacacagcuuuuuuugugucucagaaaauacuucccagaagauuucacuucaaugaugcuggucucuucuucaaucaccacuaauuuauuuccagcuaaccagugugaauuaucccaguaguccuuucuguucuggacucucaaaccacauggccgaaggugccaaguucugcugcuugcuggggcuugaaccuggcuggcuucuuuguucuauuauguuaucaccagcuuucuuuuuuccaacugccuacgcuuggcuguccuggaucuugcuuuguagauugacauugauuugcgugguucugucuucuaggauuaaagguguguaccaucauaccuggaucuaaacuuagcuggauacaaucuugccccaaagucacauucccuuaauucaguuuaauauccuugaacacaggauucaacuucauuucacauccucgugccccuucuauacucaaaccguauauuuuauauuuuuccuuacuaaguuugcuauacuuacucaaaaagcucuucaugagacucagccagagaacaaagucuauguuggguguuucugagaguuccuuuuucagugcaauuaaucugagucucuuuaucuuuacuucaggcagacucuucagacaagggccaaaaaaaaaaaaaaaaaaaaaaagcuacauucuugaccaaaauacuacaaaacagucuguaggcuacguauugaaauucuccacugaaaccucuuggaccagguccgcacaauucauaucacucccagcaacagucuuccauauuccuaacuaguuccaaauccaaagucucaaaauccacauucuuccaaacaaaagcaugaucaggccgaucacuccagucccucgugccaacuucuaucuuaguuaggauuuuacugcugugaauggacaccaugaccaaggcaacucuuacaaagacaacauuuaguuggggcugaauuacagguucagagguucacucaaggcagcaucuaggcugucagagcugagaguucuacaucuucaucuuaaggcugcuagcagaauacugauuuacaggcagcuagggugagagucuuaagcccacacccacagugacacgccuacuccaaggccacaucuacuccaauagugccauucccaaucuuucuauuuugaaaaggaauauugaauauuucuuauuaauacucuggggauugaacucaggacuuggugcuugcagaauaugaauaagaucuauacuuagagccuccauauggaggaaaggguaaacaggguuacaggagcaguuucuugauuuuuuuucucuaguugucuguagucuuuuaccacccuacacaugcuguauuauauuccuuuucuaguauuauucacuuuuuguaagugcucauuuaaaaauaaauaaguuccucgccaguaaacuuguuucuauacauugauguguaaaugcaauaguaaacacuugauaauaggaugucaaugguaugugucuaaucaaugaagggcacuuuuguuccuuuuauauaaaauuuuauaauuagcuuuucuuucaguauacccuaagcuuuucaaaaagggaagaaucucagagucaucuggucauuuuaaaaucuuuuuuaaaaaauucaauguggggcuggugagauggcucagcagguaagagcacccgacugcucuuccgaagguccagaguucaaaucccagcaaccacaugguggcucacaaccauccguaacaagaccugacucccucuucuggugugucugaagauagcuacaguguacuuauauauaauaauaaauaaaucuuaaaaaaaaaaaaaaaaaaauucaaugugugugugugcgcgcacguguagcaagcagacggguggaucucacaaugguccucuggagaucagaggucgcgcaacuguggaucccagggauugaacucaagcugcugucuagcuuggcaauuuucaauuuuuuuucuguuuuaacuacuacaguuucaugauuacuuaaaguugauuauuauacuuguugguuguaaguuaacauuuguuuucacagagcauagaaaccauguagacacaaacacauauguggaauaaauuauugauaugggguggaggagcagguaugaugaacauguggcaguuagagggcggcuugugggaaaugauucucucuucccgacacaugggcucuggucagagcccuccagucucggcugcaaaugccuuuacuuagccaacucauaggcuuugcacagcuacuccuuuccccgcuguguguauuuuccuaugauauaggacauuguuguucuauacuccuguaucuuuuagccagguuuguaacaaggaauuuagauaaugagaaagaaaaucccucauuuugaguaaaauacaauuuucuugauaaguuuucauuaggcuuagcaaugacacauuguaauguaggggacuuuauaagccaccucccugcaaccuauaaccuuaauucuccuacugugaauucuacauuguuacaucggacuaaaauugcaugugugucugcuaguggaacauucuauuuucuucucucaucuuauacagacugguuauuuuggcugugugcguuguuucuuuugucuuuuuagauaguaggccugaacacacacucgugggugaguguguguguguguguuuaauuuacauuuuauguguaucaguauucugccgauaugcaugucugugcacacuugaaugccugcugccuguagaggccaaaggaaggucucagauuccccagaaacuguaauugugagccacuuagcaggauccucugaagaguaucuaguguacguuacugagccaucucucuaggcccccagucugcguagguucccacugcuucucaguauggucucuugaguucaagauuuucuuguggauuugacagcauagccagccaaacuaucaaaaccaaccaaccaaccauacuugguguggugggugggguuuuacuaccucaaauuucuuucuauuugcucugguuucuuucuugcgaauauaucuaaaacaggugggcuauacuucucaggcucuaagagaucauguaaggcuauuaggucaaaauuguuauccuuagaauacuaagaugcuauuaauugguuuuaacgcguugauuuguacugauacuauaaaagcagaaauaaauacuuuuuguuucccuaugguuauagcaccaaaguaaacaaacauuuuucauugcuguacacuuggaguuaaauaaagaaaauacuucagacuucacuucucuauuuuuuaaaugguuauaugucuacauauguggauguguccacaggaguauagguuguaaguuuauguaaacuccccaaaguagaugcugugaauugaacuuggguucuuggaaagagcagucuuuauguacuuuuaacugcuaggucaucucuacaguccucuuuucauuaauuuuuugaaaucuaagaaaauauuuccgcaacaugguuacuuguugcugaacaguacaacuggcaaacggucacuauuaauuuggauuuuuaacauucucaaaagugacucuaaugaaccuaccauuuaaauugguacuuguuauaaugaaauaaaguuaaacuuugaugcauaaauuguuaaaaguuuaaaauucuuuuuuuuucuuuucuuuucuuucuuuuuuuuuuuuuuuuuuuuuuuuuuuuuuugguuuuucgagacagggcuucucucuauagcccuggcuguccuggaacucacucuguagaccaggcuggccucgaacucagaaauccgccugccucugccucccaagugcugggauuaaaggcgugcgccaccacgcccggcuaaguuuaaaauucuuauuugcuuaagccucauaacuucccaauauuuacacuucucugaugaaaucauuggugauacuaauaaguguacuuucugcaauauuuuaguuuaguauuuaacauguaaacaccaguuaauaaauagcucuuguaggaaguguguucaguccuucauaagugcaaaaaagucaggaaagucaaguguuuaauuaauuuccuaagcagcuggaacugagaaggguacaggauuuauguucacaagcucagguauaucucauuaaaacuugaaagaaugcauaugauuugaggagauaaaaggauugcaguugcauaaugaguuaugcuguuuuguuuuguuuuguuuuguuuugagacagaguauuucuguguagcccuggcuguccuggaacucacuccauagucuaggcugaccucaaacucuagagaucugccugccucugccuucugagugcugggauuaaagguguauaccaccaccacccuucgaauaaugagcucuuuaaauugucaacauugauuuucuuuuuauuuaaacaaugggcuuuggcuguuugaauuuauuuaguauugcuacuauacuuaucauugguaauuaaaauauuuuucuaccucugaucuuauuuuguuuuuguuccccucccugauuuccuguccuuucuuuuucuuuuuuucuguuuucuguaucuguuuuuuuagguggagucuuucauuuuggaccaggaugauuuggagaauccaaugcuggaaacagcuuccaaguugcuucuaucaggcacugcugacggugcugaccucaggacaguagauccagagacgcaggcucgacuggaagcuuuacuagaagcugcagguaugcuguguauucuucauaguuggaucuccucuguuaucccuagcuugcuacuuaacuguaagugugcuacucuauguuuuguguaaugaccauucauaaauauuaauuacauuucaauggaagugucaugacugaaaacauugucaugauaaaauucacuauggauuaacauugguaaauuuaaauaaaguuuuaauugaauugaaaucuauauaaaauuuacaucccacuuuuugccuuacuaaaaaggacuuuauauacaugauucucaguacuuaauagauacaguauuggaauuugcguacccccuaaagacucugauuaguacucagaguuaucauguccagagcaguggaaacuagcaauuccccuauuuauauucacagcuaaagugcugcuuucugucuucugcuugugccauaccugagcaggucugcuuaaacacucuguucuucacauuauacuuuuucccugaagaugucauuguucagaauggccuuguagccaugugugaugacuaauaaucuaaguaaaguauuugggaagcugaggcagaaggcuuguuacaaguuuauuucaguccaggcuagccuagccuaguacaccaaagaggccucuagacaugcuauguaguguucuuuaaucuaagaaaauuguaauguguuuuauuuggaaaauauauuagguaagauucagugaagcauagcuuuuuugcagugcuguugacuguuauuauuaaugaauaaacuguauauuaauaucuuuaacacagagcacacaugaaacuagguuauaguuuggagaaacuuuuaccuuaugcuggcacagccuuaccccauguacagugcaggcuauauucuuaaacuguguuauuuccauagaguggauuuuauuuucuccuuaagaacauuauuuuaauuagagaauuauauauauuauuucuucuuccuccucauucugauuuuugcuucuccauucauuucuuuuccuuuuucaaacaauaauuuaauuucauucuuuauguguacugcuguggggcugucauccccuggaacuggauuuacagacagcugggagcugucguguaggugcugggaauugaaccaagguccuuuggaagaccagccaguucucuuaaucgcugagccaucucuccagucccuuucuuuuccuuuuuaauggaaaauuucacacaaaaacuuagaauagcauaacaaacccucugauugugauguucaaguucaguaagcauaaguacuuggguagucuuguuuuaucuuacucauuacacuuuguugauauuuucauguuuuguuuuguuuuuuuuaauuuggaaguuaauucuuccuucaguuuuuugcuguuuggauuuauugauugauugauugauuguguaugaguacacuguagcugucuucagacauaccagaagagaauaucaaaucucauuacaguugguuguaagccaccauguggaugcugggaauugaacucagaauuucuggaagagcagccacugaaccauugaaccaucuuuccagcccuccucaugucuuugaauauaggucuaacuuuuaugugauuucauuuauaaauucuuccauauguaucuaaggaguuccuuaaaaagacagccauaaagacaaucaaggggaaaaauaguagaaauuuacuauuaauauuucuaaauauccugucauuguuuagaauugaugaauuauuuuauauugucuagguuuuuuuguuuguuugaucgauuuuagaaugaguuucugguacucuuuuaauuauugagucauuucuacagcuccagaacacuuuucuccagagagaugugugaaaugugcagauuuuuuuguugguuuugauguagcuguaguugguggugguggucucuguuuuauucccuuauuuuuccuguuaggggcuaaaguuucugagaucuugugaaaauguccugcuguccucaugcauaguaguuuaugaguugaaguuuaguuuaaaaaaaucauuaccucuuauuuuuaaacucauugcucuuuaguguuccaguugaaguuugauauuacaguugugauaguuuuccucaucuauacacuuguuuucaggcuuucucagaauuuguuuccauucgaaaauugguugcauugcguugucuuuucaaaucauaaaacuuucuuugacccugaguucuguuauaaccaauagcaaugacauaaaaaaaaaccagauuucaaaagauacauaucucuuuugucaagugaugcuuuacauccugaaauauucacugauuuccuauugcguuauuauaauuuauuuuuaaugcagccaugagaaacaauauucauuugcuuuuuaauuucuguguaucagauauuaggacauaaugugucugaauugucuugucuuaagaucuuguagacugaagccaccugugcuaaguuuuuaccuaucuacugugagggaaaguuuauuucuaauuucauugugacugagagaucaguuccuggcuaugguaguucugagagcacccuucugucccacagacacucaauuggaucuccccuugcuuucuuaggguuaugcacauugcuucauccacagauccucuucaucuuaaagacuuacuuuuuaaauucccugccuuuguuaucuccaggcaaagaauucuuucuacuguccaugaguuucugauugguuuggacucacuaggauaaucuguuugauauaguauaacuucauguugggaguaaacuuuauuauauguguaguuuugggagguagacuguagaaauugauucaaugguuuguagcacuuaauguucuugaaaaggaccaggguuuauuucccagcacuuaagugcuggcucacaaccacuguaacaccauuuccaggggaguugaucccauauugugaccuuucuccucaucaugcaugcacacaauacauauacauugcauacaguaaaacacuuaaaaacauguaaaaaauaaauaagcccaagggaaauaaacaaaagaauaguauauaggauauguguaacaguguuaguugguagaacauuuugguuuuccuagcugugauuacacacagaagcuuuuauuucuuugggaucacuaauguauuaguauguaagucuucccucuaagucuguuggacuuuuuuuugagagacaugcuugcaaguuuuauagucuuugcauaauaagcuugacugccaacauugugguccugggagaguacaaaggaggcugagggcagaguagggguacucagaaugucggcauucacccucugugcuccuccuuacccagucgggguccuuuguuuaugaucuccuuauuucucuucacuagcuguguaucaacuuaaucuacucuaguuaccuucccgguaguaacuuagauuuaaugauguaucuuaguuuuaucaagaauggaauuccuuuugcauucuaaagucuaugaggaaagggagaaaacaauuauucucucuuauucuuaaaucaaaccuagauauugugauauauucucugugcuaaguuuuguacuccugagacagagugccuuaggucaugcauccaagaacauauggcauggauaaaaccucuagguucgaggagaguuauuuaccuaaagauuagagacagauauauccaguauaguauaugaagguuacuuguuaacauacagguuuuaguaaccuaaguuuugcuuuguuucuguuuggguacuuccauauugcugugaaaauacuguaacaggaauaggcaaguuaucgacggcggaugguaaagccuuugcagacccugaagugcuccgcagguuaacaucgucugucaguugugcguuggaugaagcugcugcugcacuuacccggaugagagcugagagcacagcaaaugcagggcagucggacaagugagugcuuugugucguguuccauacaaacgugguuuucauaggaaugaaaauaacuaauauuuguuaagcuuuuuuuucuuuugccugauacugugucuacuuagugugauaccuuuuuuuguguauaugcccaaaaaauccauaccugucaaacuucuuaacaucaguucuauaaguaagcugagagagagaucuucaagucgguggagugugcaccagucuauaaguagugcuggcagcaguuagggucuggcuggcggcuuuguuaagagacuuugcugcuuuccucggaagcacugaguuuaguaccuggcacccccauugggugcugacaucucucaccagugguuuguacacacagaaacauacacauaaaauuuaaaaaucaaaauaagacuuuucauuuacuuagguugcuuuuuauguauuagugacaaagaagucacugcuagucuaucaauuguguuacuuuuuuucaguuuauuuguauaauuuagacccuuuuaaaggaugagguuuaguauuugcuuucuauuguuuuaaaagagucauaaaaccuuguuucuaauaaucugaaugucaggccaggagaccuuaacguggcucucaugccuuguaucugugcuuuuagucuuauuaaggauucaguguaaguaauauuuuaagguuuucuagugcuuuauaaugaaaaccauauuucauauguaaaauauggauguguuggauguguuguggagcaugaucgaagcaucugaagaaguagccucguccaauugaacaugaagcuauauggggagauagcacagugggugaaguuauugcugagcaagagugaggacaugcgugugacuacccaagcacaaggaaagccaggcacaggaaguggagacgagagaagucccagaagguugagggccugcuagccuguccugucucaacaagguagaagagcccugacugugaggcaauuauagaaguaaauacuucccuaccuacucauuuauuaacauuacuugcucccaucuugugauacucuuuuauggauguaagaacuccgguagguuuuuauaauuaguuaggugucuuccauauuuuaugaauuuuuuaauuucauauaaaauuucuagcaauugaacaaaaguuuaauguauauuuucguuucaacauuacauuguacauaacugaaaacauuuuagaguagugauaauuuuaauuagaugaccuggaaaccacuacugguaugaugcagguuuucugucaucccgaggugauccuguucaucucuauucccacuguagccgcagucuggcagaagcguguucagaaggagauguaaaugcugugcggaaacuacucauugaaggucggagugugaaugagcacaccgaggaaggggagagccuccuuugucucgcuuguucugcuggguacuaugagcuugcacagguuuguguccggaaaauaaaccuugaaaagaaaucucucagccgggcguggugacacaagccuuuaaucccagcacuugggaggcagaagcagguggauuucugaguucgaggccagccuggucuacagagugaguuccaggacagccaggacuacacagagaaacccugucucaaaaaaaaccaaaaaaaaaaagaaaaaaaaaaaagaaaggaaucucucauuuacuaagaaaagaaugaauuuuuguccauuaagcuaguuuuaguacauugcuacauacggcuuguauauauuuaacucugaggaauuuuacgaguuuauguaggucuuauauaaauaaguauauugaaaacuuucagauuuuauuaauaaucuuuagauucuauuuuuuucuuugucaagguuuuauuggcaaugcacgcaaauguggaagacaggggaaucaaaggugacaucacaccuuuaauggcugcugcuaauggaggacaugucaaaaucgugaaguugcugcuagcucauaaagcugaugucaaugcacagucuucaacaggucaugcaugcuucuguuccagcuccauuugcuuguagcuucccuuuuaauaauaguuuucuguaugauuauucccuuuuaaagauuuaacaguuucuuagaagugcuacauauuugaauaauuucuauaaggguuaacuauacaaauuuaauacaauuuauauuaauauauaauuauacauuauacaauuaacauauaauuuauaauaauauaaaguaacaucuccuguuuuguuuaugagacacucuuagguucuuuuaaaauauauuaauuuuuuaagcacucaguuugaaagacugcucuguaguuguagaaagguaugauuuauacgucucaaaaccuggcuuccuuuuuauuacaaguacaagauagggagaauaggaagaacaguaaggacuuuaccacguucuccuaauuuugcuaaauuguggccaaugaaaaaacuauaaaaagagguccaauggcccccaauuuuagccuuaaauauuucuaguuucucuggcucuaacaguuaugugaaauuguauuuugugaguuuucuugggauuaaaaaaaucaaauuuaguuguguuuuaaauaaaagucuacauaauuuuuuuuuaaacuuuuuuacuuaccaaguugggaucucuuggggaguuuuuaaucacuaagcagggaaucuuugcucauuguuuugucucaugccuuuuguucuaggacaugggaggcugagucaggaagguucuguguguuuagaccagccugaacuacacaacauguuccaaaaauaaaaauaugaaaucauuugacauugaucaguuagcauauggguuauauaugagagguuugggguauaauaccauuuauuaaaaauaaugcuuuaugaaacauuuuucugauuaaaguuaacuauaaucucauuugggaaggaaaaaguuaauuucaggaaagaaagucacaguucacuuacaauucucaaaguuuuuuuuuuccuuuaauuucaaaguaaaauauaaguauaucaaaguaauauaaguaaauacuucuacauucucuguccugccuccauuacuuugaauuucccuucuaaacccucuuaugucccucccuccaaucgcccccuccaacauuccuuuuuugccacucacuuucaaacuggcagucucuuuuauuauuaaauguuaccaauauauguaugaugcagaaauauggcugacugaguugacuuagcguggguugucuguguauuauuuuaguggugcacuuguuauuagauaaccaguuagagggcuuuggaaaaggcugacucugucagcagucauuaguugccuacaguucuuugucuagggcugggauccuuugagauuucuuauuucaguguuagugugucuauuagaauuauugauuguucaggucuuguuuagguagcuguuuuguugugguaucauggguuuggcuucccugucaucugucaguucuccaaucuugauaaguuuauuugauuuuucuguuauuugacauguauuuuguuucuguuguuuggugcuacaaggaauugaguucagaaucuugcaccuguuaggcaagcguugaccaaauaagcuaagucugaggccuuuuaguucauauuguaagccaggcacuaaccaagcuuucuaggcucucuuagagucagagugugacuagggcuggccuuagguuuuccauccuuuuguuuuagccuucucauaguugggaucaaaacccauccaccaggcacagcuugauacuguguuuaaauagaaagggaggauaggaaguugauuucagaaaaagaaaguacagccaaguaaugaaauuauauguaucuauuuaguguuuauuauggauacaguuuccacauuagcuuuugugauauaaauugguuuuaugugaaaaagcuuuacauuuauuuuuauuuaugugugugcgugcaugugugugccauggugcauguggggaaaucaaaggacaacauccaggacuuaggucuuuccuccuccuccuccuccuccauguggguccccaggaucaaacucaggccauccagccuggugguauguccauuuacaugcagaagcaucuuacugggucgaggugcacgugcaugcuuguguuugugugucugugagugauauuaacaucuuuucauuguuuucuuaaacaggcaacacagcucucaccuaugcuugugcuggaggcuacguagauguuguaaaggugcucuuggaauccggugcuaguauugaggaccauaaugagaauggucacacaccucuuauggaagcuggaagugcugggcauguggaaguagccagauugcugcuagaaaauggagcuggcaucaauacgcauuccaaugaauuuaaagagagugcccuuacauuagcuuguuauaaagguaucauuuaaaucuuuuugugaaaugaaauaaugaaauuaaaaucgguuucuaaauuaacaauaaaacauaguauauaguguuauuagacaugaguaaguuuguuuaaaguguuuuauaacuaauauuuaauauuguauagucucagcauuguaauuuugucaauggaagugacaauccaacucuuuuaucagaaagcugaugauuuuaugugguuacacuuuuugaugguuuuccauuuuggaaacauuuuaccuuuugcaagaagauacaugauaauuaaaugucaaccaaugugaaauuauuacuaauauggaauauggauuauuuggugggccaaauauguccaccuacaagaaaucaacauaagagauuuuuguuuguuuguuuguuugcuuuuuuuuuuguuuuguuuuguuuugauuuugauuuuucaagacaggguuucucugugcagcccuggcuguccuggaauucacuuuguagaccaggcuggccuugagcucagaaaccugccugccucugccucccaagugcugggauuaaaggcgugcgccaccaugcccggccuagagauuucuuaaaaaaagucaaagagucacaguuuucauacucuacugguaugacaaauaugugacuauaaagugaguguuucuuuuuuccguuuuuuuuuuuuuuuuuuaagauuuauuauaucuaaguacgcuauagcugucuucagacacagcagaagagggcaucagaucucauuauagaugguugugagccaccaauugguugcugggauuucaacucaggaccuugggaagaguagucagugcuccuaaccacugagccaucucuccagcccccuuuuuuuucuuuaaagaaccuaaaaaugagccaugcaacuuugugcuugcaucuauaccauggcacauuuaggucauaaaacaccauuucaucugaaguauuaagacaaagguuuugcaagugcagauacaaaauguaaggacccuucaggucuguccucugcguaaucaugucacugagggccuuuucacgccgaucacaugcucagccuguuauaugcugagauguguaaauaguuaagauuuacauuguuuaauugugagugugugauguuagcagauuuucauguagccagcacaauugaagucacuuacuguccucuccuaggcacaagggcugcucuucauuaaggauuggaggaguuaagcuuugggaacuuugauuggaugacuuuauacaaacacuuuugaacccaguacugguuccauugcauuacucauucccagcuggcuagagcacuuggugacagaucuugucucuuaccuuucuuuuguagccuacucuacuuucuagagagcaccuaagguugagugcaaacuuuaguuugaagcuaguuagaaaauuaagcuaguggaaugcaccuggaauacugacagggaucagugaacucuguuaguuucuuuuguuucuauugggauuacuugagaguuugacgagauaggaaagauauagacacagacagacuugaguauugauauauugaugagauagucagccuaaucaccagguaguagauagugugcuuacugucuuguuuuagugcgccuagggcuguuuuauuuuuuccuuucuggucuaauucuaguugauuauaaauugauuauaacucaguucauauuacucucuuacauaguuaguauccaaaguacuauuuauauauauaauuggucuacuuuuuagucacuuuuugaaguuucuuugaaagugugcauuucuaucauauguauuaguaauaaaagaaugcauauaauucaauguuuuaacaauacuuucauaaaugggguuuacaaauuauaaauaagaguccccugaacaguuuguuaguuguaauuuuaagcacuuggucucauaagguaauagcuucaaugauuuucaucccaggcuacuucucuugacaaauacauaaaauauagcacaggagccaaagagauggcucugcagcuagagugauggcuguucuuacagaggauccgauuucagugugaacacaccugccuggcagcucacaacuccagcugcaggggaucuguuagcuucugcugcucucuaugggcacugcaaucagaguacagacacauaauugaaaauggcagaaagaucauuugagauguugggacgugacaucuuuguuuauuugcaccaaaaaugaucuaucacuuuuauuuuaagaauaguuuuugaaaauaaguaaguaauccaacacaauuuugauuuaggacaucuagagauggugcgauuucuuuuggaagcaggcgcugaucaagaacauaagacagaugaaaugcacacugcucuaauggaggcuugcaugguaagauggauaaaaugcacauagauuuucguacuauugggagugggagagcuacugggaaguaaauagccuuucuuguuuugcaaaagcucuuauuuugucuuacuuuauuguggagcagaaucucagcugaacuauuauuuuuaaguuguacuuggugaucacauguaauucaagcauuuaggaaguugaaacaagauuauugcuguuauuuugaggcaagauuggacuauauagugaguaccagcucaaccaugguuauaucacaagauucugucaaacuauaaagaacugccagacaagauuucugccuucaaucccagcaguaagaagucagaaaccagugggucuguaucaguuucaggacagccuccugcccauagugaguuucaggacagccagaacuauguaaagaggaccaaaaaagcaaguguguguauauacaugcacgcauacacacacauaugcaugcacacaucuuugaaagcaaaauauaaaaaagaauuguauagaguuugucuuugaaauuuaaauuauguuaauacucuuaaaaauguuugcaucuuaaauuuauuuucuuuacaaaagagauguaucuaaaaaaaacuauaggaagauuuauaagaaauguuguacaguugucauuuaguacuuaaauuauauauugcuuuuuuauuuucagcccuguauuugcuuuaaugaauuucucuuuugugcauguauaaauuuuuuuggagcuuuugaguuccuugucuggcguucuuaugaggaucauaagagaccaacacacagcaacaauauugauguuuccaguaaucucucugauaaggaaauucagucacuguuacuaccuuauaccacaaaaauucgugguauuuagacagaggaauuuuucuguaaauacauauacuuaaaaaaaaaaaccaaaaucacaaauaaaugcaaauauuugggcauggaucugauacucagucucaauaaauaauauagauagguagguagguagcaagcauagauagauagauagauagauagauagauagauagauagauagauagcaagcauagauagauagcaagcauagauagauagauagauagauagauagauagauagauagauagacagacagacagacuuguaaucccaguuauuagucacaauaaaaaauaaugggugggaguucgggcugauggaugugaucaaaaggugcaugaaucgaagccaggcauugggagaucucgcuaaaaacuugaagcucugaauuuauggaaagcauuucaaaacugcuaaaauaguaauguuacuuggaaauaagacauuagaggugucagauaugucuuguucuuaggccaggguggauaugaccuuuagagcaaggcuugaggaaguauaugaaggauuaaaagaaacuaguuauugaaaggaaagcacaguggaaaggaaauucucauguaguugccaguaauaagcuaccuucuuuuucuuuucacuuguguuuaaauaaugaacaacgaacaaaaccucaugugcacauugcauuuacucauuucacacacgguacaguguauucuacgauguuugagaugcuguuuucugccugccuaaucaaguuugcucacucuuaagagcuuaugaaaaauuugcuuuucuguaucugagcuuuguuacuuaucaguuaauuguccacugugcucugcaggcucucugugaccuuagauuugucuuaauccauguacuugccauugcuuccuugauggcugauaagcacuucuugauuacaggcauccuucucuaauuugcuuuaaauccccaagcuccuaguuuuuaguucuguacgauaaaaggguacuggcaacacagcauauaauuacugaaaugucagauguagauuauucuagugugagggaacaucaacaaacuuucgugucaauacauaauuuagaaauuuuuaaauuugaagguuuuuuuuuaauggugcuaacuuaauuucauuuuuaauugcuuaugaauaggauggccauguugaaguagcuagguugcuucuggacaguggugcucaagugaacaugccagcugauucauuugagucaccauugacuuuggcugcauguggaggacauguggaacuugcagccuuacuuauugaaagaggagcuagccuggaagaggucaaugaugaagguuauacuccuuugauggaggcagcucgugaaggacaugaagaaaugguggcguuacuucuuggccaagguaagcacaucuagcuaaugcuaaauaacaaaucuauagaacacaagucucuucaacacaaguugaauuucugcacugagcuguugcucccaaacuucugcuuugucugcuguaaaaugacucacauacccuguuuaaacaaaugauguagaacuuucuucaauguagaacuuucaauauugugugcuaugagaaaauaaaagaacaaacaaaaaucaaguucaaauggacaauuuucuuaggguaauaugagguauaguucuugaagccuugaauguaaugagggaaaucuuuagagguagaacacuuccccauaaguaagugugugauagaaccagugcccgauggaggagcauggggaacacugcuguggagguuuaagccaugaaauguacagcaggccagaugaggauuacacacuguaaucccagugauaggugccugaggccaaccagggcuuauauggugacacucuaggaaaagcaagacaacacagaaaaccaacagguacaucggaaacuguuucucauagcaugaggaucuucuggaaaaagaaagguggucuaguaguuuaaauaccuuacauuuagaugauaauuuccuacuagauuuauuuuucauccaauaguauuuuuuaacauuguaaaaucugauccauuuaauacaaggaggcacauuuuuuguuuuuauguauagguucuuuugacuagaacucuaagguacagauuuuugaaaaguggauucuuuuuaaaagugagucauuuacacugugugguaauuuuguuacuuuagucaguuguuucuguggggguggcucaggaagcuccuacaacagugcuugucauauggugcuaauuaaaaucaacucugguguggugagaguaaugaugguaaugauguugccuaugguaauucaauuaagagaauuaacuucagcuugugcagccuuauguaaaaugcugcuguaaauaaaaccaacauaaggccuuagggauauguugcucagggauguaguacuuacucaauguucucaaggacuuguucccccugccccccaacagcucacacuugccuaauauggcaggccauggguucauucuccaacacugccccuccucuaaguucaaauuauguauauaaauguaccuucacagucuguacuuugaauaguguccaggaaauaguaaugacuuaauaaauguuagcuacuguaacugacauuguaucaauugauacuguaauugguaaaguaucuuuaucaccuacccucuuaaugcgaggggauuuggguaauguuaugacuccuuuuaguuauuacugguuccuuuuaaaacagauauaacaacugcauuuaucaaacacagacucaaugaauguacauuguuuuuauuuuuuuauuuccaagaguagggaagagauaucucuauucuuuuagauauauuucauuagaaaacaguuauguuuuguuuguaucugauuaaaugcaugaacuuccuuuaaguugaaucuuuauuuuaggagcaaauaucaaugcacagacagaagaaacucaagaaacugccuugacccuggcuugcuguggaggcuuucuggaaguagcagacuuucugauuaaggcuggggcugauauagaacuaggguguucuacuccuuugauggaagcugcucaagaaggucacuuggaguuagugaaauacuuacuagcugcagguaugcuuuuuguuuucaauuugggaauauauuguaugauguaaauaaguaucacagcauccaaauauguuuagguuguuuugguacauagaauauauuuugaaaaguuaggauaugcuucguguauguucugaauaauuuaccuaucauaggaaauacuugcaauuuuaacuucuuuuuaaguagaauuuuaaaguauuuuuuaacuuuuuuuuuuuuucaaaaaaauuuuuuuuguuugugguagacaugccacucacugugcauauguuaagggguagaggacacaccuugugggaguuagcuuucuuuccuucauguaggcugggggaccaaauuuggguggucaggcuuuggcagcaagugguguuaccagcugagccauuucuugcagauuucccucacacccucuaguaaagaggcugucagugugcucauucuaaacauggauauggauauucugucugauuuaggagauggggacuaucaugaagaaauagguuuauguucauuuuuaaaaaguaaucauauguaacuguuacaggagcuaauguucaugcaacgacagcaacaggagacacagcuuuaacauaugccugugaaaauggccauacggauguagcagacgucuuacuccaggcaggugcagaucugguaagcuuugucccuuaaaucuucaucuguaaaauaaggaaagaguuaaggcaucguagcacauuccuauguacucggaggcuaaagcaggaagaugcauaaaaguuuaagggcagccaaggcugccugaguucaagguuucccugcagugcaugguaagacccugccuaaucaaacaaaaccaagaaaucaauucaaagacauauuucuccuaccuuuguuagcuuuuuuccuuauuuaaauuuacacagucugguuuuugguuuuuguuuguuuuuacacauuauuuagucuuuagucuuuguucuuauuuuuguaguauuauucaguucacuaaucuuauuccuguuuaugcagaaauuuuuucugcuagagauaguucuacaaauuaauuuuccuuaguuguuuauuuaaggcaaaugugacuuauaagcauuucuuuguagguuggggaaaaaauugccuguauaaaaagcaccauaaaauguugaaaaagaaacaguauuuauauacauaaauuacuuagaaagguaaaauauauuguaaguucauuuaaugcugguuauuaagaaaugucauagggaaugcacagaaaguaagaaaggucagaagguguagcuaguuauuugauguaguuacuggcugggugggguuuggaaagggaggccuggaaaugguaugacaagagaugcauaauuggaaaaaaauuugucagaggaagucuuagagcuuagaaguugucaaguuccuuuguguaagggaagagcuauucucacuggagcacuuaggaauucaaauggaaccucaauuccauagggaguuuaagacuagacuucacuacaugaaacucucuuuuaaaaaguaauauguguuugaggagauuauaaucugagcauucagaagacuaaaguaggaguuucauauccagugcauaccugagauacggaaguagguugaccaucuacuuccugguaucuaggauuacagguguguguaaucaccaacuuuagucuucaaauuauuacaauagcacauaucuauuuuaauugaaagcauauucuuuuuaguuugcucauuacaugaaauauuuauaugugugugugcauauauguaugugggauaugcucaaaaguaagcccacuuuuccuuuugauuugcaugaaaagaguaauugacuauuggcuuuaguuaucaacugugguuugguuugguuuugguuugguuuuuaugcuuuuguuuuaaaacaggaacaugagucagaagguggaagaacuccuuuaaugaaagcugcaagagcgggucauguuugcacaguccaguucuuaauuagcaaagguaagcuuauguagagggauucugugugaaguaucuuccuauauguaugcuaaggcauguugacauuggaaggcuaaagaacaucuugugguuguuacaucucauggagaaggaugcucuucacauuaguaauaaacuuaucauauauacuaguugugaacuacuauaaaccaaauaaccccucuuuuuggagaaaggguuuuggaaacacauguagcuuuugcuguccuugaacucacucucuauagaccagcccucaaacucucugagggaaaagcuuaccugcucuuuccucuuuauacagaaagaugggagaaaagcauugcuuggucuuuuuauuccuugugaguuuuuuaaauguauuuagaccauagaauacuguguuugucauuuugaaaauagauuuuauuucugugaauuaaaguuacauguauaugcgguuuuugccuuugguuuauauucaugagugcagugcccauagcugccagaagagggcaugagguauaggugagaagccuggugugcgugcugggaagcaaauuuugguuccccagaagagucuaguacucuuaaccauugagugagccacuuuuuuuuuuuuuuucugucccuguauuuuacuuuuuuaacauaguaauugccuuugguauaacacaaccuuuuauuaucuuuauuuccccauauuaaaucuuuuaugaaagaaauauauuuucaggggauuugcuucagaauaauuuuguauaggagagaaaagaaaguuuuugaaacacaagaggcuguuuauaauuaaugagacugaguaaugagugcgugagguuucauugucccauuuucuuuagucuaugauuaucuccuuuuucauaguccucagccuguaaaaugagucagggaggaaagguauuucugcuuaguccugaguuugaugcuuggaaaccacaugcaagaaagagaaaaucaacuucuacgagcuguccugcuuccacacgcacaccgugccacauguacaccccuauauauuugcuugcaagcauaaacacuaaauaaucuagcaucuuaccauuggugcugaaagacugcaucagugguuaagagcacuugcaguucaguuuccagcacccacaugaaguagcucacaacuuccuguaacuauagcuccaguggguaccaauuuuagucuucuguaugcacauggggggaggcacauaaucacacauaggcacacacauauacauguaauucuacuaauguguucuccccucccccccuccucccauuuuuguuuuaggagcaaaugugaaucgaaccacagcuaauaaugaucauacuguacugucccuggcuugugcaggaggucauuuggcagugguagaacuacuuuuggcucauggagcagacccuacucaccguuuaaaaguagguaacucaaguacuuaaggcagcaucaugaaaacuucuucaucuugaacauaauaaaauuaucauauauaagcuauaccuguaaugacacucugaguauuaaguuaccugauguuaaugcaaaaacaacuguccuguauuagcuauuuaaguuaaguguaucugagaccuaacugcuuucuuguguguucauucuucuaggauggcucaaccauguugauagaagcagcaaaggguggccauacgaguguuguuugcuaucuuuuagacuaucccaauaaucuacuugcagccccuccaccagaugucacucagcuaacucccccaucccaugauuuaaauaggguaagauucaaaacuaaagcaccgcauauuuccuuuagcauuuaaauaauuuucauuuaaacuuuuauuguuuuuaacguucuuuguauaauuaugucaaggcgaauguauaucuaguagaacauuuuauuuuuggauugguagaauuauguuuuccucuuuaaauuaugaucaggaauaacaguucaauucauagucacuuuuuaaaaaucaaagaauaaggaaaguaauuuguaaauaugucauugucugaaauggauauuacauauucuuaacaguucugcaguuuauuagcaugauaauagaucgagcacuaacgagugacugucguccuuuuuccuuaggcaccucgaguaccaguucaagcacugcccaugguugucccaccucaggagccugacaaaccaccugccaaccuugcugcuacucuucccguuaggaguaaaggucaguuauacuucuaaagauuguucuuacauguucaggugaaaacaaaagaauaaccagcccuuacucuucaagagcaaugcacuuacuaaguuggaaucaguaauguuuuucaggugaaaguaagaaaacaaaaacuagcccuuaaaaauuauuuucaccaacgaggaaguuucuuaaguugguaucauuaaugucuuuuuguuuguuguuuguuuuaaaccaaugagaaaaagcaaguuucugggagggaaaauaggugcuaagagaaacucagaagagauucaggugguucuuuuugauggaauucugacuacuaaccaaaccuaacucuuuguaguggcaugaggcaauaaagauuaagaaguuggaucaaauauuaaaauucaauguaaaagcugguuuaacauagauuuauaucuuagauacuuuuuccucagccuaauauucaaagauauguaagauguaauacauucauuauaucuuaaaauaccaagguccuuuuuuuuuuuugacuuguauaugucauaccaugccuguucuuaaguauauccccaauuaccaguuuaagucaguuuuuccuuugaaaaguuuuacaugaagaaauugugauuuuuuuuuuuuaauuuuaauuuuaauuuuuuuauuuuuuugcaucuugguuuuggcuaccuguguucuuuuaccaacaaguaugcuauguguuccuagcagcucuuuucggucacuacaagcagccuguugucuuggcauucuuuucgguuguuucuaaaccuguuagccagaccagucuguuuuccuggcugucagacgguaacagaggauggcguagucuagcaucuuuucuuccagggacacuaaaucccaguucucuauuggcuaggcagcugugugaauaugcgaguuucuaucucuuuccuuugucagucuuauagaugguaggucccaacgaagacauauauuuuaguuggauuuuaauuucuugguacaucucagugguuuggguucucuuuguguguauguguguguguuuauaaaaggcacagcuauuuuauuaaguguggaaaaucauuuuucugaucuuaugaugaguuguuacaucugaccauaugaaauacuacacguagccuuagacuugacguaaacugcaccacuuaggugucacagcuuacaucccucuagugucuuaauuuuagccuugugguauuuauaaaauucugaacuuuacuuccagauguuacucuaugcacauaaaauacauacauucuauauuuaugauagagaagguggacuuguguuuaacuacuuaaaaguacauuucaccuucauggauaugauagcuuggugcauaacuguuggcacuaacccucccaacaguaacucuguaaugaggaugccauucacgugcacuucugaggggguuucuuuuucacacagcugcuucuaaacaaaaguccaacagccauuugccagcaaacagccaggauguacaggguuacaucaccaaucagucuccagagagcauuguagaagaggcucagggaaaguuaacagaacuggaacagaggauaaaagaagccauagaaaaaaaugcacagcugcaguccuuggagcuggcucaugcugaccaacucaccaaggagaagaucgaggagcugaacaaaacgagggaggaacaaauucagaagaagcaaaagauucuggaggagcugcagaaaguagagcgagagcuacaacugaaaacucagcagcagcuuaaaaaacaguaucuagaaguuaaagcucaacgaauucagcuucagcagcagcagcaacagucuugccagcaucugggacuauuuacuucuguugggguuggagagcagcuuuccgagggagacuaugcacgguuacagcaaguggauccuguuuugcuuaaagaugaaccccagcagacugcugcucagauggguuuugcaccaauccagccucuggcgaugccucaagcuuugccucuggcaacgggucccuugccuccaggguccaucgcaaaucuuacagaacuucaaggagugauaguuggacagccaguacugggccaagcacaguuggcagggcuggggcaaggaauucucacugaaacacaacaaggguuaaugguagccagcccugcucagacccucaaugacacgcuggaugacaucauggcagguggguuuauauuguuaugagcagguaucaaauaugauuugcuuaaggcgaguaagagugugccagcauuuuuuuuucuuuuucuuuuuuuuucuuuuuuuuuuuuuccuuuuuaaaaaaaaaaaaaaaacauugcucaauauucaacuugagaaguauuuuuuuggacucuugacccauuaugucuuuagaaaaacuacauuaaauaguucucagauggcuacaggucaaauuaaagauuagcucauacacuguaaaugaacaaaucugucauggcugggaaucuguuuuucaguaguggguugaaucuugguuuuuacuuuugguuuuguuuuuccacuuuaaguucagaacacggguuggguuuuggcauuuuugcuucuguauucauaccaauaaaagggaaauugauaaaaaucuagguacaaagguaguaggacauauuaggaagucuacuugugauugaacaaaaacccaaaacuuuuauacuaauguaccaagcuucaugguggcuaaagacaagcaaacaacaaucaaagcagacacuuugacaacauaaauaaaguaucaaacaaguagagucugauuuuacuguaugucaguaauuuuuauccccugugaauguuaauguauagucuguuucugacuguauuaugggaagauauuuuccccaugguaaaugacauguuuuuaaauguguagccaguaagauuuuauucuauuuuaacaaggacugcacuuuaagaagaguguuaauauugcuuauuugggauugcaauuuuguaaauuguuuaacagaguagaauaagauuucauaaggauauagguuauaagaaugcuaacugaaauaauuuuucuucaggaagaaaacuugauaaggaagggagaaauaaauaguaaaugguuguugaauuuugauacguuucuucugcuauuuucccauuuuuuacauuuauuuguuuuuacuuggguuguuuaguauuucuacuuugaaaacucugagaaacauuuauuaugauggagucauuauuguaagguuccuuucuugaaagaaaauaugcuguguaguguuuagauguuuagauugagauaacauuaagaaacugagaaaaacaaguauaugcauuucaaaaacuguuauaguuucccaauccuuuuauuuuuaauuuucuuagcaauauguaauaugaaaaucuguuagaggcuggagagauggcuuaguguuuaagagcacugacugcucuuccagagguccugaguucaaauccaaaugauagcuuacaaccaucuguaaugagaucugacgcccucuucuggugugucugaagacagcuacaguguacuuaguuagauacuauaauaaauuuuuuuaaaaaagaaaaaaucuguuaaucuuaagaguaaaacuacaccaguaagauugcuaguagugacuuauaauaagaauuguaacaaucuuaauaucuaucaguauaagauuuuccaaaacuuaaagcccuguuaaucaucucuaacuagucaugauuagauaucuaauaaacuuuaaagacuuuaacauugaaugaccaugcauaguagcauaaauuaauacuauguccauuaaguuagauuguaauuccuuauuaucucagguuaccaaaggguuuuaguuaaguuuuaaguguuauuuauugaugaaaugaagacuuggucguucuauaccaaugacuguuggaaauuuguuuuuaaugugcuaucagaguuuaccugauguucaugggcugauguaaaaauuuuuaauucugauagucaucagauguuuguaaagcagcauuuucuauugauucauuuauucccaaaauuucugucuguguguucaagauuuuuccuuuauaaaaguuguuuuuguuuuguuuuguuuuguuuuuuacuugaaugaagauuagauuuuagaguuacgacaaauuuguuauuuucuaaaaagguuacuuuuguaucaugcucuucuguguggguaaagagaagugccuagcagagaaagaacagaauuaaucuuacugucugccugcagaucauuccuaccuaguaucucauucguauucacaugcugugcacauacaugugugcacucuuacacaccccuuuucuguauucugauuguuugaacaacuucugaucguauuuguccuuugaguugacuaaagauccuuuucaccucuuauguugggcuucguguguaaugaagccucaauugggcuucuucccucagcacuguccccuaauuccuuaggucucauuuguuagguuucuccuaggacucucucauuucuucccaguacuuagcuggcuaagucuuuaaccugccuuauuucccauacucaccaaagcaaaacuggguacuuguuuaacuuccccuaaaacaugcuuuuguucugucuauauacuuuuccaaucccacuuuuaacuuuucaaacaugugguuuuuguucucuaauuugaauuuuaaaauguaaagaaaagaaaacggaaaaaaaaacagcuuaauacuagaauuccuuuagcuauguagauguuuaaagcuuuuucuuuuuaucuauguaguacaugguggaauggugagcacuuacucuugauaaagcaguuucagagguacuccaaaggaaaugaggguuuuuuucuucaaaacuuuagaugagaugaaaagaauuaauuugaaacauuaaaaguaguuuuuuuauguucucuaaaauacauuauuccaguuggaauguggauuaauuugcuaauuuuuuaauccauuuaaaaaucauagaauaaaaaguuugugagggcuaaggauauagcucaauugguagagagcuuguauagcauccauauauacccuggguuugauccccaggacucaauaacuccaccuguaguggaacaguuuuacaauccugguacagaggagguggagucagcaguuguggacauucagggucauuuuuagccauuucuuuuuuuugaaagccuguccaaaagaaacauguaaucuaucuuaagagcuguagauuuuauaugauuuugaaauucauauauaggauaaaaaauuucaaugaaauuauuugauccuuaagucugugcgguggcucgugccuguaauaccagcaaucuugagguagauucaggucagaauugcaagacugacaauaaauaaauaagccaauccugaacaguuucagagccguuagauaaucaguaguacaugccccuuaucuuggucugcuuccuuaaugauuaaaguguuauguuugguuuuuuuguuccuuguuuuucuuuugaccuuuaaguggacuaaaaauguacaaucauagaguuuguguugcuauaauguacaguguauguuugugccugaccuaaggauuauauguaaaguagauuucuuaauggauagucauguuuauaacuguuggaagaucaauuucaguauuauuuguggcaauauaaguucuuuuugccugguuucagauucagcugugaaacauaauuguuuucugucuguagccgacaauacuugggaaacacacaucuacacucuauucagagauuacuguccaaacuuaauacuaaugcagcagcauucuuacugugggugaagagaagauguucucacauugacuucagaauugaguuaucuggagaauaaaaucccuuaauccaacuuccagucuguccuaugcuucuuuagcauucuccaccucaaguacagacuagccauuauuugaaucauauagugggugaaauaagaucauaccagauuuccuacauagaaacaucaggguccauacugggaggaugauuguguaaaauauauuuauuucuagccuaaucuuaauuuuguucugucagugugauuguccgauugaauguaagacacuuuauuccucucagaauaauucuuaauguaagaaaaucuauaucugugugagagucaaacuuuuauaguugagaaaaccaucacaccguguuucaaaguuacuauugcccuguaguaguuaguauauuuuguguuucggguaguuuuacuuugaggaucuuccaucccaaaaaugaaguaacuuuuauuugcuccaaaauauaagguaugaaguugccacuuuuuaaaaaacaaaacaaaacacccuuccccuuucauucuaucauuuauuccuuuucuaguaauuuuaguacauaaagcuuuuguuuucaggauuauuuugauuggaauauuuuuuguuuacuuuaaauaaaagaaaauuugucuuucagguggauuuuaugggaaguguauuaaucaauauacauucuaauuugggguucuccuccaaucaaaaaucaucagagaauuaguuauaauagcauuuuagagacauuuuguugcaaaaacucuuuaauacuuuaaaauaucucuugcuaacaguguuuccuccuuauuaagugcaguuauuuuguucaacagcagucaguggaagagcaucugcaaugucaaacacuccuacccacaguaucgcugcuucuguuucccaaccucagacuccaacuccaagucccaucaucucuccuucagccaugcuaccuaucuacccugccauugauauugaugcacagguaagcuccgcauuuaggaaagaugguuuuccuggaaucacacugcuuuuagugaucuuacacaucuaagauuuuguugucagagacuccagauacaauuaaaaauuaaaacccauuuaaaaaaaaaaaaguaucaagccagacaggcaugguggcucacaccuaauuuugcauuuagaaggauaaauuauuauuacaugaguucaaggccagccuggaccuucauagucagugccauguucuggcugaguuaaaacuuuaggguuguuuguuuguuuuucuuuucuuuccuuucuuucuuuucuuuuucuuuuucuuuucuuuuuuugagacaggguuucacugugaagcccuggcuguccuggaacucacucuguagaccaggcuggccucaaacucagaaauccaucugccucugccucccaagugcugggauuaaagaugugcgccaccacuguccagcuaaaacuuuaguuuuuaaaagacuagaauauaaaaggaguauaaaagcaagauuaaaaugaaaccagagcugugaucccagccuuugggaaguuggguagagaggaucaggaguucaaggucaugcuuaguuguguaaugguugaagcuagucuggguugcaucacacccugucucaauagagcaaacauuaggauugcuguauaucuccuuaaauagucaauggaguguuuauaaaagaaaaggcuggggcugagacuguaucaguggaggaacacuuaaaggccuggguuuaguuucuagcuucaaccaaaggugauucuguaacuuaaucaacuucauguuucugaacauaauauagucuuaguaacuuuucccccuuaagacgggguaucuguauagccugggcuggucucccagcaaucuucuuuaagccuccugaguguuaggauuaggcaugaauaaccacaccuggcucuauauuauauuuuuaaauuaugauggaauuacauauuguuuaugaggaaauauauaguaauuuaugcaauuuuaacuaauagcagauucuauugagggaauagaaacacuuucuuuggauuaagaauauauaugaagugaaaaaaagauacuguuacaguuuagaaagggugagcucuauuaaauaagcugcugcauuaaaaaaauuaguugcuucccagcauuaaggagauggaggcaggcggauuucuagaugaguuuguggccaguuagggcugcauaguaagacccugucuaaauaagauuaguugacugucaauggcaagacuucuuagugguuaaagaugcuuuucaucaagucuaauagccucaguuugaucacuauaaucuaaauuguaggagaauaaacccacuuaccacuuuucuugugaucuacaucuguacuaugccauguguucucacacacauacacauauagguagguagauaaguagauagacgcauacauacauuacauuacauauuuguaaauucagcaugaugucucagggcaagaugggauugacaaauuugcuuguuuauaucuugacaaggccaaaagauggcagguacggugcuacaagccuauaaucucagugcuugagagauagaggcaggaaggcuacauaguaauucugagaauguccuggacuacagaagaccuuugucucacaacaaaucaaugaaguaaaauuaaauuaaaauuuagaaagaaaagacgaaaagauuaagaagugugugaggagagagaggcuauuaaaaaagguaaaguuauggugguggagugauggcucauugguuaaaagcacugacugcucuuccagaggaccccgguucaauucccagcaccugcauggcagcucacaacugucuguaacuccaguuucaggggaccuuguacccucacacacaugcaggccacaaaaaaaaagaaaaagaaaaaaaaaagaaaaaggaaaaaagguaaagugauaguaagaaaauguaggauuuugaugaauaucuggggugaagaaguauaugcuguuaagacuuaaaccagcuuuuuauaaauuugaguuucgaggaauguguguauauaccauuaaaaccauguauuucagagcuauagcaguuccuuuuuauguauggguuuguuuguuuauucuuagacagggucuuacuguauagaccagacuagccugaaacucagaaccgccugucuuugcccuccuaagugcugggauuaaagguguguauuacuaccagacucacaccugguguguuuuaacuuucuguuuauuuuguucgguguguggguauuugaacagcauguucuucucuguuccacaagcaugcuuggucucuauggaagccacuagagucugugucauaguuuucugaaacagccagccaugagcugccaugugggugcugagaaaugaauguagguucucugcaagagcaccagguacacuggcucacugaacccucucucuaggcuguaauguugcuggaggauaaagaaauccugcauuccucagaccacaccacuuacuuuacuaucuggaauagaaaagcauuugguuggucauuuggcaaaggaggaaaaagcgaggagccugacuuuaaaacuacaaaaacaaugugcauuuauauuuauuauugaucaaauaguagaauucaguaaaacuuggaauugaauaugcauuauuucccuuguccuuuugauuuugagacuauugcauuugacccagaaguguguucugauuuuuaggggaccaggaaacuguguaggggcccuuaguacaaaguuaaguucuuguuuuccaaacauuuaaaaaugaaaugagccuaaaacugugugcccaagcacaaugugauuuuacugaguguuaaguuauuaaugauaaaauuauuuuacucaaacacuuaagcaacagcuauguacauuaauggaggauuuacauaaauuaaaauguacuuuuguuuauauauaaagauuugacugacaguugcuaggcaguggcacacaccuuuaguccaagcacucacagaucucuugaguccaaggacagcuagauuacaggacagccaaggcuaaaacaaagaaacccucucuugaaaacaaaaagugaucugaugauggauccuuaaaauacucauguuugggaacuugagcucaccaguuaggauugucuguugcucuuaagugggucccacuguuuuccagcaucuacauggugguucacacccauccuuaucucaaguuccuggugacccagugccuucuucaggccucugagggcaccaggcaguaauguggcacacauagauguaggcaaaacacacauagaauaaaugaaucugaaaugaaugaaugaaugaaugaaugaauaaauaaauaaguaaauaaauaaauuguuuuguaaaucccugucugguuucuacauugagccuuuaaaaaacguguugcacuuuugccuaacaugacauaaguuugcuauuugugcuuaucuagagauagaaaaaaucuuugcacauuagaaaacaaacagaacagauaaaaugauaauuauuacacuucuuccugauuuaguuauugaaauugauuuagaaauuuugcuucugugucaaggagguacaucaauauaaaaguuaaauucuuuuuuuaaaaaaaauauaaucucuaaaaacacuuaauacuagaauaaaaaucccaucaacucuaauguuaauagguaauuuguaugaccaaaaugugcugaacacacaaaugaucuucugaguacuaccaaacuaaagagcuacuaugagagauugaacauucucaaaugggauaaaauguccagguuucuuuuaauuaguacuauucagagguagagguccugaccuugauuucuagcacaaacuaggcaaaaggcuuuaugaaguuguaaauaaaauuuggagauuaaagugcaguacucacaaauuauuucuuguuucuaugaaaucugauugacucuuguagacauggagguaaaagaaagaacuaguaguuuugcucacgguuuguaaacgcuuguauuagccucuuugcugucauauguacauuauguaugucugaacuucuugccuuuauuuuuaaacugcuauggacuuuucucaaguuagaaguaauaugagaagaaauaauuuuuauaauguauccauuauuuccaucuauuuacuaucucuucaaagguguagauaugggcuaggacuauggccuaggugguagaguacggccuagcacacaaagaauacuggguuucacacccuagcaccauauuaauaaaccuguuaugaugaucuauaccucaaauuccagcacacagguugaaucaggaaaaucaaacguucagugucauccauuaguacagagcauguuugaggccagccuggguuacauaaacuaugaaguuuaacuuggcuuaacaucaagacucaaauuauagcuggaugugaauuauaguggggcauaacagcacaugccugugauccuuagacuuugaagguuggggauuaucucaaguuguagguaagucuagaguucaaaauguuacggacaguguuccucccccaauuccuaaagagauaaaacacagcuguaaaguguaugucauugucuuuuaccucaauugccuaagucuuagguagauggguuuuuugcuuguuuuuucuguuacucugcauuuuguaaucuagagaagaguuucacuagagugauagaaauaccugaggaggcaauacugugcauuaaagucuucuacuguguucugggaaaucugaggcagagggauugggaguuggagccuggcauguauuaacaagacucugucucaacaacaacaacaacaaaauaguuuaauuuaaaauuguggcuuguauuaguuggagagacucuggguuuagcacuugcuguuuuugcagaauaccuaucacccauguggcagcucauaccugccucuaacucagguucugggagaacucauacccuuucuuagccccuucagcacacagacagagagguccugagggcagccuacauucauucugucccugcuucauaagaauugugcuuagaaaagcaguucauuaaaauuaaguuuaaauuuggugauuuuucucaucuauuugauaccuuaaaauguuaguuuaguuaaacuugcacaugauuuagcuguaucaggagaugaaauauuugaaauugugaagguuuucuuuaugcagguauuuaaaaguacuuaggucuuucgguccuuccugguuuuaaauguaaauauuuagaaauaauaggcuuauuauuaaauaaucgaggcuagccuggucuacagagugaguuccaggacaaccagggcuauacagagaaacccugucucgaaaaaaaaaacaaaaaacaaaacaaaaaaagaauagguuugcuuccuauacuagauuuuuaaaaauuuguauaauaauuagcuuauugaagguuucauuuuccuacaauacucucauguuuuguacuccuuugaauuaagucauguguaugguuguaucaccuagucauauaaauaguaaagguguuugucuguuuuauucauuguuuuugagaguuucucacuguauaucguuggcuauccuagaacucauuauauagaucagacuggccuccaacucaaacauucaccaaccaguacccaaaucucugagagcuguuaccaugccugguuuuuaauacaugcacgcacauacaaacacacggcguuauuuuucuuuccuuuuucuuucuucuucuucuuuuuuuuuucuuuucccuaugcuugagauuuuaccuuagguacuugaaauaaugcaguaccuguuuggccaguauauagugugaaguccguaaaggauccugaccucucaggcacgcuuucuuucuuuuuuugcacuguaaaucauuguuaaaauuccaguuuguauuaauggaguauaaaagcaagaugauaucaauuggaaauugugcacuuugugggauagaagcagucuucagaacuuuacaguucuuauguuaucuucaaaucuuagucccuuuaaguuauuaaugagagaaauaaaacagagugggccuccuccuccuuuuaacuaacuucaauucccuaaaaaauuugacaacucuccuuacucagcuuuaaaauuuuuuugauuuuucaaaauaaauaguucuagguguuuuuuuaaaauagcuuuuacuuuaauuacuuuaaauuaaauuaaauagucauugacaagauccugcggaauccucuacuuaucaaccuaacauggaacagagcacuugggggaaaugaugcuuaaaauuaauauuaaauauauguuuuaugaugagggaaauauguuuuguugaucaccuauuuuuucaugcuugucuuuuucauauuuuauauauuuuauauuuucuauauauuuuucugcauuuaagugggacauugcuauuauaaauuacucuccagaagaauuuuuacaccucauaaccuaaaccuaucuguagauugcauauaaauacagagacuguggguaggguaggacagguauuuuuaacagucucagaauacuuguagauuuucuuugugauacgguuugauauauagaguguccuucuuuaaaagcccaucuuuaguagacaguuuaauguggccaucaaaaucugaguuucuguuuccuuuuuucugaaauaagacacaguuucuuuucuuuccauuuuuuuuuuaauguaaaacaugaaaugaagagcauauacugaaacagaacugugacucauugacguuucauguccuucuccauuguuguaguuggugcgucucucccuuguggccaccccugaucucugcagucaguggcugugucucugccagcucuucugcagagcaucuauuguggcucccucuccaucacugacuaauaggauuuuucucauuucuugacucuugaucaguuacacuuuuugucuuguuuuuaguuuuuuuguaauggaauuuggcacuuauaguuacuaggaggcuuuuauuauguaaauauuaguguagaagaacauaaauauuuuauauaaaucuguauuaguaagucuuugguuaugugacuuuuuuacagcuauugucauucauugaacauuccauugauguuuccugaacaaaaaagagaaaacagcauaaguuccuuagcuuuuuaagaguuccaugggcaccaagucuuuaaucccuaugcaugcacagaucucugaauucaaugcuagucuggacuauauauagugagagccucucaaaaacaagcauaacaaagacaauuuuuuaaaucaucuguggauagauaaacacuaugguaauagaauauaaacaucuuuuaagaugaaauggagcuagccugauacaguugcauaugacagugauucuacucuuacugaguucaggugggauugugaguucccaggccagcuuuagcuacauagcaagacaaaugucagaacaaagaaaccacaaaggaaaguagagacacauaauuuagaacauuuuuaauuacuguguuaaaaaacaagaagagccaugcaugaugacacauagcuuuaaucucaguacucaggaagcaagucgugucugucuucagagugaggccagucccccaaagaaaacccaccauaauacauugggaggcagaggcaggcagaucucuguaaguucaagaccagcccuguuuacauauagaguuccaagagaggacuacauagacccugucucaaagcaugacuuaaaggauugcaaagcacauggucaguuuaucaccugagaaugguuuucguauugaaagaccccauuacagaggcuccucuuacccaguuugugagcuugucagacuucucaauuuuauacauggauuucuuuuggaaauacuuuuauuuauauuuaaauccaacuacauaguggaaaaaguacauucacaucuucauuuuuuucagacuaccuaaaacauuuugcaauguuuuagucagacugguuaaguuaaaaaaugcuuugcaaaccgaaccaggcaguuuucugaguuugaggccaaccugagucacaaagaauauuccaggcccccaagagcuauaguaagacccuaucucaaaagccagguacaguggcauucagcuguauucacagcauucauaagugaguaagauccugucucaaaaagaaaaaaaaaggguugugaaucuguuaguauucacacauuacuccagaaguuaauagcaugauuagccuucaguuuucaaaauacaguguguuucacguguuuuaucucuuaaagaauuuagggccuuuauuuacaauuagguuacuugaaaacaauuguuuuggguuuuuuucuuuuucaaagcagaguuucuuuguggaacuggcucugccucugccucccaagcacugggauuaaaggcaugugaaacuaugccugcuacauucuuuaaauuuuaaggcuuuuagcuuggggugguuuguggcagggaaggggaugucaaaacaaccaacuuggucucuguauggaggagucuucaucuuguaugcuguaaauuuuucugcucuaacuaguaguccucuauuccuaaccuuuuguucccauucucaauguuauaccugaucuuuucugcugguuuuucguucucgaugauuauuuccucauguacacaggcuagugaaaaucgccugaagccaucagaagaauucucugcugaucuucagagcacucucucuguaguccuuuccucuuuagacucuauuuucagcuaggcucuggcuaccugccauuccuacauuugcauuucuccgcauuuuuuccuuuggaaccaccuaucuacccauaucucaacuaguguguaugugaagguuugugcauguaugcacgucuauauauguguguguauauuuuauauauguauaacauauguauauauauauagcauauaaauuauagaccagguauggugacaccgcucuauaaauucuaauaguaaagaggcagaggauaaaggaaggaaugauaaaaguucaaaaccaaccuaguacagugauguuccaucucaaaaauuuaaacaauguuauuuaaaaauagugaauauaauguuuuaguagccuuuguacuauguaagucacugaagcuagcauauggaagaggcuucuaauuucagcacuccaguggugaugaucgcaaugaaaaagaguucaaggucauccugaacuaaggcaaaucugagcuaugaaguuucagaaucaccacccuaaaagaaaaacaaaccauaguuuggcuagucauugauagaagaguuguuaguaaaccacauagcauccuaguacuugaggaggccugaggcaggauauuguacauuccaaccuagcauggaccacagauuuugauguccucacauaauagagugguacauauguaucuuugugcuucucauuaacacuggaaaguauucagauaaacuaaacugaucucuuuuuuuuuuuuuuaacagacugagaguaaucaugauacugcacuaacacuugccugugcugguggccaugaggaacugguacaaacacuacuagagagaggagcuaguauugaacaucgagacaagaaagguagcccuuauuuuugucaguuuuucuuuauggaauguuuauagaaacuauguauuuaucaacagcuuauagccaaguauuggugcuuagguguauuggaaaagaguuguuacugguucuuugcuuaacauauaguaagaugaucuuuuucuuuccccagguuuuacuccacucaucuuggcugcuacagcuggucauguugguguuguagagauauugcuggacaauggugcagacauugaagcccagucagaaagaaccaaggacacaccacuguccuuggcuuguucugggggcaggcaggagguaacuuuucucuuuagcaaauaugaacucauauauuuguuuuccauauaggaaaauauuugccugauuuauugaaauuacuguauaggaauacgguuaauacaauguuccgagaaaagucauauauuguauaggggaaacagguuaaauacaccaguuauacuaucuuuuuggagucacaacuuuccaguuuuagauuuagaaauugcccugucauccauguaguuuccuguucaguguaaaaggcuuguugagcccgccugaggacuccagaucuccaggcaggaggggagagaggcuuucugaaguuuuccuuugaccucccccguucucgcugcugcacaugcucacacacaacacaaauucuauccaauguuaaaucuagacgguguuacaauuucuauccauugaaaaaucaggagcgugugauggcuuguaucuuuaauauuaguacucuguaaguagaggaaggcaaaucucaggcuuguagaucaacuuggucuuuguagagagcuguaguccacccauggagacagugcacauaacaaaaccaacaaaaccaaaaaccaaaaacuuuugucuuaguguacuaaugcugugaagagacuacagcuauuauaaaagaagacauuucaguuguggacuaccuuaacaguuucagagguuucguccauuauggucauggcagcauucgaagcuguaggagcucauuucugagagacucuggguuuggugugggcuuuggaaacuugaaagccuacccugagugacauacuucauccagcaaaggccacaccaccugaccccucucaagaagcacugcucccuuaugaccaggcauucaguguaggagccuaugggggcuauugcuauucacaccuccacaguagcuuccugucaauuccuaaucaugauuuagcuugaaauauccauuccagauagaaguucaguggcagaaaauuuugcaguuaagucuucuauaaguccuaaucaugaguuagcuuuaaauacuacuuucacaaauuaacagauauuuuauuuuuaaaccagagaaauguaaauuaauuuccuugauuuuaaaacaauaggacauacuuuuuuggguuauuuacaacaaaaaaaaacaggugggcuagagguaaacuuauuaauaaauaugauugauuagcauguuuaaggcauuggguuucaacuuaauauacaucaaagcauaaccaagauauaaguuacuucugauggaaaacucuugccuauaaacacauugcucuuauuugguaucauuacaacagguauuuugaaauaauuaguaugaucuggaaaaaucaauauaaaauuacaagaacauugccuuuacauaaugagauuuagaauuugcacacauuuguccugugauagguacuguagaacacucaaaauauuuaaaacagauaugcuuugugccuguuauuggcauaugcuuguaaucccuggacuugggaggaaaaguagaagaauuaauguaagcuuagccuauauaguccuaggucauggcuauacaauaaaacacuccauuaaaguaaugcagaguaggcuuauggcuaggccagcauacaaagcgacuugccgcagccugacuuaugauuucccacacacaugcugauuaacaaauuuuuuuuuuuuuuuuuggguuuuuuuuugguuuuucgagacaggguuucucuguauagcccuggcuguccuggagcucacuuuguagaccaggcuggccucgaacucagaaauccgccugccucugccucccgagugcugggauuaaaggcgugcgccaccacgcccggcuaacaaauuuuauaagaaaaagaaagaaacaaaacaaaacagaaaaauagcucauugugucaaagugcacaagagacucucugccucagugagauggaaacugagaaccaacuaaugaaaguugcuucugcucucugccaccuuccuuaugaggcugcauaugugcaaccauacaaaaaaaaaaaaaaaaugaaagccacuuacucuugcuggcuuuaaugaaaguaaucuauaucuuuaucuaaauaaaugggcuuuaacagacacgucucugaauggccaaaaagcucuugauacucaacauuuggcucucagagaaaagugcacuugagucccagcaguagugucagccuuagcuccugcauuguugauggaguuauuucuaacugcucuuggaauaauuccagcugcaucuuagagaauuauacauccaagacaacuauuaguaguuaagauuuagugcugugcccacaggcacagacuaauauauuaagguuauuuagguugccaauauauggaaaacaauuuucaacucuucuguuugcuuaacaacaacgacaacaaaaaccaccauacagauugccauuagucccagugcucaggccugagaggcagucacaucuuauccauuaucagccuggccugcaugguaaucaccauguccaaaaaagaggagugcuugaagugauucauguguguagauaaaauggaucuuggauaauuauuuuuguaaauauagaaauaacaaaaguacucauuucugaauauucucccaaacuuuugggguuugaaucuucugugagcucuuuauaaggcuguugucaucugaggcuguaagaaugaaagaacuuauuuccuuauauaacagaaaccggaaagauacaucuaaaauuaucauuaucuuuagaaaacauagucuaccuuuuuuucccuccuuuaggugguggaguuguuguuagcucgcggugcaaauaaagaacacaggaauguuucugauuauacaccucuaagccuggcugcuucugguggcuaugugaacaucaucaaaauacugcuaaaugcaggagcugagaucaauucaaggcaagcuuuacuugucuauagaaauuucauuaagaauauugugcuauaaaucuuuggagaaugcuguuuuagugguuuaaacaguuuuuuuauaauuugaaauaaaaauuuaagauagguuuuauucaaauauuuuaaaauguugacauaacugaaaaauacaaacugcuguuucuuaggguacuaaaggcauuauucugaaacagguaaauauuugguucaucaucauaggauggagaauuuauucccuagcuaguuauuauaugccaucuacuaagaguucucugaggaaguuuuaauaguaucucaaaagaugcaagggcucauaaagguaguuaaaauuuuaaguaauccuauagaaucaagaguuuagccagacugggugggugauccauuccugucaucaaagcauuuugggagguugaaucaagaaaaucaggaauucaggucauuuugagcuaccguagcuaguuagucugucucaaaaaaaugcaggaaaauuuuauauucagguuuuuuuaaucuuugcuauaccucugcugugacacaaaguuuuuuucauuuuguucucucauacuuuuuaauccuagaacuggcagcaaauugggcauuucuccacugauguuggcagcuaugaaugggcauacagcugcaguuaagcuccuuuuagacaugggcucugacauaaaugcucagauagaaaccaaucggaacacugcccuuacauuagccugcuuccaaggaagaacugaagugguuagccuucugcuugaucgaaaagcaaauguugaacauagggcuaagguaagaaaaauacugaaauuuauaguguuuacucuuagguacugugacaaaauaucuaagaaaauaauuuuaaagaaggaaaauagguuuauuuuagagguuaugauuucauuacuuucuagccucaugcaaaugcgcgggcauacauuuuuuuaaagguacuaauaaguuauuagcugaaaauaaugugguuuuguaaaggucaggauacguuaugaagugucauucacaucaacgaacuuguaucuuguacagauucuauuccacuaauuuuagguagaauuaaaguuuuaauuagcuguaacucaaacaaguaucaguacagauauuuauggauauguggaaacuauaccauauuguucccucagauuguuaacauuuuggcuguuucuggucucuuccauaguuuguuuuuuuuuauuguuuuuuuuuuuauuuauuuauuuuccauuaaaccuagacuggccucacaccauuaauggaagcagcgucuggugguuaugcagaggugggccgaguucuuuuggauaaaggugcugaugugaaugccccuccagugcccuccuccagagacacagcuuuaaccauagccgcagauaaagggcauuauaaauuuugugaacuucuuauuggcaaguaugucaugagcauauucuuuguguuauauauguguguuaacauucugagggcaaugucacuguguuaaaaagucaaaugcaaucuacacuuuccucuuucuuugggcuucagguugacaguaacuguucugugucagacaguugcaauuuuaguuacaugauagcuaccugucaguuuuccagaaaaaugcuuguggguuuuggcuuuugaacuuuaaaauuuuuaaaagacuuaucuguguguaguggcacgugacuuuaaucccagcucuugagagacagaggcagguagaucucugugagauagagacugaacugguauggauauucccucgcaggaugcuguucgucuccuugacacuauuuauuuaaggugcugaaugaguguucagaguuaguaacuuuuuaaaaggaaagcacauugaauauauaaauguuuaauuugacagaaguucucuguaauacaauuuguccugaauuuuuuuccucuuuaaauuuucauggcaguuuauuuuuacugcugccccaucauuccaucucauguaagaagcugucuuccauuuccaggggagcucauauugaugugcgaaacaagaaggggaacacuccguuauggcuagcagcaaaugguggacaccuagaugugguucagcuacuggugcaagcaacugcagauguagaugcagcagauaaccgcaagauaacuccgcucauggcugcauuuagaaagguaguucuuauauccucauucucuugcagcacugcacauggccaguugugugggagaacacggcuuagugauuauucugaacuuaguucugugauguaauaacuuugaugaaagcaguaauacuaugugcaaaugagaugcucuacuugcaagccaaauagaucuaauauuucaaaaauccugcaaaugugauucauauuggauauuaaagcuaaggauaguugcaaagauauucuagggugacuggcuggaugacuccgugaguaaaggugccugucaugaaagccugacaacuccagaauuguccucugaccgcuacaugcaugcccuggcauagccgccccacccuccaccccaaucauggguauauacacauggaauaauaaaguaaaauaaggcauguauucuaagguauacauuugaaaucuaguuauaauuuugucucacaaaauaacauuuggaugauuucuuacauucccauuaaacaguaaguuuuauuguugguuuuauucauucaccuggguuuucuguuauuggcuugguuugggcuuugucuuuuuuuuuuucuuuuuuaguuuggcuuugauauggauucucacgaaguugcuuuggcuggcuuugaacuuugcugcaacuuacagauuauacuuuuuccucuguauaagagugcugggauugagcuggagggauggcucagugguuaagagcaccgacugcucuucugaagguccugaguucaaaccccagcaaccacaugguggcucacaaccauccguaaugagaucugacucccucuucuggagagucugaagacagcuacaguauacuuuaaaaaaaaaaaaagagugcugggaucuauacaagugagacuggccuuuugucagugaaaagccuaucaacaguuuaaggaaaagucaguguacuauauuuagaacuaggauuaaaauuuuuagauggagcagacacaacuuuuuauuucucuaguccaauugcacagaacuauuacaggguguuuuggcccaggcuaucuugaaacucucucuauaagaugacuuuaaaccguagauacucgugggucaaccuuucugaaggagacacuuauauauaaacccaucauuaggauuauagcuuaaagagagaguaguugucuaauugcgugaaggucugagcuuuaccccuccccccacuacuacaaaaacuuuucauucauaaagcuaucuuauggacaacauguaguauuuuuaggauguaaguuacaugauaucauuuuucuuuccuuugaguguauuuuuauuuuuucuacccuuggagauaaggucuuggcaaacuuaugaagaucugccugccucugccucccaugcuguaguuaaaggugaacaccaccacucccaguuauguauucuuguuuuuuauuccuccuugccucugguucguguaaacuacacagacacuugcucccuuuuuagcauuuaaggcuacucuuggcucaguggcgucuuuucauauuagaaucuuaacucauuugcuauugaagccagcacaguuuaguccuuaaaucucagcuuccauuaugaaucccuaaugaaagagagucaugcuguuguuugaucuuuuucuuaccuccugucugguuaccuuuguucuuaacuggaaugcccauuauuuuucuaguuauucauucuuugggggauuuuaaauuuccccuucacaaacuguuccaucuuguuggaguucauauaaagguuguagaaguucuauaaugcuuuugcaacccuuuguuauguccucauuuauucuuuucuacaaguauugcaauuacaaaaauagaucgccaaguccagcagcuugcccaccuaauucuuucccuccuucccucuuauaaaugaauguuaacaggaaaggugauguauuagugguagcauagaagcauuuuaaggacuauaaguauucauuuaaagccaaggauaaaacauacaagugcaaguuaaaggaagagagagccuaacuucucucaguauuuuggaagcuggguuaguacagucugccuuacauaacagguucgagaccagcuucagcauggggagugcucauccuuaaaagguggaggggccauacaccuuuauuuucagcacucaagagucagaaucaggcagagauaagccacccuggucuaucgacauagugacccaggacagucagggcuacauaaugaucuucuguaucaaaaauaggcaaauaacuuaaagcaugacagaguaagagcaaaauggcuuagcagguaaagguacuuuccaugcgcaccugcccauguagaggugcuagaagggaauugaauucauacaugacauaaacacaugaacauguauauaggagaaaguuuuuccguguauauauacaugcaauacuaacuacugucuacccauauuaccuaaauuguagguauuaucucagaaauuaguaaaugcugaggaaaaaggacaguaggcucauaaccagaagauguguggguauagaguuucuuucuuugagacuguugugggauacuugguccucacacuuagccucccucacuuaugauugugauuaaggaaugggcaaccagaccucucugguaacaaauuguuaccuuuuuauugaagcaggaucguacucugguccugccuguccaaggcuugcuguguaaaccagauuggccuugaacucucaaaagucuuucugccucaguccuggaauugaagguauaaacuuagaauuaaaaaauuaaaaaugagugauagcagaaaaaaggaugaugacauuuauagaauauuuucuuacugaauguuucugucacuucaugcugauauccauucuuuuauucagagcguuuuagaauguuaguccacauuguucuuuauuuuaggggaaggcaacaugagaaugaaaaauggaacaaaagacuguucuuuccauuuauaguauaaauacaaaggucuucacuuugcaucaugaacauuaaugucaauguuaguucagacaggggauuuacugaacucuguuagcaucugcuuuugaucuaacagcaauaucugcuuuuagggucaugugaagguggugcgcuacuuagucaaagaggucaaucaguuuccaucagauucggaaugcaugagguauauagcaaccaucacugauaagguaaugugggguuuagauucacuguauauacaaacuggggauuaguuuugguuaauacugcuuuugugcccauagaacuuggugggagcaacaaaaaaaaaguguaauauuuaugaauuuuuaaaagauguagcuaaauuuguaauguauucugagaaaaaucuuaguagagccuuauucucuagcaagaaaccuugauuccuuaaacaucacagaaauugguggagcuauaaauuugaggaggauucauggcuggagguaaaguucaguguuagagcaguggguccugcauucuuuucugccccaauaggauucuguuuugcccagcacuuguggcuugaauuuuggcagguguaggagaauauaaauccuaccagagaauuaauugauagcucccacuaucguuuuugacguaccccucuauguguguguguguguguguguguguaaucuugacgaaggccaacaaauccauaauguauuuuguugcaucauaaugagcagcucuccauucauuucaguguuuacaugaacuuguucauuguccugccuaacucagaauugaauguuuuuuaugaggaauuggagguaggguuguuguuuuuuuuuuuuuuuuuuuauuccacucccuggagacaggggaaccucuaucuccauaacccuugguacccugugacucaccauguagaacagauuggucuaaaauucagaaacccaccugccccugacuccugacuccugggaccaaaggucccaaagcacuaucgcccaggcuuaaauaguuauuuuaguauuuucuugcuuguuuuuuuguuuuguuuugguuuuucaagacaggguuuuucuauguguuccuggcuguccuggaacuauguagcuucugccugccagguucugggauuaaaguugugugccaccaugcccaggcaaauuuuuuacuacuagguaaugaaauguuccuuuguugguuuuuuuaaguguguuuugagaaugaaaucauuaaaugacccuguauaugucuuuacaucuguuuuuuugcugacauugaucccauuucuuuucuuguuuguuuguuugguugguuugguuuuuggagacaggguuucucuguguagcccccccgcuguccuggaacucacucuguagaccaggcuggccucaaacucagaaauccgccugccucugccuccaaguguugggauuaaagccaagagccaccacugcccggcuaucccauuucuuuuuagcaaguuaaccaguacgcaaaaauuauagcugugguguguauuuguuuuuguuauuagauuuauuuauguguuugaguuauuugccugcauguauguauguacacuaugugaguaugcauugucauaggccuaagauaauguguauuagcucuuucauagauguuuugagauuacucugccuacccccagcuuguuuuuuaaguaccuuaaugaaugucguguuuguaagacucuuuaaguaugaguugucguuugaagcuggaaauauuuccaauuuuucauuguaggagaugcugaagaagugucaucuuuguauggagucaauaguacaagccaaagacaggcaggcugcugaagcaaauaagaaugccagcauacuacuggaggagcuagaccuggaaaagguaacagaugccucucugugauaccuucaucuucuauaguuuauccauguguucaauucuguuuucuuucucuucaauuugucacaaauuguugcaguugcuaauacuguuuaaauguuuacuuagacuguguaucauagcacuggagcaauauugaucccaccccccacccccaccccacccccagccaacaagggaaaaguaauuuuuuuaaaucuucuagauacauucuaucuagauuuuagucuuaacuaaauuucucuugauucucagccacaaccauagacuauauuuuaugucuagggcuugggucacuuuuccaguucugcacacaucuugucuucuaggcuccagaugccuguaaucuacagcugcugcuguucaugguggucauuuaugguacugguauuuccaaaauacugcugucuuucacuguaacuaggcuucaccaguagccucucauaggcucucuucauggugccaagccucagcuccuuuacaugaccccuucaaguccugaguuuuugcaaccuuucuuggccucucacagugcagagccucagcugcucuucaggaccccuucaugccuucaaaaccaguaccacuugaguaacuuuuacacauuacuaaguccagccacagcacaaaguacaaccuuggcuaucucuggaacacagccucugugcucucaggaaacacuucccagaagaugucaccucaaugaugcuggucucuucuuaaucaccucuaauuucuuagcuccagcuaaccagcaucaauagucccaguaaugcaaacagcacacccccacaucaugcacuaacuaccugggguauccuauuccuuauugacacaguccuccuuuuugacccauuauuucccuggaucaucauacaguuuuguuguuuauuuuggcuugagacaaggccacaagucuauccugacucucuggauucuaccuuccacugcugggaucacgggucagggcccuugcucuccagugacuuucacuuaccuaaaaccauaagcuacauguuuauccuguuauuucuuuugugugugacuaugugaauguauauacgggugcuuacaaagccaagaagagggugucugauccucaggagcuggagcuauuggugucugagaugccugaguuggaugcuaagaacgaaacucaggucuuccggaguagcaucaaauaugaaacugcugaguuguguccuuuuuucaugaugcuaacucuauuugcauaucugggagaauacauaguaaacaugaucuuuagccauguggggaggugggggaaggagaagggagccagguacaguagcuaaggguacaaaaggaacaguuaaccaaggugguuagauuauacaggaaagaacagcucagcccccugggcugaagaguucaggguagggacagaguaagaauacaaaccaggaggaccauauaacagguagggacugagcaguguugagagaagcugguggccagguuggcuuugauaagguaaggccuuuuguccugcuuaugaaacuuaacauuaauaucuggcugacaauaucccaacugaaguuagaucuucccuuuaaacaaaguuaauaguuuuaggauuuuuugaaaauacuuaggaagaaucuaagguugucuaaggccuugaaauuuacuggguguuuuuacaaaauagaaauaauuuuuaaauuaguaugugucugcaguuguuauucaaacauaucaaagagguuuuccucagacacugggacaguguacucauggugccaggcaccauucucaaaaugcagucucaaauuccauuagucagggcuuuauaaaggcaaaacucacaaagcuauguauuucauaaugccuuugugccgccaggagcaagaauguacacugaagcacuuuccaccuacaggagucaagcacacguugccuacaugccgucuggggcaagcaagcuuguucacagaaguaagagugcugggcaagauuaggcaguuacaagaacauuccccauucuagggcaaguagggcuuuuuuugcuuaaaucguggggcuggugagauggcucagcggguaagagcacugacugcucuucugaguucaaaucccagcagcucacaaccaucuguaaugagaucugaugcccucuucuuguguguuugaagacagcuauaguacuuauaauaaaucugugggccagagcgagcagggacugagcaaguagggcggaccggagugagcagagcaagcagagauccuaaauacaauucccaacaaccacaugaagguucgcaaccaucuguacagcuacaguauacuuacauacauucucagcucagagacuaacccaacucaguuaaggccucaucuuccucccccugccuuuaaaauccuccauuccugguuugccuuaguuucauuaguaaguuacuaccccccacuccuaucaacagaauuuuauguuuaaagucaggaaacaaggguguuuaaaguguuuuaaaauucacccucuagugagcauucaaaaagagaagcuuuaaagugacuuuuuccugccaguaaaucccagcuuggaacaugaggaaggagggucaccaugaguuggaguacagccuguucugcucuguguaguuaguuugggggugagagaguguguugaacaucaugacagucuuuaucacccucccucccugccuggccuggcuucauucuaggugucauuagguaagcagccugucacuguucuguaucuucaguuuguaugacaucauuuuuugucaacuguuuccuaaaaauuugccuuuaccacuucuucauuauuguguguauguugggggauacagaggggaggcaaugauucggugcgugaggaugcugaaggcauuggauccugcuggagcucaaguuagaaaugauugaaccaucaaacaaggcugcuuggagccaaaccgucuuuugccagaguaguauaaccucucacuccugaacucucuccaaccuuaaaaaaauuccuauaaucauuaaaacaauuuuuugaagugauaauugcugagccauaucccagacuucucuuuugagacagggauugagguguagcuuauauuggccucauacccuuacuuuggcgagccuugaacugaaaagaccuuugcuuaaaaacaguaauuaaaaccuuuaauucgagugcucaggaagcaaaagcagguggaucucucugagcuucaagccagucuauucuacauugugaguucaagguccgccaaagcuacauaguaccucccaaaaaaggagaggguaguauaguauaaaaaugaucauuauacuccuaaucugugugcauuacuguccgccucuucuuuuuucccccaauccuucuacuuuuauaagucuguaagaaauucuugcuuggagcuuauucuucggcccagaguggagauacugcccuaccugugucuccccucucuacagucacugucugcuaaguaugcuuugugucauuucucuccagcagcgaguucaauucagugaauuuuaauguuuuuaaauugccuucuaauuaauguuacaugacuacuuuuauucaaaguaaguuuuauuuuuauuuuucuaauaguuaagggaagaaagucgaaggcuggcuuuggcugcuaaaagagaaaagcgaaaagagaaaagaaggaaaaaaaaggaagaacaaagaaggaaauuagaggaaauugaagccaaaaauaaggagaacuuugaacuucaagcugcucaagaaaaagagaaacuuaaaguugaagguauucuuuuccagcugagcaugcagucaaaaucagcugcaccuaguagcccuaauuccaguuauaugguaggcugagguaaaaggaucauguucaaguccuguuuggucugcagagugaguggcccaguggcacaacuugauuagauugucucagaaugccaggaaaguagugcuggaucugucucuggucugcucaguuguuuuuacuuaaguauuugaugaccacagguuauaaauguaguugucucauuuuguuuacucacuuauuccccgacuuuauauuaacuuacauucuaaaaaccuuuuuuguugucguuguuuuuuuuuguuuuuguuuuuguuuuuuucgagacagggauucucuguauagcccuggaacucacuguguagaccaggcugaccuugaacucagaaauccaccuaccucugccucccaagugcugggauuaaaggccugcgccaccaccaccuugcuuauaaaaaccucuuaauggacauuuucuuccauucuugauuuguaaaaccuuuggguucaugucuuucuccccuuuuuuugaauuuauauaaccacauauaauugaccacuugaguauuuucccauaagugauuuauucccaacuguuuccaaauauuuucucuugcugucauaucagucucaucagugaaugacuaacucacuauugcugcuuuuacagaagaaccugaagucuugacagagccuccaagugccacuaccaccacuaccauaggaauaucugcuacauggacuacuuuggcagguucccaugguaaaagaaauaauaccauaacuacaaccagcucaaagaggaaaaacaggaaaaauaaaauuacuccagaaaauguucaaauuauauuugaugauccacuaccaaucucguacagucagccagagaaggugaauggagaguccaagagcagcagcaccagcgagaguggggacagugacaacaugaggauuuccagcugcagugacgagagcagcaacagcaacagcagcagaaagaguaacaaucaugcgucggcuguggucacgaccacuauggccagcaagaagcagccgucuguucuuguuacauuuccaaaagaggagagaaaauccguuucgggcaaggcuucuauaaaguuaguuccaaguucugcuuuuacuggugcuguguuaaacaccuugugagacaaguaaauuaccaaauacuuuuguaugguaaagaauacuaagauguuguuuagauuuuaugcugagaaaauaaauaauuuucacuauguaauuuuucgugauuguuaaacuuagcuuaugaaaaacauggauagugaagcugggucaugccuguagucucagccuuuggggaggcugaagcaagaguucaaagguucaaagccaguuugggcuacauguugacuucaacauucuuuuaguaucucaacuuaaauaccaauugauguuaaagaaauuggaagaaauucauuaacaaaauaagacauauuagcauucauauuacucauuucugcaacugguuacguggccuuaauugguauuuauaacuauuuucuucuacuacccaaucauuauuaauguacuuucccuccuuuguuaaagauugucagagacugucaaugaagggaccaguaauucucugucaacuuguacaaaaucugguccgucuccucuuuccucuccaaaugggaaguuaacaguagcaaguccuaagcgugggccaaagagggaagaaggauggaaggaggucguaaggcggugagugacuuuuggcuuauuaguuagacuccucgaacuguucccaagguuacagacacaaucaugucccaaaccucgaucuggucaauggacagccuuuuacaaagcgagucuuuaaacccugucuuucaaacaugaauaaacucugggaaaagcugugcuucucaagagacuccuuuuuguggggauggaacccaggcccucugccgugcuaggugagcacuucugaauauccgcaguccaguuuguguuuucauuugagacgagguuuuaaguuuggacuaacuucugaucuuuccguccucaccucggugcuuuucuaggauaaccacauagggcuauuuauugaggcaggguuuagccuccuaaguccucaaaauaaaaaugacaggcaugugucaacacauuauugcuuauucucucaaacuccaccccccgccuccccaccccccacacacauacuuuuuuuuuuuuuuuuuuuuuuaauucaaggucugauuguguagcucuggguagcuuggagcuuagaucgcccugucucugccucugugucuuagggauuuguuucugugaagagacaccauagcaaggcaacucuuacaaaagcaaacauuucaguuggggcuggccauuaucaucguggcaauuuugcagacaggcauggugcuggaggagccaagaguucuacaucuugauccaaaggcaaccaagaggagacuuuucuucuucauugagcagagcuugaaccauucacaaagugucacuccauaauuauggccaagcauucagcacacaaaucagugggggccaaaccuaucaaaaccaccucauucuaccuccugaguugugagauuacugccauguccagcuagacuaugacuuuaugaaguguucucuuuagcuacuguuaggaacuuaugucggccuuuuuauuuuucagcaauggugauaaaauaaaaccaagggccucccaggugcuagggaagugcgcuaccacugaacaaucuccccagguuauauaccaguuugaagauaaaugugccaagccagguagcacuugggaaauggaagcacuggaggaucuguaguuuaauguuauccucagcuacauagugaguuugaguguugagauccucauuguucacaacauacaaauaaaauuguaauuuuauggguaccugcuuucaauugcuaacacccguauggggacagcucacaauugccuguguaaccaucauguaaggacauuagacauccuuuucuggccucuacaagcaccugcccauacaugauaugcagucagucauauagacacacauaaagugaaccauuucuuccaaguuguccugugaguuucauaugacacaugguugccuugcaauacaauguaaaaaaaaaguccuuguaauuuugcaaagccaugcaugauaauccaugccuauagucuaagaacuggagaguuggagacaagcuuguuugacuuggaagccaagcuaggcuacagucuuucuuacgcaguccacacaagugguacccacugauuaacacugcucuuccugauaccaacuuccagcuuuuggcagauuaauuuagguggcuuuucuucuuuuaauuucuaguaggcuuuuugucccccucaugugaguucaaugaacuauauaucagauaaaacaccagaaauaauuaagucaaacauagaagugccuacaaaaugccuuucuuggacuuuaggauaaauuagauccuuuaaccaucccuguuaauuuguaucacaagaauuugcaguagccgaguacauaccuaccuaguauaugcuucagggauuaauaggaugauagucaagagagcaacaagaugugaaaugcuaggcuaagacaggguguagaccaggcuagccuagaaaucaaagauccaucugccucugccuccagauuauugggauuaaagggaccuuuuaaucgcaauaucuagccacagcauaauaaaaaaguacauuuagucuaacuuccaaagucaccauagucuauagcagucucgacaaaagguuuguuuaucuggauuaagaauaaauaaaacgcuggugugugguggcuuagaccucuaauccuaacauuggaggcaggccaauaucuacuuuucuauccacccaaagauacauacugagauccuguauuuacccaguauuuaaaaucaaaagaauaaauauaagcuuauuuagcaggucaauucuccauuuauaguaauaauuaacaaaaaaaccuuaauaguaaaacuuucuuacuuucauuauaaccacuaauguuuuaauuuacuaauuuauuguugauugaacuuuuaaacaggucaaaaaaaguaucuguuccaucaacugugauauccagaguuauuggaagagguggcuguaauaucaaugcuauucgggaauguacuggugcacacauagauauugacaagcaaaaagacaagacuggagaccggauaauaacuauaagguaaagcuuugguuuuguguuuucuuuuuuuuuuuuaaagaauuuuuauuuauuauuauauguaaguacacuguagcugucuucagacacaccagaagagggagucagaucuuguuacagaugguugugagccaccaugugguugcugggauuuugaacucuggaccuucggaagagcagucgggugcucuuacccacugagccaucucaccagcccgguuuuguguuuucuuuguacuguaacucaacagaguaagaaccauuugaguaggggaguaguguaucuguguguguguguguguguguguguguguguguguguguguguguugcacaaguuauuguauguacacucacacugccagagaagaauauccccucagugaaccugaagcuugcuguuugggcuauacugacuggccggaguugccaggaucuucuuccaugaauaaugcggauguuauagucauuuuuaugugggcuauauacauucagcucuuagauggcuguugaggauuugaacucauguccuuauacuuugugcagcaagcacucuuauccacuaagacauugucuuaguuuggcuuuuccugugugaacagacaccaugaccaaggcaacucuuauaaagacaacaucuaauuggggcugacuuacagauuuagagguucaguccauuaucaucaaggugggggagcaugguaauauccagcaggcauggugcaggcagagcugaguucugcgucuucaucugaacgcugguagcagaauacuggcuucaaggcagcuaggaugaggguauuaaagcccauucccaugggaacacaccaauuuuuuuuuuccccccuuugagacaggguuuaaaggcaugcgccaccacacccggcuaggaacacaccaauuuuuugguuuuucaagucaggguuucucuguauguauagcccuggcuguccuggaauucacucuguagaccaggcuggccucgaacucagaaauccaccugccucugccucccgaguucugggauuaaaggugugcgccaccacgcacagcagaacacaccaauuucaacaaggccauaccuccaaauaaugccauucccugggccaagcacauacaaacuaucacauuccauucccugguccccauagacuuauucaaacacaugaaucuauggggggggggccauaccuagccacagcauaauaaaaaauuuaaaaagucucuucugagauccacccaaucgcuuaacuguaauacccaaaucaagacaggaaaacagcugggcaaacuccagacucugcaucucuaugucugaugucaaaguggucuucacaucuccaggcccuuucucuuuuccuggacugguuccacauccuguuagcagcaugucucaggagauaucuuauggcucugacaucucaaacauuuuggggucuccaaguaucacagcuucuuguuucagugucugggauccacacaugaucuucugggcuccuccaaagggcuggcgucacuaucucugugcucuguagcacuauaaccuccagcugauccacucccacuguugcugcuguucuugaugaucauccugugguacuggcaucuccaauaagcuggcuggggucuuccacuacaacuagguuucaccaaaagccucucacaggcucuccuuuuagugucaaagcucaacucuuuugcaugaccccuucaguccugggccaaacugcauuuagggcugaaccuucaccaguggccuuccauggacucucucagugccaggccucagcugcucaucaugaucucuucaugccuucaaaaccaguagcgccugggugacucuuacacauuaccaaaagacagcugcaacaggggaaaauaccuugacaaucucuggaucacaacuucuuugugcucucagaaaacacuucccagaagauuucacuuuaguggugcuggucucuuaaucaccucuauucuauucuauucuauucuauucuauucuauucuauucuauucuauucuauucuauucuauucuauucuauucuugauugauugguuuuuccaggguuucucuguguagcccuggcuguccuagaucucacucuguagaccaggcuggcuuugaacucagaaaucugccugccucugccucccaagugcugggauuaaaggugugugccacccagcuaauuuauuuuuaauucaaguuuuuuaagauuuguuauaaauacaccauucuaccugcauguaugucugcaguacagaagagagcaccagaucuuauuagagauaguuuugaaccaccaugugguugcugggaauugaacucagaaccucuggaagagcagccacugcucuuaaccucugagccaucucucuagcccccucaccacuaauuucuuaucuccagcuaaccagcaucauuuaauccaguagucucuucuauucuggacucuuaaagccagagccaaauaaccaaaguugcugaguucugcuuuuugcuggggcuggaacauggccuacucuuguauucuauuauauuuucaccagcuuucuguuucccaacuccuucauugccuaagcuuggcaguccuggaacuugcucuguagacugacuuugaacucagagaacuaacuuugaacucauagaucuguaugccucucuccuaaaacacugggauuaaaggugugguccaccaagccaggauuuaaguuuuuguucaccuagaacuugcucuguuggaccuugaacucacauuuugucuuccucuucugggaguaaagguguguacuuccaugccuggcccuaaacuuagcuggguggauuuugcuccaaggucacucacuacucccuuaauucauuuacuaucugugaacacaggauucagcuccauuuuacuucugagugccccuuuaauauuccaaccauauauuuuauauuuguccuuucuucucagcuuguuccuuuucauuaaaauguuuuucauaagagugaacuuuaguaaccauacaacagaaauuaccccaggcuguuuugagacuuccuuuuucaaaggaaucuaaaucucuuggccucaggcagacuccuaggacaaugcaaaaaaaaaaaaagucacauucaccaaagaaccacaaaaacagucucuaggccacauacugaaauucuccacuaaaaccucgugggucagauggucacaguucaaaccacucucagcaacaaagucuuccacauuccuucuaggaugacccauuaagacccacuuaaagcauuccagugcuuuccaaauccaaagucccaaaaucuacauucuuccaaacaaaaacauggucaggccgaucacagcaguaccccagucccugguaccaacuucugucuuaguguuuuacugcugugaacagacaccacgaccaaggcaacucuuauaagaacaacauguaacuggcuuacagguucagagguccauucaguccauuaucaucauggcgggaacaugguggcauccaggccggcauuugcaggcauugcugggaguccuguuucuuuaucugaaggcugcuagcagaauacuggcuucuaggcagcucagugagggucauagcccacacccacagugacacgccuacuccaaucaggccacaccuccaaauaaugccacucccugggccaagcauaaacaaaccaucacuggcaucuccucagccuuuauguauuuaaaagauuauaguuuuagaagaguuguaauacagguauuuaaucucagcagaggcaggcugacagaacucuaaguuuaaggccagccuggacuuuauaaugauuuccaggacagccagagcucuguagggagaccuuaucccccacauacacaucccaucccccaaaguaugagucuuugggaauauuauucucaggauuuuuucuaaugaauacauucuuaugauauguuuuaaauaauguuauaaaaauuugagauaguuaaaaauuugucuagauucuugaguaauaaauuucuuacacauuuuaaagcagggaguuauuuucucucaauuacuuuauagauuuuuguugugaaaugauauccuuagaauuugaacuuauuaauguaacauaaucaguaguggcaguguaaauauuuaaccugaaaacucaacaagugugucugcugaaauacuccaagaauaaagaugacaguuuacgacauuauaaggaugcaaaagcuguacuuaaaauagcuauaguauaaguacauuuugaaaagcggguucucaggguagggucggaggagagauggcccagcagcuaaaaacacugacugcucuuccagagaacuagguuucgauuccccucacccacacggcagcucacaacugucuauaacuccaguuccaggguauccagacaugcaggcaaaacaccaaugcccauaaaauaaaaaguaauaaauuauuuaagagagagagagagagagagagaaggaaagagagagagagaaagaaaaagggagggagggagggaaggaaaaguggguuuucaacugaguguauacuaggacuuacagguuuuuuuuucuuuaaaguagggagacauuuaauccauuucauuuucaccuuuuccucugcuagauuaacuugcagaauccagaggaaaggcaaguaaauacccuuucugggucauuuguucuugagguuuccauauguaaacuuaaaucgggcguuuuccugaagagccaacguucuaguuugcugucauuguuguugcuggcauuguuagaauuccucacuuguuuugagagguuguccuccaaugcuguucauagggaagccauuuaggcaguaaacuuaucucagauacuaagaucaacgaccaaauccucuucccuugcuuaguuguaaaguguuucauguuuacuugaacauugguguuuuguuuuuugauuuuacaguguuaaaaauugaauguaaauucucaccaaugagcuacaauuccaacuuuuuuuuuuuuuuuuuuuuuuuuguuuuugagaccggguuucucuguguagcccuggcuguccuggaacucacucuguagacuaggcuggccuugaacucagaaauccgccugccucugccucccaagugcugggauuaaagaugugcgccaccacugcccggccaauuccaacuuuuuaauaagauuguuuuaaauauucaucacccuuuuugaggcaggcuuucuauguaacucuuuacuaggcuaugucuuaaguguuaagauuaaagucuugcaccaacacucuaggcuuaccuucuuuuccccuuuuucuuuuaaggccugcucucaguaaguaacucaggcuggccuggaacucacagaucauucuucugcugguacuauuggcauugaguaccaguucuaguuauugaccguauauuuaucuucaaaauauuauuguaggccacacaagcuuuuauguauaaucuguuuccuaaugauaaaucauguuacaauaggagaaauaacauuuuagucuaaggaaacaaugggaagauuuuuuuuucuuuaaaaauaaaauagaggcugggacaguggcuuaggaguuaagagcacuuacugcucuuauagaagacaugguuuccaacacuuacuugguggcuuacaacugucuaaacaguuauacauguggacauaaucuuuuuuuuaagucacuuaagggguguguguguguguguguguguguguguguguguguguguguguuugguuuaccuguuuaauguguguuuauacaugcauacauguaaaugucuacaugagaaugauagacuguacuacuagaaaguagugaaauuaaggcuaauuugggggccauuuuuuuaucuguugaucaacaugcagggguggcacugaaucaacaagacaagcaacucaguugaucaaugcuuugaucaaggauccagacaaagaaauugaugaacuuauuccaaagaaucguuugaaaagcuccacagcaaauuccaaaaucggguccucagcaccuaccaccacugcugcuaacaguuccuuaauggggaucaaaaugacaacuguagcucugucgucgacaucucagacugccacugcacucaccguuccugccaucucuucugcauccacucacaaaaccauuaagaacccugugaauaaugugaggccuggguuuccaguuucucuuccauuagcauauccuccuccacaguuugcacacgcuuugcuugcugcucagacuuuccagcagauccguccaccacgguugcccaugacccacuuuggagguacuuucccaccagcucaguccacuugggguccuuuuccugucaggccuuugagcccugccagagcuacuaacucgccuaagccucacauggugccucgccauagcaaucagaauagcagugguucucaggugaauucagcagguucucuaacuucaaguccaacaacuacagccaguucaucagcuucagcggugccugguacaacuucaaauggcaguccaaguucuccuucagucagaaggcagcuuuuugucacaguugugaagacauccaaugccacaaccacaacagucacaacuacagcaagcaacaacagcaccgcacccacaaacgccacauauccuaugccuacugccaaagaacacuauccaguaucauccccaucuuccccaucaccaccagcccagccaggagggguuucuagaaacagcccuuuggauuguggaucagcauccccaaauaaaggggcaucugcuuccgaacaggaagcaagcaguccaccaguaguagaaccugcaaauagcagacccccacacagcagcaguucuucugggagcucaucaggucauuccacucagcagcagccuccgggaucuguuccucaggagccaagacccccucuucagcagucucagguuccuuccccggaugugagaaugacuguuccuccuacagcaacaaguucugcuccaguggcggugccuucuacugcgccugugacguacccuaugccucagacacaaaugggaugcucccagccuccuaaaauggaagccccugcuauuagaccacccucucaugccacagcugccccucacaagacuccagcuccagugcagaguucaucugcuucaguccucaaugucaaucacauuaaaagaccucauaguguccccuccucuguccagcuaccuucgaccuuaaguacacaaagugcuugucagaauucaguacauccagcaaauaagccuguugcucccaacuucagugccccauuaccauuugggcccuuuagcacauuguuugaaaacaacccuacuaaugcucaugccuucuggggaggaccuguuguuucaucucagucaacaccagaaucuaugcugucaggaaaauccucguauuugccaaauucagauccuuuacaucagucagauacuuccaaagcaccagguuuuaggccaccauuacagagaccugcuccaagucccucagguaaguguauuuauuuguuugacauuauguaguuacuacuugacauagaugauacaaaaauuuugggcuacuuuaugauguccuugcucuguguauaggcuaccuguauagagaagaguuuuuguugugcacugcuauuguuucugagacagggucucaacuauguguagcccuggcuggccuagaaucaggacuguagaggagccuggccuugacuucaagguguuugcuguggugcccagccuuagagaguuuuguuuuaucuuuuuuggugauagagguuguacccauuugguuuaugcaugcuggaugagcacuuuauuuuaucagugagguagaccccaagugugagaggguuuuagucccuuuauacacuguuguaucaugugcauuuguuuaguguagugcuuuuauuuuaaagucuuuucaaagcuaauaguaaauuuugucuugaauuuaccuuauaaaguuaauaggucucauuucuccucauccuagcccugcuuugaaaaagaaguuuguauuuguggggaagggugugguuacgggauguuuugaggaauggaaccaacauugagaggcugaagaagaguagcccuuuagcacaauguuugauaaucuuacuaauguucauaccucuguuauuucaucucagugaacaccagaaucuaugcugucaggaaaauccucguauuugccaaauucagauccuuuccaucagucagauacuuccaaagcaccagguuuuaggccaccuuuacagagacccacaccaaguccaaguuauaaaguauaacuuggaaaaagccaguaaaggccauggugaugcaugccugcagucccaacauguggaaaggaguugguaggaagaccagaaguguuaacauaccgaucuugauuagggcuacaggagauccugucuaggaaggaaggaaaacaaagguuuuacauuaauaaagagaugcuggcaauuuuauuaaauuggaauucauuuccguuugucuuuguuuuaauaugagaaagauguccagcuacaccuucuaaugugguagccauuugcuacuucuuucauuucuauuuaacaaugaaaauugaccagguacaguagugaauaccuuuaaucccagccuuggaaagcagaggcaggcaggucuucccagccagggcugcauaguagguauuacccugucuaaaaauaacacuuucaucuucuuaguccaaguuguaaguacuguggacuacuggcuaccauuuggacaggaaaauuauggaacauuacuauuuuaagggaaguucuuuuugacagcacugguauuuacagaggauuuaaagaguuuuuaauucuguuauacuuuuuuaaguucacuuuuuuuagauucauaaaggagaaauuguaguuucucauguaaauaucuuagaugacuauagcauguacacucaagaaguaauuaguauuuggcaguugguuuuuuuguuguuguaguuguuguuuugugguuuuuguuuuuuguuuuuguuuuuguuuuuuccugagacaggguuucuuuguguagccuggcuguccuggaacucacucuguagaccaggcuggccuugaacucagaaauccuucugccucugccuccaagugcugggauuaaaaguguguauacaaccaccuggcagagauccugucccuuuuuuguuuuuguuuuuguuuuugguugguugguuugggguuuuggguuuuuuggguuuuguuguuguuguuguuguuguuucaguuuuuuauuagauauuuucuucauuuacauuucaaaugcuauccgagaguccccuauacccgaccccugaccucccuacccugcuccccuacccacccauucacuucuuguuuuuguuuuuuaacuagugaaacuaucguggucaaguaauugagaaaaucuacgugagagauggacauacuauauagucugugguuuacaugaucugauccuauuuacaaauauucuaaggaauauuuuguuuuauuuuggggguuggauuuuguuuucugagagugcugggauuaaagccauguuccuccacuaccagcagaguucuuaauguguguuucucagcuuuccauguucuagaguuacagguuuuacuguagucacauaggcugggguagagugaugggggauuccuguuguuuuuuauuugaggaagggccuuguuguguacccuggcuggccuguugcuagcuaguccaggcugacucugaaaucugaugagucuuuccaccuucugccucuucaguggaaggauuaaaugcuuuuaccaauguacaguguacccugacaacuacugauuuuccuucccuucuuguuucuuuguucuuaagaugggcuuuuccugguccaccugacaagggucuugcacaggcaggucuugaaccuggcucuaccuuaccagagcugguauuauaggccugugccaccacaccaugggcucucuaaguaaaguguuaccauagcuaucuuuguucauucucauacuauuuauagcuaauuuuauauuuaauacauggacagagaccaugugacaugcaaauacucgugaacauacaauucaaaaagauucaaaaagaaucguacuuuaaauaaaauguagugcauugcugcacacagguaagagcauuauacuacacauuuuuuauuuaaguuuauuuauuuauuuauuuauuuauuuauuuauuuauuuauugguuuuucgagacaggguuucucuguauagcccuggcuguccuggaacuuacuuuguagaccaggcuggccucgaacucagaaauccgccugccucuaccucccgagugcugggauuaaaggcgugcaccaccacgcccggcacauuuuuuauuuuuauuuauugugagacagauucucacuguguagcuuuugccacccaggaauucacuauauagacuaggcuggacucaaagucacauaaauugcccugccucugccagccuauaucuuuuuuauuacuaguaugaaugauacuguuuuccgguguguguugguugcaugcauauauguacaccaauguuugccuguugcucagggaaguuagaagacacuuggauucccuggagcugagauaguugagccauccuuugggugcugggauccaaucucagguccucugcaagaagagcaaguguuccucacugcuaagcuagcuccaacuccagcuccaagccuguggcucuucuuacauaaacagauuguuuaaagaacagaaugcagacuaguaaauauuguucccucauucauauuauccuuuuguucaucucuuuuuaugagggaaugcuuuugaaagggaucuuucuuuauagaugucaaacuugaauuguggccauucuccaccccauugggauuauagacguguaugaccuugugagauucccgguacgugagugugcccguuuuugaguuagagucucccuuacaucaagucuggccuugaauuuauuauguagccaaagaucaucuuaaucugacccucuugacuaucucccagaugccggcauuacagguauuugccaccacacccagcuaagaaguucucucuuuuuuucucuucucucuucucuuucccucccuuccuccuucccucuaaaauuaacgcaucuuccagcccucucuugggggguaauugcuguaaguaaugauggucuucuacauuacagguauugucaacauggacacaccauaugguucuguaacaccuucuucuacacauuugggaaacuuugccucaagucuuucaggaggucagauguaugggccuggagcaccucuuggaggagcaccccuuggaggagcaccuacugcugcuaacuuuaacagacagcauuuuuccccacuuaguuuguugacuccauguucaucagcaucaaaugguaagugucuguaucccagauccuuaaaagcaaagagguuugagaucuguaaauacaggauauuugcuuuuaagacaggcucuccuguguacugggcuagccccagcuucguugcuuccaguucccacaagcuggaaauacgaucuugugcuacuucgagcaacucacaccaaauuugagauuuuaaccucaccauaacuuuaaugcagaaaggaauguaauuuuuaacucaacagucuguguaaaauuuguaguuuuuaaaccauuuauugggacuagagaaauggcucaguacuuaagaucacuugcuacucuuggggaacccacuuuugaucccagcacuuauuugauggcuuauggucguguauaacucccguuccaggcaucugacucccuuuucugaccuucaugagcaccacgccuauaugugauacacauacauaaaugaaggcaaaaucuuccaaaaauccuuuaaaaccuacuuuuugaaugguggugaaaccagagugucuuuccugcagugaagcaccuacuuaaugucaauuuacauuuauucuucagaucgacuagugauagaaacgauuucuagcuuuauaaaacaugugacuggaaagccuagcauuauggaacauaguuauaauucuagcuacuuuagagaccaagguaggagaauuuguauuucagacagccucaguaaauugccaagcacuuaggcaauaauguaaaaaacggucucuaaugcaaauagaaacacuugucuguauagacaacaaaaacuuuuccacaccuuuuaaauuuuaucuguguagugcugacuguccaggagcucagcuggagucauggcugguuucaaauucagaucccauccccuggcuuuuuguugguuuugguguuuugcaacaaggcuucucuguuuauaccuagcuaugcuagaacucacucugugaaccagguuagccagugcuuagauuaaaggguugcacugccaccaccacccugcuuuuauuuuuuauuaguaauauauuuaaaaacuucaauuucuaaugggcauauaaaaguaucccaguuuguguuaauaguguauacccccagauucuaggcuugcaaggcuaagacagagggaggguaaguuaaagacuugccagcaccuauaucaacaaacaaaaaaacaaacaaaaccuauuguguuuggcugugagacaacucuccaguauaccucacccccauuauuuuaagacgauuagauggucauuaccaaaacuacaucuuguguaaugccaacaauccuguugauagaugaugaggaauugcuuccaauuaguauuuuauagucauguggaaaguacuguguguagcagccugguguucacugauuuuucuccuccuaagcuagacuucacugacuuagauacugcuuugcaucggaacaacugucccaaguuacuuuucuguugcugugaaggcaacaugaccaagucaacuuacaaaagaaagaaucucuagggaaccuacaguugaggggguuagaguucaugaccacuggugaggagcauggcugcaggugggcuagcacacaguggagugugaggugacagcucagacugcaucuacaagcaugagagagagauguggugggcgugcacuaagauggggaugaugugggccucugaaacuucugcccaucaccagugucacaccucuuucaaaaaagccauacuuuuaguucuucucaaacaauucuaccaacuggagacacauaagagucugugggagccauucucacacaaccacauuuuucucccuggcccccauagacuuguggccacagcagaauacaaaaauacucuuaauacaacuucaaaauuccccaguuucagucucaaaacuauuuaacuguccaaggucucuucugagacucaaggcaaucuugacucaaggcaauuauaagcccccuauaaaaucaaaaaugaaauuucauaacuccaauaugaugucaaagcacuuaaaucagucugcccucccaaccuuucugauuguuaccgacuucucucuuuuggccuggccacacaccuggcuuuauggcuuucuuaacccuggaggaagaguucgcaagccagaaccacauuugcccuaaacuaccaaauccuacugccugcuuaggguaggaccuggccuugcccuucaguuacauuugcauuaaucuggugcucugcuuuccuccugcauuuucucuguucaagcaggaagguuacaggugggggcuggcccugaggcaccacuccuucuauuccauuaucuauaaaaccucuccuaaucucuuucagccuugguccaucauuaaauucccugguucuccuuuucaagcugaaaauuuucauuuauuuuuccccagccuucucauuuucauuguagugcagaaugagagcaaguccuauuaaccuauugaaaagucagaauuaggcuaucggccagugaaauuuguccaaaacuucucaggcagauucuuuugacaaguacaaaacaacaacaaaacaaaaaaaaaaccaaacuucauucuuuugugagaauagcguaugaaagaucucuacucaacagugcuaauguucuuccccuccgaaaccccuugagccaggccuccucagucaguauagcucccaacuguacuguuuucuauaccccugcuaugguggcccauuuagcaucucccagagugcucauccacuuuccuaguccagaguccaaugaaaaucuuuuacauucuucccaaaagaaacaugaccaggccucuugcagcaauuuagcccauccccaaguaccuacuucuuucuguuuucugugaagagacaccaugaccaagggagcuuaaagaagaaacaaacaguuuauagagggugagcauccauaagcauccuggccgggagcauggcagcaaccaggaagcauggugcuggaacaguagccaagagugcagaccuccuccacaggggagggcagagagacaaacuaaccuggaaugccuuagggguuuuuugguuuuuuaauuuuuguuuauauuuuuuguuuuuguuuuugagaugguaucuauaaaacucugccuacccugaaucacgccauagaccaucuuggccuggaauuuccagagauaugccuguuucugccuccagagugcugggauuaaaggcauaugguugggccuuugaaaccucaaagccagcugguccccagugacacgccuucaacaagaccauaccuucuaaucuuaucuaaaucucguacugauuugagacuaaguauuugaucuuaagagucucugaagagucauucucauucagaguaccucaacaggaaacacaguuguuuucgaagaguacaguuugagggaacuggaguuacggcccaguuaauaaaguacuugucuaguacacacaguauuugaaucugaucucuagcacucaugaagaaucugaagcuccgcggcaaaggcugggaacuggcaugcugaugaaccaguguagaccugagugcagcuuccuguaaccuugaccugugaaagguggagcaagaaaaggaaucccuagggcuuguuucuguuaaccuagcuccaguuucaccgagaaacccugucucaagggcagaggaauugagcagguuggauacacaauauccuccuacggcaggcacaccugcacagaaacuugugcgcguaucaucacacuuggacacacaaauacucauuauucuuagcuauacagagaucaaugccagccuggggguagugggcaugcacuuaauuuaaacauuguucuuuuaaauguuuugauuuuaagccaggcgugguggcacaugccuuuaaucccagcacucuggaggcagaggcaggcggauuucuguguucucgaggccagccuggucuacagagugaguuccaggacagccagggcuauacagagaaacccugucucgaaaaaaaaaaaacaaaaacaaaaaaaaaaaaaguuuugauuuuauauuagcagcagauauuggcuuaauuaaauaauaggauggugauuuacuaaaugaguagcucuccacuuuguagcauugagaucauuauagucuaacauuaaauccuuggccuuuuuauaaaacgugugugggagggguggguuauuaagaguugagcucagggagggccucaugaaugccaaguaagcacuauauuauugaacuaaauuguuauuguaagucaguucuuaauuuccaaauauguugcuuuuaaagacagagucuuauuuuguagccuagccuggccuugaacuuguagucuuccuguauuguguuuuuuuuugagacaggguuucauuauguagccuuggcuguccugaaacuugcuauauagagauucugcucuugaacucacagauauccuccugucucugucuccagaaggcugggauuaugcgccaccaugccuggcugcagucaucuugauuauaccucuguagcucugauugcaaaugugcaccaucaugcucagcuuaaacauucuucuuaaaacagaacagaagagaaaauuguuucaaagcaagaaagaggcuguugaggaaggaggagaaggauaagacagugaugggaguaagggagguaaaaauaaagaauaugguguauauauacgaacuggacucuuuguauggaauucaaaaguaauauuaaaucucagcuauccucagaaaaacuaaaauuugguuuugcaaaauuaaauauuuuacagaguaccuguauaauauuucaaaauauccuuuuucagagucuccagcacagucuguauccucuggaguucgugcaccgucuccugccccauccucaguaccuuuagggucugaaaagcccagcagugucucucaggacaggaaaguaccagucccaauugggacugagcguucugcacggaucaggcaaacuggaacuucagcuccaucuguuauugggaguaauuugucuacaucaguaggacauaguggcaucugguccuuugaagggauugguggcaaucaagguaugauaugcuguauauuacuggaaaugaaguuuauucauuuagcuaaauauuuuaaucaguuucacauucacuuaauuuuuugagauuuuacuuuuuugguuuuucgagacaggguuucucuguauagccuuggcuguccuggaauucacucuguagaccaggcuggccucgaacucagaaaucugccugccucugccuccagagugcugggauuaaaggcggcaugcaccaucacgcccaaugagauuuuacuuuuaugugugguguuuuuccugcauaugugucuaugcaacacucauaugccuggugugugaggagacuagaugagagcauugaauccccugaaacuggagaugcagccaguuguuagcugccaucugggugcugggaauggaaccaucugucuagcccucaucauuccuuuaaaggaucucuauuccugucucuucaguuagacuaaucuucucuuaguucugguuucaugugcucuuucccucugcacuuacucaucucuuaaaauaaucuaaugacguaaacaauauugguuuauuaagagucuccuguagaccguugaauccuugaacuaacuaugucgauggaugaggcuagccuugacccugguccuuuugccuucacgucccaguacuugauugcagguguuugcuaucuugcccuacagaagucuccuuguauuuucauuuugccauauuaagauguugguguuuccuuugagacguuuuggcuucuucauagcuuugauuuucuuuuguaguuugguugucauuguugcugcuauugcuauuuaagugaauaaauguuuauuuaagggauuucucauguaaauccuccacuguccauuaacguuucucauggucaagauuucucaagauugcccucucaaauaacugauguauuccgguugcauuguuagaauacucacacaauucuuuuguguguuauuuuaugaauuagugacauuugugacaacuucagaauucuucauaugaaauuguuagcaucuuauuucuucagacauuuuacuuuaggaaucguauugcccuucucccucucucuccacuuacuaaggaugaguuuauaucauacucauuucuaagagaacaaguucauuaaugucauaaaucuguaggauacaccagugccuaaaaucaaaagacagucacuguuuccuaauugucuuguaguuucuucccacacuuagagugagaaaagcaauuccaugcauuuacuauaccaggcauuucuaaugauguguaauuuuuuguuuuaugauacuguucacuaagcaacauggauauacugcuguaaacauagcaaaaauagauuauuuugaaagaauucacaauuugguauaaguuaaaauaggaauuaaaaagccuuuuuuaaauuuucuuuuuuuuaaagcugugucuugauuuugaauguuaccaacguuuguuuccgacuuucuuuucucucagacaaaguggacugguguaacccugggaugggaaaucccaugauucacaggccaaugucugacccaggaguguuuucacagcaucaagcaauggagcgagauaguacagggauuguaaccccuucugguacauuccaucagcauguuccugcaggauacauggacuuuccuaaaguugggguaauuuaaauacauauuuucauuauuacaaaagaucuuuuuguuugucugauuguuugugcuuguuuaucccuagucaucuuucauuuccaagugcauaagcugugaagucuggagcuuggcaggucagacuggcuaggauagucuuucuagccauuuaggggacuccuauuucagcaguuguuuguugguuuguuugguugggguauguuguuuauuuaggguuuuuuuagauuuuuauuuuuacuuauuuguacaugugaauauguaugugcacaugaaugcagaugcccacugaguccaaagagggcauuugaucacuuggaacuggaauuacaggaagccaugagccaucaaaaauagaagcuaagaacugaacucugguauucuucaagagcagcaaacacuuuuaaccguuaagccauuucuccagcccacguagaacccuuuguggggcuaggauuacuuucugcuugugguuuuuuuuuuuaaaaaagauugauugauugauugauugauugauugguugauuuaaagauuuauuuauuuauuauauguaaguacacuguagcugucuucagacacaccagaagagggagucagaucucguuacggaugguuguaagccaccaugugguuucugggauuugaacucaggaccuucggaagagcagucgagugcucuuaccugcugagccaucucaccagcccucugcuuguuuuuuauuggguuugggagauuuuuguucaugagacagagucucaacagguagcucuggcuggucuggaacucuguguagaccaaacuggccuccaacauacagauaucaccugcuucugccuccuggauauugaggugaaaggccuuggccagcgugucuagcuaaauaagugcacaucagagaauacuuucuggauucugugaauuaccuaggaguucauaaagucaauugagacuuuaaaaucaauuuuaggaaucuuggcucuuuuguuuuucauuucuguuucuuuuuguuguuguuguuguuguuauuuaguuuugguuuuuguuuuuucauggaguauguauuuaucccuggcugaccugaaacucacuccauaaaccggacagccuuugccucucaaauaccucuuuuuguuuucugugacagaguucucuccacauaguccuuauaagauuuuuauuguuuaucagagguaggaugcuaagaagaagauagugacuuggauauuaaucucucucuuucucuuuuuguccucuuucuuuaagaguaugccuuuuucuguauaugggaaugcaaugcuuccuccaguagcaccuaucgcugauggugcuggaggacccauauuuaauggcccucauucugcagaaccuucuuggaacucacugauaaagaugguuucaaguuccacagaaaacaaugguccucaaacgguaaggcugauuauucagcaagcagucacuuacauguuuacaaaauaugaagcaaauagaauucagguaaaccaugguagcuuuagagcacagagagugcauccagcagaggacauuggcuauauagaugaaguacaucagcaaucuuuaguaauaugguacucaguuuuuaaguuaauuaugggaaucuauuuuauauuuuauucuguagcagaugauauguaggagaauuuaauuauauagcuggccgugguagugcacaccuuuaaucucaacacucagcagguggaucuucauaaguuauggguuagccugguuuacauggagaguuccaggccaucuagggcuacauagucagguccuguuuucaaaaacaaacuaaaaaguaagaugcaaagugaucuucauguaaaauaaucauauuaacauuacuauuugcuacuuuguuaagaguucuacacuauaugaaaaccuagagcaauaauuauacacuugguuuuggacagaauguaucuguacauuuuuugucuugucugacagucacuagauaccccaggcugaucacaaacuuaagguacaacugcuucagccuccccgguccuuggauaauaagaauaaggaacuguacuagucuaaucugaaguugccauggggucuguucagggucucuggaaaaucacccuuucacagcagucuccaugcuauuaaguagcuuuaaaguugugagcaccuccuccuguuaggauuucagaaagaaaagggaagcacggagagcagauuugguaacuagaagguguggcuuagugacaggacacaugcuuagcauccuaaguucccaggcucauucccaggcagggcugcgacauacauuauugauuuuuuucucuaguauuuccuaaugugcugcugucuuuuauuuuuaucccuacccacucccacccccacucccuggguauugcauguuuuauuuauccaguguucagaaauuguaguuuuuuuaagugauauuuuuuuccaguuugugaguguguaccuguguuuaugucuguaucacaugcauguuuugugccuuuggagcccagaagaguaucuuggaacuagaauuauagcccguuaaaagguaccauguaacccuagggaccaagccuaugucugcuacaagagcauccugugcucuuagcaauugagccaucucugcaggccccgccuuuuauucuucuguuugaguucuuugacaagaggucucaaguaacccaagcugucccuacuguacagauaaggaugaccuugaacuccagaguauuuccuuuucuuuauuaggacuaaauguguugccaaauccagcuauauguugacgauugaaugagauuauguugucuuaguccauaaauguuucauuguuuguccuaguauucuaaguaucugccugacuuguauuuggugacacgaaugcucuguuuguagguauggacuggacccugggcaccucacaugaacagugugcacaugaaccagcuuggcugaugaggagaagccugguagccugcagauuccuuucauucagaggaaaucacaaguggccgagaaacauuuuuaugcucccaaaucauucuacugaugugcuugacugaaguguguaggcuuuuugcagaagaacuuacuaacugaccuauuuucugugaacauuugugacagccaauucuccaucaucauccguuuuuaccuuaguuagaauuuuuucuuaucauuuuucuucuuucuuucccucuucuccuuuggacauaacuuucuguugacgcuguucuuuggcugguugguuuuaguacuguaaacugcuucugagcaaacacggaaauuuagcaaaauuauguaaacuugauccugaaguuuuagaauggcaaauaaauguacaauuguuuacauaacagaaaaggcuaagcagaaaguaaauuucagugugucagucuagaggcucuacuuuauguagacuuaaauucaugugagauauguaccuucauauucagaaaucuggaugucuccuucauacauuaaacuauuaauaagcaccacuuuucuacuuguauauuuuaagcauagaguaaaaugaugggcauuaucaacugauguucccugcguuagcucugaaacacccaucuuauucccuguuggguuugauuguagcaaggcagauagaagaaauuucugauuuuuccgugucuuuauuaaauuugucacacuuuucaaacucaugcacacacaucucuucaguuuggacucucucuuugccacuauugcuacuuaguaagauucucuugcucaauagugagaaccuucuuguaaaguuuuuucccauaguggcugugacacagauguggagcaucuucaguggcaccagugguuuuuucuaaccagaaagcuugagacuuuugagcaacuuaaaagccaccacagcucucagucagcauauauuguuuauuuuuaaagauuucagcauauuuuauauuggaugauauugauucuuaacauuggcccuuccuggucagcaagagucaacaugcaguuuucccuuuucaagcaucuaugucuuaguuugaaaggcuccucucucuguaguuguugguagaaaugaaaaggaugaacagcuaacuugggccaacucaaaaaggaguguuuggguuccuuuuuaaaaugaauacacggauuauaaauuaaagucuccauuuaacuuguuuauaugugauucagggccacacuaaacuacucagugggaauuauauauuccaaccacuugaaacaauaaacaauaauguauacaagaagaauauguguccugcccugucuccuauggaaaaguaacucacaugauugaaauauaaaacaguuuauacaugagaaauacugucauaauacaugucaaauacuaucaauuugguuuuuaauuagagacaaacuuaacacuguaaaauaugaacuaaagcuuacacaugccaccuaagguugauaauaacauucauugguugucauaguaugugauaugauuuuaugccuguagugaccugagugaagaggauaagguaguuucucaaacccacccagcacucuggaugcuaaguauauacauucaguuccaccuuugcuuaauacacacaaaauaggaggaaaauagccuacaaauacagccaugaauuuaaaagaaauuuaaaaagcacuuuacuuacacaaagcaacaaaacugcaugauguuaauauuuuguauugaauuuugccacgguucugucuucuuugcucccagaagacuuuucugagauaccuagaguuauuuucugccuaaaauaauagaguuggagaacagacacuacucagggugugcugccacgugugaguagugguguucaccacacauaaccuccuagcgagugucuuacugaaaaaggaagaagggugggaaagcgaguauuuucuugguuuuaaaauguggagcauggaaauagauuugagcccugucucucuacacugagagagcaggauggcgccaugguucuagaaguuuguaccaggaacauuuuucaaauacauuuuuauacuucagauguaauauagaacauuuuauuuauuuaaacaauaaaaaaaaaguucuugag

SEQ ID NO: 2518 - RNA, 3283 nt, Mus musculus
uuuuugguuaaaagagggacuuucuuuccuuucagcucccaccaugccaaggagacuagugaagaccuggacauuucaggaccucuugagccacggcugccagagcaaucaauaaaugccacaagcaccuagaaagauggggguugcugguggcaugcauagcaaaaucaacuuuaacaaacaucugggcgacuuuugggaaaguuggugugaggaaucaccacuuaaagaaucaggauuucuacccaacuggcaaccuauccaaauugugaacacuaauccggaaacaggcucauucuacaaaacaacaaggcugaagcuguugccaucucugaugugcgagcaggcuacuguaaguucuggggaaaggcaggcuccuuauacagcauguuauggcgaaggccaaauucuucagagaaaagcugagaagaugaaggauguugagaggugccuaugugcugguagcuugaagccacaaaagguguuuaaaugcuacuguuuuccacacaggcugaguauguagguucuuuggugaugggucagcugauuaacaagacacagaccacccucacauccaaaauacuucaggaugaguguuuaagucgaguggacuggauuccagaaugcagaaguggauucauaagucacugcauacaaucugagucuugauauucaaagaacagcuaacacugucaucucaacccuauucuaugucuuaaaaagccagaacaaaacaaauaaauaaaucccgagaaccagagaaaggaacacauuggcacuacagauauggcugaacaauuaaaagcacguauugcuauuccagaagacccaggauaaaccagcuccccacacccuacaucagcagcucauaaccacuuaacaacuucacgcccagaggauccagaaugccuuugguuucugcaggcucccacauucacaccagacaugaacacauauacauguuuguuuguuuguuuguuuaaagaggggugggagaguuaaguugaauagcaagacucaugguuuugagauagaaguuagcaaaaugaaagugaacaugacuaaauaacaaaucauuacuaguccaguccuguauuuuuacauuuggaacuauccaugucacaaauauuauacuuucacuaagaucuauuauguaagaauguacuagugauuaguaacauagccuucuugauagaagugacacaaaacaugacuucuauuuguaagcuucgagguacuuaucugucuacaugucagucaaaaccacuaaugucaucuagcauuaaguuuuuaaaaaguauaaacuuuacaaaguagacuaaucauguuuaaaauaaaaguuauauggucuaaaauuucaaguagauuuuucuauaacacucuuaccauuuaacacacacacagagaauaaaaacuuuuaaagaaaagggguugaaaauagaugaaacagcaaucacaaucaaaggauaguaguuacuaucaguuacaaaauaacgcaaaacaaguuacacaggaagaguaucuaucuuauaauguuagcagacagugaguauauccagggugguucagucaugagcauacaacaaccuacuaccacuauaugcagcuaaacaaaacaaaacaccaauguggcaaguuuugcauauuaccucgcuaagaaaaugaugaauaugcacauuaugauaucugaacauacguuaggaaaagaagaaacucaaaagauuugaaagagaugaccuugcaauuuauguaugagguuaaguucuugguccagaaaauaaagaaacagaauauuaaauacuaauaguuugacauucuauuugaaauuuuuaaaaaagaaaauauccauuaauaagaaaaaauaaaaaucuaaaaagaaauuacuuucugaaagauuugaucaaaacccuuuuccuuaaagaaaaacauuagagcuuuaaaucuaagauuuuaaaauuacaaaucaggaugaauaaagcgaagacaacuuguaggacgaguccagcaaaagcaagugaagcucugucaaucgucauggacgagguuucaaagaaaaugcaugaggagacgcaugcucccacaagugcagaagcaagcguaagagagagagauggacaguauccuacaaaagguucucauuaaaacugcaguaucauaauaaucaacaaacaggguaucuuacuuacaaacgcuggaaaauacacgggaauacgaccaagcgcaucacacacagcccuaugaagaagccuccuaaguaaauguaacacaccuaauccuuuuuuaaauaaaauaaauauacuagcaaaugguaucaguacuauaaaaaggguauccauaagaaagaagauacaagaaauuccaaagcacgaacuguuuucucccucuggggacugcuuuccccuccuuauccgugcccucuuaccuuccuagcuggcauuacacgucaagucacacuaacgggcucugucugguccucugcacucuacacaacacccauucucucacuuccuaccuaauauaacaccagccuuaaaauaccaccuucucaccuacuugcaaucgguuuuagagccauacaaauacuugucauugugguggcaacuauccugccauuaacuugaggcaguuucugacauuaucuaaauagauccuugaaggaauauuuaaaauaaacaaaauuaugaucaacuauuauaaacacguaagucauuacauuaaauauuauaagugaaaaagaacaugugucaucucaacaaaacuguaugguuaaaguaaacaucuacugcccugcaugguagcauacaccuuuaaucccagcacucagaaggcagagacugguaggucucugaguucauagucacccgauauuacaugauuaaaacuuccucguaaaauaaaguauugagcuagagagauggcucuacgguuaaaggcacuggcuacucuuccagaaguccugaguucaauucccagcaaccacaugguggcucacaacuaccuguaauagaaucugauccucucuuucuggugugucugaagauaguaccguguacucauauacauaaaauaaauguaucuuuaaaaaaaaaaaagugucaacgaccauaaaagugccuguugaaugaggaaaaaaaaaucgcucuauucucuauuaaaaauuugaguguucauuagcuuuaaaaugaaaagcauuuaauuuaaaucaagaauaggacauucaaaucagaaagaacagcagcuauucugaaaaccuaccaaaauaaaaaauaaaaauaaauaaaaa

SEQ ID NO: 2519 - RNA, 3283 nt, Mus musculus
uuuuuauuuauuuuuauuuuuuauuuugguagguuuucagaauagcugcuguucuuucugauuugaauguccuauucuugauuuaaauuaaaugcuuuucauuuuaaagcuaaugaacacucaaauuuuuaauagagaauagagcgauuuuuuuuuccucauucaacaggcacuuuuauggucguugacacuuuuuuuuuuuuaaagauacauuuauuuuauguauaugaguacacgguacuaucuucagacacaccagaaagagaggaucagauucuauuacagguaguugugagccaccaugugguugcugggaauugaacucaggacuucuggaagaguagccagugccuuuaaccguagagccaucucucuagcucaauacuuuauuuuacgaggaaguuuuaaucauguaauaucgggugacuaugaacucagagaccuaccagucucugccuucugagugcugggauuaaagguguaugcuaccaugcagggcaguagauguuuacuuuaaccauacaguuuuguugagaugacacauguucuuuuucacuuauaauauuuaauguaaugacuuacguguuuauaauaguugaucauaauuuuguuuauuuuaaauauuccuucaaggaucuauuuagauaaugucagaaacugccucaaguuaauggcaggauaguugccaccacaaugacaaguauuuguauggcucuaaaaccgauugcaaguaggugagaaggugguauuuuaaggcugguguuauauuagguaggaagugagagaauggguguuguguagagugcagaggaccagacagagcccguuagugugacuugacguguaaugccagcuaggaagguaagagggcacggauaaggaggggaaagcaguccccagagggagaaaacaguucgugcuuuggaauuucuuguaucuucuuucuuauggauacccuuuuuauaguacugauaccauuugcuaguauauuuauuuuauuuaaaaaaggauuagguguguuacauuuacuuaggaggcuucuucauagggcugugugugaugcgcuuggucguauucccguguauuuuccagcguuuguaaguaagauacccuguuuguugauuauuaugauacugcaguuuuaaugagaaccuuuuguaggauacuguccaucucucucucuuacgcuugcuucugcacuugugggagcaugcgucuccucaugcauuuucuuugaaaccucguccaugacgauugacagagcuucacuugcuuuugcuggacucguccuacaaguugucuucgcuuuauucauccugauuuguaauuuuaaaaucuuagauuuaaagcucuaauguuuuucuuuaaggaaaaggguuuugaucaaaucuuucagaaaguaauuucuuuuuagauuuuuauuuuuucuuauuaauggauauuuucuuuuuuaaaaauuucaaauagaaugucaaacuauuaguauuuaauauucuguuucuuuauuuucuggaccaagaacuuaaccucauacauaaauugcaaggucaucucuuucaaaucuuuugaguuucuucuuuuccuaacguauguucagauaucauaaugugcauauucaucauuuucuuagcgagguaauaugcaaaacuugccacauugguguuuuguuuuguuuagcugcauauagugguaguagguuguuguaugcucaugacugaaccacccuggauauacucacugucugcuaacauuauaagauagauacucuuccuguguaacuuguuuugcguuauuuuguaacugauaguaacuacuauccuuugauugugauugcuguuucaucuauuuucaaccccuuuucuuuaaaaguuuuuauucucuguguguguguuaaaugguaagaguguuauagaaaaaucuacuugaaauuuuagaccauauaacuuuuauuuuaaacaugauuagucuacuuuguaaaguuuauacuuuuuaaaaacuuaaugcuagaugacauuagugguuuugacugacauguagacagauaaguaccucgaagcuuacaaauagaagucauguuuugugucacuucuaucaagaaggcuauguuacuaaucacuaguacauucuuacauaauagaucuuagugaaaguauaauauuugugacauggauaguuccaaauguaaaaauacaggacuggacuaguaaugauuuguuauuuagucauguucacuuucauuuugcuaacuucuaucucaaaaccaugagucuugcuauucaacuuaacucucccaccccucuuuaaacaaacaaacaaacaaacauguauauguguucaugucuggugugaaugugggagccugcagaaaccaaaggcauucuggauccucugggcgugaaguuguuaagugguuaugagcugcugauguaggguguggggagcugguuuauccugggucuucuggaauagcaauacgugcuuuuaauuguucagccauaucuguagugccaauguguuccuuucucugguucucgggauuuauuuauuuguuuuguucuggcuuuuuaagacauagaauaggguugagaugacaguguuagcuguucuuugaauaucaagacucagauuguaugcagugacuuaugaauccacuucugcauucuggaauccaguccacucgacuuaaacacucauccugaaguauuuuggaugugaggguggucugugucuuguuaaucagcugacccaucaccaaagaaccuacauacucagccuguguggaaaacaguagcauuuaaacaccuuuuguggcuucaagcuaccagcacauaggcaccucucaacauccuucaucuucucagcuuuucucugaagaauuuggccuucgccauaacaugcuguauaaggagccugccuuuccccagaacuuacaguagccugcucgcacaucagagauggcaacagcuucagccuuguuguuuuguagaaugagccuguuuccggauuaguguucacaauuuggauagguugccaguuggguagaaauccugauucuuuaaguggugauuccucacaccaacuuucccaaaagucgcccagauguuuguuaaaguugauuuugcuaugcaugccaccagcaacccccaucuuucuaggugcuuguggcauuuauugauugcucuggcagccguggcucaagagguccugaaauguccaggucuucacuagucuccuuggcauggugggagcugaaaggaaagaaagucccucuuuuaaccaaaaa

SEQ ID NO: 2520 - RNA, 1311 nt, Mus musculus
auucucucuagacucuagggaauagaaauugggagugagaagagacugggacucuaggcaaguuaggacggcuagaguuauugggaaagcaccguagagaagagucuccaagaucccaagagaauuucuugaauguucagguaaauaccagucauuuguguaaggacaguacccgcaugcaggagggaaggcucaugaccagagcaaacaaccuuuguaggacacgugagggcugucugaaugccugcucucugcagucagaggugaacgccucuucagaagaugacaaggcaacagagacaucuugccucaguguuaugcuucaccccagaacaaauauugguuugguucuuauaauauugcuuaacagcaaaauaucaucgaaagagugauaagaagaaaauuguauguuaaucaaagggaaaagguguugauauaaagaaaaaaagaugagaaucgguuucuuaucaggagcaaugugagcuacaggacauaauaauuacauacuaaaaguacuaaaauaaucccccaacaacuuggaguacuuuaaucacugaaaauaguccucaaaagccaaaaugaaugaggacuuuagacauucuuuaaaagguggaacaaauucaccaccagcagaugcacacuaaaagaaaugguggaggaagucucuuagcaaaauuaacaaugauuaauauuuuauuaauaauacuuuaauaacuaauaaauauuaauaauaacaaugcuaaauggauucaaaaauuuauauaaagaaauggaaaccagaaugauauaaagaaaugugagcagaaauggccaccagaaggaugaacaaaaagaggucuuuauucagccauccuuaaaaagcaaugaugauaacuaacuuuuuugaggcaguaucuuuggggggaugaagagaggugaauaaaugugugucucucucuuugucucugugugugugcaagcguguacuuaccauagaguucaguagguaaauaggguauuugcaccaagccugaaaaccugaguuuaaucccaagacucacacaguagauagagagaacugaauucugcaaguuguccucugaccucuacacacaagccacagcacgcacacacacaaaauaaauagauaaauagguaaauucaguuuuaaaacauaaugaaauuguuauucuaaaagacaggucagaaagagaaaggggaaaauacaugaaucaaacaaacaagaacguaucauaguauuaagccaaauuacuaaugauugcauuaaauggcaaugguguaauugcugucauuugaaauccucaaaauaca

SEQ ID NO: 2521 - RNA, 2330 nt, Mus musculus
caguuuccugccugaaggaagagagagaacagauaaaaggggugcaguggguuugagaacaccauagugcucuguagagccccaaucuccacaccuccuccagcauaucccgagcuggugcucccugguccgggaucuuguccacaaugagccuccagcuccgcagcuccgcccgcauccccagcgguuccaucucgccauucaugcggauggcgccgcuggcauuucuguugcuguucacgcugccgcagcaucuagcugaaggugagggcgcagcaccugcguggcgcagggugccugacccauccgggcgggccaucgcagucagcgggucccaggagcggggaaaggggcucuuccagcauccuccuauaaucuugucucuuccacagcugccccuuccucagucauagccgcaacggagcugcguuguguuugcuuaaccguaacuccaaaaauuaaucccaaauugaucgcuaauuuggaggugaucccugcagguccacagugcccuacgguggaagucaugugaguucugacuguguucugggugcaggugaucuugggagauggaaguccaggacacccccugcccuacccacaucccuuaucccggauucuucagucacccgggcucaccugugcauccucuuuuuuuccuccuccgcagagcuaaacugaaaaaccagaaggaggucugucuggauccagaagcuccugugauaaagaaaaucauucagaaaauauugggcagguacuugcuaucuuagucucugcagcgggcaagguccuuauucucccuguaugaguugaggcucccaucccacauucgaaacugagcuuagaauaaaaggauucagaagggaaaguuguuauucugggauguugcaauaacccaaaacucaucucucucucucucucucucugucucucucucucucucucugucucucucucugucucucucucugucucucucucucucucugucucucucugucucucucucucucugucucucugucucucucucucucucucucucucucucucucucucucucucucucucucucucucuguguguguguguguguguguguguguuaggauaaacugaagaauuuuaguuacugauauaagucuuuucucaacagugacaaaaagaaagcuaagcggaaugcacucgcaguggaaagaacggccaguguucaauagaaagauuucugaggacucugaccccagugaagauaagaagaaagggcugauucucuccacccacggauuuucuuuaugaacucccugcuuugaugagaaaagggaaaccauugucccugaagcuuccugcucaucucacaaguguauuuagcaaaaauauuuccuauucuuuccuaucugucacacuaucggaaauugugauacuuuaguguguaagucaagaaucauugguuguuaaccuuucaaaaugucuugaacugaaggugacuauugcauugucuccggaauauguauauguauauguauauguauauguauauguauauguauauguauauguauauguauauguauauguauauguauauguauaugauguauauguauauguauauguguguguauauauauauauauauccuuuguaauguucaugagaaggcaaugcugucauacucucucucauaaaauggggaccucuuuuacuguuguuucuuggguguguuaagaguguucuuacgucugagccugggcuggcauauaacuuuuaugguuuuagaaagcugcugugucaugcagaaaccuauguagaacacaguuccuuauuuagaauuucuaaauguguaaguucuagaaggaucaauguguucucaucuuauaauuuuagacauuugaugucuucguaguauggcauaaugucaugacuuacucaacaaacuguauacuauuuauuaauuauuaacuaguuuauuaguauuacuauuugggccacuaacuauauauuuuagauaguauauauuuuagauaggugaagaagguaagaagcaaggaaauuccuuaccuaguuuucauaaaaaacauuuaaaaguuauuucuagggagagaaacuuuagcaaauaucuauacucuuagaguuuugaaaacauacuuaacauguuugaauauggauugcugagauauuuagaugucuguagugugucuuuuaaagagugugcuuuguuauaaggagauuaaugaauucaucacauccauuauuuuaagccuguacaucuuauagugucucacuucuuuauauuacucuuuugaggaaaauaaaguagcucuagauuccau

SEQ ID NO: 2522 - RNA, 3502 nt, Mus musculus
cccagaucucaccacagcccuucgcaccagcucccgcgcuccagacuccagccacacuccagccuagcgccauggccccucccaccugccggcuccucagugcugcacugguccugcugcugcugcuggccaccaaccaccaggcuacaggugggauucggauucgaggcugauguuucuggggaagccucaggugggcgcagccauccccagccccucugacccggugucuucuccuacaggggcuguuguggccagugagcugcgcugucagugccugaacacccuaccaaggguugauuuugagaccauccagagcuugacggugacgcccccaggaccccacugcacccagacagaagucaugugagugucucccuggauagccucuaccauggccagaauagcccagaugcuccugcggccccaagcucaccccagcagaaccucgagccuuaauaacgaucccuacuucucugugcagagccacucucaaggauggucaagaaguuugccucaacccccaaggccccaggcuucagauaaucaucaagaagauacugaagaggugaguggugcuuuguuugcacgugauaacccucaucagaguacuggcuucuaucucucgagaaucuuaucagggaaagucacagaacuacaauagugauuauuaucuuuacaauuauaauaauuguuuuugauaauuaauuagccuacuguggugccugaaggauuuuuccaggaucuuuuaucccuaccuggagccucuuucuaucgcauaagagggagauagcacugcuuuuuagaacauucucaucugccuuggccucccaauccuaguuaguucuaaaaagcagguccgugguguuuggaaacagguucuaauuuuuaauauuuagugaggaaaagcagagauuuugcaguggcucaguauauauauauauauauauauauauguguguguguguguguguguguguguguguguguguguguguguguaauaucaaaacuuugauuauauauaaucaaaacuuauuaucuauuucuuucuggaaauuuuaucuugaaacuuaauaaaaaaaaauaguagcgcuucauaaguuaagugagaccuggugugacagacaaucugcuucaacagcuuucguuuuuugagaccccagguccccuguucaucucuguccuguaggagagcauccgcaagccugagguguuugcucuguggcacaggcaucacaggccaggguccuuagggcaggcuguccucagaaaacccaggagaaugaaggaugcugugcaccuaauaaaaacaucuuacuucucacgacagcggcaaguccagcugagccgggaaaggaggaagccccucaccaugaugaaggaccugcauucuaaaucagagaaaagcgauccaucccaacggugucuggaugugucuuuaccugcuuguuuuuaacaacuccugagaguucauaccuauuuuauuucacauguaaaauaacuacggguauaauugcaucuacuugcaagauggcaucuuauuuaauguuuauuuaauaucaagucuaaguuuaaccaagccuauucuuaacuugaagguuagagauuuucagauucuguuagggaguuauauugcuauuucugaggcaguauuccuuggcuggccauuuugguggcagcugugauagucaaaaaacagacaaacaaggucaugccgguguaggaagaaugcaugugcacaucuaguuuuguaacuauacaagauuaucaguuguuauuuauugaaauggucuuacggugucacaugaaauaucaacuuuguguuaaagcuuuaagaauuauaaugcauuauauauuucuuagacauuuuaagugauuuuuuaaaaauaaggcacagugacuauuuaaugccuuuaugucuuagaauggagaaguuuaaauauuuauugguauuuuuacaaauaauuugaaaauaaaauauuuuaaaauaaugcuuguuccauuuccuuggagggccuguugcuuaagguuaauccaaugaguuaccucggcguuucucaaguuuucuuccuccucaccacacagucagcuaaaaaagcaaaucacagucuaagucauggcucuguucaugugguaguggcuuuugcuccccacccaagaguguaauuuucccagugcugacucaagagaauuucgaccucuccacucuaguuccagggcaucugaugcccucuucuggccaccaagggcaacagguacucauaugguacacagacaaacauguaggcuaaucauccauauauacauauaugugugugcguauauauguauauguauaaauauguguguauauguacauacacacauacauaaauacacacacauagauagguaauuucuaucuuacuauguaugaaauuacuacccauuuuaaugcucuaauucuuugcaucaauaugaaaaauauugguauacacaugguauauacauuggauuugacuauauuggccucaucuuucuuuguggcaauuuagaccuugaaagaaagccuuagaauagccuguguacaaagaugcucaggauggaagcuacacuauaguuucuaaggacauauuugugugaaaaagaaaacaugacagucaucuaaagcuaaacuccaaaucugggaaugcgaguuguuuguguguggaccuacgaagcaccugcuuguuuccuauuuggggauuuaggacucauuaggaaauccuggauuuggguagaggcaaggaccggaagccugaguauuugagaucuuucaacuuguucccaguauccgaauuaauaaggcugugagcggcaagaaacaagcucugugggcugcccauacacacucacacaggagaaugaagaguugaaaguuguaauaaucucuucaucuccaagaauacugauuacaaaugauucuggaagguagaaaagucuaggaacuaaacagaaauaaaugcacggggacccgacuagaagcucccuccacaacgcuaccauccucucccugacucggagugacuggauacaggaaaagggagccuauagcuucaguggagccauaauucauaccuaagacccuccuccaacacuggaucuuguccuuccggcugcuauguccucgccagcaguagucaacauaggacacaggaaggaaaaaaaaaaaaaaacuggcuaaaacuagguuucaaagaaucagauugacuucggguuugucgacggucuuaucacaaucuuggccaacuuucuugauuaagaauugggacacaggaugugagguggaggucacuaguugaagguagcaggaaaugaaaauguugcaacagaacuauuucuuuagccugguuaccggaaacacuacggcauggauggggcuccugaguaagguuugagagagguuggggggagggggcugauaccacccugccuugggaguguuccagaggaacccuccugagacuaccagaaauagcca

SEQ ID NO: 2523 - RNA, 1883 nt, Mus musculus
uccacaacaggacucagagccucuaaccaguuccagcacuccagacuccagccacacuccaacacagcaccaugaucccagccacccgcucgcuucucugugcagcgcugcugcugcuggccaccagccgccuggccacagguaggucucgccacugccacugggggaggagggaccucuggugagcgcagccucccacagucccgcugaccaagagucuucucccauaggggcgccuaucgccaaugagcugcgcugucagugccugcagaccauggcugggauucaccucaagaacauccagagcuugaagguguugcccucagggccccacugcacccaaaccgaagucaugugaguaucuucccgguuagcuucugccacuuccagacucgcccaaacccucccgcgcccccacacuucuccuagugggaaugccuaacaugugggucuauccuucucucugcagagccacacucaagaauggucgcgaggcuugccuugacccugaagcucccuugguucagaaaauuguccaaaagaugcuaaagugaguugugacuuguguuuguacccgagacuagagucaagggugggaguacuggcauaugaccccugaacguuaauucuaucaaggaaagucuguguuuaucaggaggucggaaaguugugguuauuauuuugguaauugaccuuaauuugagaucauuaauugguucugaugcuagagaauuguguccucuuggacacaauuacuauuguauauuacacaauuacuauuguguauaauuauuaccacacucaaaaccccuaugcaaauggucaguggcaacaguuccuaaaagauggagaagucgccaauagccuuuaaaagucuccuuaggggcuggcaaagcaugcccgagccuucuuuugccagugagauuucccugaguucaaggcuaaggucucugugaauguuacauaauuuauugaauuuaagccaaguaggggagauaauagcagcuauaucacagaguugugagugagagaggauuaaagucacacuuguaaauuaacccaugcugaaguagguuuuuguuuguuuguuuuuguuuuuguuuguuuuuguuuuccaagucaagugauugacuccacaggaaccgacaguacagaacucugggugcaaguguagacauguagaaagcccaucuggagccucaggggcuggaauaaaagaagaaaggcuuugaugacuauuuguaacaaugacucuuuucugauugcagagguguccccaaguaacggagaaagaagacagacugcucugauggcaccugucuggugaacgcuggcuucugacaacacuauacaauuucuuuugaggguccuauuuauuuauguauuuauuuauuccacaaagugugugguuuuuauuuuacauuaauauuuaacaguguggauacauuucaucgaugguaguucaguucugcuuguucaguuuaaagauggguaggcuuaaaauauuucauuaaacuaauauuuauugggagaccacuaagugucaaccacugugcuaguagaaggguguugugcgaaaagaagugcagagagauagaguuuaguauuauguuuuguauguauuagggugaggacaugugugggaggcuguguuuguaugucuugaaaagaaugucaguuauuuauugaaagucgucuuucauauuguauggucaacacgcacguguugacgcuucccuuggacauuuugugucuaguugguagggcauaaugcccuuuuacauucuuuaacccuguuucuccuggucucgucucgcucgggacagagacguucaaaggacuguuacaaaugaaguaaaaauaaaaguuuuauuaaaaaaaau

SEQ ID NO: 2524 - RNA, 605 nt, Mus musculus
agccgguuccggccucacgcgcucugcugugacaacaugaaacugcucauccacaaucuccuaagcucccaugugcggggcgugggcacgcguggcuucccgcuacgccugcaggccacugagguccgcaucaaccccguggaguucaacccggaguucauggcgcggaugauccccaaaguggagugggcggcgcuugugcaggcagcggacaccuuaaacuuggcugagguacccaaagagccgacugaaggcuaugagcacgacgagacauuuuugaggaagaugcaccacguguugcuugagguugauguacuggagggcacccugcaaugcccagaaucuggucgucuuuuccccaucagccgcgggauccccaauaugcuguugaaugaugaggagacugagacguaaccuugcuagccgccacuuugguauuuuguugacuguguguuucuguuguacggucuguuaaauagacgugucaugugugacccccaaaguccccccagugacucgccgaccaccguguacuugagcuccauaguauuuuuuucucauuaaagguucaaaaccaaaauaauaauaauaauaauaauaauaau

SEQ ID NO: 2525 - RNA, 1756 nt, Mus musculus
guaagagcucccugggggacagccauggcgaccagugggagcaucucgccugagaacuuagacuucugauggucauuguauuugugcaaggaacuaccuuaaagugaaacauaacuaaaaugauuuaaaagcacaguccuaggcucucauguggguccaggaaugcuauuaauuucuaaaauccagacuaaaagauucuuacuuugcaaagcauaaaguaaauacuuagaaaguuuucccaagggguggauaauaauuuggccaguuacuaauagagaccugcccagcaaauaauaaaugugauuccuaguaagauauaacuccuuccaagugacaaaacuucaccccaaagcauagaucagaaauaagaggagaaagaguuucccaccacccagcaagcaaaugcuggcaauccuuaucauuaaaacaaagcuuacuagguauagaaggaauugggaaacacgagccauaaugaggaaaauaaccaaagcuaacucagaaccagaguagauauuuuauuagaaggcaaauaaaauuucacaauuuuauuccauauuuuuuuaaaaguuaaagaacaggcagcacaacuuccagauagcggaguggccucagcugcgagccgagcgguggcggcagugccccucaggacacccgcagaucaccuuuuccccgcgacuucaucagggcugagugcuguguaccgguaugcccacggcugauguguaucccuccacuguaugcugaccucggcaauguugccagagacauucuucaacaaaggauuuggcuuuggguuggugaagcuggaugugaagacgaggucaugcagcaguguggaauuuucaacgucuggcucaucuaauacagacacugguaaaguuagcgggaccuuggagaccaaguacaaauggugugaguauggucugacuuucacagagaaauggaacacggauaacagucugaggacagagauugcaauucaagaccagauuugucaagguuugaaacugacuucugacaccaccuuuucaccgaacacaggaaagaaaagugguaaaaucaagucugcuuacaagagggaguguauaaaccuuggcugugauguugacuuugauuuugcuggaccugccauccauggaucagcugucuuugguuacgagggcuggcuugcuggguaccaaaugacuuugucagugccaagucaaagcugacaaggaguaacuuugcagucggcuacaggacuggggacuuccagcuacacacaaauguaaauaaugggacagaauuuggaggaucaauuuaucagauaguaugugaagauuuugacacuucaguaaaccuuguuuggacaucagguaccaacugcacucguuuuggcauugcagcuaaauaccgguuggauccuacugccucuaucucugcaaaggucaacaacucuaguuuaauuggagugggcuauacucagacucugaggccuggugugaagcuuacacuaucugcucugguagacgggaagagcuuuaaugcuggaggccacaaacuugggcuugccuuggaauuggaggcuuaauccaguuaaaagaaaccucugggaacgaauaccagaagauuuggccuuaauauauuuccaugagaccagcaggcucccccuccccaccccucccagaaggugaucaugaaaggaugauuaagcaagaguuguauuuuaaauauuuagacagucauuguuggcugguuccuaguuggaugauuaucu

SEQ ID NO: 2526 - RNA, 1207 nt, Mus musculus
cggcggccaccuucaaccccggauucaguuuccgggcacagaaauggugcccggaggccgcuacuuucgcaucugcguugcuucugccuccgccgacacggccuccuuccccucccccacgggcggggcgacgaccgggaacuagggccgccggcgagcggaggaaccaggcgggugggcuuccuacccugaaaccgccucugcaggagcccacugccccgcuucgcggcuuggcgcccguuggcgcgcucugggagcuggcggcggacaggguacccccgggcugcuucauccuagcaauccccagccccaccugugcccuccucugcaccacgcgcgcaggucauccuccuccccacgcagccuuccgcucaccuugcaggaaaggcucggcucugcacgcacgcacgcacucuugcuggcguaggcagccggcgagaacaauguuuccgccgcaccaaccccgacaccaagcgcacacaccggacgguugccgcgagccgcggagcggagggaaauguccccugccgaccaccacaccgaccgccccucucggcccccguacacaccuccaaccaacagcggcggcgggcacgucgcgcggaggucaguagugucgcgggaucggccgcagcagauucuccucccucgaagcaacccgaggcuucggaauccggagagccgcgagcucggggccccucacagccaccucuucccgagagccuagagcugcaacgagcuccaagaacacggacgucccgcccccuuugccgccgcccccucuuauuguuuuaccccugcggaaagggcuagggaaccccccagcacagcgccagccaaucaggcaucaguuuggagagcuagacccaaccuucucgcgucccacugcggagcacgcgcagaacggcgccgcgcucgcucgcucgcucgcucgggcguccggaaagccagggaaccggaaccggccuaaagucggggcgagagcccgcugauuugacgucacaaggaagcugccuuucucuugcagugaugcugaagccucccuguccucucagguggcgcgaacaaaaaagauggcucgccgcuaaccaguggcuuuuacaaacgguuauuccuggagccuuuauucgugauaagagggagcaaauuuaguaaugguccugguugcugcguuaucggagcauuaaaaugcaguuuugaacucugc

SEQ ID NO: 2527 - RNA, 2601 nt, Mus musculus
ugagucagcaauuucacuccgguucuuggaucucacaccaggcacuuucucuccucucccaguccugcccuccgacccuguuucaaucagcuccggggacugucuaccuccaggacggguaaggauaccauguaacaaguucuaggagcaaaccggcucacugggagauggagggcaaggcugcaguauaggaaggaccauuaccagcuggcaaaagaaagcucaaacugcugcaucagggagcuccagcccgggggagcuucuaaaagcucuagccugcagaggggaagcugcuucgagacacugagugccggccagaccaaucuaucccucuggcccugcugugggucaucgccaugugccucaucugagacuguuuggauuuccuacugcugccucacagacgggcuucaggcacauuuucuuuuuaaauuuagacagacuucaguuuucaucaaaacccugccgcuuugaaacugugcucuugagaaaaagacuuugucccuccccagugccccacgccucaaccccacgaugcuuagccagugguuaagagcuaauaugggcucuguucaucaugucacugccuggcuuuguuuaaaaugguguggauucugaacauucuuuaaguuccugacgucaaccguacacaucaaauuaauaccgaaauccucauuucgcucuggcccagauucuaggcccagaccuaguuagcagccuuucaggaaggcgaauggcugccaugaccuauggagaguuuggaucucagaugucuucuuguuugagacaggacaucccuuagcucgggcuggccuacaacaaauaucucucgccccugccuccucagaacugggaaugaagguguguaucccuacuccugguuauuuguuuuuuuaauguacacauuaagauguaugugcgucaguacccacaugacaccaugaacaugcugggcuaaaaggacaacucuguggagacacuucuccccuuuggucugaaacucaagucaccaggccuggaccaucagauggcaagaccaccuuuaccuccugagugaucuggccagccugcuucucagguauuuuacaguagagacaaauacuuaguagauuuuucuagggucacuuugggucuuacaaacuuuguggcucuguuucagaaagccacguuuaauagguggagaggaggugaguggggcaaguugggggcucgucuaacucuuuaucucuuggcugagucagugcucuauuucugugaagaaacaucaugaccaaggcaacucuuagaaaagaaaacguuuauuugaguguggcagccagggagguccuagagcaagagcugggagcuacuuccggguccacaggaggagaggccaggccuggcaugggcuucugaaaccucaaagccuaucuaccccacagugacacgccucuagcaaggccacgcccacucaaaggccacuccuccugcuccuccuugugucuucacguugccacucuucagugacuaagcauucaaauaugagacuaugggcgccauucuuauucaaacugccacaucugccuccaguuauuuccacucagauagaaaugcaaugugacacaaaauuccucagauuaaauaacagcaugcuccgcugaaggacuugcagagccacggaauggaugcuaccaauaugcuaaugcagcagagaagggaggccgaagggaagccuccccucucucugccugucuauccuucuugcuuuuccaccucucacgccacuguccacagccuccugaguggcuggcagcaacaucuacacccaacucucuucuucaauguacuugacucugacaguuccggagucucccuccaccugcauguuauucagcugagcuuuuccugguuauuuggcggggguggggcggggagggggguggggggaauuaggggguguagucacuaaucguauggcauuggcaccccaucaucaacuccauuaaagaacuagaauggggguggggugggaauguagcugaaugggaaauaacauguuuagcaugcuuggucuaagucccaguaucacacacacacacacacacacacacacacacacacacacaaaagggaaggguuggauggggauggggcgggacuuugaagguguaggcuggcuaguuuugggaguuucuggucccagaagcucaggcuaauuugacagacuacauucuguucuccacagacaggcagucuugauauucugccugccaccuccuccaugggccaccagcaaguaaagacagacagcugcaacuugcccuguaaaccaggcuugcuggagaaggggcuggggcucuaucuauaaccaaucaucuuauacuuucauggaaucuuggcagcagccaaugagaacuucaaaggcuuggccuagcugugggaugggacaauaaacauguuaaucccuugucuuaacugcuuaggaccugccuguucagccagcagcagggagaaggagagagcaauagaggugaggaggugauggccaaaugccucacagaagccaaagugcaagagccuggaucccacaaacuuguucaauaguuuucuaaaaaaaaaaau

SEQ ID NO: 2528 - RNA, 5516 nt, Mus musculus
acacacacacacacacacacacacauauauauauauauguucguauucagauugucugaaugaggcuucaaaagaacucaagauuaccagauacuccguccuuccuggucauacugguaacuuuucuuuuuucaaucauaaauaacuuugucuuauaaaauauauggcuucaaacuuaagaauucacccaguaacauuuuagcuuacuauaccagucuuaguauuuuguuuuguuuuguuuaaaaauauuguccuauauguucucaucuauuuauauuuuaaguuuuuauuuauuuugcuauguauuuuaauguuacucugauaaugauuccagguuauguuagaacuuuaaaguaguuaauuacuaaaaacaagguguagaacggucacagaacucuauagacaauauguuuauuuuuaacagauguacuuauuuuuauuacuuaugugagucuguucugcuggcauguaugucuguguaccacauguauacccgaugucuagugagacaagaagagggugccacccccccccccccaacuggauuuauagacuguugugagccaccauguggaugcugggaacaaaaccugagucuucuaggaacagcaaaggcucuuaaccccugagccaugcaugucaugagccccuacuuuggcaauuuguucucuuuuuauuuauucuuuucucacacauuacaccccucccuccucuccucccagccugaucucccccaccuugccccuccccuagaucuauuccuccuccucccuucucuucagaaaagggcaggcuuccaagggauaucaaacaaacaugguauagcaacuuauaguaagacuaggcacuggcauuuuaaauuugccacauuagaauaauauuugucauaauauaguagagaacagaaaauuuggccccauuuuuguguauuuauugauauaugaaauagucaacaucacuguauagaggggugaauacccgccuuaugagggcguuacucuaacaauguccucauaucaaggucauuguaaaaaaaggcaaagcuacagauauuacaaaucuguguuuccaagaaugacagaagugagcagugguccucuuuuaaauucacuggggacauauuccuaaaaaacauuaaaggcuauagugcacucaaaccaugcagauccugaauuagaaauaugcauuaccuuuucuuuuuucaguguguguguguguuaugugugcgguguauguauguuuguguauguguguuuaugugugugugguguagguauguuuaugugugugcauggaguauguauggugugugucuguguauguguagguaugugugcgguguauguuuguuuauugugugugguguauguauguuuaugugugugcaugguguaugucuauguauggugugugucuguggugugugucuguguauguguaaguaugugcgugggauauguauauggugugugugugguguguauaugguguguauguguaaggaacaugugugugguauaugugugguguguguaugguguguauauguauaagguacauguguguguaugauguauguguguguaugugcuuugugugguguguaugugcuguguguguaagguguauguguaggguacauacgugugguguguaugaguuugugcauauggaugcgcuugugccacacuacaugugugaggagcucagaggacaacuugcaauacaggaguugggugucuccuuccaccaaguggguuucauggguugaacucaggccugcaggcuugagccgucucaccagcacagaaacacauuauucuuaaggcacuugagucagaaucuaaguuccaauuguguaaaauccugcagaguguacaaaucuucuaucuuuguaugcugugguucucaauagccugaucuucagcccacuucagugaccuggcauuggguacacaggaaaagucacaacaagugugucccuuuauuuugcuuuuuuaaaauuuuguauguguauggguguuuugccugcauguauucuuuggaccacacaaaugccuggugccugauggagccagagagagcaucagauuccccagagcugggcuacagucaauugugagcugauaugaggguguugggaaucuaaccuggguccuuggcaagaguagucaaugcuauuaaccacagaaccauuucgccagcccuuccacauuucuuuuuuguuuugguuugguuuuuuguuuguuuguuuuugcuuuuuucgagacaggguuucucuguguagcccuggcuguccuggaacucacuuuguagaccaggcuggccucaaacucagaaauccgccugccucugccuccaaagugcugggauuaaaggcgugugcaaccccugcccgguccuuccacauuucuuaaguagugcucuugaguuggacauguccaccugcagucaggaggcagaagcccuccggagaggagauccugaguuucagcuagccugagcuacuccgugugacuuaauuucaacugauggcaaugauacacuugcuuuucuuguagauaaagaaaaaugaagguggugauucugauggcccuucuugugcucacagcucacuguguaccaguaaguaaccucugaacaaauguccgugucugcaaacgagcuuuaccgcauacauccugaaucuuuaguuauacucaguccugaaauaaggacaacagagcaccccaagagcaaaacagcaccuccauuuuauuuaggaccuucucuggaccuauaaggaaguagaucuuucaaccuauuuggaaagaccuuguuagaaaaccaagagcaguauguagccauggacacaggaagcucuccuggccucagagagcagcagugguucacaaucuuggcugcccuuuggacaccuuugggagacuucacaaaguucugacaucugggugccacuccccgaaucuggcuugacuggucugggguuggugccaagugucuggagguucacaagcuccugggugacucucccacugguggcugggcugaggaccauggaggaagacgcauacucagugauggacaugaaguggagcgagccugaggcaggccagucuagaccauacagccccgauugucacugcagagaaagaagagagagacugucacucagacucacagugguguccaaccugaggcuugcagcccauuggcaccucagggcaacucuggauagagcccaacacacuugcagaugacugugucagggggcuggccgucuggagaggauucuuauucuugauaagacacugugguuguacuuuccauuuccacagguaucaagauucccuggcaagauuuuccucuacuguccuuucuucaaccggaagguaaaguccccucccccucccuccaucacuucuucccuucuucuuuagaaagauaugauuuagagaaaacgaucacacagacacuguuacauacucgcgcacgcgugcgcgcgugcacacacacacacuaaacaaacaaacaaauaaacagaagucaagugaguaacuaauuagucagaaauuagcaaauuguuuuguuugacaucuuuaacgucuaccaguguuuuccucauagucuagguuucuuagauauaucuguuaugauguucaaaucccucucaaaguugcauguaacauguucccuuuagagaacuuuaugucaaucaguaaagcucuuuucuuuucuucccuuuuugucaagaaaucuggcagccaccuuuguacuuuuuuuuuagcuguugucuuugacucagauuuaaacuauagguuguggccucuuggcaaucuccugaugcuucaaaucuucccgaagaugcuuacuacgcucagacagcuaccaaauggcuucuucucucauauuuuaaauagaagagcagagagauaagugugcgucacugcccagcuaacccccagcccccuccacuuccguaugaugacccugaagcaaucuguguaaauguuuucuuaagagagcuuucuucaaaacauuggaaaauacacuuagccgggcagugguggugcaccucuuuaaucccagcacuccagaagcagaggcaggcagaucucugugaguucccggccagccuggucuacagagugaguuucaggacagccagggcuacacagggaaacccugucuugaaaaaccaaacaaaagcaaaacacacuuaaacuuagagucgcuaacaaucaccugagcugugaccguuccuuuccuuuucuugcagcacugccagagguucugugaauucuuuaaaaucuguguaaguuuuuauucucuguuuuauucucuagugcucagagaggaugaagacuugggggagguaaaggggaaggcggggaguagaaggaucggaugacuuuggacacucugccaauccauagcuucuuuuucauaaagcccuaaaccaucauuuagcaacuaaaauacuuaccccccccccaaauaaagaacuaccauaccauacuguuccuugaaaaugcuaaaggaggcaguuuucaauuauguuaucuaugaaaauaucugagagguuuuuuuaaagaaagagaacacuuguuuaaaaucgcauaauuauaauuaaaaaacaaaaccaaaaaaacuucaaaacuauguuuucaaaguucuuguuugggaccuaccuggagacuugacccggcaguuaagaacccuugcuacucuugcugaggauccagguucgguucccagcaccuacaugagccaucaugaccaucuguaacaccaauuccagacgaucagaugccuucuucugaccacaacuacaaggaaccagacuuugggucccagcucccacaugacaagcaggguguccccacagaccugucgccugggaucccggguagauggacaggacaaugacuuccuggcugggaaagaucccugucugaaaggagagaggcagagagggagggaggaggacaccuauuggucucuucugacagcagcaugucgcacacagauaagacagauuuuauuaccccacacgugcgaagcaguagaaguuaguaagaggagaacgaaacggaaaagagucuggucuuguugagaauucuucccacccuucccauaucacuuaaaaacauuauuacacaaaauagccaugucacuuuuauggauacauauacuagcugugcgauuuuuauaugucauuuuuuuuuauaagugcauuucugucuugauucuuguuucuaucagaggaagccgccacugagcagaagaacuacuguggucccaucauucccacucacaacagaagcugaccuuucucugacuggggguccucuuacucccgacaggcggggagauucaagauaguaggguuccucacagcccagaaaagccucuucccccacacagugcccaugcuacagucggaucaugcuuccagcuccuuccugcaccacagugacuccucccuaccugaugugucaauaaaaagcuuacauuac

SEQ ID NO: 2529 - RNA, 27332 nt, Mus musculus
ccuucucguaggaagaguggccauguaucacucugguaggcugcaggagggauucuguggacuguuuuccuaggaaaaggaguugaaaguugaggcuuaagaauaaucagcacaaugcacucagaugaaaacuggaugugaaaugagccaaccacagccacaccacacccacaucucaaguccaagggugacaaagcaguuuguuaucuguccacaccuagacuuaugggagacaagcucuuguuugguuaggauauuuaaaaugcacuguuaccugcagggaaacgaccacagauguauguuuucauauuguagcucaaaacaaacugcagcucuugccuacuugggauuucuuugagcugacguuuaugguuuucuucuuuagacucuugugcaaacuguaagccaguuuuuuuuuuuuuuuuuuaaacauguuaaugguacuuuuaaaggauuuuuuaaauguguaggguguuuugccugcauguguauuucuccacaugcgugccuggugcccuuaaacagggcacugggucacaaagacugauccagcucuccagccccugguuaaugguccuucugacaacauugaguauugcuggcagggcucagacagggucuuauaggaucuuucuagacacugggaagccagggaaagaaugaggaaggggagaacgcuuaaagcccacagugccuuggggcugacagcacaggucugucuagucugaaguauagcuugguaguagcucacuugccccacaucaugaggggccuuggcuugauccugacaucauucgccaguguggguggggggaugggaaggaugcugcuccuucuaauuauggagagauuucacaaggacgauuugccacagaccuuuauuucucaccucacuuuuacuuuuugguuucuuacacaaugacauuaaguaaaaacauauacaccgugaaagacucagaaaguagaaagaaaauacaccuuacacaugaucccagcaccaacucccacccccuaauauuuggcacauuuucuggauuuuuuuauaauuaccuacauguacacugaauuaugcuacaaauccuuuucaaacuuuagcuacuuauacacugagaugagauggucaaaacacacaagcagaaucugcaggagaaaaugacacagacagccuuauaggaagaggaguugugcuguugacuguggcugaagcugcugugcucuccgcuuuccuuuguaucuucacaugggugagaagcagagacgacaggaaaggcuuaaucccggagcucugaccugacccagaguuccagcugcugcaagcuuucuucuuuuggucaagcucucucuacucuucccccauuucauauccucaccccacccccaagcccccagacaggguuuugcucucuugcuauguggucucaacccagagcaccccacugccugccucauucucccaagugcugggguuacagguguguguccccauaccugguaaagccucccuaaaucucgagaaauacacuccaaaccauguaaggaacgagaggguacuauuugggagaaaacaucaucuagagagaguuuaaaaauaugucaccuagaagagcuuaaacaggacacucagaacaauuaaacguuuuaaacugaaauuucaacguaauacucuacaaacauuauacauuuuaaacugaaauuucaauguaauacucuauauacauuauacauuuucaaaaaacaaaauuugcauuaacuguaacauuuaaaaacuauuccaguagccaccggacuuaggaacuguuuucuacagugcgguccugccuaccacacgcauugggaauaaguuucaacaugacacaaacaucuagcagugcuuuauacacaauggauauucaauaugggcuuuacacuagcugccuaaacauuggguuggaugguuaaaauaaacauagcaacuauaaggaaaacaacaacaacaaaaacccucccaaaacacaauuuacuaaaagagagguagguggucuaacauuuacagauggaaaccguggcaggcugggguuaauccucauguucaaacagcugcugugcccucuacaucauaggagacccuuagcuagcaccagagaugcugcagggaacaggcgagagcguccugugaacuuugcuaaugccaugcauguggcaugcuggcauucuggauuucuaugccaaucccuggguaugacccagcagccuagaacuggccuugguacugugugccugaagucccaggggcugggagcuccagcugcuuucagagcuccggcugcucagagcugguuccugagcacacacccgugaggaacacaggaagaaggccaagggacggcuucaggucucacacacacagauaggcaccagaaacuuccuccacagcagugcugggugaggcugacgggcaguccccuacagugaccugggcaccguuggggaaagcaagggacaaauaaacccaagucgaccucagaagcugaacagagccaucgauggagaggaaggcaaccagcagcaguugcucuccagcccaggggcagagacugcccuuccucuaacgugaacaucaaaccuguucucaugacaauagcaccuaggaagucugaggcaaaaggcaucaaacugcuucuaaagccagcagccugcaugcagacuggguccugcaaugcauucacguguggcaacagcagcacacaccgcgguacacacccaucugacuacuaaccaccuguagcuuugguugagaacaaggcacgggaacugaucaaaccaugugaagaguaggcacucagggguggggugaagcccagggagaaccugcucagggugagcaagagggcccagggcucgccucccgcacaggaaagaaaggaaaacaaaccccaacagcaacaggcagcagagaaccagccacccaacgauagcucaaagauagcuuugcuucucaauuacguagcucaggcugcccugaacuaacucaggaugucaaguugguucuaaacucacgagccuccugccuugacuucccaagugcugggauuaugggugugugccaccacacccugcuaggcauuucaaaaucacuauuuagacuuaaggcaauuaaaaaaaaugagagcuuagcaaaaacucuuuauacuaaaaaaauaaaagaguggagcucaacugucuaccugaaucuguacagcaggagccuguuugagcaggcaagccuauuuacaaguaagaaccucuuacucuuguaacacuguccugauugcagagcaugaauaacucccauccccgcacaguuaguccaggagcccagugaccccaggaagacggacuagcugccaccagggaacuauguacagcuuacuauaaacaccguauguacaucugcccucagucaagggcucuggcucauucagcuacauaggcagcagcaaucaguagguacucagcacuucuuaacauugcuacuauuuacauuucacauucccaccagccccaccucccaauuaagaauaccaaauugcuacaaauguuacugugguuuacaaauuauaguguuccuugacucuuuaauguaaacaaauguuuacuaauuuuuggcaugcugauacacacagcauggggcaggaaauggauaauuugcugauaaguuacuucauucuuuuccucuuuuucagaagugcaucucguagugcuagcugcaagagaagagaaagacuaugucaagaaccaguaagaaccuguuacaucaacuacaucaucaagguaccagacaagaacgacuaggccaagaacucucauaacaacaucauguaauaaaauauucccuaaaggauccaauccaagucagcaagauggcucaguggucaaaguaagacaaucuuaccaugucaccugucaucucucuucaauagcuccgacuucaagacauuaauuuaggaguuaaaauccagggaauuaagcucaaggcaaagaucucuuccuagcuaauucaggcucuuacuuaaaauuuuuuuuuuuacuguagugugugugugugugugugugugugugugaaggugcacaugcccuggugcccggguggguuucacagcacaucuugguugaacuaauucucucuuugcacaucaugguuccugaauuuuaccucaugugccaucucaccaaccuaggcuguuaaaauuuuuaacucuuaaaaaaaaaaaaaaagauuuauuuuauuuuauuuauaugaguacacuguagcugucaucagacacaccagaagagggcaucagauccuauuuacagauggcugugagcccacaugugguuguuaggaauugaaccucuggaagagcagucagcgcucuuaaccacugagccaucucuccaggccaauuuuuaaaaauuuuaaaucacuuuguguugaaauacaucaggugggguaaaagcagugguguguguuguagcugguugugauucugucuucaaaccacaggaucugugaugaugucugcuucucuaucaugcuaaaaaaaaaaggcauucuauagaacagaagugagggaguggugcccuaagcuaaauuaaaccuuguucaaagccaggcugcuaacaggguggcugcguuuuccucagccuaagauguuagcaaggcucaggaggauagagcccuuauguagaaauggcaucacuuuguuauguacacguguuaaagacggauuacaggcaaaagaaaggcagagcagagcucaggcggugggacccucgcagucacauagcugccuagagggcuggucucuacacucagucuuggcagccugucguuggcuagcuaccaggaaaccauguagucuggaauugguuuucuacaguugcuucacaaugaucugugauaagaucugauaugcauccacgagaggaggcugcacaauguccauuacugagauaagcaggccagccacacagcaugacccugggccaugcaugguaccauggugccugcaaucaugaagcaaagcaacaccuagcuggcugaagcaagagaaucuccaagaaaagccagccugggugaguucacacaguagccaccgccaccacccaccccccccaaccccacucuugcuucucuuacuuacagagaagauccugggucacccacaggucacauggugacugcuaucaacucaaguuuaagucuuucccacccugacugcucccagccucagagcacacucggcacguggcccucagaagacaccccgccugucaaacauaggcugucuugaacacaggcuucacgcuagacccaccugcuucucccggaaggaccgugcuguuuuugaccggacauucuggcuauaccgcaucaucauaaaguucuucugcuuuuucuucucuuuguuuguggaacuggaaaauggguuuauuuugguuuucuuccucacaaacuccuuucggucuguccuuccagccuauaagcacaaaaaaucagugaucaguauuucuucauggauaacacagcucaggcauucucuaauggccccguuggaugccaaggacgagauggggacagaacacagcucuugcucccuagacucaauccaacagaaacaagcuuugagcuuaguggaaggaaauggacugauucagccugauucccagaaagcaaagcuguuuuuggcgugguaggaaaaggaggaaggaaagacaucaguguguggagcguguagaggagagagcgcgggcucugaacuaucuaacgggucucccuucagacagaagcaaggugaggcagagcuuguguuugaugacuccccagggcaguuaaggcacaggagcagcugacaauagucgcuguacaaacaugagcagcgacagcacgagccagaggcugacgcugacugugaacguaagcuucuacugcuuuaaaaaaugcgcuaagccuucugauaccaucaacuacaguguaacgcugcauuuuuauccucuacauuuuguuucugagugguagucacaaggcuauauagaguggucaaaagucuaauguagugguauauauuuuuaaucccaacacucgggagucagauacaagcuggucuuuaaauucaauggucuauauggaaaguuccaggacagccauagacacauagggagagccugucucaaaacaacaacaaaauacagcaaaacacaaaacagagccacuagggcucggcuguggcucagcagggagaaugcugaggccagguucccucccaggcaccacauaaaccaagcgcggcagcaccugucugcacccaccuucaaagucgaggcaggagcaucaggcagccaagggcuuccuuacuuaaagcuuuagaccagccuggguuauggguuauauaagauuccacccaucucaaagcaaaacaaaaaacuuagccaacucaacaccuaaugauggcgcaucuuauucuauguuuauauacgucucuuucauggaugaagagagacggggaguuuauggcuacaucacuggggcauuuuuauucauuuuauuugcucucuguuugcaaaugguagacugauguaugccccacucaccauugcaguugcuagucucguuuccuugucagacuugggcuuuuuaugaaggcguucaaugucccgaagagacagcaauucaccccuguggugagggaaaauuaaauacaggauggggugggauuugucugccugcugcugucacuggcacacggcugacugcaggcugggccagccucaccuggacuccucgucacugucaauuucuaaguauuuccuuuucugggcuuuccccggagcagcauccauuuccuucuucaucugggccaugcggauuuucuggaagucauccugcguuaaaacucgacuggugcugauggcugcagccuuggcuuuccgcuccuccaugggcaugcuguccagcuucguggccuugaaaagcauacagccaaaaggagaauugacuaccagcuuaagugacagacagcucaagucauuuaaauuuuaacauggcccagcaaaaaauggcaucuagguaacuaugagcaugccgcagucucgaagccauauggacuuacaauugcuugcugcuccucaucagaagaguggugcacgucaacccacucaccauccucuuccuccuccucacugaggcuggcgcuuucccauccaucugugggaaagagucacagcaagaugagguaagugagcaagguaggaugcgccacuuaccaacaacuggaguugaugugugcuaugccacaucaauuuaauuuaaggaacagggacuagcacugacuaagaaucuacuaaaagccaaauuguuacagugauuuaccuaauucuuacagcucaaagaggaauggauucugaguaagaaacauaccagaggcuggguguaguggcacauagcuuuaauuccagaacucagggggcagagacaggaguaacucugaguuuaaggcuagcauggucuagagugaguucaggacaucuaggguuuugcuaaacagagaaauucugucucaaaaaaagggguggagggaagaaaggaaagaaggagggagggagagagggagggagggagggagggagggagggagggagggagggaaggaaggaaggaaggaaggaaggaaggaaggaaggaaggaaggaaggagccagaaaacacagccuauccucagaccacagggagccugucugagucuguggucugccauuuucccucguaagcagcucccuaguccugccaggcagcuucccuaacauaguagagacugagcaagguucaaaccccagcaaaaggcaaggcaaagggcaggcagaggaccuucaucaucuucuguauuaucucccuucucaagcucuagaaccucugcuccugggauguaaucuuuagcaucuaauucuccauauucuuguauucuugcuucgauggaggcuucaguggguuuacccuaaaagagaaaauuauuuaaaaguaaggugcuuaaaaaaauaagaugcuuagauuuuuaaaaaauucauuaugaaaggcacuauaggaugugagcacuauuaaacauguagucaaauaagggacggccugcuuacaugucagaaacaacguaaccccagguacagcaggcucacuucuuccucacugucuccugauugaauuugagaaacuggcuuuguaaagaauaccaaacugcucugacauuuuaggucucaacagugcuaugucuuuguauuacaaacacaccucccucucugcugaaagaggcagcaccucacuccagccugcugacaguaucacacacugucaacuacacacagcccagcagaccuuucggacugagcuguccaucacagagcacaugccagcagcaagggccgaggaccaaggaacucaaucaagugcccccuaagcuugaggaacagacccacacacaucacagccacucuccaggaaagcuaaucuaacaugugaacugcaggcauuacccucacuuucugagaccaccaucuuuagauuaaccuacccggaacuucuucugcagcaucugaggguucaauguccggaagagauggaucaaaguccuggcagacaucaucacaucuaggagacacugccuuugauuagaaauucucaagcaaaggcagcagugagguaggagggagggagccacacugcacucacugccuacagagaacuacucacucuuaucuuugugugucuuauacugagccagguccuggagaagcucuucagucauggccagaggacaucgagcugugaucucuuuuauagcauugauccuagaaaaggaaaauggauguaaaauaagcguacuaggcuggacuuucuaggcuuaggcccccuaagccugcaguguggcagagacugugagggcaaagggcccuacagacugacauucccaacaguugcacuuccucugacaguuguguaauaagaaucagccacaacaaaucauggcauuauuugcuuccagugcuaaggagagaaggcgugaagucagacuggaagggaggguuaaaggucuuuagggcuguuaccccagcagcaguuugcaagggagacacagagaaacugcuuagcauaucauuuacaggugcacagauuagauaaaccuuuguguuacccaaaagggcaauugcaguucucuagaaguaaagagugauucauuaacaaaucucuugcgccuucaggagacaaauccaagguggaagaaaaagaaaaacuuaggcuaaugaaaucauucucauaaaacuauaaaacaucuaaaacuauaaaaauggcugauugggacaaguacuguuaucuaguucccucuucagaauucucaccaauaaaugaaauuacaaagccucccggggaaaccacuuuucuagacaccacacgcacagcauaacugucuaucuuaguacauuauaaacacugacuguccccaaguauguuuuacauacccuacggucaugacuuccccagaguucuugucaguaacaaaauuguuggccaccgucacaagcaacgacugaauaaucugaguuggaaacaaaagagcugagucaggcggaggucccugcuuccccugcacucagacuguggugcagcagcaaccuucugccuuagggugcgcgcugagaaccaaagcuaaggagcuaaggaagacagaaacgagugcgcccccagcucagucuuccgggcuauagauaugguaaaguuuaccuccuuuaacagcguuuucucuuuuacauugugugugugugugagagagagagagagagagagagagaauacuuauacccgagcacaugcaugugcacauguaccagggcagauguguagaggucaaaggacaacuuguaggauucgcuucucauccucuccaggcucacuggccuuugcucucuggggagaccuuccugccuaucaucucuugauaggaguaccagauuagaugugcacaguugcauuuaguuuaaaugaguucuggguaucaaacucauggcgucaguuuucuguuaaguacuuuuacccacugagucacgugacuggauuauaacauaauuuuccuuuuuuaaaaauuaauguuuuagguuggcauacaaaguaacagguuucauuguggcauuuuuuuuuuuuuacacacucgucacuuugcgacccuucauuuccacagugcacucuccacucaccucugcuucuucucuuccuucucccaaauggucucgcuccugcucucugucuaaagguucuguuuuguauucaugugugugugugucugugugucaugcuggugggcucagaggcuggaagcagcagagcaccuggcugccuaacuuguguucuaggaaccaagccugggucucccgaagagcagcaaagacucuuuccuacuaaggccaucucuguagccuccucuucuuaccacauuuauuccauuacauuguuuccaacaaugaccaaaacaauacugugcuuuugacacaagauaauucaaucuucuuugaauuuaaaaacuaaucaccaugaacucacaaauacccuugguccuuccgagucauaaaacuugguuauuaaacucagaagccucagcuagcuccuuucugucaacuguacagcuaacuucuguguccaucuccuuaggaguuaggucucgucuguucauuuaaagaagggucaggagagacaauaacucugggaagaaaccauaacaugccaacgguggcaccccuccacacacacaaccuggaggucaggggaagugucucaccucugggggcaccaggugaugagaggcuugugcagcaaacagaaggaucuucgugacuucuaaaagcacaagagauagaaagggcaaauguugucacucugccuccaaggacuacugcaacguggcaagcaaauccacaugucaugacugccacuuauguaucuaccucaaccccagccccgaccugucugcaugguucaaccggugccacuuucaggcccuugcucaacugcugcuuaucagaaaggccugccugacccuacagccuaaacagcaccugccccaugcuugcuccuguccuuccucugcuuuccucuuccaaacacuccgccuggauauucuacccagugacgaugucuagacuucugucuagagcacaaauucgcugaguuaaggaaggacucugcuuuagggucacuguggaccucagcaucucacagauguucugcucuccuuggcuuccugugcauucacagaaacuacaaaggccaugagcgguagcucacaccuacaauccuagcacuuaagaaugguagcagaaacugacaucggggccagcucgggcugcauaccaaaauccagucuaagucccaaacuaaccaaacaagucacaaacauuuguugaacgaacucaauauacacauaucacacuuucuuccaagaggcagcauaguauauguaaagaacaaggccuuggaaccagacacgaugacucaggcuguaacuacagcacacaagaggccagugugggagguuugcugaaguucaagccagccugggcuacagagacuguuucaaaaacaaacaagcaucaaauuggguucaggugcaugccagagacaggcagagcucugugaauucaaggcuggccuggucuacaaagaaguuccagacuagccaagcauguauagugagugagaguuucucaagaacaaaauacaaaaacaaaacaauaagccaucaccagucaacaaacaaggaaaggaggggcaaauguugauuugucauuucuuugaaggccauuuaacaaccugacccagugauguagagagagcucuuagcacaauaucaggcucacgucagaagcucaccuguucacuuccuuccuguucugguuaaguuccaaagguaaagcagguaaccaacuuugccugcuucugugucacugcugacugagacugcacacaaggccauggagaacauaaagcccugccaccacgcagcuacaguugaaggugaaaacuacaguuucucucuuuuugcgauuuauuuauuuuuauguguacggauguuuugccugcacucguguaucugcaccacuugguuaccuggugccugcagaggucaaaggaggguaucagaucuccuaacuggaguuuauggauggcugagucaccaugugggagcugagaaguaaauccagguccuacacaagaguagugcgugcucuucacugcaaagcccccaaauuagaauggucaagaggagaauuuagauuauaaaaggacuugcuaaaaaauuuaucuuuaauuuuuauuuuacuuaaaaaaaaaaaaaaaagaauagugguuuguaugugugugugacuuugugcacauaagcacagugcucacaaagaccaaaggagggcacugcacuccccagagcugccugaaguggguaaugggaacugaacucaucugauucucugcaagagcaguacuuggaaaauaacccccgcuuguagcuaacgaauaggaaaaggaaaugugcugauuuaaggaagaaacgcaggccgcucuguccuccuuugucgugcuuuuugcugggaagguuaggguugggucuggucuucuguuuguuugagaagagcuuugauguacuccaggcuagccuccaauccagcauguaguuggggcuggcuugaaguucugauccuccugccucagcauuccauuuucccucucuauacagaacacauauaacuacaucuguccuuaaugacacaagaaccauggaccagccaccccuuagguugaggccagcaaggagcacacacagaagguuaccucucugguggggcugcagaaaccuuugcacaaaaggguagaaguugaagaggaaaagcuguggagagaagagcacggcagcuuuaacauuuauaaaccuaagcaugggauuucaguuccaucauguaaccucauuucacgacaaaugcaccugacuuguucugucacaggcuaacucaauacgcugcagucacccagggaaagaauuuccuccccaacacuacccugcugccucaccacaugcgagagaaagggcagaaugaaguaggcaaaggcaaacaaaacccacacucuuuaacucugcuacuggccuagcugcagagcuccguguugguguucacagagagaagcaagaccagaaccagcugguaucaaagguccugggaacaggacaggacagaucugaauagcacaaacugacagcccugacucuauuaucuuccagcuuaaccacauugggggaaggagagcaacacauucaaccaugucacaaaacuggacuggagagauggcucugccacuaagagcuguucccagcaccaacauggugacucuccagucccagaggaccuaagcucucuucuggcuucugugggcacugaacacaugcgcugcacauuucuuuguggucuaaauuuuugguaaaggcagcuacucuaaaaguaccaacauguacaacacacacacacucacacacacaccaacaagcagcuagggaacccagcauugcaaacaaaugacucccuaccagagacaccuagaagucaagaaugucaggaaggguuaguuaggcacacagugagguagcaagagucaauacaaguaugugguucgcucugguucgggaacauguaucugaaaguaacaagugcaaagagagcacagaacaguuacacgugaacugagugugcaaacaucaguauucauaugcacuggggaaacagcaguagauaaaagcagcugccuucagaaggauaggcugcacuugcugcugacucuuacugcaaacgacuuggggacuaaagcugagacaguguucuacauaacggcuuuccuuccccaagcccaccccacugcuaaccccccaggagaagccgcgagcuccauaccucgugaaugcccaccaaucuggagaugagguucaugagcaucaucuucaccucaaaccgcuccuuacagcucuccagcugcuucagaagcuucucugcgaagucuggaaggaaccagagagucgcuguggguucccagcuguggguucccggcuguggguucccggcuguggguucccggcugcagaacagggcucuacaggcccaggggaagggacagcaaaguccuagcggugcaaacaccaagcucagcuucaccaguccucagauguuucuuaaaggacggucucacuauguaaguauaguugucccaaagcucacucuguagaccagacuggcccggaaccagagaucugccugccucggccucugccucggccuccugagucagggauuaaagccgggagccaccauucuaaaugaucuuuuacauuucuuuagagaauuuauuuuuauuuuaguacaugcuugcacguguguaugagagcacaugugugcaggugcccacagaggccagaggagguguuggauccccuuacagcuggguugguaccgugagcugccuccugugggugcuaggaaccaaacuugggucuucuacaagaacagacaaugcucuuacccccucgggcggcaauucagccaggguuccuaagaucuacucuuaaaauuauucuuuuuacuuuuugagguuauaauauaucauuucccccuugccuuuccucccuucaaacucccugccuuuuuuugguguuacaugcacauauaugcauguauguacacacauauuccuaaauacacaaauacagauuccugagauguguguguauuaagcucuacagugacucuggauguaguuugcuucugauguuauggucugcagaccaccagcagccaagcuacuuggacuuccuugggaaugcagacucugaagccacagccugaugaagcagaaccugcacuuuacccagcucccuaggugauucgauuaaggaaccuugaccaaaaagaagacaaagaacacaggaaguaaugcggccaacaaggaacuuaaaagcaguaauuaugguaccuuggggaucaugaaucaagugaauagcugaaaaguuaaacacuucugguuucuucuucuucuuuugcuucugaaagagaaaacaguucaaaaccccucugcccagaauucuuuucacaugaccuacuagcggguccgagccagcucuaucacucugccuugucucacugagacuggguuucuuuuuuuuuuuuuuuuuuuuuaaaacucuuauuuuuuuucuuuuuuaagauuuauuuauuuauuuauuauauguaaguucacuguagcugucuucagacacuccagaagagggcaucagaucuuguuacagaugguugugagccaccaugugguugcugggauuugaacuccggaccuucgaaagagcagucgggugcucuuacccacugagccaucucaccagccccgagacuggguuucuuaccgaaccuggagcuuguuuuccagugacccuggcugguuaccacauucuaggggacccacccaucucuucucccacuagagcuagauaucugaacucaggccaccaugccugggcagcagcguucuuacccacugagccauuucccugccccauuacacuaauuuaaaagaaaaacaaaacaacaaaacaaaacaaaaaagaccaagcugccgggcagugguggcgcaugccucuaaaucccagcacuugggaggcagaggcagacggauuucugaauucaaggccagccugguuacagagugaguuccaggacagccaggacuauacagagaaacccugucucaacaaacaaacaaacaaaacaaaaaaacaaaacaaaacaaaaaaacccaagccaaccaaaaaacucuuugauguaaaaaaaaaaucucauuucauuguuaagaauuaaaguguguguguguguguguguguguguguguguguguauguggggggaggaggguuugggggagcuggagagauggcucagcguuuaagagcacugacugcuuuuccagagguccugaguucaauucccagcaaccacaugguagcucacaaccaucuguaaugagaucugaugcccucuucuggugugucugaagacagcuacagcgucugaauuacuaugaauuacuaugagugugaggccagccuggucuacagagugagcuccaggacagcugagugauaccuugucuuaaaaaacauuuuaaaacaaaaacuuugaaaauauaccagcuauuaaaaauguaucagcuauuaaaaugugagacuuaaaagaaauuuaaagauccaaagacuaagaccacacagaggccagggagauggcccagguggcaaagcacuugccacaugagcccgaggacccgaguuugaucucaagaaguguguggggaacccugcagucccagcacugggauuccuggaguucacugaccagcuagccacagucagugagggaugcagagugauggaagauacccaguacugaccuugggcaacccauacuguguucacaugugccugcaucaaccucacacacauacauacauaacccucacagaaauaaacuguaaccccaucaccaccacuuuagagggaucaaacuauugauuguugggauaaccaucaccaaacaacaaaugcuuuuccauguuguucuaagaacucaggucuaguuaagggaaaguuaaucgaauuaauuuauucaaguuacgaguuuugucauagcugaacguagccuauucaccuagaauguuaaugcuuacaauucuucacacauaucuaagguuuguuuuuaacgcuaucucuugguuucgaaaccuuaaaugugcuggcuaaagcucgugcauauucugcacucuaggacugccgcugcauucucaggcacagccucaccuucagcacuuucaucgccuuuuccagcuucuucuuguuuuuggagccuuucuuucccguggcauacugcaccagcaggucucucgcugugggcccauccuccugaagaacaaagcacacugggaaacuggacacaggcacaucugcacagagucagcgugggauccuuucagccacauccuuuuguucuagacauuuauuuacuuuggcuuccaugucagcauguguuuauauguguguacgcaugugaaugcaggggccgugagcugcaguuacaggugucugguugcuucacaaacaccuucaucaucaucaacgugugugcuuauauguaacagugcuugugcagacaucaggggacaggacugcugagcuggcucugugcuuccaucuuuacuugguauauggaacucaggucacuggaacugcgcuggaacuguuuuuaucugcugagccuuaucucuggacccuacauuucgguucuuaaacuuuuugcacacauuuacuaaugaauacaacuuucaaaaucaggaaauauagacacaagugcaaaaauuuucacugcagugcugaauuugugcuuagauuuaguauuacuuuucauuucaguauaauaugcagauauaauguugcuuuuauuuucaggaaacuaucaauagaagaauguuuaguguauaauacauucauauucuggaauaagucguggauauccauagaucuaaacaaaacaguagcucugcauacaccaacacaaacaaagugcacugcagcauguaugugcuauguacacagcuucuaaaagcuuacaacacauaagacuauuuguacaaacauacauaaaugcacuggaaaagaaaugcauuauccagaaggaaggaaauaugacagaaguaacccaaggucaaaaaagccuuucuccaagcugggcacgguggcgcacgccuuuaacuccagcacuuggaggcagagauaggcagaucucuuaguuugaggccagccuggucuacagaguggagaggucaaggacagccagggcuacacugacagagaaaccaaacuaauacauaaauaaguaaguaaauaaaugaaagaaaagacaaagaagaaaaccuuuacucuguaaauuauuaucugaaaguuuuuacaaugaaauguaguaagaauuuaucagacauuacugauugacuuauugaugcuaaaaggauuucaguguguguguguguaugugugagccugugugcacaugugugugugugagccugugugcacaugugucuguaugugugagccugugugcacaugugucugugugugucugcacaucccugcaggagcuccuaaggugcugaauccccuagcuggagucaaugcagcuguaaacugucuuaacaugauggugugagccaacuccagugcucugcaggagcagcaggugaccacugcggcaucacgccaggccuguauguaucuacacauguauuucuaggauguuuaccgaaaagaacuucuuuuuacgucuucuaagaaaaauugcuuaucacaaaucuuuuuuuuuccuucuuauuuugguuuugagacagggacacaaauuuugauuaaaggcacugcagcaucauucuccuuucuucccuacuucugucauguuggcauuaccuacaaaacugcuagcauuuuuuccuaaaggucuuacagucugaacucagaggagucgcacaugagcaacugugccgucaggacugcauuaacccaccucggauucugagucacuguccugcuucucuuccucaucuuucccaaggaagaacgucaaagcagcaaccaauaucuaaagaccaacaaggaaaacaaucaacuuauccagcuuacaaaugcacacuucuguuuacauucccaucacacacacaugcacugcugugucugaaggguaggaggaaggguaauuacuccuuuuucaccauuuaacauauuccauagugucacguauuucauaaauaugcagcaucaucuuuaccuaguaggggagagggauacagcuggguggcagagcauaagcuggggaguaaguccagucccugguuccacgcccagcacuccccagucauuuauuagauuaugucauacgaaaggagaguuagcucuccccuugacaaggauggaagggccaugagccucaaacacgcauguacuugaggcaugggcaccuagguuguggcaucuaaucacugucuuucuauaccugugucuagcauuaaacacugugacuuaaacauacaucggccaggcuuuauacaguuaccuuuugguagacugccaagaaugucuacacgccaccgagaaaagagcuaccauagcccuuacucuaaguuaaacauugucucugaguuucuuucaacugccggagcucaacagaagaaaagucagguaucaaaggcaaacuuuugccuuuuuuuuuuuuuggccaauaucauacagcugaucaucaugguguuuguuuuuacagagcugcucuccugccucuaaacuggaacugcaggacuguuaaagcacgaugcaggaaguggcagcccuacagcucaccuuggugaucuuggagaaacacgcaguugugauaacauugacaguuuuggcaucauuccuggaagagaaaacgacauaaaugccauggugaguccuucuggcauuaggauuuaaagugcuacggcacuacacgagccagcagagguacagcacuucaucaaaucucaucaaggcgaacaucugcugccaaggaacccgcucagaggaagauaugaaaacaaaaacuaaaaugccaacaauucuguuggaaaaaguacaauauagcaaagccaggcuagggagacagcuaguggggagagagcgagggugagcaugagaccaagcucagauuccacaacucgucucugggaggcauggugucugcuggcagaggcagcuagguuagcuaaauuaacucaaucagugucagccagauuccgaugagagacccuguccugauguguaaggcagagagcagaugaggaagacagcugaugccaaacuuggaccugcaaucccacccgcccccacaugcauagcauguacaaaccuguacacacacacaagaaaaaauaaaacuaaauuuuuaaaaacuuaagauaaaaauuagcaaaauuaaccacagcuaaaaaaaaaaaaaaaaaaaagcuacgucagcucauacuccaucaccgagagacgugagagcaggaagugaaguagaggcaugguacagugcugcucacggcccagggaccacgggcugcgcccuccuccguccaucacuaacuaagaagacgcaccacacacugccuacaugccaucugauggagacauuuucucagcuaagguuccucuucccaggaaaugcuagcuuguacugagcugacaaaaagaaccaaccaaucagagugccucuguauuuuaugcccaacuuuaaugucuuauaaguauauuaaaguauguaagauaaaaaaaagauacauuuaucucugagcucuauaaucaaucauuauaacuuaaaaaaauaagcuaauuucucaugagaaaaauucccgucuguguuuaccagauguuccuucuguagaguucgaucaucacauccaaggacaucuuggcugcgguugcauugcugucucucaacaugguguacaugaaguucugcagcaccuacggacccggggagaagggcgucaaugcacggcuggcaaaauaccgggagcacuguguguguguguguguguguguguauguguguguauguguuagagggcggagggcacucaccacguucacuuuguuguucuuguguuuggcguugauguucuugaugucagucacaauguguguguacagagucuaggaaacaaagcacacacaucaaaccuaggagcacuuuugaccuuggagaaaagcacaaacacacaugacaacuuugcuuucccacuacauucucuaauagaagagauccaaaacaagcaagugcuugaaaaaagcugaaacgguaagacugcugcucucuggggguuaaacauggagucauccuacagaaagaagaaccguuacccuacccgcuaugcggauagucacaacuccuuuacuugcaccaggcaagaggagaagcaacccaacgcccauuugcugaugaacgggcaagcauguggcagagucacauaauggaauauuauacaauuauacauugaaacagcaugcuaagacagccaccaaaacaaaucauguaugacucuacuuaagugaaccaucaggaacaggcugaacuaugugguagugcuccacucuucagacaggcagaagcucaagggagccgggguaguuacaucaaggucaaggucaaggucaggcuggacuacuaagugagaccccgucugaaaacuccagagcugagaugcagcucacugaaccagcacuucuagcaacugcaaggcccuggacucaauuuguuucauaagccugagcucuuggucuuaaauaagcaaauaaaaagucauggaaaaaugcuaagagcaacagaacauuaaguuugagagugacuacccccucucauguaaccgcucaguguagcauggucaugaagagauuagguuugggcaccggacugccugcaauuauaguccagccuagcacauggaugcugccugaccacagacaugccacucaucugugucuguaaggcagagcgaugcagaguuuucuuaccaaucucuaccuuaggcuuuuguaaggagaacauauacuugauauugaucccugguccagcguggcauucggccuauuuccuggacuagggucucuaagcauaacucugccguguaagcucagggaggaagggacagcgggcgacgcuuugcucucuaccuuccgcaggagcuugucguggcagcgcagcagcucaaagaagagcucuagcaaacuugauggauugaugagauucuuguuucucaguaagaucaaggcuuugcaaaacgucuaggggugaaagaaaacauaccaaaagggugagguuagucaaaugagaaacacagcacacaucccaucucugcccucccccaccaaccacaagcacaggacggggugcggccuuccuaccaugcggagaucugggucuaagacagugugguuguaggagagcagguccuucagcuccugcgggaaguuacugagaugcuccggguagcacuggccaaucuguaacaaagcagagcuguuacagaaacagcagccuuucuccccuaacuucaggcgcacauucacacggucagggaucggcugggucacagaggcaggugacucggucagggaucggcugggucacauaggcaggugacucaaucagcagcucuguuccugcugcuuucagugucccugcagauucuguaaggugcauguggcacaacugagagccugccagcaugcugaauggaaaacccuuuucugaugauuuugguucugcuuggcucugugccuccaacauaucuuagggagaaaauaagaucuacaagagggaaggcuggggaaacccuuaagucuucauacagagagagggugggaauaaccaggugagggaaccucugcaaauucugguagugccaaccugucucacuaagaaccuucuuaccugcgccaugaacaucaccagcucugccagcucuuugcugggcuuauuugguuguaacuugaaaaucuccauauuggauuuauagugguuauauugcugaaggaacugcaggggaaaagaacagaguuuaacagucucacacagaauaacaagcuggcacacacccuugccaguggcacagagaaucagaucuagacucucaagcacggcauggcucacuccaagacuuguuuuuagaacagaacucuaagcagugguauaaaugugcauacgaaacucagcuucuggccuuguucugccauuuuacuaucacaugacccauguaugaagggcagaaaaaugccgggucaggccuguaaacgugaaguaugccugaaggacaugaaacuuucuaaucaaaucuuuccuuuaaauacccaguaaggcuuuauguugguguuccagaugagauaugcugucaaacacaggccucaaaaggcggcucagugguuaggagcacuuguucuugcagaggaccugguucccgucccagugauuugaaaccaccuguaauuccaguuccaggggaucagaagcccucuucuaaccuccagggguaccaggugugcacacagugcacauugcaggcaacacacacacacacacacauucuuuuaaaaauggagaaaaaagaaaaacagaagacccaaaaccagggcuagggauggcuccgugugagugccagcgcccacggaaagccagggagggggugggggagaagugcaugugugugcacacaccaaccucggcccaccuccccccaccucaagccuaaacaacaacaaagccaagaguaauagacacauggaguauguauaaagccacagcacacucucuaagcacuugguuugugcuaagcuuuuuauaucuaugaccccauuucuguuuaaccacuauaacuguaaaugaaaucaagcccacuccaggucccauagcuauuauccuuccauagcuuucacugcuucuguggggcuaggaauggaacuuggggugcucagguaugugagagaaguguuccacugcucagcuacacuccagcuugccauaguuagugugucaacaaccacucacacacccacucacucacacacacaccaaguacuccuuaauccucagccuuuuuugaagguuauugaagguuuaucgaaauauaggaguuaaagggccaacaccgcaggaguggggaggucccaaauucuucauguuccuaaccccaauuccuucacugccacaccauggacaaguuauagacucacggucgcaggucugcuugagaugagcaggacauaccacacucugccccugauguacauuugucacacgcccaaaaccccagacacucccuccuuccucucaugcuaaccuccauaccaguaccccaaagugguucuguggcugaccccagggcauccaagcuuggauccuccacugugagcacggccacaucaguuccuugcccguggcugaguugguuaguaugcacccucuuuguuccuuacugauacuggucacuuuccagagggaguccuuccucuucaccgugacuuggcuuugagucccaccucaaucacugcccaaucagcaggccauggggggcuaugacuuccaccaucuugggagaaacucuggacuccgcuccauuucccuuucuacuugucagaaaaaaaaaaccccuaaaaacugucuuacaugguacccggauaaucuaaacuccucagcggcuccuagaaacaccggaaguaaaaccuaaccgcuuaccacuaucgaaaaggcucugaccucaccgcauuucccacgcuacacuuaagugacaauguuccugcuucauuuauuuccacgacagcuucugugaguccuguucuccugccuggaacgcucugaccugccuggcccaauacuaccacugcaggaaaggcuucccuucccucaacagucugcagucucuauucuaacauccucaccuagccuuaucuuacacagguaccguccuccuaagaacgagaguccaaaagacggcauggcuccauuaucugcuuacuugucccuguauucucaaugucuacaaauauacugcagugugugugugugugugugugugugugugucugcacuaaagcagauggaggaggcggcuauuaccuuucuugaauacuaaaauacaaagguuguuauugaaccuuccuugguuucacagcaggucagaaauagaaccagagcuuugggucagcuguaaaacuaacggucucaagcacccacugacaggauuuggacaguacaaaaaaagaacggagaaaagggggugucugcgaugaaaaagaaagcagggccaggccagugaagacaacuccagaaugucaggaaggcuucacugcuaucucucagacuggaggcucgcagguggaauacgucaagaaccguauaaaccaaaccacaccuuccaaucaauaaacagacuauaaaggauugaauugacaacucucaacauaaauacaaaggccgguaacuaugugaaaaagugugcaacaugcaaauuaaaauaaucugagauucuaucucaccucaucggaauggcugucagcaggcaaaagacagacagcaaaugugggaaaacagaaacuauauuccccuucucucucacgcuccacacacaugcacacacacaccacugguggggauagagugggagcacacacacacacacacacacacacacucgcacacacacagcucauggugcggauguccaugguagaaccacuauggacaaacuaaaacuggccuucuacggccugguuuauaauaaaaggacucugaucaaacaccauagacacacuugcacauuuguguuuacuggugcacgaaccacggcagcaagaagcagagccagccuuuaaguccaucaacagaauguguagugaaaaugugguacaugcauuuaguuuuuuccaaucaagagcugaaaccaugacaacaggaggaaagauguuaagaaauuaaaccagacucagagagguagccuguuuccucucagaagcaaaagucagauuucaauuuaguuugugacacaaguuagaaaggggaacccaguaagagcuuauguuuaauguguauugagagcuugccuacuuguaugugcguguauacauaugccuaguauccagaggccagaagucgggugucgcauccccuaacacuagagcaacagaugguuaugagcuaucauguaagugcugggccuugaacccagguccucuggaagaacagccagugcucuuaaccauugagucaacuccccagcucuggaagaagagaccuuaaagggaugcagggaacugaaauaaaugugauguguauacagaagugaagugggggcugucugaggagagaaggggaccaguaagggggggggggagacagggaggauugggaagggcgguguguaagaagacaaauaauaaaggcaaaggcgcgucuuaaucuaucuaccagguuaagaguacaaagucacggccuucauuucgugguucuuaugaauucacacacuuggaguaugccaugccccucacaaacuggaccuaacagaguuuuagaccgcacauuucccucaaagcauuuuuuucaaaucuagcucagggugacucccagggaguuugaacuguggcuuaacuacaucuucuacacucuugacugugggguggcccugccaucugagaacuccuugcucuucuuggcagagcuuggggcacucgggagaggccgucuguggaaagcauguuuaacacacgacucaucguaugcuaggggcuaacucgaguuuuugcucugaggcggccaacggacguuaccggcccacgucggcgaggcgggcggauaaacccggaggcagcagguuuuaggguguguuucaguguugguggggucugcaugucccgucccccguaucuccaucccccguccguuuccuccccaggcccccggaagcacaccggagcaucccggggagccggaucccggucccaccuccuccacguaggccggcgggucccgcuugaucagguucuguaacugcggcagguugcugggcagcuuguuguuguuccugccggacaugguggcugugggugggcucccuggcgagcagugcuuggaaaacguccgccucugucagucgcagcccgggccccgcggcagcuuagacucgugggucccaguguaaccggaaacggcacgugggacacgccgcuugcccgaccgagcuacggaacgcucagaggaucaaacuucaccacccugcugcaacucuuuguaggcgucugcacgcuaucggucccugccgguggacaaccgcuacugguugucaccaaacucuggagcagguuuccuuaucucaacauucuuuuccacugaaaacaauuuuuauacaauauauuugaucauguucuuuuuccuccgccaauuccucccaguucuccccaucuagcucagcauucuuaugguggcccaaauaaaugaggauuaauaugggacucagguaugacagcauacaacuguaaucccuguacucaggaagcugaggcaggagcauuauauuuguuuggggcaagcccgaggcuuacucugucucaagaaaaacgacagaaauuaagcaggggccuggggacugguucagguguccuaucucauaggagacccuagguuucuucuccagc

SEQ ID NO: 2530 - RNA, 12711 nt, Mus musculus
ugcugauggcugcagccuuggcuuuccgcuccuccaugggcaugcuguccagcuucguggccuugaaaagcauacagccaaaaggagaauugacuaccagcuuaagugacagacagcucaagucauuuaaauuuuaacauggcccagcaaaaaauggcaucuagguaacuaugagcaugccgcagucucgaagccauauggacuuacaauugcuugcugcuccucaucagaagaguggugcacgucaacccacucaccauccucuuccuccuccucacugaggcuggcgcuuucccauccaucugugggaaagagucacagcaagaugagguaagugagcaagguaggaugcgccacuuaccaacaacuggaguugaugugugcuaugccacaucaauuuaauuuaaggaacagggacuagcacugacuaagaaucuacuaaaagccaaauuguuacagugauuuaccuaauucuuacagcucaaagaggaauggauucugaguaagaaacauaccagaggcuggguguaguggcacauagcuuuaauuccagaacucagggggcagagacaggaguaacucugaguuuaaggcuagcauggucuagagugaguucaggacaucuaggguuuugcuaaacagagaaauucugucucaaaaaaagggguggagggaagaaaggaaagaaggagggagggagagagggagggagggagggagggagggagggagggagggagggaaggaaggaaggaaggaaggaaggaaggaaggaaggaaggaaggaaggagccagaaaacacagccuauccucagaccacagggagccugucugagucuguggucugccauuuucccucguaagcagcucccuaguccugccaggcagcuucccuaacauaguagagacugagcaagguucaaaccccagcaaaaggcaaggcaaagggcaggcagaggaccuucaucaucuucuguauuaucucccuucucaagcucuagaaccucugcuccugggauguaaucuuuagcaucuaauucuccauauucuuguauucuugcuucgauggaggcuucaguggguuuacccuaaaagagaaaauuauuuaaaaguaaggugcuuaaaaaaauaagaugcuuagauuuuuaaaaaauucauuaugaaaggcacuauaggaugugagcacuauuaaacauguagucaaauaagggacggccugcuuacaugucagaaacaacguaaccccagguacagcaggcucacuucuuccucacugucuccugauugaauuugagaaacuggcuuuguaaagaauaccaaacugcucugacauuuuaggucucaacagugcuaugucuuuguauuacaaacacaccucccucucugcugaaagaggcagcaccucacuccagccugcugacaguaucacacacugucaacuacacacagcccagcagaccuuucggacugagcuguccaucacagagcacaugccagcagcaagggccgaggaccaaggaacucaaucaagugcccccuaagcuugaggaacagacccacacacaucacagccacucuccaggaaagcuaaucuaacaugugaacugcaggcauuacccucacuuucugagaccaccaucuuuagauuaaccuacccggaacuucuucugcagcaucugaggguucaauguccggaagagauggaucaaaguccuggcagacaucaucacaucuaggagacacugccuuugauuagaaauucucaagcaaaggcagcagugagguaggagggagggagccacacugcacucacugccuacagagaacuacucacucuuaucuuugugugucuuauacugagccagguccuggagaagcucuucagucauggccagaggacaucgagcugugaucucuuuuauagcauugauccuagaaaaggaaaauggauguaaaauaagcguacuaggcuggacuuucuaggcuuaggcccccuaagccugcaguguggcagagacugugagggcaaagggcccuacagacugacauucccaacaguugcacuuccucugacaguuguguaauaagaaucagccacaacaaaucauggcauuauuugcuuccagugcuaaggagagaaggcgugaagucagacuggaagggaggguuaaaggucuuuagggcuguuaccccagcagcaguuugcaagggagacacagagaaacugcuuagcauaucauuuacaggugcacagauuagauaaaccuuuguguuacccaaaagggcaauugcaguucucuagaaguaaagagugauucauuaacaaaucucuugcgccuucaggagacaaauccaagguggaagaaaaagaaaaacuuaggcuaaugaaaucauucucauaaaacuauaaaacaucuaaaacuauaaaaauggcugauugggacaaguacuguuaucuaguucccucuucagaauucucaccaauaaaugaaauuacaaagccucccggggaaaccacuuuucuagacaccacacgcacagcauaacugucuaucuuaguacauuauaaacacugacuguccccaaguauguuuuacauacccuacggucaugacuuccccagaguucuugucaguaacaaaauuguuggccaccgucacaagcaacgacugaauaaucugaguuggaaacaaaagagcugagucaggcggaggucccugcuuccccugcacucagacuguggugcagcagcaaccuucugccuuagggugcgcgcugagaaccaaagcuaaggagcuaaggaagacagaaacgagugcgcccccagcucagucuuccgggcuauagauaugguaaaguuuaccuccuuuaacagcguuuucucuuuuacauugugugugugugugagagagagagagagagagagagagaauacuuauacccgagcacaugcaugugcacauguaccagggcagauguguagaggucaaaggacaacuuguaggauucgcuucucauccucuccaggcucacuggccuuugcucucuggggagaccuuccugccuaucaucucuugauaggaguaccagauuagaugugcacaguugcauuuaguuuaaaugaguucuggguaucaaacucauggcgucaguuuucuguuaaguacuuuuacccacugagucacgugacuggauuauaacauaauuuuccuuuuuuaaaaauuaauguuuuagguuggcauacaaaguaacagguuucauuguggcauuuuuuuuuuuuuacacacucgucacuuugcgacccuucauuuccacagugcacucuccacucaccucugcuucuucucuuccuucucccaaauggucucgcuccugcucucugucuaaagguucuguuuuguauucaugugugugugugucugugugucaugcuggugggcucagaggcuggaagcagcagagcaccuggcugccuaacuuguguucuaggaaccaagccugggucucccgaagagcagcaaagacucuuuccuacuaaggccaucucuguagccuccucuucuuaccacauuuauuccauuacauuguuuccaacaaugaccaaaacaauacugugcuuuugacacaagauaauucaaucuucuuugaauuuaaaaacuaaucaccaugaacucacaaauacccuugguccuuccgagucauaaaacuugguuauuaaacucagaagccucagcuagcuccuuucugucaacuguacagcuaacuucuguguccaucuccuuaggaguuaggucucgucuguucauuuaaagaagggucaggagagacaauaacucugggaagaaaccauaacaugccaacgguggcaccccuccacacacacaaccuggaggucaggggaagugucucaccucugggggcaccaggugaugagaggcuugugcagcaaacagaaggaucuucgugacuucuaaaagcacaagagauagaaagggcaaauguugucacucugccuccaaggacuacugcaacguggcaagcaaauccacaugucaugacugccacuuauguaucuaccucaaccccagccccgaccugucugcaugguucaaccggugccacuuucaggcccuugcucaacugcugcuuaucagaaaggccugccugacccuacagccuaaacagcaccugccccaugcuugcuccuguccuuccucugcuuuccucuuccaaacacuccgccuggauauucuacccagugacgaugucuagacuucugucuagagcacaaauucgcugaguuaaggaaggacucugcuuuagggucacuguggaccucagcaucucacagauguucugcucuccuuggcuuccugugcauucacagaaacuacaaaggccaugagcgguagcucacaccuacaauccuagcacuuaagaaugguagcagaaacugacaucggggccagcucgggcugcauaccaaaauccagucuaagucccaaacuaaccaaacaagucacaaacauuuguugaacgaacucaauauacacauaucacacuuucuuccaagaggcagcauaguauauguaaagaacaaggccuuggaaccagacacgaugacucaggcuguaacuacagcacacaagaggccagugugggagguuugcugaaguucaagccagccugggcuacagagacuguuucaaaaacaaacaagcaucaaauuggguucaggugcaugccagagacaggcagagcucugugaauucaaggcuggccuggucuacaaagaaguuccagacuagccaagcauguauagugagugagaguuucucaagaacaaaauacaaaaacaaaacaauaagccaucaccagucaacaaacaaggaaaggaggggcaaauguugauuugucauuucuuugaaggccauuuaacaaccugacccagugauguagagagagcucuuagcacaauaucaggcucacgucagaagcucaccuguucacuuccuuccuguucugguuaaguuccaaagguaaagcagguaaccaacuuugccugcuucugugucacugcugacugagacugcacacaaggccauggagaacauaaagcccugccaccacgcagcuacaguugaaggugaaaacuacaguuucucucuuuuugcgauuuauuuauuuuuauguguacggauguuuugccugcacucguguaucugcaccacuugguuaccuggugccugcagaggucaaaggaggguaucagaucuccuaacuggaguuuauggauggcugagucaccaugugggagcugagaaguaaauccagguccuacacaagaguagugcgugcucuucacugcaaagcccccaaauuagaauggucaagaggagaauuuagauuauaaaaggacuugcuaaaaaauuuaucuuuaauuuuuauuuuacuuaaaaaaaaaaaaaaaagaauagugguuuguaugugugugugacuuugugcacauaagcacagugcucacaaagaccaaaggagggcacugcacuccccagagcugccugaaguggguaaugggaacugaacucaucugauucucugcaagagcaguacuuggaaaauaacccccgcuuguagcuaacgaauaggaaaaggaaaugugcugauuuaaggaagaaacgcaggccgcucuguccuccuuugucgugcuuuuugcugggaagguuaggguugggucuggucuucuguuuguuugagaagagcuuugauguacuccaggcuagccuccaauccagcauguaguuggggcuggcuugaaguucugauccuccugccucagcauuccauuuucccucucuauacagaacacauauaacuacaucuguccuuaaugacacaagaaccauggaccagccaccccuuagguugaggccagcaaggagcacacacagaagguuaccucucugguggggcugcagaaaccuuugcacaaaaggguagaaguugaagaggaaaagcuguggagagaagagcacggcagcuuuaacauuuauaaaccuaagcaugggauuucaguuccaucauguaaccucauuucacgacaaaugcaccugacuuguucugucacaggcuaacucaauacgcugcagucacccagggaaagaauuuccuccccaacacuacccugcugccucaccacaugcgagagaaagggcagaaugaaguaggcaaaggcaaacaaaacccacacucuuuaacucugcuacuggccuagcugcagagcuccguguugguguucacagagagaagcaagaccagaaccagcugguaucaaagguccugggaacaggacaggacagaucugaauagcacaaacugacagcccugacucuauuaucuuccagcuuaaccacauugggggaaggagagcaacacauucaaccaugucacaaaacuggacuggagagauggcucugccacuaagagcuguucccagcaccaacauggugacucuccagucccagaggaccuaagcucucuucuggcuucugugggcacugaacacaugcgcugcacauuucuuuguggucuaaauuuuugguaaaggcagcuacucuaaaaguaccaacauguacaacacacacacacucacacacacaccaacaagcagcuagggaacccagcauugcaaacaaaugacucccuaccagagacaccuagaagucaagaaugucaggaaggguuaguuaggcacacagugagguagcaagagucaauacaaguaugugguucgcucugguucgggaacauguaucugaaaguaacaagugcaaagagagcacagaacaguuacacgugaacugagugugcaaacaucaguauucauaugcacuggggaaacagcaguagauaaaagcagcugccuucagaaggauaggcugcacuugcugcugacucuuacugcaaacgacuuggggacuaaagcugagacaguguucuacauaacggcuuuccuuccccaagcccaccccacugcuaaccccccaggagaagccgcgagcuccauaccucgugaaugcccaccaaucuggagaugagguucaugagcaucaucuucaccucaaaccgcuccuuacagcucuccagcugcuucagaagcuucucugcgaagucuggaaggaaccagagagucgcuguggguucccagcuguggguucccggcuguggguucccggcuguggguucccggcugcagaacagggcucuacaggcccaggggaagggacagcaaaguccuagcggugcaaacaccaagcucagcuucaccaguccucagauguuucuuaaaggacggucucacuauguaaguauaguugucccaaagcucacucuguagaccagacuggcccggaaccagagaucugccugccucggccucugccucggccuccugagucagggauuaaagccgggagccaccauucuaaaugaucuuuuacauuucuuuagagaauuuauuuuuauuuuaguacaugcuugcacguguguaugagagcacaugugugcaggugcccacagaggccagaggagguguuggauccccuuacagcuggguugguaccgugagcugccuccugugggugcuaggaaccaaacuugggucuucuacaagaacagacaaugcucuuacccccucgggcggcaauucagccaggguuccuaagaucuacucuuaaaauuauucuuuuuacuuuuugagguuauaauauaucauuucccccuugccuuuccucccuucaaacucccugccuuuuuuugguguuacaugcacauauaugcauguauguacacacauauuccuaaauacacaaauacagauuccugagauguguguguauuaagcucuacagugacucuggauguaguuugcuucugauguuauggucugcagaccaccagcagccaagcuacuuggacuuccuugggaaugcagacucugaagccacagccugaugaagcagaaccugcacuuuacccagcucccuaggugauucgauuaaggaaccuugaccaaaaagaagacaaagaacacaggaaguaaugcggccaacaaggaacuuaaaagcaguaauuaugguaccuuggggaucaugaaucaagugaauagcugaaaaguuaaacacuucugguuucuucuucuucuuuugcuucugaaagagaaaacaguucaaaaccccucugcccagaauucuuuucacaugaccuacuagcggguccgagccagcucuaucacucugccuugucucacugagacuggguuucuuuuuuuuuuuuuuuuuuuuuaaaacucuuauuuuuuuucuuuuuuaagauuuauuuauuuauuuauuauauguaaguucacuguagcugucuucagacacuccagaagagggcaucagaucuuguuacagaugguugugagccaccaugugguugcugggauuugaacuccggaccuucgaaagagcagucgggugcucuuacccacugagccaucucaccagccccgagacuggguuucuuaccgaaccuggagcuuguuuuccagugacccuggcugguuaccacauucuaggggacccacccaucucuucucccacuagagcuagauaucugaacucaggccaccaugccugggcagcagcguucuuacccacugagccauuucccugccccauuacacuaauuuaaaagaaaaacaaaacaacaaaacaaaacaaaaaagaccaagcugccgggcagugguggcgcaugccucuaaaucccagcacuugggaggcagaggcagacggauuucugaauucaaggccagccugguuacagagugaguuccaggacagccaggacuauacagagaaacccugucucaacaaacaaacaaacaaaacaaaaaaacaaaacaaaacaaaaaaacccaagccaaccaaaaaacucuuugauguaaaaaaaaaaucucauuucauuguuaagaauuaaaguguguguguguguguguguguguguguguguguguauguggggggaggaggguuugggggagcuggagagauggcucagcguuuaagagcacugacugcuuuuccagagguccugaguucaauucccagcaaccacaugguagcucacaaccaucuguaaugagaucugaugcccucuucuggugugucugaagacagcuacagcgucugaauuacuaugaauuacuaugagugugaggccagccuggucuacagagugagcuccaggacagcugagugauaccuugucuuaaaaaacauuuuaaaacaaaaacuuugaaaauauaccagcuauuaaaaauguaucagcuauuaaaaugugagacuuaaaagaaauuuaaagauccaaagacuaagaccacacagaggccagggagauggcccagguggcaaagcacuugccacaugagcccgaggacccgaguuugaucucaagaaguguguggggaacccugcagucccagcacugggauuccuggaguucacugaccagcuagccacagucagugagggaugcagagugauggaagauacccaguacugaccuugggcaacccauacuguguucacaugugccugcaucaaccucacacacauacauacauaacccucacagaaauaaacuguaaccccaucaccaccacuuuagagggaucaaacuauugauuguugggauaaccaucaccaaacaacaaaugcuuuuccauguuguucuaagaacucaggucuaguuaagggaaaguuaaucgaauuaauuuauucaaguuacgaguuuugucauagcugaacguagccuauucaccuagaauguuaaugcuuacaauucuucacacauaucuaagguuuguuuuuaacgcuaucucuugguuucgaaaccuuaaaugugcuggcuaaagcucgugcauauucugcacucuaggacugccgcugcauucucaggcacagccucaccuucagcacuuucaucgccuuuuccagcuucuucuuguuuuuggagccuuucuuucccguggcauacugcaccagcaggucucucgcugugggcccauccuccugaagaacaaagcacacugggaaacuggacacaggcacaucugcacagagucagcgugggauccuuucagccacauccuuuuguucuagacauuuauuuacuuuggcuuccaugucagcauguguuuauauguguguacgcaugugaaugcaggggccgugagcugcaguuacaggugucugguugcuucacaaacaccuucaucaucaucaacgugugugcuuauauguaacagugcuugugcagacaucaggggacaggacugcugagcuggcucugugcuuccaucuuuacuugguauauggaacucaggucacuggaacugcgcuggaacuguuuuuaucugcugagccuuaucucuggacccuacauuucgguucuuaaacuuuuugcacacauuuacuaaugaauacaacuuucaaaaucaggaaauauagacacaagugcaaaaauuuucacugcagugcugaauuugugcuuagauuuaguauuacuuuucauuucaguauaauaugcagauauaauguugcuuuuauuuucaggaaacuaucaauagaagaauguuuaguguauaauacauucauauucuggaauaagucguggauauccauagaucuaaacaaaacaguagcucugcauacaccaacacaaacaaagugcacugcagcauguaugugcuauguacacagcuucuaaaagcuuacaacacauaagacuauuuguacaaacauacauaaaugcacuggaaaagaaaugcauuauccagaaggaaggaaauaugacagaaguaacccaaggucaaaaaagccuuucuccaagcugggcacgguggcgcacgccuuuaacuccagcacuuggaggcagagauaggcagaucucuuaguuugaggccagccuggucuacagaguggagaggucaaggacagccagggcuacacugacagagaaaccaaacuaauacauaaauaaguaaguaaauaaaugaaagaaaagacaaagaagaaaaccuuuacucuguaaauuauuaucugaaaguuuuuacaaugaaauguaguaagaauuuaucagacauuacugauugacuuauugaugcuaaaaggauuucaguguguguguguguaugugugagccugugugcacaugugugugugugagccugugugcacaugugucuguaugugugagccugugugcacaugugucugugugugucugcacaucccugcaggagcuccuaaggugcugaauccccuagcuggagucaaugcagcuguaaacugucuuaacaugauggugugagccaacuccagugcucugcaggagcagcaggugaccacugcggcaucacgccaggccuguauguaucuacacauguauuucuaggauguuuaccgaaaagaacuucuuuuuacgucuucuaagaaaaauugcuuaucacaaaucuuuuuuuuuccuucuuauuuugguuuugagacagggacacaaauuuugauuaaaggcacugcagcaucauucuccuuucuucccuacuucugucauguuggcauuaccuacaaaacugcuagcauuuuuuccuaaaggucuuacagucugaacucagaggagucgcacaugagcaacugugccgucaggacugcauuaacccaccucggauucugagucacuguccugcuucucuuccucaucuuucccaaggaagaacgucaaagcagcaaccaauaucuaaagaccaacaaggaaaacaaucaacuuauccagcuuacaaaugcacacuucuguuuacauucccaucacacacacaugcacugcugugucugaaggguaggaggaaggguaauuacuccuuuuucaccauuuaacauauuccauagugucacguauuucauaaauaugcagcaucaucuuuaccuaguaggggagagggauacagcuggguggcagagcauaagcuggggaguaaguccagucccugguuccacgcccagcacuccccagucauuuauuagauuaugucauacgaaaggagaguuagcucuccccuugacaaggauggaagggccaugagccucaaacacgcauguacuugaggcaugggcaccuagguuguggcaucuaaucacugucuuucuauaccugugucuagcauuaaacacugugacuuaaacauacaucggccaggcuuuauacaguuaccuuuugguagacugccaagaaugucuacacgccaccgagaaaagagcuaccauagcccuuacucuaaguuaaacauugucucugaguuucuuucaacugccggagcucaacagaagaaaagucagguaucaaaggcaaacuuuugccuuuuuuuuuuuuuggccaauaucauacagcugaucaucaugguguuuguuuuuacagagcugcucuccugccucuaaacuggaacugcaggacuguuaaagcacgaugcaggaaguggcagcccuacagcucaccuuggugaucuuggagaaacacgcaguugugauaacauugacaguuuuggcaucauuccuggaagagaaaacgacauaaaugccauggugaguccuucuggcauuaggauuuaaagugcuacg

SEQ ID NO: 2531 - RNA, 64384 nt, Mus musculus
caugacugaaggccuccgcccggccccucccgcuucccggcgcagucgccagccgucaccaucaccgccgccgcggcuugcuggcgagccccaccagcccgcgucaccgcucugcgcgcucccugcaccucccuggcugcagcagccggagaaaacgaaagccaggcggccccggcacucgcgaucgcaccggcucugcugcucauuccgguaucuacuccagggcugugcgcacugcgcgggcagcggcugaacacgcacggagaaggugcgggagccgcaggggccccgggcuuugggcggcugcugcucggccuuggcggaggcuuguuccagcucgccguucggucccaggccuggccggugagcugcgcgcaguaugggcagaugcugcuucuacacggcggggacgcugucucugcugcugcuggugaccagcgucacgcugcuaguggcucgagucuuucagaaggcgguagaccagacgaucgagaaggugaggcaggcuaguguguguguguguguguguguguguguguguguguggugucuuucuaggccacccucccauugcggacccuguguggggagaguugcguuggcgccgagccugcagaacacagcucuuguuugccuccccggguuggcaggauguggagacuugaggugacucuuccuuuuaaauaaccuguaagucuacagaucucgacuuuguagaaaagccuugcguuuccguucuauccuuagcaauucuccacaccccucuacgcacccggucuauguugagcccuguuucccucgcacuugacaaagaaauagaaaugcguaaaagcaccgcagaagaggcuggcuuuguaggcuugcccgcgcagccuuugaaacggagugagccuggggaugagaagugggugagaggucuauuguguucuccuuccugggcuggacaggguaggguaggguagggcagggcagggcagggcagggcagggcagagcagauggcaaacagucuaggcuuuaggaaugggugacauuuuauccauugcaguuagugcuuagcggcucugugucucgcagacagcccugucucuguuucauacuugugcucaucagccauuacuuggguaauuaacgaauuuggaccugucucccaggguguuugauggggccugaaaacuggucauguggaagacuucuccauccuggggccacccuggucacuuuuuucuuuuacccuuucacccacauucaccaggcacgguggaaagaggaacuggagagaguuacuagggucaccuuuuccuuuaaaaauaaagagcuaaacaaaugagucacugggguagccuuucucauuagcaucauucuuaugcauaaugucucgcugaucucuguugcugucucccagguacaaaagcuuaggcuugagagucugcuuggagucacuguauuccagauuaauaaaauuaguugccuuauuccaaaugccaauagaugaugucccuaaauagagauucgcaguaguaaccaguuacuuggagucuggcaauuaaagauuuuuuuuuuaagugucaaggcaaagccuuauucaagccuuaaugagauggcauugccaagagaagaccaagccuacugugugagcuucucaaagaccauuguugcccugauuguguguguucaaggagaaaaacaagcccuuuaaacucuugcuuugguagcgugaguaaggaauacaacagucagaauaugauuuguggauccacuugugugugugagugugugugugugugugugugugugugugugcaugugucuggguguuuuuggggcggggggaucugguaagauaaagguuucuccuagcaccucagccauaaacaccgauucuugugaauucguuuuuauucagggagggguaucuaucugggaaguagcgucccaggaccugaguuucuguuggccacaagugcuuuucuuccugggaagaaacugacugauaaguuauagcacaacaccagacuuacagaacugccgggccugagcugcagagcgggugcaccacgggaugucugauaggaaggaaauagauucauuucagcagauggaauggggaugcuguaagugaaccugaggcuaccagugugcacuuuccucggaaaccaguagggucaucccaaacagagagaaagaccaagaggacuuuacagaugagaagggcagggaaugaauguuggcuccaugcuccugaugagaagcccgggacuacuugugggaucuuuucguuuuccuuuugagauagagugucauuauguagcccaggcugguccuugaacacacagcucuugucucagacucccaggugcuaggauugaucacaagcauguaccaugacaccugguucuaucaucuuuuuccaaggaaaagaguaugcuuucccuccugggcuauugucaguguuuaaugauaugaucgccacuuuguuuuuauuagaagccagugagucugagagcaggaaucagacaucuuguguucagauccuaaauauaccacucugcagcuucaacuuugagcaaguuacuuaacuucucuaagccccgauuucuuuucuugugaaagugggaaugggaagugugauccgccaucuuagccacucaguuguguuucuaugaagcuccugggcuuuaagcuuugggucucaugcucacacaagccuuuccaaagcccuguguuuaauuuuaugcccaaguuuucccuccuacaaaggccccuucaaaucacagaagcuucaggauccauaaaaccuguaucugugggcuaagcauaaacuucacacuuacgacggcacacaggacugggugaucaguuugugacauccaucauuauuuccaguaguagccaguaguaguucuaugggguaguucauucauagguugacuuuaauaugauccacauugugauauaaucuacgccaauacugccaguucucacuguuuuccucugaagauuguccgugccucaacuuguguaacaucaaaaauggguggggggggggaagguuaacguucugaagcucagguucggccaauuucggggaaguuugguaagauaauugcuaugcaaauugaucccagagauaauuuaguaaaauaaagugcuugccacacaagcccagggaccugagauuagauccccugaaccugcauaagaagcuggaugaggcagcaugcacgcgugaccccagcacucuggaggcagagacaggaggaucucugggaccucuggccagcaagccugccaauggcgaguucuagagucagcgaaagacccuaucucaaauaaauaaacaagcaaauaaaugagaugugguugacacucagcauugaccucuggaguccacaugcauguggacacgugcacauguagucacacauauagccacaucacccauaugcacacgucaaaaacaauaacagaaaggaagaaagaaaacacagcucuagauugacaaagugggcugaagcgacacuuuuauuuuggcagguaaguauaguggccggagugguuuuuggaaccaaaugucucagcugccugcuacuugccaugaccaaaauuuagacacaagcauugguaggaaguaaucaaguuuauucaaagucagccuugaagauauuagcagggcuagcuucccaacugucugccuugggguuauuuaugggagaugugagguauagaagggaaaucgaggcuacagcugggcagggucuuagaaggcagaacuucaugaugauagaucuuggauuuuucucuuuuuuuuuuucuuuuucuuuuucuuuuucuuuuucuuuuucuuuuuuuuuucuuuuuucuuuucuuuuuuuuuuuuuuuuuuuuuuuuuugagacagggucucacucuguagcccuggauggccuggaacucauagagauccgccuuggccucccacguguuggcauuaaaugcaggccaccacccaggcuggaucuuggaucuugauuccugcugcuugcuaaucuaaagaaauaucuagcaguucaucaucuuaaccaugcagauggaugccaaauuagagucuccugggaagagaggacccucagcauagacagggucuccaucagauuggccuuugauguauaggaaaggcagcucgcugagggggccagggagugcaucaacagcauguuccccaugaucuccgcuucaguuucugcuccaggcuccugccuuuucuuccuccagcuucccucagugaggcacugugauguggaaacauaagccaaaaaaacuauucuuugcccgucuugcuuuuggucagagauuuaugacagugacaaaaaaauaacuagaacaacgaguuccuucaaccaaaugauuacagaggcugggagggcaaaagacgggacaauuucaaaggagcugcuguuacuggacccaggcauacugguucccacuaaugacaagccucauccuaggaaagccauguuguccuugguuugguucucauuugcagagguguuggaugcaccuugcuccucuucagcucgauugcucucucucucucucucucucucucucacacacacacacacacacacacacacacacaccauuccuggcgguacuaaggcaucaacaccaccuucggcaugccuuggaggcuuucugaagauagauuugcacagauaggccuagcagacugcuucccacugugagguggugugaugcuuguacaauguaaccagaaucugagagauggaagcaggaagaccagaguuugggauuauccucauccacauagagaguuccaaccuggcccagugacacugugucucaaaaaauaaacccacaaagcacccacggagcgccuggaaggaggagccuuaggguugucuuuauaacccauagcccagcccaucacuuugauaccuaacacagugccugcuauauuguaggaacauacugauuuaaucuuuucugggaagcaaacccuggagucccuguacaugcugaacaagcuauguuugagcugcaccuccagcaacuauguaaucuccaagacuuuuucuugcaacuugaccuuauuccccuaguuauucccauucaacguuacaaauuagugcuugcugugucuccaaaacaccaagcuggggcuaugcugcuaugacucaguaguagaaugcuucaucgcccgugguaaauguccuauguuuaauccuucggaucaggaaggaggagagagaucaugacuguuuagagcuacaacuacaacaguaaacaagacagagugucugccaaaagccaagaagacuuagacucuucaucuaagguuuuugauuaaaacaaaacaaaacaacaccccccucccccaaacguuagaaaucaccuuauuuguuauucuacuuucaggaaacagacucaggaugcuaaguggcuuauggaaaggccaggggagcaguaggcuugcgagcuuggucaccugauacugaaccuguuuucccaccuuauggcugaugccaucucaguucccaggauugccuugcccugcccgauuguaugugugugugcuugcuaguauaagggugagcagccucuccauccagaagacuguugguguggauaaugaauacuguggccaccucucaccugaccccgugccacauggucuccccauaauucuauugucuuuaaugucuuagcaugggagggggcccagucuuuaaggagcacagacccccuucaugcaagaggacuucuuuucuuuucuuuucuuuucuuuucuuuucuuuucuuuucuuucuuuucuccuuccuuccuuccuuccuuccuuccuuccuuccuuccuuccuuccuuccuuccuuccuuuaaagcuggaaggggaagcucuugaguuagaaauggcccucucaggccucuugagaguauaauacaaacuggauagucagcaggaacccagcuuccuucgcuuacacaucuaacccuggcuguuuacugcccuggggcuuccccaccacuguguggcuccagcuguuguccucaggaaaugcuggcuucuuaguuucuccuuugcaaguugauaaaccguggugugguuggcucuccacccagguaggacucgagaguuauaaacaggccugugaguaaguuccuuaaaggauucuugacuccucagcagccuuuucuucagucuauucaaaacaugaucuugucacaugacacuccuauaugcuuccuucaaccuugucagucugagcugacagaaaguguccucacagcuaccaguuaugacaguggaauagaccaggaguugucaguauuguccccagacucuggggcagugguucucaaccuuccuaaugcuccaccuuccucagauuguggugaucccagaccauacaguuauuuuuguugcuacuuauguaauuuugcuacuguucugaaucauaauguaaauaucugauauguaggcuaucugauacgugacccccaaagggguugagacccacagguugagaacuacugcucuaggggaauacagcaucuauuguggaggcguagcgaugccagacucauuaggaacaguaguaccaggcuaaggagcuggggguggugaugguuucagcccaucuucauuccuugggaugggaguucuggcugaggacauuauuacuaauacugccauuauccggcacauuuacaggaaaagacagagauagaggcguaggaagguucuuggcagccacuugauuuacuguucaguaaaaugcaacauuuccuucugucaggccacagccaaagggccaucuggucugccagacaucugcuugcuucgcagagaagagucagccugagggaguaagcucauuauugaaaaaaugcacugccggccaagagaguagacacgcaugacccuuauuaucagauccaucacacaucugcaggacuaagagaggggcugcuuuuaaucaaagcuaguaaccagucagaagcaaccaaaggaaaauaaacucugcccuggguucuaacucuucacauacucuuuuauuuuauuuuauuuuauuuuauuuuauuuuauuuuugagacagagucuccuguaaaccagcugaccuuaaacucucagaguaggggaggaggcugaccucacaccuuaccugaucuuccugccaccuagucucaagcgcuggccacacccagcaguuugcuuucuuuuuccaaaagugcuuucaggauacacuuuguccuccauuguuuagugaguguuacaggaauguguacugcuugugaggcagagugcaugcuaggcagagagcuacacauauguaaacaagacgggugggggccagggcggagaauucccuguccuuggaaaacuguaaucaaauucaaacuucugcuggccucuuucuacucuugaagcuguuaaggacuugugugcuuuuguuucucugaacuguacauccugaugcuuacagcaggagaauuaaaaccaaagcuggagaugaguaugucgaccccaguucaaauccccagaacugagguaaaagcuagacaugguagugcaaugccugaugggaucuguaaucccaguguuccuccagcaaggugaggggugggcacaggggaauccauggagacucaacagccagauagcugggcccgggcaguuuggaaacaaacaacaaagagacccugucucaaacuagauagaaggcaaggacugucaccugaggcauguauuagcccauacucauguauacacacacacacauacacauuuuauauauauauauaaacauauuaauuauaucuuauacuauuuacauauauacacuauauauguauaugauauaauuaauauguuaaucuauuaaauaauauauguauuguguguauauauauucacaugcaagaaauaaauaacauuuuaacaauuugagagaauacaccaacacauccguacuuaagcagagcaaggacaucuucauaggucagguaaacuuuacuuuguagucacaaagccagagaaaaaggcagaaaugauguaugacuauuguuacuaaaauuacuuuugauuuuguggcgugccugagagggccucagggacuucuagggguccagagaccauguucauccaguuuuaauuaaauuaauaaugcugacuuucuaagauuauuuacauagacuauuaacauuaauuacauuauacauguuauaauaauauauuauauacaacacguguaucuuuuuuuuaaagauuuauuuauuauauguaaguacacuguagcugucuucagacacaccagaagagggcaucagaucucauuacagaugguugugagccaccaugugguugcugggauuugagcucaggaccuuuggaagagcagucagugcucuuaaccgcugagccaauucuccagcccucuuuucuuauugugacauguacaauguauaguuauaacaauuauaaucuauaucuauguuuuuuuuucuguaagaccuauuuggaaaccauauuaguaauauuuucaaagcagccagaguuuguuuagugugcugugucuuucuugugugcccugaguucagugucgagacagaguuuugugauggauggauggauggcugaugaaugccuuguaaucccaggacuuggaaagcuuaggcaggagaauugaggccagcaugugcugcagaguaaguugcaggcuagccuggacaaaauggugcucugucucaauagcaaauaaauaaauaaauaaaaauaaaaaagagccaaaccaaccaaaagccccaaguuuggagcuauugaagauucaggcucugggaaucucuuguuuuuuaauguguucuuccauaacuugaggagaacauuggucucuucauaacucggggaugcccuucucuggccucggccccacagagcuuucaaucuguagcacacaauuuaguauucuaagcuagcuugcaagucucuuuuaaaagguaagaauccugucauacuuaguuuuguuucaucuccuauugccaaacucaaugacuuauacaaaacaaaacggugaggagccaggguauagcucaguggaaaggcacucacuuaccuagcacucgugagacccuagauuuagucucuagcaccauaaaaaaagagggaagaggagggagggaaagaaaagaggaaggaagggaugaacaagauguucaguaaacgccuuugcauggauggaagguucgauggguucaaauucugucuuuggaagaguuuguuugcuuccuguguggcuuuccauuggcucucacccuguaggacaagucgucacauacuuaccccuggaaggguuuaucccuuuaaaaucuagaaacuugggccaaagagauugcugagagggucaagguguuuguugugcaagcugguugauccaguuucaacaccccgaaccaugggaugguaggagacgagaaucaacucuguaaaguuguccuuugaccuccacaggcauguccuagcacaugcccccugccucaucaugugcaugcacaacaaacaaacauuucuguuacaugucugugcugggcacugugagccccacugaguccuggguagcagcagccaacagcgcaggcccggggccagcccggggccagcccugcucuguuagcccacuugagcugcuuucuuacaccaccaggcuucugaacaacagauuacauuucucacaguucugaggguugggagagucaaggcccugccagauucagcaccugaagaaacagugggacaaguuagggcuuauguagggguggucgggugcagacuaucagcacagggagggccugggagggagaagagcugugcaucacagccugaggguagugacccaucacacuguagccacagccaggguauagagagagauuaccuuaggucucagagucucccuccuccuuucuauccuugaacaucagccccugggauccugucagucauauucaggaugggcuguucccuuucauuuaagcugcucaaaaccaaucuuacagacacacccaguggugcauuuccuaggugauuuaaauccauaaugauaaugaagauuaauuaucacaggcauucaucccauucauaaggacuuuguucuugugacugucacuuccugacacugccaccuugggguggaggauuucgacauagacguuuugaagagccagaagcauucagaucccaacacccacuguucucacaccuccuaaugucuagcaaaugucccucgcccucagacuuguucuguugucuuucuuagagaaaccucucucugugccucaccuucucuaccaaaagcagaagaugagagguagcuugggggcuuacauguuugacaaaugacgguaaaggcuuguuucuguguagaagugaauacuguuucugauuugaccacagccuccuucucucucucuagccccccaacccccacgcacuuuguacuggcuucuacaucucuuccagagauguagugucaucagccaucacaagucccgguuuuuaagaugcauuuuucuaauugacaauucagauuauauuuauuuauguuuacaauaugauguugguuguuuguuuuuguuuguuuguuuguuuguuuuuagaacagccuggaaugggaaaaucaagcuauuuaacacaucccaucugacauauuuaucugcaggggcugggucggggugcgggucgugcauaaaugagaacaguuuaaaaaugugcucagcuguuuuccaguguguuguuguuguuaacuauaguuacucucauggacaguaggucucuucaacuuauucuucuuaucugguugaaauucucauuuugacagcaucucuccuuacccuccauacugaaggucccauucaaagggacacuguacucauuaccaggaauggaagcagagacagauaaacaagcaggugggaaucacaucacaaggcucauacauaagauauaaucauaaccaaacagguuugaaacaaugagucagccugcacagguuacagacaaaguaugcucauccauggcugcacuuuacuuaaucccgucuuaaaauaauuuuugucacccacucccuggcuccccgcccacccucccugcacacauauaugaucccugcuuucaccgugagaaacaaagguugcccuggucuggauguucacggcuucuccaaagcucuguguugaaaccucccccgccccccuuacuagguuuagauguccuucugguaguuacccuacccccuuuagaccugcuggucucugccugcaguuucugaucacccaacccuuuagaaauacuucaguggguguuucaacaggugcuuguuccaguguagcuauuccaccauuaaaaacaaaaacaaacccaccacacuuacccaauuuauagacagaguagcagcuuaccagugagcuagcauuugaaacagcugucagcuuucauuagcuaaacuugugacaguuacaaucacagcagccagaguuaaaagacagcacaaaaaaugcccaggcccagaauaucuguuuccaguguaaaguuuggaaucaaggggaaaacauugauggcagaauuuuuuuagcacaacagaaacuagcuggaaguauugaaauuauuucaauuacagcagcagccugucuuugauuugcuuaauauaugggagcaacuuuucaaaacaagagcaagugguguucugguaucuggugaguuuuccuagucuggaauccaacgaaggccacguauauucuuuggccagguucucaaaguugguugccuuacauguguguggauggcaauauggaugcuugaguuguguucaguuauuaaggagcauucuguugaccgugcagaguaguuguuagugcucuugagcucugaugguuucuuuaaaagcauuucugauuccuuucaaaccugacgcaauuccccaaguguuuauuuuuagcauuugaaaauggcuugcccuggaacagcugguucagugacuuuacagcuguugucuucccccaaggcugccucgcagugcuccguagagaagucaacccagcucugucugaccgacaucaggccuggccuagucaauggcucuuuguccccagcucagggcugcuguucucacuucugaccagcuuuucacugacucaaggucaugccguuugugaauucugccaacuucaugucguggagagagagagagagagagagagagagagagagagagagagagagagagagagagaagauacuugugaucuaagauguuguuuuuuucuacugcuaaacaaaaugucaaaaaaucuuaaagcuagagaaucggaggacuuacugagggauaugcucacuggugauguuucuggaagcaucagacagcaugaguucaggauaaccuuuaucaaauaauuccaaugcuagcagucgauuugaagaaauuaggagcguuggugagauggcucugugggaaaggcccuugccucgcaagucugcuaccuaaguuggcuucuagaagcuauguaaagguggaugcacagagaugcguugacaaagucaucuucugaccuccauguccucacugugacacagaccaccuccuucucaaccaugcgcaagcacacacaguaaugcuuaaucaauuaaaaagcaauuagcagggcuggagagauggcucagagguuaagagcacugacugcucuuccaaagguccugaguucaaaucccagcaaccacauggugguucacaaccaccuguaaugagaucugaugcccucuucuggugcaucugaaaacagcuacaguguacuuacauauaauaaauaaauaaaucuuuaaaaaaaaaaaagcaauuagcccaucacuuaggugaagacauuuccgaacuuucucugaaagacagaaaaaaggacaugccccaaagagaaggauugggugaagccaacuggucacuacacaacagauaaguacacagagacauauugcuucuaaaacuaaaugacauuuuuuuuuccaaaauguucauguauauguauagauuuuaaaauaucagaaggaagaguuaaagagaugccucagcauuuaggaguaauugaugcccucacaggaacuggguucuguucuuaguacccacauguuaccucacagccaccuguaacucaaguuccagggaauccaauauauucuucugggucuguggucaccagccacucuuguggggcauauauacaggcaaaacaugcauacauauuaagauaaaaauaauuguuuuaaaagcccagaagaaauauuaauaguggggguguggauuauaaggguauuauauuuuccuuccugacacucuuuuuguuuuucuuguuuauuuaucuguauguguguguguacacaugugugcaugagugugcaugugccauaaggcacaccugugacacguuacucuuauguagcuuggaggagaauuuuuuaggggcuagucuucuccuuccacacuguuuugaggcagugucucucuucuuccuauugcucuucugacagcauccaccuuuguucauggguuccaggaaucgagcugagcucagcagaccuggccacccagcaccuuuaugcacucugcuagcuccuugguccuuacuauguagcccaagcugaccuugaacuccugauucuucugccucugccucccaagugcuuauaucuuagguaggccaccaugacuaguggcuuccuguuaggcuuuuuuuuuuuuaaaucaaaacuuuauuauaaagauuuugcagccaagugugguggcauacgccuuuggucccagcacucaggagccagaggcagguagaucucugagacuuccgagaccgaucuggucuacaaagugaguuccaggacaccagggcugguacacagagaaaccuuguuuugaaaaacaagcaaacaaacaacuuuguaaauaaaagcuuuucuaaggccagcaggaaguccugggcaggcagaggacagaguaccauuucccugauuucagaugacagcaaaugguagugccauuuagaaggugagauuggaagcucacaugauuuuucccugcacacuuacaguuuauuuuuaauuuacuaugucaauaucucuuuuaaaugugauauuauuagacacacacuucuguaaacuggucauuuugcccuacgcaagagagagacuugcuuacaauucugugugacauuuguuuuauaaacuuuugucuuaagaauggggcuucuuccugucacaggaaagacuuuacuuuguaccuuugggccgaugaacagaaaaguaaguuuuuucugccuuuuaguuuagcuuuucuuuuaaauuuauaacaagggaucugccccagucuuuauuuuaaugaugguucgaaguauugugcguaggaaaaccuaucccauucuaucuggcuaaaauugauaagcauaacccaaagccauuuguaaaacugauguaggaccucaugcugauuuuuagucuggucugacuaagacagcucagcaguuggguguuuuucuggggcugucacuaccacagcagagcccugggggggugggcagcaguuccuccccaucuguggcuucauguuaagaaugucacagggcagcuguggcagugacacuggcuccuuguauguggcagaaugaaagacuuccugugugaggcauccccagggcuugaacuuaaggucggucgugacuuagcugguggguuaacgccacuuuugcagagcaagcucuuugcagugcacaccccgugccuuauguaucuggcacaaagcuaggagguuccauccacagggacccagucucuguccugucuugugguauaagguuccagugcuuucucuggauacauuagcauagcagggcugagcagcuaugggggcucugggcuucaguuuuucucgguccuuggaugccaguugauggagcucaccaugaccucccacagucucccugcuugccuuaagaacucaaggugacugaccgggaagcucaugguccagggcauuaugcuuucuauguuaugguuccuugaggguagggaugcuagcuauaaaacccaguuuaauuuacaucccaagugaacagcaaaguaauuaucuuaguauuugugcauaugauguuaccguucacuuccugcuaucaguuguuaccgucuggucauagcucucugacaccccccccccucuuuuuuuuuuuuuuuuuuuuugguaauuauuuccauauaaguugcagauaucacaacacuuugucaccaaauccuucagaugccucuguaaagacuaaaucauuuucugggcuggagaaauagcucagaggaucuggguuugauucccagcauccacacaggagcucccaaucaucuguaaccagugccagggaauccugaacccucuucugaccuuggguaucaggcauacauguaguguaacagauauacacguaggcaaaacuccaauacaaauacuuuuuuuagaaauuaauauauauguguguauauauauuuaaaagauuaaauucuaaaauuuaaaauuuaaaagauucauuuucuauguaguucauguaauaucugggacauaauuauacuuaagaaacuguuguuuccaugaaagaugauuguauuugcuaaaucuggucacugcagcaggcuguaugguaagcaaaccugggcuuugcuacacuguagaccagggcuuguccagacaugauuuaacauacuggcuugcaacuugcagaagucugugcuuuuguuucuuugucuacaaaauuggaguuuucuuuccauugcucuuuugguguuugacuucgauacaaauugcaaaacuggaaauucuuaucuuguaggaccuauacuuaaagcucagauacaaugaggccucuagcacagccccagagucuggcagguacccaguaggcagcuggcugugcuggcagcgugacuguuugugagccgaugcaggaaaagauaaagauaaagacacacugcuuuuagaaaugucggcaguugcauauacagcuucucuuugcucucuuguucccccuuagucacaugcacaaaacacacauggauguacacacacacacacacacacacacacaugcacacaugcacacauacacauacacagaaacauacagauacaaacacacagacguacauguacacauacauacacacaugcacagacacauagacacacauauuuagacacacacacacacacacacacacacacacacacacacaaggcccagggccucuucugggauuuacagagggcuccuugacuagccuaaccugcagcuauaugacacagaacaaacauacaagaacuuuauagaaacugggggagguuuugagacuaugaaagagaacagaacaguguauucagauggcgucgguucuaaguagucagggcagagaggugccaugggucaggcugaccacagggagaacaccagggugugccagaguccgcuaccaacggugacgcaggcaagcugucaaggacuguuucagugcuagccaggaguguuuucauuugcucuguuuaaggagacgggguuucuaaaggcuuauuuuuauccuaaaccucagaaagacaaguuuagagaugcccgagaaaucuggcuuccacccuuucuggaaggaguucugccuucuuucuuucuggaaaguccccccacuuuguauuuuuuauaccuuggguugccagagcuggcugaaaccaagugguauaaacccagcugcuuacccagcuguucagcucucccuugcaggagguucugggggggggggguuguaauuuuguagaugaucuuuuuaacauauaagugagaucccaaguccuuucuucucuguacagaacuucccucccccaugcuggaccauagcuggccuccaggugaggcccucugcucacuggcugauacggccacuccuaggcacccccacuucuccugacacuguucucuagccuugaccacuccucccagggaaugaaacuuaagccuaacccuugagacuccugcaaacaaaacaucccuauuagcuuuugcccuuggcaacagucccuucuccauuuacaguaaugcuuucaaguagccucuccagacccaagccagauuuguguugcccacucccaacuccuccaacccuccaacuuccaggaauugaguuuagagccuuccacgugcuaggcaagguaaaugcuacacuguuucgagaagucaacagccaacucagcugguuacaugcugaagagcugaauuuuccgguuuaguuugcugauuucaucccuaaugacuuccguuauuagguguuuccugugcugaccacuccauucuuuguuuuguuuuguuuuuuucgagacaggguuucuguguguagcccuggcuguccuggaacucacuuuguaaugaccacuccauucuuaagugauaccucugugcuguccaauggaaaguacagguuucuuccaguacagguuuccucggggcguuuguggagaagaaacaguuauugcccugccuuuuucuagaaaguuuuggaccagaaaaagcgaucucuggaagaugaaguaauuauuauuuccagguucuccacucucauaauuccaacacugguuuaaaguagcuuaaguuccugguacaguuucuaggcauuggaugaauaguuucugauagacugucaaaaaccguauacgagagauguauaggaagagacguucuuguaauucaaguguauaccuagucugcuuucuucagcuuacugccccucugcccucagcuaguuuaggcuugaggucaggaaauaagauaaagccagaucuuagccaggccuguaaucccaggauuugugaaacuaaagccagucugggcugacucaaggcuaaccuguguaacucaguguuucaaaauaacaauaauaauaauuaaaacuuuuauucagagcuggagauguagcucagugguugagugcuuaccuaguuucccacagggcccuaaauucaauucccaauaccuaaugggugagaaaaagagucacaaagcuuuuaaauaccuacuucuaacauggacagagaguuccugccuggagaggaugagccuugccaagcagacgcuagagcaggaccucagaagcuggaggagccaaggagucaugugauuuguuucugcauuucuauuccaucagucacaucucaacccacugacuuagcaaguuauuagauagaaacgacggcuggaccuccgugccuuagaggaggugacacagauacgccauuuaugccugagcuagccaagucacuuguucaccuuacuuugacaaguaguaagucucugcagguagcucuguccacucuaagcagccgcuucucugacuaaagcugaccgcaacaucauuuccugggcauagacauaauuauuuagaaggcagcuggacacaugucugcuagcuuaaaagacaccgggaguuuuggcaccagggccuaugccuuccaggcuaggaguuuuggcagguuuacaaugccaaauaugaauucugucuuguggagcaggcuucaaaucuaaucagaaagugguugguuauuccccuaacaagcuugccacuauugcgccaguaggugaaauuuugcuuggccagucagugacacucaggggucacaucugaguaagacuguuggguaauucuucuucacucugggcuauuggcucuagcuagcagugagggagccucuggcccuauuccacggugauuucuccauccugugacugaagcauauguucucacuuaguucuguuaggcaaccaagagcaguagcaguugucuguauuguucuggaagccucagaggucuccccgaacaacaacucauagggagguagcccaauucugacacuggauuuucauuuaauaaccuaugguuucugggagcauuuuauuccuauguuuuuguucuuauaaggaaacuagucauauugguucccgaguucauuaccucaucuaaccucagucaccucucuaaaaaaaaaaaaaauccagucuucaaauaugcucacauacugaagauuuggaauuaggacuuaaaaaauaugaauuugagauauggggauauuagcccaugacauaaguaggaaguagaggaaggauugugggaaauagaaauugucuacaguagucaugaaacucaguuuguguuugagccagaggcagccaucucuauagacaugucagggguugacuauggaugcauguacagcuccugaugguggaguuacugggugucaaauggaagaccaaaccaaacaaagcugguguuaacuugucugucugauucuuaggcuuaaugacagugagaccuguuaaugucagauacaaccauguucucaagagauugcaagugauugcccaagaaagaauuaaaauaagcaagcaaggagggcagacuuugacaggcaccuggcaugugcuuuugcuguggaggguggacuccugaugugggccccugagauggguaaaagcagggcgagagccuggccacccugcccucccuuugcgccugcaugucuucaggucagauucuugcugacucugcacaggacagacaugaucauccccgaggagugucucucugcccuuccuagcucaaccccugcaaggcucaccuacucgaagaugagaaccagguugugugacagaguggcuacggcucagaguuugguaggaaccagguugauucugcaauuaacuuaccaacagauugaaguacuuggcagggucagaucugcaacaaagaugggcagagccacucccguucuuccucuauuuaaacuuaaaguuuaccgggaauaacgguggaugccuguaaucacucagugguugagauagaggacugccucaaaggaccagccagaacuacauagggagcuucaaaccagccuggacuucauucagagugcguuaaaaccaaccuaaaccccacauuucuaaagaucugucaagaccccagugaugagcucagaguccuaagacuccuuuagauguuccgcuucccaacacauugacuauaucuuucucugcuuuucacaguugcccuucucuuuaguucauggaucgggacauguugccaccacaagcuucuugugguuucuggaaucugggcuucugcuuccaaacuccaguuacaggauaggaaaugucuaucccauguucuuucuagcccauguucagaagcaguggccuuaccauuuuguaaaccuguuuguuuguuuuccuuccucagaauaugguauuacaaaauggcaccaaggucuuuaauuccugggagaagcccccucuaccuguguacauccaguuuuauuucuucaaugucaccaauccugaggagauccuccaaggagaaaucccccuacuagaagaaguggggccauacaccuacaggugagucccucuucacuguugaacuguccugggaucccuggguugugccagcgcagcugugccaggacagaccugggggcuuacugcuuugguucuguucugccugcggcuuugcucuugucuggggaguuuccgcaacagagcucugugggcggggcuucgucccugccugcgugcucaagaaggcugccccuuccuguccuccacagcugcucuccaccucuggccuuuuaaggucccccucagacuuuggcgacuuuuagggcucccuccaauucccuuccacacauacaguuuuaaaccaguuucuagaauucacuguugaucugagauguuuucugauucccauucauucuuuuuuuuuuucuaaugagauuggcuuucuuauagcucaggauggcuuugaauucucuuuguauugaagggugacuugaacuucuugacucuccuucuaaacuuggauugcagccuugauuuaauguuaggugugaacccagggcuccuuacgugcuuauuacuaacugaacugagacaggguuuuaccggcuugaaauuuauucuguagccuaaauuggccuugaacuugaacuuguggcuauccuccugccucagccuuccaagugcuaggauuucaaacauagucuaccacacucaguuuguccauuucuaagccccacucacuguguauaagaaauagcagguuggugacuggguuugugacagugacugccgguuucaaaggcugagaagauugaagagugguauugaucauuuuuuuuuauuacauuuauuugugugugucugugugcgcgcucacccucccacccccaccacgcacaugcaccauggcauaugugucagaggucagagaucuacuugcaggagucaguucucuucuuucacuguguggaucccaaggaucaaacucagguccucaggcuuggcagcaaacaucuuuaccucaugugccguuuuccuaggaccgugaacauacauuuucaaaggugagcagacugagagagacgacuucggucuuauggucaagauacuuucuguguugcaauggucccaguagcuccuccuucuccuacaggaaccaugccaggaaagucuuugccaauauuaaaacaaacaaacaaacaaacaaacaaacaacaucagugaagaagcagacaguccauucuccuggacugccaacuggucucaaaguccguuguaaucaguugcccagugugggcuauaucaugaguucuaggccagccugggcuacacugagucccugucuuauaaaagcaaaagcaaaacaauacccaaacuaaaaagaaugcccagggacuggagagauggcuuagugguuaagagcacugacugcucuuccagagguccuaaguuuaauucccagcaaccacaugguggcucacagccaucuguaauaagaucugaugcccucuucuggugugucugaagacagcuauaauguacucaucauauauauauauauaauagagaaauaaaaucuuuaaaaacaaauaaaaagagugcccaggaaggaguuugggaguaucaauaccucuccaaugaguguuaucuaguguguuucucccgaucgcccuaugccaugccccucccccucccccacugucucucuguucccccucccuuccucccuccuucucugccuucuuuuauguuuuuaaauaauaggcccggucuguaugucagggcucuggaaucuucugucauagguguggagauuagaggacagucuugggugucagccuuuauauuuuaccucauguguguaacaugagggucucuuacuugccacuuacgcacaagcuagcuggccugcaaacuucuggggucuccuaucuuuaccucccaucucauuguaggagcacuggacucacaggccuguguuacugugucuguuuuuaccugaguucuaaggaucggaacuuagaauuucauucuuuccuggcaaaagcauuacaacuaagccauuucgcagccccggauuuuuguuugauuguguuuuguuguuuugagacaagugcuuaccagauagccucagcuagccucaaacuuccaaacuuuugcuucagccuuccuaaggcuagaauuagagguauauacuacuggccugacucuaaagcagauuaaaaaaaaaaagaaaaaaagacuauucucuuguuuaucuuuuugcaaauuuuauauaugauaaguauuauauuuacuucuccuuaucaaauucauauccuuuuauucuuuauuaauguuauauaauauacacauacauauguacauuauacauauguuacauacauauauacuuacaaauauagccugcucuguuuauuuaguguuguuccucugucuguguguguguagggcugaccucuugggacuggcucacccaucagggggcucuucccuggaagagacugaucccuccccccucagccgucacucacuaucuguagauccuuaccuaauguugagaccccguggauuuuccccgucuauaacugcauguguacaggccuuguuacuuuuucaggucuuagguuuuguugagaugucauggguucagcuucccugucauauauaaacagcacuaacucgcagucgaugcccugguccucuggcuucuacagucuuucccccaacuuuucugcuguuuucugagccuuggguuuguaggguguguauuauagcuguaucagcugggguuggucaguuguucuauacauuuugacccguugugacuuucuguauuggucucugcugcaacaagaagcgucuuugaugaaagcuacacuucucugugggcgaaaggaaacguauuugggcacagguaggaauuguguggcuuuaugaacguggcaguaggaguuucuccuacuagggucauuggcuuuaccagccucagguagugguuuaccauggaagacgugaguuccuuccugcucagagggccuuggguccaaauggcuguuggcuaccccaggagauaaguggccacuauuucaccuuuuagagcaucuugccgugcuuguccuuguuguggucuguagacaucauagcuacuaaguagguguuauuagacgcguucucacgaccggccaggaaagaacaccacagaccagaaucuucugcggcaaagcuuuauuucuuacaucuucaggagcaagagugcaagaagcaagagcgagcgagaagcaagagagagagaaaacgaaaccccgucccuauuuuaaggagaauucuccuucgccucggacgugucacucccugauuggcugcagcccaucggccgaguugacgucacggggaaggcagagcacaaguagucauaagauacccuuggcacaugcgcagauuauuuguuuaccacuuagaacacagcugucagcgccaucuuguaacggcgaaugugggcgcggcucccaacaucucccccuauccuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccgugcaacucucucgggcugcugaagcacacucacucuaucccgugcaaugagucuagccucgugagauguaagagcugaguggccagcgaccuauugccuaagcauagauaaccauauaucagggggagcuccauguucuaguccugcaagcgccugggcaauaaccaccuugucucuccuaguuugggccuuaagcuuacagaccaaucaaagaagcaacacuaauccacagcaaaguguaucuccaaauaauauuaaucccacccauuuuuuaaagaaggaaaaugcugaggagauccaauuggguaauccuuuggucagggacagguccaagcgcguggaguugaccugaagucucaauucccgaaggaucuguucaaauucagccauccaauucuguaacauauacugaaaaagacuuuuugacaaauuagcuguccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucaucuggaccuguccagacagagccaaggcugucugaaucaaggcuaaacccaguuccuaguuagugguaaaaaagcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguacccaaaauggguugucuucauucugugggaaaacacagauagcuccccuggaucuuaucaaaauaggauccgggccauaccauuuauuaucaaggacauuuuuccauuuaaccaucucauuuggccuaucuggcucugaacaaugacguucagccgcaguauggccaugaacaucaauauuuaaaaaauugaguguaaagagugccaaagacacagacacucuuggugcucgggguacagucuccucaaaauuuccccucuucuguuuuauaagauagguuuugagggugcgaugcgcacgcucaacaauacccuguccuugaggguuguauggaaguccagucaggugggucacguccaucugacggcagaacuguuggaauuuuugagacguauaagcugguccauuaucagucuuaaggagucuggguuucccccaagcacuccaugccucaagacaauguugaaucacaugugaggcuuuuucucccuuuuguaaggccugguuagcagcuagaguaagagcccuuggggaggagauaugaggaucuccuucuaaaauaccaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaagaggauaugccuuuuguagcaugguaaggucuuuauggcacaggaggaugucauccauguaaaggagcaaaauuaaagaggggaauuguucccucacuggcaaaagagcuucuugcacauaaaguuggcacauuguaggacuauuggacauucccugugguaagaccuuccauugauaccucuuaucagguuccaugugauuaauagaggggaugguaaaggcaaaucugggccuaucucuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagauggcucaauauggccuaguuuuaauuguuccucuaccaguugaaucacagcuuuuaguuuuucagaggauaggugccauugaggaacccacacuggguccccuguuuuccaugguaugggucgugcugccccaauggccgcuaaggaaaacccagacccugucugucuugguuuccauuaggugagaugggcucuauccuucccuguucuugauguccuaacccuuuuccuucuuuauaacccaucuuugccaugauauuuuuugcuuuagcugaauacccuccugauggggcguuuucauuggacaaaauaaggcccaaaugcugcauaauaucccuuccccagagguuaaccgggagugggagcacauaagguaugaauuuccuuugcuguccuucagaggauucccacgucaaggcaacggagcuuauagugggacaugauugauauccuaggcccuguaaugaaugagaugacucuguggugggccaugcuuugggccaccaauguguagaaauuauacuuuuaucugcuccgguaucaaggaugccuucaaacucuuuuccauuaaucuuaaggcggagcuuaggucuaucauuuaaagauacaaccaaauaggcagaaucauuuccugaggagcccauuuucuuuaucucagguccugcaaauuucucccugguauuaucagggaggagcagcagcugagcuauccuaucuccuuuacuaauagaaaaaacgcccuuagggcuugagcacaggaccuguauuucaggggaauguugacaauccauaacuccaggguggacuacuaagcccugcaaggugagugaaccccggccgagaauaaggcccaugguucccgggggcaaggaugguauaggcuccacuggcaccggcugaauacucauuugaggcauuaauaggaagucggaggcggcacgcagguccacccuugugggucuuccugggucgccucucugacugcuuccuggguccugacaaaccgguucccauaucuuugagggcccugggaccgagggcccgaugacccguuuuuuggcacaucaguugauugacuaucaggugggggaaggacucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaguuaaaacauguccucugaucauuucugcucauggagcgguucugagauugaaggauggcggccgcuaagccugcauugcugagaggucccccaagcucucgacagacccugagccagucuuguaagccuuuguucuuucuuggggcuauggccgcucggcacuccuuuguggcuugcucauagauuagcuguucuaucagaggcgcagcuugcucugaaucuccaaaaauacgcucugcugccucugucauucuggccacaaaaucugagaaggauuccugaggucccuggauuaucuuuguuaacugaccagugguuucaccugcucgagagagcgccuuccaggcccuaauagccguggaagaaaucugggcauaagcuccccaaugguaguuugucugaucagcagaauaagcucccugacccguuaacaagucaaaaguccaaucucucugcucuggagucaaagcagcugcguuugcucgggccugcgcuugugcagcuucgugccaaagcgcucuccauuccauauauuugcccauacuagggagagcggcuuuuacaaccguuugccagucagcaggaguuagugccaugccggcgagccugucuaacugcaccaagguaaaauuagcauugguuccauauuuacggaccgacucggcaauuucuuuaauuuguaaguauucuaccggagcguggacacgcccacccucggcuccuucaaagaccggaaaugccuguuguauuuuccuuuguuccucuuugggaaugaaugagucugcgcacugccucucugcgcacugccucucugcgcauugcugacgcacuacgcagggcggggacuccgcauagggcggaccuugaagccgacugcccugaggccaaucagcaaacuggccuucgccagccgcuuuuggcuuccuuaacugauuagcuagcacuuuagcugcuucuuccucccagucuguuuccucagaggaggauucuccaucugcuucagaacuacuaagagcuggcuuccugagcucaucuagugacgaguaucuccuagagaccuccgcuaauugaucuuucuucuuuucccuuuuuccucuuuuucuucuaaucucucuccagguauuccuaccuaaccuuaacuuuuccucggguucaagacccuuggaaaggccuguauacuuauuuuguguaccauauuuucucuuugcuccuacucucucuccccgcuuuacuucugauagcuuguccugaauuuuaucuagaauccgcccuaucuuaaccacuugauaacaugugaaaaggaacaaaagggcuucuaacacuagaaaaaauucaaggccaaacauuuuccacuuuacuucugauagacugucuugaauuuccuuagaaaguucaaggccaggcuuaccucguaaagcuguacucacugguacucucguuccccagcugaaaaguucugaauucauacaguugaauccuucuuaacagucugcuuuacgggaaccuuuauuaccgcgacccgcaguucugguucuggaaugagggaucuuccuugcgccagucccgaguuuuuuuuuuuuuucucgucccggaauuucucgucccggaauucggcaccaauuguuauuagacgcguucucacgaccggccaggaaagaacaccacagaccagaaucuucugcggcaaagcuuuauuucuuacaucuucaggagcaagagugcaagaagcaagagcgagcgagaagcaagagagagagaaaacgaaaccccgucccuauuuuaaggagaauucuccuucgccucggacgugucacucccugauuggcugcagcccaucggccgaguugacgucacggggaaggcagagcacaaguagucauaagauacccuuggcacaugcgcagauuauuuguuuaccacuuagaacacagcugucagcgccaucuuguaacggcgaaugugggcgcggcucccaacaaguaggagugcugguuguuuucccucuguggcugcuuauauacugccucucaauacauugagagccuguccucagggagaaggcuucccacuugguuccaccuugauuucuccaauuguucaaaguuugcugugucuuuugcaauagggaggcagaaaacaagggccauuuuguguucucuuggacuccccugaugaacaacuugaaaggaaguuuccugugccuggcaaugggguuuuuauuagcuagucuauagcuuuuagaggcauugucuuccaugugauauaacuucaucauguguguguugugcauuuguauacauacauguauauaugcacacacaugcacaugcuugcacauguaauugucagcagauguaaaggugauuuccuuuucaaacaccuuauacauccccucucuuucucuuucccucugggcuguccuccuccuccccucuguagguaacugucuuagucaggguuucuauuacugcauaaacaucaugaccaagaaacaaguuggggaggaaaggguuuauucagcuuacauuuccacauugcuguugaucaccaaaggaagucaggacuggaacucaagcaggagcugaugcagaggccauggagggauguuucuuaccagcuugauuccccuggcuugcucagcgugcuuucuuauagaacccagggacugccagcccagggauggcaccacccacaaggggcccucccacccuugaucauuaacugagaaaaugucuuacaacuggaucucauggaagcauuuccucaagggaggcuccuuucuuugugauaacuccagcuugugucaaguugauacagaaaaccagccaguacaauaucucuccuaugguucccauuucucccuuuauaguccacaguuuguucucuguauccauggguucugccuccauccacauaguuaacuaacugcaguuggacauacuugagagaaaucuauauucuugcugacgugggcauacaauaguugcuuuugugcuaaauacauauggacuugucuagcuugcuuccuaaauaguucagcccauaacugcuguccacacaguacuuccauuguauuagguacaauaugaaucuagagaucauuaguaguacaugggaggaagucaagaggagaguucagugguagaguuaaaaagcauugaguucgauucccacuguggcagacagcaagcaaaaaagcaugcagggaaauguauguaucuuauacgucaacacuauacccuuuuauuuuauuuuaaaaagauuuauuuauuuauuauauguaaguacacuguagcugucuucacuccagaggagggugucagaucucauuacggaugguugugagccaccauguaguugcugggauuugaacucaggaccuuuggaagagcagucagugcucuuacccgcugagccaucucuccagccccuguacccuuuuauuuaagggauucaaguguugagauguugggguacggcagcuagaagcuagaagcgauccccuguggguucugaauagguuucccaaaugauccggaguaaauaaauaaaugaaaaaauaaaccuucugaauuaaaacauuugguaugagcugagccuaauggcacaggucuauaaucucaacugcuccacagauugaggcagggggauugcaaauucaaggccuaccuggacuacagacugagaccaagguuagccuagaaaacuuaaugagauccugucucaaaauaaaaagcccaaaguaccgaggaaacggcucaguacugcuucgcccaccaugcacaggucugaugcggccaacaaagaguuaaugugugggacgcuugagaagguuuacuguagaccuaguagggauuauggugcacaguagguuaagaguuucaaacaacagaaaauacaacaaaucaaagcaagcaaacaagaacaacaacaaacuuacaggagacagugccccaaagcagguacugccuccaggugcugccagugagcucuccugccugccugugcuuccucuuccucucauguccucucuggugccagaacggcuuucccauagggcucacaagacacuuccuucaccucccugcuuggggcccuggugacucucucugugaugugcgugguuguauagguuugguaucuucugugacuaagccuuuuuauauuuuuguuuuggacacuuguauccuuccaucuuuguaacaaacacuguaaggaaacaaaguuucuuuggacucacacuuugggagguuuuugaaaggacugcuuagucccuguggcugcugggcguuaaugacauagcccaagaggaagaggcuugggccucauguucucuucaaaggcagguaaagccuuacgcgugccuuccagccuaaagucuuuacugucucccaguagugccacuauggagaaggagccuuaaugggccucagggggacauuuaaccaaagcauagacuggcucuuagcuugggauuuuauacucuaagccagguguuucaguacauaccugcagucccagcauuagggaggcugaagcaggagacuugccauuaccagccuagaguacagaaugagacccugucucaaagggguaaaaaaaaaaagcuuauucuccaacuagagcuuucaaaagaaauuuaauaugagccacacaaaugacuuaagcuuuugcuaguauccacgggauaaaaaacucauauauuucagcaugucagcauucagaauuauuauuucaugucuuccuuauucauacuaaaucuuucaaaucccauguaauccccccccuuuauaucauaaauuucuuuuuagggguguggggggggguaggguuugaaccuaggaccucgugcaugguauguaagcauccuaccacugagcuauaacuccagccccuacauguuuauuuuauucuaagcaguguguccuggauugacgccuagucaugaucccacccugcuggcaacuggauuucugcaggcugggcaaaugcuuuaccuugggacccacccauccccccucuggcuacuuuuuuggaguguuugcuguucagacugacaaaucaggggaacauuucaaaagaggcugccuaaaacuuucgagcacuaacaguguaauccucagccugcuugacaccgcucagcuaaaacgaaccagaagagcagccuuagaccaggccacagagcuaaggggugaacaccaccaaauaugauucacuauucucccugugccuaagcuaacaaaagaugaaagauaaacguccuauugcccuggcccaaagcuagcaaaaacuaaaugguaaauucccuuuucuucuuugcccagagcuaucaaaggcuaaaagcuaaagucaggaugguaaguucaguuaacugucuucagugauaaacaccugugugagucuuggcgcucacgguacggacuacagaauuauagguaacagcaaugaaaguuguuuguuucuuuugcuggcgggccugguagguauagugcaauucucacaccaagucucgucuuauccugugcagaauacaguuaucaugccugugccuaggaaaguuucagugacagacucaagauaauaacacaagauggcuguucuuucuggagucccucucuccacccccaccacccccagucauccccuuugaaaggcccgccacccuucccucacacgcagguuucaugagucucucccucagucugcaugugguuguucacacuugugaucucucagcacuugggaagcugagacaggaggacugcuuugaguucaagucagucagugagauauaucaaugcccugucucagaauagaugcuggagagauggcucgguggugaagagcacguccugcucuugcagaggacccaaguuggguucccaguacccagaggguggcuugcaagcaucuguaacuaguccuaguggauccaacauccucuucggaccccugcagccacugcaugcacacaguauacacacgcgugcaugcaggcaaaacacucacgcacaugaaauaaaauuaaauccgucuuugaaaauaacuuucgaggacuaaaauaaaagcugccuucaccuuuccucugguuucuguuugguucuuuguuugggcaggggcucucuaggugagcacaggccaccucacucaaggauggaggugauuuucuaguucuccaaguguuacaccccugcuagaccacagcucaguucucaccaccaugcuuuaguugucugugagucccuccaacacugccaugcuggcaugcuguaaugccucucuugagaaugaguacaaaucugucccuuccuccugagacguguccugaccugaagugcucuccccauggaagugugcucauugcagcaaucacgaaggcguguuaguaacugucuguaggggcuggugauguagcucaggcaguugggugcuugucuugcuucagaucccagugcguauagaaccaggauguagugcauagcuuucuuccuaguaccaggaagcugcaggcaggagggucaaaggaucagggucauccugaaguccauagagaauuugaggugcaccuuggccaucugagacccaccugagaagugggauaaugaguacccaugucacgggacaugcaugguucagugaguaaaucgauugccauauagguaugaagaccagcguucagauccucagugcccacucaaacacagggcaagcauagcggccuguuuguuauacuagugcugggaagugagggcagggauucucuggaaagagcugacugacuagucuagcaagcuuugaguccaagugagagacccugugucaucaugguuugaacaugcuuggcucagggaauggcauuauuuagagguguggccuuguuggaguaggugugucacuguuggugugggcuuuaagacccucauccuagcugccuagaagucagucuucugcuagcagccuucagaugaaaauguacaacucucagcuccuccugcaccaugccugccuagaaacugccaugcucccaucuugaugauaauggauugaaccucugaaccuguaauccagccccaaauauauguuguccuugauaagacuugcccuggucauggugucuguucacagcaguaaaacccuaacgaagacaccccgccuuaauguauaagaggaagaguaguugaggaaguuacccaacaucaaccucugggcucuagaaacacacacacacacacucacacauauacuccacacacguacauacauacacacaagcauaaacacauacacuucacauauacgaacacauacacagaccuauacucccccccucagacauacauucccaacacacagacauagacacauacauacacacacagagauauacacauaaaacacacacacaugugaaaacacccccccacacacacacaaaguggcuguacauaucugacuucuuuuuuuauuagauauuuucuuuauauacauuucaaaugcuaucucgaaaauucccuauacccucccuccgcccugcuccccuacccacucacucccacuucuuggcccuggcauuccccagguacugggguauacaaaguuugcaauuccaagggccucucuucccagugauggccgaguaggccaucuucugcuacaaaugcagcuagagauacgaucucuggggguacugguuaguucauauuguuguuccaccuauaggguugcagaccccuucagcuccuugggugcuuucucuagcuucuccacugggggcccuguguuccaucuuauagauggacuucuugauauacugauaucugacuucuugauauacuggaaggccaguguggacccagagcggugggguggggugcacagggagguccuuucaucuugagcauccagcaccuguuagcacgauuagaagaagugagugacauggucccaacugugguuuagaaccgauaggauauaaguagaggaacugauuagugaguagcucagcuggaauggcaggacucagucagggaaagccaagaauagauuggagaaggaccaggcucugugaauggauggcuguuauagacgccacaaaugcagguuggcugggcgcccugagaucuggguuuguagauaaaccuaaccuuacagggagccaucaaacuucuugguggagccuguuuugccugugucugcuuucugacaucuucaaguggguccggugccacuugcgacuugauugugcuauucugggggcugacgccgaacauaccguaguacccguagcaguguuuggcaguucagugagcuccuacuggucuguucgugguguagaccaggcuggccucuaacacacagagaucugucugcuucugucucccaagugcuaggauuaaaggcgugaacugguacucccagccaagucagcugacucuuagccacggugugccaggccaccuggggugcagugaaggaggacauggugacacugccacuguucauuguggagggaauagauggagaauagaggaaggaaggcuucugggaagucgaggccuggcucaucugacaguuuucaguggguucguugccccaagagcuagcaguguuguauauagaguuuggauguuccugggagacaaggcagguccauguaugaagaaccagucugaccgguccagugcgcaucugaguuuuuggaagcccgagguugaguggccagaaccaacuugccccaggagccuucugcucagugaagccuuugauugagacuucuauagauuuaugagagccuuggcagacuuacuguuuuuauucuauuacucacuauuucaggaaucagaacugauuugucuacggccuguucaguugaucuucaugcuuucguuacguauuuauuaaauuuaccauauccuccuaagaagcccugucccuuguuuuguguuccucagauuuuccuucacauugcuucuuuccauggaugacugcuuugacagcaguaagaaaaaugugcgugcuaaaccuuacgcgggguuuguucuuuuugagggcggcucucucacuuagccuagauagaacccacuaauuaggcaaggcuuccuagucagugagcccagagcgucccagcccugggguuauaaaugugcgccaccgcggccuaccugccugcuuaugugggcucaggaaauugaacuaaggucuucaugcuugcaaggcaagcacuuuccugauggagcugucuccacagcccuccuaacuuuucuuauuuuuaaaauuuauuuugaugugugugugugugucuauguaagugcaggcagaggcuagaagagggcaucaaaugccccagugucagagacacagauaguugugagucacaugacauagaugcaggaaccaaacuagaucuaacacugagccaucucuguagucccucuuuuaccauauuuuagcuuuuuuuuaaaaaaaaaaaaaaaaaaaagaagaagaagaagaagaagaaaagaaaagaaagaaaaccucacucucauguucauacuguuuuggggaauguaaauuaauggcauuauggaaaauauaugaaaguuucuuuuaaaaaacuaaaaauagagccaccaugugauucaugcaucuuaccauugggcauccauccaaagacaaugagacuggcugguugaagaggucugugcacuuacacguuuaccgcagaacaguucaugguaucucuucugguaucuaaauggcagucuccugugccccagugugucugaagacaggagacaggacauagcaucccccgucuccagaaccuggcacagguggcgaugccgcacaguagugacugagugucgugugugcugggggcuucagcggagcuuuauacuggaugguuuauuucucacagcaucucugugagauaggcacaugguggucgccacuuuacagauggagaaacaaagacagaagccucggggagcaggcucacacugcagucccccuagagaggcggaggcagagggauggcugaauguuuugcaaagugagucucaggcuagccaaggcaacauuguaaggccuuaucuuagaaaagaugaagccaaagaaaccacgagugacuuuuuagucccacagcaaaguauuaguguagauaggacugagcaaaaaaccugagucagaucucacuguacaccccuaucuagugaucugaggucacugauaucagccaccaaggugauaggugauuuuuuuuggggagggguauuuuguuuuguuuuccagacaggguuucucuguguaaccuuggcuguccuggaacucacucuguagaccaggcuggccucgaacucaguaaucagccugccucugccucccaagugcugggauuaaaggcaugugccaccaccgccuggcgauaggugauuuuccauagagagcuaugggugaacccaaaugacuaacuccuuuugagaugaacguaaugacuaaaggucgagguguugcuugcuugcuuuccuuuugguguugaagauugagcccagugcacgcugggaaagugcucuuacagcacugagagguguccccaucaccuaacacauuguacgaaccaauuuauccagcauaccaaaaaagcuggaagcacagcuguugauguggccagugaauuaaaauuguucuuuuucauucugugugucccuccuuccuaugggauucaguaguucacagggaauaacucaaacauuuccuucuuuuguuuacuuuagagacagucucgcccugcagcccaggcugaccuggaauucacuguguuuuccaggcugaccucaaaguuacaacaaucuuacuucaacuucccaaagccagagccugcaggggaagucaccaugucaggcuucuuucuuucauuuccuucuuacuuuguuuugguuuugauguugucuuuuuaaacagagcuuugguauaugcaagcugugugguccaagcuggucuaaaacuucuggauucuuagguucaaguaauccuccugcuucagccccccuggugcugagauuacauguaauaccaccacaccaagauuuucauccaacucucuuuuuccuccccucuccaucccuucucuccuccugcucuccccuuccuuucuuucugagaugagucugacaaaauagccaaggauaucuucuggccucagcaccuccagagcggggacuacaaguguggcucccacuccuggcgcgcucucucucucucuccucucucucucucucucucucucucucucuguuucugucugucuguuuuucugucuccaucucucuguuucugucucucacucuuucucuuucuuuuuuccuuccuuccuuccuuucuuccuuuuuucuuucuuuccuucuuuccuuuccccuuuuaaaaaugcuuagauguacuguaguguuaagcauuaaacuauggggcuggugagauggcucaaugguuaggagcacugacugaacuucugaagguccugaguucaaaucccagaaaccacaugguggcucacaaccaucuguaaugagaucugaugccuucuucugaugugucugaagacagcuacaguguaguaagauauaauaauaaauaaaucuuuaggccagagcaaguggggcagaccagagugagcaaccuucauucucagcaaccaucaguaaagcuacagaguauacccauauacauaaaauaaauaaauaaauauuuuuuaaaaauuaaacuauagucucagauuauuauugucuauugaagaacagggcaguuguaccaggcaguuggaaauacagucccuugauuccuugucuacgcccaagauggcuuuuguuucuguuuuaagcgguugucuguguuucuagauaguucucaggucuucucuaauguggcugacaguaaucugaccacuucuuguugucugucucuuguuucccagcaacuucacugugucuaguuggcugcuguugaucagcugguagcuggcauucguucauguauaugugcaugagaauguaugcugcuaaccagguuuacugguauugucauaaaaaucccucuccuugucugucugucugucugagcauugccagagggggagggaaaugguuuuguuuguuugguuuggguuuuauuuuuggcugaucaugcuguuuugagaggaaagcuucccucuucuucucuuucucucccucucuccuucucucccucagcagaggaggaagccaugucuuacugguuuauuucccauguacagcucucuguaaaggccaggagucaaugaugauuuaggaugguggaggacuccaaguagcugagggaagucacgaggucagcugugaguagucugacggagucagugucccaauggggacacuaugggaaaaccuuggcuuugacuguugaacuucauuaagaaaccacgucagguuacaggccuaaauugauugccaucucuguccucaauucacccuuagguuuccacaccguaaggaaguucuuaaaagucaucuccucagucaguauucucuacguaagcuuaaguggagcaggccuuaggcuugggagugaucgggccuuuagguucaugaacuaagacuugggggaagaaaacaaaugagcaaaauaggcucugugaagacccugauuuugacauuaggagacuugaccacauuggccaauggacccaucugaguggcaggcgcugcucccugaaccagcuuccucugcuuucaaauuggugcccaccugggccaccuguucugauuccucagugggauaucaauuacuguggguacgccguaaucauuaucacuggucccugcagaaggucuguccucgaacucaguguggggacacucaggagaggaccugagggauccgagccuucuguguuggggccagcuuuggcugagcaagugugugucucagaaacuuccacuccuucaucgucuaauaaucacuuugaauuaacuucugugacuaugaaugaggucaggugacccaggcuuuaaacccgucugguccccaaauuguuuucuuauucacaacgacuaggguauaauuucuagaggagggauguuugaucucaagcaagguaccugugcucagugggacucgggagagccugcuugaagacuguaaaguaguuuaauagagauaaaaggggcaguguaagaggcggggcagguuuaaagauccaugcuaccaagccaggcagugggacaaaucuggaaucccaguacuuagaaggcugaggcaagauugcugguucaaggacagccuggcuuagguagugagccccugccucaaagcagaaaaaccaaaccuaaaaaauaagcuaaagaucuaagucaaaggaguguguacuucaucagaucccaugagcugcaccaggaggaugcuggaccucaaggggguccagauuaagaagucauaggaacugcuacacucaggcccccagaaccccagguaguggcccaggacagagaggaaaggaaaucgggcugccaccagaagaaaggggcccgaaaucaagugacaacacaagucacugaaaaccucugagggucaaacuguuugaacacagccaccuguaccugauacauuguauauuccuagaagaccugcagguuuuuuucucauaauuauuuaaaucuggccuguauuacaggcauucauugguuauaccccacugacguuguuagucaccuuuuaggaagucugaccuacaggaagcugugcacaggucagauauucauggguacuguuauacacaguauaacagcucggugccuagaccuauagaacauucaaagacuucucuguucucucaugugccuguuuaucacaugugccuuuguugauuauuauuuauuuauuuauuuauuuauuuauauaauuuuguuuuuuugagacaggguuucucuguguagcccuggcaguucuggaacucacucuguagaccaggcuggccucaaacucagaaauccaccugccucugccucccaagugcugggauuaaaggcguucgccaccacugccuggcuuuauuuucuauucuuauuguaaaucuacaaaguaugagacacagggggcucacagcuguaaucccuguaauccgaguucucagaaggcagaggcaggagagucacugaaaguuugaggacagucuggucuauauagugaguucuaggccagccagaaccaccuaggaggacccuguuuaaaaacaaagacaagaaagaaaaaaacaaaacaaaacaaaaauuaaaaaaaaaaaaagaaauaaaaacaaagacaaaaccaaucccaaacuagagagaauuuaagaggaguuaagacaagguauucaggcuucugccccuggcuuguuugucaucuuaccggaggcugcauggcaauuccuucacagucuaaaggaugucacucagaaguuuauaacugagugccuaaagcaaguacaguuagcaaacuucacagaugggcggcuggacaaaacaaaauaaaacaaaacaaaaacaauaaaaccccagaauccccagaucaaagggccuauggggggaguggucguggcccagcugccuggggccuucuaaccuguuugcgucaacagacucuuagacaacauuuuguuaacuacauaucuaaugaaagauuuucuagauagcuguaacgguccaugccugauaucuuagcacuugggaggcgaaggcaggagcauuguccccaguugggggccagagugggcuacagagucaaauccuaucucaaacaaaauaaaaagcuccaucaaauuagaguauuauuuuaucucgaugacugaguguuuugauacaucuugcauuucacaccuucauugagucuuuguaggccugucuacuaagccacacccacccccuucuuuagacccagucucacacugcagccugaaacucagcaucaacucagucuccuacuucccucagccucccaagcgccaggaucauaggccugagccgucaaacccacccagcccaagcacucugagagauuacaaaucacugugucucuaaauugacacaguaauuuauagguugcagauguuuaaugauuuguuccuaucuaucaccccagaugcuuaucauuucuuugugucaggagcaaugaaagcaccuuuucaacuagcuacuuagaaagaauuguuagugucaacaacuguuaccuauuauacucuccauccagcucuuucuaagagguuucucauuuuagggaacuuauuugaacuaagcugaaauauguauagaaacaggagugaacuccaaacuuacuguguuggccccaauucauuuccucaucucugcaccccucucccucucccccucucccccucuacucccccucccccucccucuaucccucucccaccccaaccccccaauugaggcucaaauuuuuaaaagaaacuuuuagagucagucuugcuacuauguagaccagcccgcccucagacuugucagugauccuccugccucagccacuggagugcuaggguuacaaacaugugccauuauaccuagcuguggccucaaauuuuaagauaaauuuacaacugaauuacaguuggaaucagaggcaccaguauacaaauugaaaccaaaucaaaccugggagcugaauugaaaacauuucaggaucaagcuauaauugaggaaacagcucauuugucuauuugccuguuugacuauuauguccuccugauucuggaaggaaaaaaaaguggaaacuauagauuuugauguuuuccugggucucguccccuuucaucaucuuggcucuaaguuguaguuuuuuuguggcuuagcaucagcagccuauguaaauaaguacuuuauuagaaauguuauauugaaaaaauguaacaaguacugaguggagggaaugacuuuguuuguuaaacucuuaucuauuuucaaauaauuuuguuuguuuguuuguuuguuuguuuagggagcuccggaacaaggcaaauauucaguuuggagaaaauggaacaacuauaucugcugucaccaauaaggcauauguuuuugaacgaaaccaaucuguuggagauccuaacguugacuugauuagaacaauaaauauuccucuguugguacgugucauuaucaaggguuuguggaaggaaacagcaagccugauacacuuaauagcuauuauuuuaugauaguaaaguaagagcuaaauaauuuaagagcuauuuuauaauaaaauauagauauuauggggagggagggaauucaucuugcuuagaaugagucucugaaauuuaauccuagcaccaucagaaaacaaacacaaaauauagauaugcacagagacuuugauuugugugugugcccuccagggaacuuuaucaucuacauaaaccuccucugaggcuuccacucuaaagugacagcugcuuaacacugauggaggacccaggaccuuaaagaguucacaucugaaucugaacuuugccuugccuugcugcuaaagguccagccgccacuuugcuccaggggcaauggagccaccuuguggccaaaggucccugugugucuguaagaucucugcgacgcuggcaucauucagagccuccuaaagggaagguuaaauccacaucuacaauaagauguaauacgagccugcccuggugguucaggccugugauaccagcuacuuucuauggcaaaaacgggaagaucaaaaagcccagauugggcuccagagugaguucaagguuagccugggcaacuuagugaggcccugucucaaaauuuacaaaaaggggccuggagcuuaggauagagaucaguaguagaguauuugucuauuaugugcaagaccacaaagucuaagcagacagacagacagacagacagacagacacacacacacacacacacacacacacacacacagaguaauaggagaaagugcaguagcugaacucuuacuccauauaaagacaggaaggucacugguuggauuuucuguuuagucucaaacauuuacaucucaguuucuggcccuucuguuaagggacagaaagagagccaauggguguucuuagggacacugguuaaccugccucugcucugcagacugucguggaucuggcccagcugacccugcucagggagcuuaucgaagccaugcugaaagccuaucagcagaaguuguuugugauucacaccgugcacgaacugcucuggggcuacaaagaugagaucuugucccucguccauauuuucaaaccugacgucuccccgaauuucggccuguucuaugagguaaguuuccuuccuagaacaugucuccagcacacagcggggaagaagagggcacacaagccagaaugcaucuuaagucugccucucuuccaggcgaagaccaaaauugccuggaguucuaaauauuuuuacaaagccuguagaaaaauaagaccguggcuuuggagggggagggaaugaaacugucguaaauugaauagugggugacagauaaaacuaaccucgggaguggagcgcugagguggggugaggcaguaugcucacauccugccuauaccugaccaaggucucgcucucaggguaugacauuauagcaguucacuuccucucugggagagggcaagccuuaaggguuuacaaaacuuagugguuguccagacacaauuauaaacaaguuucaaauauuacuucugugagagaauggguccugaaaguugagucucucgccaacgucguuugauucuggaagagcauccugagugcacagucccuagaauguccuggcucauggggcucggcucucgaagguuaaaguaucacagcaugucagacacauuuggguauuuuaaugcuucuauuugaucauuuuuuuuugaaucgcgaugcucacuucuuuccagagaaauggaacgaaugacggggaguacguguuucugacuggagaggacaauuaccuuaacuuuucaaaaaucguggaguggaauggaaaaacguaaguccaguaaggguuccugguguaaggguuuucaaguuuauaguuaaacaaaauaagccuuuuuuuuuucuuccuaauuugauacuggggcuguugcuuacuggcagagcgccugccuaccauacagacagcucuagauuugauuccagcaauggaaaauaaguugacauuugucuuuugaauaaaaaagucaguauucuuaaaauuauuacuuuaccaauuaaagugaggguaaaaaaccuuugagaauaaguaguaaagauuuguaugccuaccauggccacgagugaauuagagccacggaguagccucgcugguuuuccuuggucgaaugaugugcagcagccgaaguucaaacacugucaaaccaguauuugauuggagggagggagagagggcccaccuggcuuuucacuucauggguguggcuuguucauguuauucuuuauaaagaugaaauucauuugcguucaguauuauaauauuucaaauugaagacuuuuaucaccuaauuuuugucuuauacacaaaacacuucuagccuuuuaauaauaauaagauggcuuagucuuuuauauucauagugaauuauggguaaaugugugauauauuauuuaacauguuugaacuuauuuuuagaugcuuuucuaggcuuagguuuuuauuguacaugcuuuucauuuuuccuucaguaauuuuaccuguuucuucauacucacauccuugcaccuugauuuacuuuugagacaaugucucacuauguaucccuccccuccccuccccuccccuccucucuucucuucucuucucuucucuucucuucucuucucuuuuuucuucccucccucccucccucucucucucucucucucucucucucucuuucuuucuuucuuucuuucuuucuuucuuuccuuccuuugguagcucuggucuuuaaacucaguccuugugugugcuaacgccucaaccucugaggcauauccacagccccuuugguuuguuuuggguugagucaagcucucgcuuuggaucccagucuggccaggagcucuggcucucucugccuggccccacagacgcuggaauugcagcuuugagccagcacaguggccguccuuugcccuuuagccuuugccuuccuuugaucugcugcguccagauuuggauucacaucacaauucuguuuggcccuggggugcacuucuaaccuaaggcuuccagucugagaucugggaaaacugucagcaacuaucuauucacuuuacuggcauuuaccugagucuggcuacaggugguugggguuuaggccaagugauuccagguucuugguaucuuauucaaagcacugaaauaagcaccuggagauuugcacgauagcauggagacucuucaaaguguaauggcagugcggaucagcagagugaaaaugguguucucgagacccagcaggccauaugcauggggcccucaaaagcuccgauuauugucugggacuuucucuuuuaauguucaagggagacguaugauugcuaagggucauaguguaugugguuuguuuguuuuuaucuuuuuuuuuaauauuuuauuuaauuuaaguaugugaguacacugucaugucuucagucacaccagaagaggccaucagaucccauuucagaugguugugagccaccaugugguuccugggauuugaacuuaggaccucuggaagagcagccagugcucuuaaccacugagccaucucuccaggccccuuguucuuguuuuuguuuuuguuuuuaucuugauugacagauugauaaauggcguuucuucucucaugucccauccagaaugaauaugauuguaaugaugugcaaggccaacucuuagguauaagauagugcagccugaugcaagggagagguccuagguugcacacagguggccuggugcauugaauggagaagaguuggguguggucacgccaaguccaguuugcuaagcacgugcacaagcuugccugccucagucucaucucccugccuccuagcccccgaguuccucuaaacauuuauuggagccucuucgucuagucugugucuuaauuaauuuuucauuuuuugaucuuguauuuauguaaauuccauacaacuaucuucuaauucaugaguuuucucuucagcuaugaugucugcaguuuuauuccuguuaauuuuuccccaaaaaacauuuuuuuacauccaaguuuucuguuuuucuaauugucuuaauuuucaucuuuuucuuucuuuuaauaccauaccacguaccuucaguuuuguuuuugguuuuguaaaaugguaugggagauaaaacucaaccucaugcaugccaaccaaggguauacacuaagcuuccuuaucaggcuccauuacuauguaaaaaaagggcuuauuuguuuuauuuugacuaucuuaucuuugcaugugugccuguguacuacacgugguucugauggcccaugagaacagaaggaauuagauucucuggaauuggagguacagaggguugugagccaacauguggaugcugggacccuaacccagacucugugcaagagcaucaaguguuccuaaccucugagccaccucucuagacuggcuuccaucucucuuuggccuggucuccaccucuggccuggccuccgucucccugaccugccguccgucucccuggcuuggucucugucacucuuggccuggccuccauuauuuuuaagaauguuacuguuuuacuuugcaauacuaaacacacacauuuauggcauuagccuguucuguucuucuaguuucuucuaaagugaauuaacuuccuugaugacuuuauuuucuguauuguacuauaggcuucaauuaaaaaaugauuuucacaagcuaggggugugugugugugugugugugugagagagaguguauguggucugucugcuugccugucugucucucuccccaucccucucaaugucccagccagccuccaccuaguucaaaaccugagcccagagugggccucccaccaugccaucagggggcauccacacacaguauggcucaagcuccacugugaggcuauuucugagucgccagcuuuggacaacacuaaaauacacaccacggguagaagcugcuuucuuuggccucuuuggaugagcagggaaucucugcuccuuagacccugacucaagcccgaguggcacauucuccauccuugcuaacuuaggaacugaacucggguuccuccccugggcuccggcaugcagaagagcaucauuucagcucugcuuaacacuguguacucagcagcgugugguccaggcagaugcucauuuguguuuugaaugugguauggacuguuuggauguuucccuuucguguuuuaucagccuugauuuccuguuuucacuuggcagaccccccucagugcaggaaccuagaguaccaucugcggcugaggcugggagaauuucuauuuaucuuuuuccuucuucuuccuuuggcauugguacuguuuucaucuguuccaaguguucuaacaaguuaucauaaacugcaugacuuauaaaaggcagaaacguauucuucccaguucugcaugcugagcaguccaagacgaacacuccagcagcucuaaacgcuggcagcagcguggcuccuuacaggggcugcuuucuugcucuaacuucacacacgugguggaaggccugugccagccccuggggucuccucuaaggucacuagucuuaugucagagcaacccuuccugaccugaucgccugacaggcaggauuucaauaugaacaccuggagggaucauaccuggauaguccacuacauguaccauuguuaaagcaugcuaacuugucuaguugucuuagucaggguuucuauuccuggacaaaacaucaugaccaagaagcaagcuggggaggaaaggguuuauucagcuuacaccuccaaaccacuguuuaucacuaaaggaagucaggacuggaacucaagcaggucagaaagcaggagcugaugcagaggccauggaaggauguuacuggcuugcuuccccuggcuugcucagccugcucucuuauagaacccaagacuaccagcccagagauacuaccacccacaagagacucucccccuuuaaucacuaauuaauaaaaugccuuacaacuagaucucauggaggcauuuccucaacugaaacucuuuucucugugcuaacuccagcuugggucaaguugacacucaaaaccagccaguacacuaguccacuacauguuaaagcaugcugucucaacugugcugcuuucagugacagcaacacaguguugguaucuccuguuguccugggcaagucugcuauuuuuggaagggagaacuacucagagagcaguuaauggucuuccaugaauauuaaggaaugggauauaucuaacccacauccccucuguccccagccuagcuauaagcacggcugcuauuaacgucuacuuggguuacugcuuaaaguaaaucaguaucucugucucuguuguuguuguugaugcauuugcauaugauguaggauguagaggcaagugugucgcacugugcacagaggucagaggacaacgcuguggccgugguuuuucuccugagccuuugcauagguuccagagacugaacucuggcugugaguuuucccuggccguugucuugcuggcccuuaaaccacuauuucuaaacaccugugcaggguggacucuucuggaagacggaaacaggaauuugugacuauuaucaaaagugauuuuggggcuggagagauggcucagcaguuaggaacacugacuguucuuccagagguccugaguucaauucccagcaaccacaugguggaucacaaccauauguaaagggaucagaugccaucuucuagugugucugaauacagcuauaauguacuuauaugcauaaaauaaauaaauaauuuuaaaagaguucuuuaaaagaaagaaagcgauuuugguuuggagccuacuuuuucuuucucuguuauaguuccuaccucuucugugccuacgugugagugacauacugcuguagccagccccacuuauacugaccuguuagagagccuacaguccagcuggaucaucuaucuguauucuuuccuguacuauaggucgcuggacugguggaccacagacacaugcaauaugauuaacgggacagacggagacucuuuucauccgcugauaagcaaggaugagguccuguaccucuucccgucagacuugugcagguaccaacuuguagcauagcucuuggacugagagacaggguaaggaauauaagcagaggcacucacaaugcacgagaauuuacaaguccugguacaggugcuggaggcccacugagagaugacaccguguaaggguucacagcacagaugccagaagguagcucugcugguuucgaucuuaacucuccuugcagcuguguugcccugggcaaguuauugaccccgucugccuggcuugcuuuuauauauauauauauauauauauacauauauauauauauauguaugagacagggacuccggugucucgggcaggcuucagacuugccagagucuggaugcaguugaggaugaccuugaaccccuucuccuaccuauaccucccuacugcuacaaucacagaugugagcugcuuauacagggcugggaucugaacccaggccuucacaggcacugggcaagcauguuuuccacuaagccacaucccuacucugacuuucuauccuucccuccuccucucaggucaguacauaucacuuucagcagcuuugagaacguagaaggacugccugcuuuucgguauaaggugccugcagaaauacuagccaacaccuccgaaaacgcuggcuucuguauacccgagggaaacugcauggacucagggguguugaacaucagcaucugcaagaaugguaagaacuucuagggagguuacgguucuguaacgguaccuagaaugcagacaggucugaggcgggaaaccagauuugucaccaaccuaguauauagcgcaauuccagccuuucaggaauacuguuuugucaucugccugccugcaaucucagcacccagauggcaggaagauagaagggucaaggucagcucgggcuacacagcuauccccugugucagacgaugaugaugcuauuuugucacagauauagcaaacaauuaaaacauuacuaguuuugguagcacaugcuuuggcuaaaauucucaaugauuuugaaucagauuuagucuuauacucuuaucaugaguuucccgguggguuuuuuuuuuuaauuauuucuuuauuuaauguauaugaguauacacuaauguguaucaggcacacuagaagagggcaucggaucucauuacagaugguugugagccaccaugugguugcugggaauugaacucaggaccucuggaagaacagucagugcucuuaaccacugagccaucucuccagcccgguuuuuuguuuguuuguuuguuuguuuguuuguuuaauuugaauuuguuguucuugguguauaacgggugagcaugcaugccauggcccauguguggcaaugagagggccauggcaugcaugcucaguggauucaagucuuuucucccaccuuuaugugggguccugagagcuaccccgggucuucaggcuugggugcuuacccucugagcauccugcucucccucucaguucccugguuccucugcucuccuuuccuuuccaugaaugagagagaauaaucaaugcuacaggcugacaaaaggugucgucuucaucaugaaggugaguuucaacagucaggugucaccgcagaauugcucacaguggccuugccugacggugcgcagugcccucuuucacuucuguuuuuugcucuugguuucguuugcuuugaggaagggucuuguugauuaguagcucaggcuggcaucaaacucucaucccuggagucuuagccuccugguccugggaugaugugcauagcuuaguagcccugucuugucaccaugggaacagagcaaagagaaaggguguguuuuuaugaaacuucucuaagauuuucuuugcuaguaccacuuuuguuuuguuucuuuugagacauugucuuacuauguaggucuggguaucuuguaacucaccauguaggccaggcuuacccuagcauuucuaauauuugugcuauaccccuacuuagucagaauaggauuccucuuuaaaacguguagggugguggugguuuugagauguuuucauuauguacuuugaggcuggccucaaacucauucacuauguagcccaggauauccuuuuuuuuuuuucaggauuuaucuauuuuuuauguauaugaguacacugcagcugucuucagacacacaccagaagagggcauugcaucccauugcagaugauugugagccaccaugugguugcugggaauugaacucaggaccucuggaagagcagucagugcucuuaacugcugagccaucucuccagcccccgcccaggauagccuuaaacucaccgugauccuccugccucagccucccucagugcugggauuaccaccccuggccuucuuuaagguuccuuugaagagcugcauggcagcccucucuccugaaugacagugcuccuuucucaaaaaaacaaaaccaaaaacaaacaaacaaacaaaaaaaacccaaagugaugcaguuucgugguucuccugucugguuggcauuaaaaucuucuuugggauaagccugagauggcaguacauacccccuguccauuucacagcagcccacaaaccuuacaucaguuuuuuaagacacuagauauauguaugcagcccauaaguuuaagccuugaaaagagaagcaggaggaagucuaugaguucuaguccagccuggucuauggagugaguaucuuccaggccagccugagcugcagaauaagacccccaugucucaaacaaacagcaaaaccucaaacaaaacaacagcagugaaaaugucauuccaugagagagagcuaccauuuaaguaguacucugagacaagaccuucuugcuaagguggaacguuuccucugaagccugcgagauaugagccccugggaaauacucgugguguuugggaaucucagcuucuucaaaugcaaaaugaggacuagguuuuuagucuuagaguauccugggauaucauuuaacauagauauauagguaacacgucuacuuguagguucaguagcuaucuaaguauaaauguggccgugacguugguauaagggguggaguaaaauaaugggggauacagcaggugacaggaaacacaguguaaacauuuaacuaggagauuuagagcaguagugagccuggccaugcuuacuaggauauagcuuuucuuuuucuguugugaaccaauuuugcggucaggaccuguguguucuucuuagacuuaaaccagcaccauucucuucuaugucaaccacugcaggugcacccauuaucaugucuuucccacacuuuuaccaagccgacgagaaguucguuucugccauaaaaggcaugcaucccaacaaggaagagcaugagucguuuguggacauuaaucccgugaguacacacuucucacuguguacgugcagguucaccuuagcccaaagcauucguaagggacguaccucccucuguggccauccgaguggguggcaggggaucagugugcacauugugguccguagccuauaaugggaugucugaacucugugggccagaucugcaggaaccagcaagccugcuauaaagaagaaugggaagaaagcaaagacaggacacggauuagggauguggcucagccguagagugcuuaccucgacugcacgaggcccuagguucaauccagcauagcaaaccaaagugaacucaacuguacaaguucagucacgagaccagcugaggcuguacccacauaacugucuggccugcugucggacagugucggauuucaccuucagaauugcggaucgauugcgucuucucugcuuggaauaugcagaucuaagcauaaauauucacuucauuagcuuuuuggcaaacccucgacagguacuugggcaguuucuuauauauuauucauguagaugguaucagauauguauauacuuggcucuugaguucccaaaaaaggauguuacggugauaggggaucccuaucaaugcaagagucucucuuguagagacuggcauguagaaauaaaacugaaagcucaaagaucucacugagccuggcagcacagaccugugauucccagcuacccaggaacguugaggccggaggaucacaaguucaaggccagccuggguuacaguaugcuucuugugugcuaggcaagcacugugccagcuaggcugcagccccugcccucagguguaacuauguuccuucucucuuagccaucaggcaguucccuuuugucagggcuuguuaccaugggugaagucccguacccucagggcacauaugcccuuccugugucaugccucaugcauucugguaugggaggcccuagacuuggaaaucauucucuagcagggccuucccaucagccacuuagcuccggaaaacugcccagaugucacaucuaacguagaauuuauggcuucugguggaguacuuccaggguuuguucuaccaaguggcaguguccuggggacuuaauagaagugcccugcuucuguguuccacugugauccgcccaucagaaucugcaugcagaauuagcagcagauucccagggaguuacaucuacaaagccccagcuccgccccccugcccccagcacaaugaauaugugugguccugcuguggagaccaguuucccccuuguacacuccaccugucaaacauggccauggguucuugugggucagaaccacacaguuacacucuguugaaaauguggcugcauagauccuaauuuucucucucucucucucucucucucucucucugcaguugacuggaauuauuuugagaggggccaagagauuccagaucaacacuuacguuaggaaacuggaugacuuugugugagugucaccucuuccuacagcagaugcuggguuugccguguaacuuucggguaggccugaauuggagggguagagccuacuuuaagugacaagugguugcuugacuugccuguccccaaugggauguggucucaguguucauggugccucagccuuggccuguaugaggugcugcccaggcaucggguguugcuguuggcacuuuacgucagcuuacagcuuuacauuguucuuuuaauacuugggagaaccgagacaugaaacuuaagugacuugcugggauucacacagucauugaggcuguguggaucugcacuggcuuuuauccagucaccuagcaaugcccuccgccccuugacacugcccuucaucucuuuucuucuuauucccccugcuuccgcucaggcucagccaccacaaguucucauguggacacuagcagcaggcuccaggauccagccuuccucuuccacauuucaaccauaagcaaccccuuaguaagaauuuccuuccccucccaccaaaaaaaugaacccccaaaguauagcuuccugcccacauuugucgaugggauuuuucuuagaucugagaaaauaccuaucaaauauuuaaugaaggacaggauauaaaaccauaugugucuaccucuguguccaucugucugauccaucugucuauccauccauucauccauuuauccaacuaucuaucauaaaccuugauguauuucccccacugaacucuccagauuucauuacaauccugguuucagugcucacucaucgugggcauagugccuggauucuaugaguagguuucccaucuuucugcccuguacauagugguaacuauaacauaugacuguucugagagcugaauaaaacaaagccccuaaaacacugagcacagagaggucaaacaggggucaagugggcccuuguugcagagaugauaugguggccuagaaacuuccugaguggcacuuguguagucugcucugaacagcuuccccuuugauggaucugcguauguauguagcuuaggcuuuguuaaaacaccacagagaugugccggucugcauugcugacugacaguguugccaucuugacuucugauuucuaugucugcgaagauaacuaagaagucuguggccaguucccaguaacugagugaaugaaguguacucuaaucuugguuugaacggaucucuggaggugagagauguuuucaugaggagguccaugaaauaacaccguccuuugucuuuguagugaaacgggagacaucaggacuaugguuuucccagugauguaucucaaugagguaaguccugaaagaggaggaagacacaggauguuuuaacuguccaagcuuggcauacuuccauuaugauguuugcugcuguaguggcguuccauucaaaggugggugugaaugccaguguccagaguccagaagagggcacuuugugggcuucccuauguggcuucucugagcucagugcucuucaagggcagucagugaugcucuugacugcugagccaucucuccagccucaacgaucauguucuaaaauauaagcaugcaagagaggcuuguggaaggggccugugccugggaguugguuuggacauuuuccuucucaggagcagcagcugaauuaaaacucccuucugaggggcuguuucuggggaaacagcugaacucugaaggagaagcacugccaagcuggcccaugaagccucugucuccgaugaggcccagacagcuuagcacacugucugugaaagucacacaucaggggcaaaugagaugucucagcagauaaaggugcuugcugccaaugccggagaacuugaguuuggucuccagaaccacaggguggaugaggaucaacacccccccccucaauuuucuuacuuccgucacgcacgcacaugggcacccaccaccaccacccccuccaccaaacaauagcaacaaacaaacagguaaauagaauguuuuuaaaaugaccuaucaaggucaggaauggugacacaugccuuuaaccuuguuacuagagaggcagcggcaggugggucucugaguuuaaggccaaccagggcuaccuaaugagauccugucuuaaggagaaagaaauaaaggaagggaagagugaacagaaaagaaagagaaagaaagaagggaaacacaggccuggaauugacacuggaaacuacugacaagaggaagcccugacucugacaagccugggacagguacuggaaaaucuuccacagagccugacacucugccacccccaaucuagucagugcaaaccaagcaggaguguucuucacuccuguaggugugugugugugcucuuuuaaugccuacccauuacaccaagugaagaaaccuguucucacacuaagaugcuauucuagaguguuuccuugauuaggaauucucuccgauccuuguuaccuccacaacucaguugagcaauuuuuguugagcccagugaccaucacguggacucaggagagaauugauacuguuuagauaccacuuuuguaguguuucagccauucauuuacucagccaguauuaagcaccugcuguguacugaguacucucccaggugcgaagguggcugagcugucuugcuuucagggaacugacaguuacugaacacaaacaaguaaacuguuaugcugguuucaaggacaaggaacgagguucuagagauagcaacaaaagcuccucuaucaggccugagguagccagagacaauucuagaaugaagaaaugcuaagaugaauuuggagcgacccaucugacgccaggcagaggcucccauaccacuuauuuuugugucgaugcaacagaagcagcuuaaaggagaaagguuuauuauggcucgagauuucagaagggcuucagucugucguggcaaggaggcuauguugaugggagugguuggcacaaggcuggagucacaccucacuggaucuagaggcagugccacaaguuggaggccaccuuggucuacauugugaguuccaggcuagccagggguauagaaugagagccuaucucaauauaaaauccaaacaaaccaacagacaagaaaacaaaaccaguccuacaagaugguacccaacauuuaaaacaggagccuguggggacauuucagacucuaacgguaacauauauuuucucuacauuucuuagcaucuuucucuauuuucagucuaugaugaguuauacuugucuucaagagaaaaucgguugaguaaacaaacgcccucuuuuguuauucuaugugaauucucgguauauaugguuuguuugaaaugagcacacacgcacacacgagauaacuaguccucaagguaaugcuauuucucccccuuccagaguguccucauugacaaagagaccgcaaaucaacugaagucugugauuaacacgacuuugguugucaccaacauacccuacaucauuauggcacuggguguguucuuuggcuugguuuucacguggcuggcgugucgaggacaggggucuauggaugagguaagugcuggguggaggaauugaucuuuuguggauaugucuagcugagggauuccucaauaaucuauugcauggcugccagcuggcuccuuuggauagacuuggggggguggggagcacugauuuucacaguugcagauggacugagugguuuccagggcugguauacauugagaaagucagggugggugauagaauggaauggugccauuugguguuugagggucucuugauggguuuggauacaucccguaggagguaacuucacaucuuugaaaaaaauagugugaaacaagaauagaaaaccuuaauccccuaagcuugggugcuggacugcccggguucaaaucccaguucuaccaauaaacaucuauaugacccuuaaaauggccucaauuucaucaucuguaaaaggaaugauaacagagucucccucaugaguuucuggagaggaucagaugauguagaaagcauagaggauuugacucauuguuucucaagaagcuugguuauuauauguaauaaaaauaauuccaauguuguagagaaaaggggccagagaccacuuguuaagaauucuugguauaagccggggcgggguggcgcauaccuuuaauuccagcauuugggaggcagaggcagauuucugaguucgagaguucgaggccagccuggucuacagagugaguuccaggacagccagggagggcuacacagagaaacccuguaucaaaaaaccaaaaaaagaaaagaaaaaccaaaagaaaaaaaauccuugguauaucuggagguguuaugguugagauucuguaacaauggugaaaggugguugcauaagaaccauuaauuuccaggaggaaugggauaaaccggcucagauuggccucugaagugaccaggagucucauggcuccuguagaagcccuucuguuucuauggaauuagaggcugaggcaagggccugacacaagccaggcacucacucuaccauggagacacaugccucguccuuaaaaacaaaugcauuuugagaugagaucucucugagcugccuagguugaccuugaacuugcucuguggucuagccaggccuugaauuugugaucuucacgcuucagccuucucagugauggauuacagagaccugaaccaccaagccuggcacagacagacacccuugagugcuuggcaguuucugcuuuuacugcacacuucuucccuucaguuauccuuuaaaccaucugagcagugugaagcaggagaugaagcugguugaaaccaaauggguaaccauagcuuggaggaaacccaucuguuauguggcuuucacucaugcucgccagaguuagaaauaaggcaaacugcuuaccauugccacguauggaucugccagucugugucaucagcagaauuuuccuagguaaaagcagaccaccuaauaaugcuaauuagcaccccauaaucaaucuucaugucuuccaaaaguauuggugagcaucuacagccucugagacacugcucccugguagguuacaaaccaggaaggaggcaguuuugguccaggaugcuaagggcuauaguccagaccauacacagagaggagcuugcagaucugguacugggggcuggagaggaaaaguuguccucuaacagggucgaguuagagucuuuuuuguuguuguuguuguuuuuuguuuuguuuuguuuuuuuugugacaggguuucucuguguagcccuggcuguccuggaacucacucuguagaccaggcuggccucaaacucagaaauccaccugccucugccucccaagugcugggauuaaaggcaugcgccaccacgcccggcccggguuagagucuuaaagagcaaugacagccaagaggaagagaaaagugggggaacugccuccccaucagcuucucuuuucaccucugccaccucgccucaacccuucacaucaggacagaaguuccugacaugaacguuuaaccucucugugucuucucugucugucucagggaacugcagaugaaagagcaccccucauacgaaccuaaugggacuuaccuguugccugagcuuggugagagaaugugagagcugcccugaccuggaccaggacagggggaacccugcauccucaugggcuccuggccugucaagaaggaaacauagcacuggcaagcgagaagccccuccuggucagagggaaaugagcagggugacauggcuggcaauucugcuuuauaaaaucgugucucuaaaacuguguucaugugucuaggaaguauuuaauaaacuuguguagaaacuuuuugugguugggcccugggagcugaggggacuucgugacccccuguuguagauacaaugucugaaucgcuuguuaauguuccguggccugacccgauucagugugcuucauucuccaaacuuuguguucagaguacguauguguuucuguuguuguucccuguucaccuccuuacacagaaagaugugguacccaggguagaaucacagcuccauacaguguaccaagcaaauggggcugcuuuccuucuguaaaacauuacauuuugugucucgcucuaaucuucaggaaaauaacucaagucuuuugauugguuuauaguguguuaggaaucaaguaggggaagggaugggguggggugggguggugucuguaaguagacagcauugagcuccugaggauuuuuaguugugcuuuugugaagcaagagguugcacugggaauguuggugaggguaaggcagauauuucauuuagaauagaguucaauguuaguuauggcaucuagaggcuaacugucaauuuuagucagagaugucuggguguagaauaugcugcugagaggacagaaucaaugacuucuaacccccucccuucaggcuucucugccacauaggacagugacacggaaugacagugucugcaaauauugagggguuauuuguaaaaugacgaaugauggaaguccaucugcccguagcuuacauuacagauagauccaggaagugugcacagguuagagaggcauuucuucuggacccagccggugcuucguggcucccugucacuaagugcucucugcuuccugugacaaucacuuuucugacagagcgagaaauguuagacugcuagucagaggcacuucagauaaggagucgagcagccaggcugcuucucuuuggaaggcaauggcuuccguguaggacuaaggacauuagugucacagccgucagaccucagcuauccuggagggcagaguccaugauucucagaguccacuauuuugggguuguuuguuuguuuuaguuuuuauuuuuuuauuuuuuaucuuuugguggcuuaguuuuuaagacaggguuucucuguguagcccuggcugucauggaacucgcucuauagaccagacuggccucgaauucacagagaucugacagccucugccuccuaagugcugggauuaaaggcuuacaccauugauuuuuuuuuuuucaaugaacccuauacauuaucuggcuagcuguuuauagaauucccugaaaacugaauuucaguauauuuaaauuuuuuuaaaaacugagaugucacauacauauuagaaguaaaacauugcuuuaauauacaggcccaaauuuuccucuauugacacaaagcaauacacaauguuucccuuuuuuaaaaaaauuuugguaguuuuugagaccggguugguguagucuuggcuguucuggaagucacuauguaaacuaggcuggccuugaacucagagaucgccugccuugugucaugagugcugggauccauaagccaccaugcuuggcugauguuucccuucuagagagacagcucuuuaaauuuucaccuuuccuacuaaucaaaguaaaaaaauuagacaccccaaaucaccaauaugugaaacuaaacugaaaauaucugaccuuuaguaaugacaaauauuuuuagacuuugucaauauuuaacucgguaguuggcacaucuuagucuucaugcuucaugacagggucucacucuguagcucaggcuaucuugaaacucacuauguagcauagguugaccuugaauuuauagugagccggucucagccucccaagugcugcuauuacaggcacgcacuacaccugucuguguuuaugcaacuacuuauccacacuaauaaauugauaagcuagugcauacuaauugguucauuccuauuuucaggauauaaucaucucuaaggagauuuuuaaacacagaaacuauagcauuuagugauguacauaguagauagacaugaucgcacauagaaaaggagaccaaaaacagauugauccuuuauuagugccaugguugugaauagcagugguucauuugguguuuucuuucuaaaagguccauggcaaacccacaaggcacagucagaauuguagguugauuaacaacaaaucuacccauucagugcggggcugaaaauagcaagcuguucccuguguucguucuucugagggcauucuccuggacgggccccaaaggcuguggccaucauccuucucaugacacagaguggcagggcacugggagugcacagggugggggaugggcaggggauaggcauuuccacauaggcucuaggcucugcccaguagauuucacuuccuugugcuuuacaaagaucacuaacggucaaaugggacaagcacuacacaacuaaccccuauugggguuuuugcuuaagggggauaacuuuuaacuuguuguuugcggugugaauucuucaaaaggcccucugagcauuguuacugguguaaauugcuugugccugccuggcuuuaaaaagacugaccagaaugcucuucauguggcuuacagaguugguucguuguugugcuucuugaccugguuuuauuucuacccauaauacaaugaaauguuucacuaauuaaagaaaguuucuauaaaguuucacugu

SEQ ID NO: 2532 - RNA, 2035 nt, Mus musculus
ucaauuuuaagacagagcuucuuuugugugcuucuauuuugcuuguuuucuuuccucuuuugagacaaggucucccucuaugguacaggcugccuccagugucacgauuauuugaguguuuuccauccuggugggcugacuccuuaaugauaaggacacuggccuggccaagaaaaugucaguucagaucuuccccugcagauggcauuagugacugaugagccucucagcuguugaacacgacugaaaucuaucccaagcugguaaagacuaacuucucaagguugcucccaguccgcugauuaagcacaacagggauauuuaaggcaggucuacaucugagauaugucagaauuuggggacaugccaguuugccucaaggacuacucucuccccacggcuuugcugaacuuguagguauuacuuugcacccagcuucccuacuugccuuuucccauuaacgaaaucacaccccaccccccacaucccaacuccaguuccucuuacaaccuguacagcacuucuuucugcuucauaauagggcugccgcguguuugugugucuguaugugugugccagucacggaacuaacccuuauucaacugaugaugacaaaauagacaacaaacaccugcucuacuugacuugcuucucuguuaacgcccuuuaucaggacacagagccuuucaaaaucugaucuccgagggcuuggcaccacaaacccuacagcauaaggccuagacuacucaacaguuaacucccuugccuucagucugcggaggcaaacgccuccuccucacuuucuugaggacacacucugacuuauuccugaagacccaguucaacccaacaaggcucugcagguacaaaucaggcacaagucagcaggcaccuuguaaaagcauuaguuacauuguacuuaaaucuuccaaggaacucgggagauccucuggaguaagggaaaccgcgcguccagccgggguuccccaugcuuggcccaccgugggcccucagcagagaucugaaggagaaagaaagcggcagagcgaauggggaagggcgauuucaguucccuggaugaccgcgccgccugcagggagaggaugcaggcgcaaccccgccgaaucgcaggggccgcugcagggcacaugacugaaggccuccgcccggccccucccgcuucccggcgcagucgccagccgucaccaucaccgccgccgcggcuugcuggcgagccccaccagcccgcgucaccgcucugcgcgcucccugcaccucccuggcugcagcagccggagaaaacgaaagccaggcggccccggcacucgcgaucgcaccggcucugcugcucauuccgguaucuacuccagggcugugcgcacugcgcgggcagcggcugaacacgcacggagaaggugcgggagccgcaggggccccgggcuuugggcggcugcugcucggccuuggcggaggcuuguuccagcucgccguucggucccaggccuggccggugagcugcgcgcaguaugggcagaugcugcuucuacacggcggggacgcugucucugcugcugcuggugaccagcgucacgcugcuaguggcucgagucuuucagaaggcgguagaccagacgaucgagaaggugaggcaggcuaguguguguguguguguguguguguguguguguguguggugucuuucuaggccacccucccauugcggacccuguguggggagaguugcguuggcgccgagccugcagaacacagcucuuguuugccuccccggguuggcaggauguggagacuugaggugacucuuccuuuuaaauaaccuguaagucuacagaucucgacuuuguagaaaagccuugcguuuccguucuauccuuagcaauucuccacaccccucuacgcacccggucuauguugagcccuguuucccucgcacuugacaaagaaauagaaaugcguaaaagcaccgcagaagaggcuggcuuuguaggcuugcccgcgcagccuuugaaacggagug

SEQ ID NO: 2533 - RNA, 67320 nt, Mus musculus
ucucccuaaguuccucgccgccaaccgucagaccgggcuugcgcuccgcagaagcagggagcucgaggccucgagguggccggucgggugccgugguaagguagcugcgcggggucgcggucucgggugcagugagagccgacagggucucgcaggugcggccgcggcccccgcggacaugcggccggucucuuagggcuagguguuguuagcagguaugcggacggagugcgccucgggguacagggaagggucguucuccuugaggaccuggaucgacuccuguuccuucuggaacuuuccauggccuuauggucacacguggaagcagcccaaucacuuuguacagcuguuuuccacuuuguacacugucccuguucuccaggggcaguggcgggaaaccugggucuucgugacugcagagucacuugcagaauucuuugaguccaacaggacugcucccugcucacuuuuguuccggccuggcuccugggaaucucuggaagagaugggaaacuguggggacagacaguggagucucgggcugucaccaguauuucgucccacaugagacugugugacuguagccucuugauaauccacuucagguccuagacuuuccaccucagcaacagccuccuuucccacaacacuugcagaaguccccaauugagcgguccuaggcauugcuccuguuaaaugucagguuggcuuuaaggucacgggaaugcagaaaacaaguaaguggugugggcuguuccucgguguguuuuggcugauaacuacauaagaaaaaaagguccagaguguugaaucuucccagagggugaguuagacagggcugcuaauguguguauaccuauggucuaugggagugggaaaguugaggcagagaucugaaaugccaaccucugugccacguuuuucauuuuuuuaaagauguauuuuuauuuuauguuaauuuaguauuuugccugccuguguguaagggcaccaugugggugccugaugccugugguggcuagaagggguugugggauucccuggaacuggacuuacagaagguuuugagcagccaugcaggugcugggaccuggacacuggcagcaagugcucuaaggccuagccaucauuccagucccauauuuuaaauuuuaauacaguuaucuauucauuuuaguugagugugaacuacauuuagaggcuguuuacccucuaaauguaguuguuaaagauuuauuugauguaucuacaaggccuuugcuugcuguuuuaguuucgggggugacucuguucuucuguauuagagugauccacuuuaaaacucuagaaucuaaagcuggugugguggugcacaccuugaauucuagcacucaggaggcagaggcaggcagaucucugugaggucuccauagagagcuccaggccagccagggcuauguagagagacccugacuuaaaauacaaaaacaaacaaaccuauagcauccauuuaaaagggccuuuuucgaaaccaccuauccccagagggcaugggguuaacuguauggccuuacaagccaaauacuggccaccuaaaaaguuagcucuuaaucucuggagccuggaagugucuuugagaaagguuuugcauaugugacuuaaaucaagaauuuguuuuuaaauuuuggauuuauuuuuguguaugaguguuuugccugcauguauguauguauguaugccauguuaguguuuguugcucacagaggucagaaaagggcaucagauuuccuggaacuguaguuacugauggugguauauauacuaucaugugggugcugggaaccaaacccagauccucugcaagagcaaugcgugcucuuaacuauggaaucaucucuagccucaaugccaacaucuuggaagggagggaucaucuuaaauuauguuuguccucaauguaaacucucggaucauagagaagcagaaggagguggggaagaagauaagacuacaaaggcagagacuaauguggcuaaaucuaggacauauguagagaugauaaguacaaugaaaugcauuaaaauuuauccaggacaacuuaaacagauccauccuccuuugcauuugccuguaacuagaguuagccauaaaaagugucuuuugugaauuuucuguaggaaaucaugggauguuggaaauuuuagagauguacuggucaaaugcuuugcccaggcaaaggcauccaguagccauugucauugcagcaaguccucagcuugaacacugcagagaagcccaugauguguacacuugggacuuggguggcagaaagcccacuacucacaugaaaggagagaacugacuccauccaaaaaguuguccucugacuucaacacacaggccaugguacacacaugucucugcugucacaaacacacacaaauaauaaagaaauaaacuuguuauauacaaguauuuccaaaccuuaaauguuaaaaauuuauaaauucaacuuuuggggagcaguaaauuuuagucagugaaguagauuaauaagcaaauuucauuuuucagguguuaauagaagaaacugaaaauaagaauauccagaaauuaagguaucucuuauuuuacuaauuaucgguuaauaguuuugaaaaugugaaucauugaacuugaugaguagcuaaccuggaauaucuaacuauaaaagcaacaagagcucuguaucuguggcuuucagacuggguuucguggggcucuguuuucacggaugaaucucauggacccgagagagguuuugguagcuagggccagaacaguuccuagcuuuggcugguuagaaaagguuugaaaagcucagaggucaucucauuggguguagauggaaacugaagcucagagcuagaaguuguaccugugcucuaaucguauucaacaguaugaagcuuucucgaucuggguuaugugcucugcagcguuagcuuucugccgucugggauguacugaugacauuugaccuaaacagccaacuucuguauuauauuacaguagcccuguguuuauauuuaguuaaaccaggucaauucuacuuuuuuguguguucguggauuuauauaaauguuguaucuucuuuuugaauaaauagaaagauacaaucauuuauuauggagcaguaaguugcuguacacagcccaaauuauaaacauucauucuaauucauguuauuacuaaccuacuagguagugcuguaugcacauauuuugaggcagauccuguauaggagggcuuaugcaugaguuuuuccaguuaaccuuugcucuugugaaguaugcauaccaccuccauaucauaaucuuagagauguccaauguuguugucaagauuacagagguagugcuuccuugaugacagcuucuagggaaaaagaguggaacugaaaucaaaugcacaucagugugauguuacuaagcaguugguaauuaauaaacacuggcaguaagugcuguucacuguuacucuccuuauaccuuuagucugcuuuuaggggaguguacaccaacccugugaaauccccagucuuaaauuucuauggaagauagaaugguccaucauuguaagugugaaucacuaguugauaaaucugggaaccugaacagaccuccuuuuaaguaacauagccaaccaaacuuggacuuaacuguaaaucaucuugcccuagagauguucuaguguaguuggguccaccuuaacaagaguccaccuuaacaagaguccuaaggaaagaaguggagauggagacuguuuauucuaggaaaggaguucaaggaggaggaggaguaaguacucagaggaugucucugagcccuucagcuaggcuguacuaaaaccuacagaugaucuucaaaaggccuuaguauguaggguuccuucugcagcauuccaaccaugacugccuuugccaguuuuaaggcucuuuccagugugaacauauguacaauuuuaaaugaggcagaaguguuaguaauagaccuugggcaaucccagaacaagcuaagaccucaccucuguauuucagucagaucugaaguagauccuuguaggucugggaauguagcucagugacagugacagagagcuucucuuauguguaccaugcuccccaguaccacaaaaauaaagaaauaaaugaaaauaaauuaaaggcaucuaugcuacaaauuucugaaaaaauauauuuguaaguucguuuuaugauccucaaaucauccaagugcagagcccagcaauuuuaugguuuccugaggaaaaagccuucaauuccagaaauccucaaugauuuuacaaacuuagaguauuucaguucuaaugugucaugaggugaaggaacauggaaucucugaucgaaaugaggauauggucauuccaaacuaaugcagacugaaaugcagggagcaguugguuuggggguuuuguuugucuguuuguuuguuuguuuugcucuauaaggacuucauuauucuaaaguucacaaaauacuggcagccgugccaaauagaagugccaagcaucuuuguaaagagcugcugcuggaaaguaaaaguacccaguccuaugcugcugugcuuacucugggugugggaggcugggugguacuggguuuagucagggccuugagccuuccaggcaggcacacgaccaacugagcucacuuuuccauacuuucuuauuagggggagcguggguaugaccuaugcccacaucugugagcuuuacuguagcccacagaaacagucuccauucuggcacaagugccguucaguagaaggcauggagcccgucccaaaccuugcacauccaccuggcugcagugcuggcucugcauggccucggugugcuggccuacaaggcacugucugcuauacuccuagcccucagagaacgguuugugugggccaguuugcauauccuucagugaguugugagugcagucuccucacaacagcugcagggucacaacugcugcuuggcugaaauuuugucaucugcuggucacauugcuguagugucugaaauuacuaggugccuuuuuuauuugcuguuuacaugcaugguaucuugucuuuaauuuuuguuuuaaaauuauuuugucauuaugagggugcuugagaauguuuacuuuggaguuucauggaauaauugucuuuggcuucacuucuguuguuugguggaggagacuugaccagcagaaaagucuuugcacauuaucugaccuuuguguguguucuguauggagauggucugcuuuuguuuguucucuucauuucagagcagggcuguugggcugcacaugcccucuuucuauguagcuuuugugguaauggugggggagggggugggagguguagagggaaaguccaauguccucuguuuuguuccuacuggguccuuaauuuccccucuuccaucguuucuucccuuuagccuaucaucuucagggaaagcuaccucuuuugaaauauucuccucacagugaugcucugaggcugaacuauacucagggcccaagugggcucaguguuuuggcuucuguuguuucacugucucagagugcaguuuucugcacugguuucuguucccuucugcaccuugaagucuuuuccuuugcuucucccauuucuccacagaagugcuucacagcaggcugguggaaacugccucaccauauagggaaaacucuucuauuucuagauauuugaaggcauuuugucuuuagaguacugacaauguggaauacacauaguuuucuugguuucuaucuugauuuuuugcuuguuugaggaaaaauaagaaauuuggaauuaggccaccaucauuauuuuccauacuuaguagcaccuucuugaucaaauauaaaaccauaaauauuauuuaacaucaaauaaguuuuucagcuuuuauuaaugauaucuaauuugcugauuugaggucuuugcuacagagauaauuucuauuauuuaggaccacaauuuuauugaaagaauaacugccccagucagaucacuaguuaucauaauaacuaaaauauuaaucuuuaaauuuuaguuucucuuuaguaacccuuuggaggcugggcaugguggagcacacuuguaaucccaaaacguacacagcaggagcaggcagaucucugugauucaaggcuagcucuguguacauaaaugaauucuaagccagccaaggacaccuuguuuugucuaggugaccuguucagacaaaaguaaugaaaacugcuuuggucuuaaagucaaguuuuacaauaaaauuugacuugcacauuaguuuuauguaacaauaagauauuucuguauucauauuuuucuagaggaaagugucaaaagcauuaacaaagucuguuccuguuucccuauaagcuuuuucaauaagaucuuaacaaagagugaaugcuuuauuucucauagauaagaacugaaugauccuaagaagcgcucacuucucaagaucucuaagaagagguagggaauaguucacauggaaucaaaagcuugugaaucaaaaaacgaagaucuuuuaccaaguggcaucacauccaaaggagguaugcaccuuuucuaaagccaaaacagggcgggagggaugcaaauucaacaaucuucauaauaaccaucuuagcuccuaguuuuuaguaugcuuuguuuuuaacugcaaagcacagaacuuaguugugaaugucuacugugcuguuuauaauucuguuuuugaguuagagauuuccuagcguuguaacugagcauaucuggauuuaguauguuuccauuaucuuuuaucuaaauuguuucugugcugauaccuucauuuuuuucaguuucuugguuaacucagcucaugucagaucaucucucuuuagguauagcaucauuccuauuaacauugaccuccugguggccuaauaaaaucccaggugcccaacgucuuguccucuaaaguuuguuuguuuguuuaagauuugcuuuacuuguacaaguguuuugccugcaguuauguuugugcaucccaugugugcuuggugcccucugaggucaggagaggauaucagaucugguggaucuggaguuacagaugguugugagccaccacuuggguucugggaaccaaagcuggauccucugcaagaauaacaagugcuuuaauuacugagccuucuagccccuucuuaucccuaagcacacaucuuauuagcaaguguuagacuucugugaugagucucuuaccucagcucucuccuguauuguuaugacuauggagcucucaaccaugucaucacugcccaacccuagccuuuucaguucuaaacauugaaaugucuuagauucacacuugcaaauucugauucaguagguccagagugaggcugagguacaacuauauuauuuuaucguuucucaagugauccugauuuacugcaaagcuuggcaacagcuguuagagacucugcuguuacuccuaaacuaccacucuucugugugugugccagugcccgcaugccccuuuaucauucugcauucucacagaaacccagaugcuuauuagucuagcuaauauuuccauuuuuaaaccuuuuuuaaaaagauuuauuuauuuauuauauguacacuguagcugucuucagacacaccagaagagggagucagaucucguuagggaugguugugagccaccaugugguugcugggauuugaacucaggaccuucggaagagcagucgggugcucuuaccugcugagccaucucaccagcccaauaucuccauuuuuguguugagcugcugggagauuuuugcuauggaucucuuaccagucugucacuuaaaagucauggucuccuaccucagcaggguccugaugccacagagaaauauuugccuugaccaggucucuucccagcuucaaaacuauaccauacuaagugagauccacacucaaagaaugacucccaggcucuucacaguucaaauuuccauccucggauguggcagcagcuuuccucuucccagaacaucucagcugucucaagcccacugguguuuacugugaugcuuccacucuugagugucccgucucuccuguucuccagacugcuugguuguuacuccuacaaacuugaaggcaauucaguacagaggucacgugcucacccucuuccccagccugucuccuaugcauucuccuguguucuuggggcucuuaguugugcuuucacuuccuguuuucccaugagaccugugcuccuucaggguuuguuaaaggaaccccaaaauaguguuugccucacaguugucuuaugaauaauuaacaaauucucuaauauuuagguucuucaagcccguuuuuuguaacgucuacucaugguacaauaauugaaaacacaucuucaacugggacuuuaacacaaaugcccuuuuuuccuaaauaugaaguggaacuugauucuccgagaaaguccaccccuuacccuggaaaagagcauauugaacguguuuuggaagaauauucacaucaaguuaaagauuugcagagaagacucaacgaagugaguugcauucuccucuagccccuggcaccggcugucuugaaauagaacuuaucccccugaaagaaaauaucagucauggguccaucagcuaaaccuacauuugaucuuuccuuucuguugggcuaaugagacauuuacauaccauuuucuucuugguaauaauaaugucuuaguuucaugagguaauuuuaguaaaaucugaaugcuucaaaauguuauaauuaaugacacucaucugcuauuaauaauugguucaggccugcuguccugcuauuaugauagcugauuucucuuugcaaacagugauagaaaggaagauuuuacauguauguacauacagaugguuaaauagauuucagaaguauuggcuaaaaauguaaaaggaacucaucuagacucaaacuaugcauuaaguuccaguagcuacuuuguaaaagccagacuucuuacuaccacauauaagaucuucaugcuagccuugcucaguacccauucucugucuguccccucugccccaguagugcuaagccacuugcccauccuggguggaccuuguaaaucuagauugccaugccugucuacuugacuccuggaagauuuuuaucaucuaucagggcucaguucaagcauuucccucucugaagccuuuccuucagguagcauggagggugcucucucuacaguacuguuuguacaucgucuguguucaacagcaugcuauucugccucaucagacuagaugaagacuguagaugagccuacaauuuuauuaaaaaugggaaaaauuaugugccauuuuauuauauacauggcauacaaagauaaauaagccagggcucucucucaaaggaguucauaauuuuggaggcgagccagucauguaagcaaguaguggugagaccuugugauaaaugcaccaacaagacacacggagacagaggaaacagacauaguaguagagagaagaaacaaugauugggcuggcaagauggcucaguguggagaggugcuaaugcacaagccuggcaaccugaauucaaacccuguauccuacaaggugaaaggagaggauggaugccaaagaguugucuucccaaaugcgagggagggagggagggaaggagggagggagggaaggagggaggggcaggcaaccuuaauuuauuuucuaugucuaauuuauuuccgauuaucuccugguagaguaugucacauuugacugguucccaguaaaaucaguaauacuuguaauauuuaccaaacagugcuguuauuauauuccuauguaccagauauguaaagaugggugugacccuccuuuuccucggggaucuucggccaaaaaggacccaugagaggaaaaguaacagagaugaugaugcaugugugcgugcgcgugugcguguguguucuggaagcccugugaguacauacugugaaugauggcaccgugacuagcugcagggaugcagaucaacucaaggcuuauguaauuuuggggauggggaucagacuauacagggugggcaaaggcugagggcuuccaucccgagcugccgcguuagcauggagaagcauuucaggaaccucaggugcuggcugaacagguucuuaaggaagaaaggaaguagaccuguaaucuuaaccaaggcucugucacauucugcagguagagaggugggggugguguugaacuccccagacaagggcagaguaggggaagcgcugccauugaagggauuccucgcucuuuaagcacucaccuuucuuacucucuucucuagcccucuuucucucucucucccuuucccccucucuccauguggccauggccggccucucucuuucuauccucucuccucccugccuuucuacaauaaagcucuagcucuaaaaacauaaaauaaauaaauaaauaaauaaaaaagaagaagggauuccuccauuacucacccagcucagaagacuaucuggaccuuaauuagcagggcuuucccacagaugggaaagacauggucccuuccuugugguaggagagacuacugugagagucguccugcagauggacagauguugauaugaagcuuggcugggacacuugguuucuuuuuuuuuucugacuugacuuggcaacacuugacacaguagcaucucuguccuccgauagauggcaccaggcaucagccuagggccucauguacacuagacaaagacuacugcugacugcuguugcuucccccuucuuccucucugugcccuuuaucaaacaccuccucuccaucugcaaugcugccugccucccuuucucuccuugcucccccuucuuuauucuuccuuaaagagucucacuguguaacccaggcuggcuguaaauuugaacucccccugcuguauccucuuaaccuuugggaauuuaggcauaugccacuguggccagccuuagcauccuagucuuucuguuuuguaauuguuuguuugucuucagguuguuuuugagauaggauuucucuauguaguccugaccugacuguccuuguacucacucgguagaccaggcugaccucaaauucacacugccucugacuccugaaaucaguuucugaauacagaagaaaucugaucaaucuuaguugacuuugaagaagccucaggcaagaaaauaugugaacacgacagcaugucuaccaugucugggauuaaaggcguacacaccaccaacaaccaccuggauccccaacuuaacuuuuccuuuucuuucccuuuccuuccuuuccuccuuccuuccuuuuuaccuuccuuccuuuuuuccucuauggcugucucaaagcuuacucuguagaccaggauggccccaaacucagagaucugccagugugcaccccugccccagcaucccauucuuuaugacugcaaucuucauguguggcaauagagucugcaagcacaugcuccaaucccuacauuaucuuuguuucuuuuaaaucuuucucuuuuuuuauguuugcuuaauuuuagucucuauuuuuguauuuuaggaccuuuucauuuucgaugguuuuuguuuuucauucagacucaaaaaugagguaauaaaaaaagcuacuuauuauacaguggccacuagcuguuguuauacaguggccacuagcuguuauuauacagaggccacuagcuguuauuauacaguggccacuagauguuauuauacagugaccacuagcuguuauuauacacuggccacuagcuguuauuauacacuggccacuagcuguuauuauacacuggccacuagcuguuauuauacacuggccacuagcuguuagcagggagaugcuucagugccuggcuuuagaaaugccugaauuuuucuguaguuaagcaccuucacaguuuuauguuuuaaaaguuuauuuauuugcauuuuauauguauaguuguuugucugcagguuguauguaugaacugugugcaugcaguacucacagagucugaaagagggcaucagauucccuggaauuggaguuauaggugguugucagcugcaguaugagugcugggaaucaaacccugauccucugcaacagcugccagucuucugaacugcagagccaucucccggcuuuagaguuuuagaugguaguggcuuuugccaaacauuuaaguaaguuaaagguaaaauuugacuuuucuugauacauaauuucaaccaguuuuaagagacaaaacauuuucccauuuuuguguugagcuggaagacagauuuguuucucucucucucucacacacacacacacacacacauacauaauauauaaacaaugaauuaacacauaacccuugagaaauuauuguuuauaggaucuauauuuuggugguuuaauaucucucuauauagagcuagauuaauuuguguguguguguguuuuuuuuuucagagcaaugaauuacaugagaaacaaaaauuuuacuuaagacagucagucauugauuugcaaacaaaacuucaagaaaugcaaauggagagagaugccauggcugauaucagguugggguuuauuacugaauuauuccuccuccuccuccuccuccuccuccuccuccuccucuuccuccuccacaagugcuagagcuugagccaggcucugggcuugguaggcaaguguucugucagugagguacagcccagcccagacacuguuuuauggcuuuauuccucacacugguggagucccaaauacuuguaaucucagcauuuggguggcugauguaggaagauugcuaugaguucaaggccagccugguuacguaauugaguucuaggucauccugggaucuauagcaaaauucuguauauuuuuuuuucuacuccuuguaguaaaguuguguuuuaucaauguuauuucuuuucuuucauucauuuccuagacgaagggagagucagucccaggaggagucacgaaaucagcuucagaauacaguucgugaacuugaagcugccaagugccuuaaggaggauauguugaaagacagcagcacacagauagagcagcuacgaaaaaugaugcuuagucaugaaggcgugcuucaagaaauccgaucaaucuuaguugacuuugaagaagccucaggcaagaaaauaugugaacacgacagcaugucuaccaugcacuuccgcagccugggcucagcuauuaguaaaauccuaagagaauuagacacagaaaucucuuuucuuaaagggaggauauuuccaguaaguggugagaacacugguuuauauuacaaugcauugagagauaguuuguaaaauccuugaaaauaagccaagccuucguaucuuguucucuggauaauacacaaugccgccuccugauagaaaacuagcuauuuuaccuguacagcuuagugggaguauagccagugugcaagugcuguaaaauacaggcauagagcuucauuuaguauuauuucuauguauagcucccuaacgcauuccuuucauagaaacugcauuuucuaagcuuuacaauuaccaacacccaaauuaauaucucuauuuuaaaaccagguagaggaucagcuugaaacccugaagucugaaucacagaacaaaauagaacuauuacuucaacaacaucaagaucgguagguguccgacugaaacaaaaacuuauggggauacuguauucuaguuguagccuccccuguaguuccaaagucuauaaacucagagauaacgaaaacaaaaauagccuuaauaaccuguagcaaacuuaguuaguuuucuuccgacaccuguuaaagcuguaaggaagccuuuauuuaagccuggagcacuguaaauuuugcuacaggggaagagaaugaguucaucucccaacacaauaaggacaaguggggauuuccagugagaagaagcugagggcauuggugggucgaacauuacucgcauaggcuugaugaauccuccuaaagguaggccauggaaauagauuuucaagcucaaggguaagcaacuuaaucaccugucaacaauugaccaaauaacaagaaugagacuauucuuacugugguaggccugacagagccuggguagaagagccuaaguugaucuaagagugacuugucacuuaccugcugcuugguuaaaugaagcacguaacacucugugacuuagucaaagaguuguaagcguguauucauaauguguuugauugaugggauccuucucuagaucucccgggagauauagcacauaguauucauaucguguaacaaacacauauugcuuauaguauucaagguuuacaaaacaggaucucacucugucacccaggcuggccaugaauuccuggauuccaaugaucuuccugcuucaccuucucaaguacaggaccagagucacauaccaccaugccuuguuuaguucuccuaguuuauugcuacugaaaugcagauucagaauucugaaacccuagcugggauucuaguguuguuauuaaaggagcagcaugccgggcauggugaugcaugccuuuagucacaacacucgggagacagagccggguggaucuuggccauuuugaggguaccuugguguacacagcaaguuccaggacaaccagagcuacauaauaagagagaucuugucucaaaaagaaacaacgaaagaaagaaagaaagaaagaaagaaagaaagaaagaaagaaaagaaaggaaggaaggaaggaaagagaaggaagaaagagggagagagggagggagggagggagggagggagggagggagagagagagagagagagagagagagagagagagagagagagagaauaauaacaguuuaaaacccaggcauguuaguaaugucuguaaucccaacacugagaagguagaggccagcuaggacuacaaaauuaaaagucagucuuaggguuuuacugcugugaacagacaccaugaccaacgcaacucuuauaaggacaacauuuaauuggggcugacuuacagguucugaaguucaguccauuaucaucaaggugggagcauggcagcguccuggaaaaucuggugcuggaggagcuaagaguuccacuucuuguuccaacggcagcuaagagaagacugacuuccaggaagcuaggaugagggucuuaaagcccaugccuacagugacacaccuacucuaacaaggccacaccuccuaauaguuccacucucugggccaagcaaacaaaccaccacacugucucaaacagaugaaagaguagcauguguaaaacuggaacaaauacuaagucugaagguguugcaagcauuaacuugagauaagucauaggugagaagagcuuccuauauucuaacagucacuuuguucuugcuuaggauugagcagcugaucagugaacaugaaguugagauaacaggacuuacggagaaagccagcagugcucgaagccaagccaacaguguccagagucagcuggaaaucauucaguauguguguacuaguaguuugaaauugauuccauuuauuguaacauaaaagcuauuauuuuaaacuggagauuuggcucagccaucaguagcacuuguugcucuugcagcagaccuggguuugaguuccagaacucaccuggcagcucauuacuguuaucugugauuguagucuugcaaggggaaggggugucccugcagguuuuauugcugauagggaaaugauccaggggagggaagagugaaaguugguucagucuaacuuagguagcuggugcugggccaaaccucaaaggucagaugccgguugguuuauuuuagucaucuauaagcacagcaaaacuuugggaaaaaaauucugauaauuaucucagucccaugaguauagcagagauuaagacauguuuacauugaaauucuuuucaaaguacaaagauggguacuauugauguagagauaguggccaagauuuagggucuggggagaaugacuaaggaaaauacgucugugagugucagcuuuggccuggcccuaagguaacauagcagucacuuaggcuucuguaaaguacaaguggcaucucucauaaggauggguuuugugguccagaagcaaugcucaagauuuaggaggaaaggggcugggauaagcaaaagauaaauucugagggauauggguggagcccgauagcaaaguaucaccagguuggaaaguacacucuucccagcauuccaggcgaacagguaagcauccucuuucuuugaagagacaggccugcagcuauuauucuaguaugcuguccuaauaccuuuuugaaguugcuuaguaauuuccauguaaaagugauaaaacuucuguaacacgcuuuugugucacuauguaugaauccugggauuugcugaguucauauuuaaaaugauaggacaaaguguguguguguguguauauauauacacacauauauguauaauuaugugugcaucuaugaacaaaguuauacauagguauauauguccaaguauauacauaaaauauaugugcauaagaaauuuuauaauuugaacuaaugcaaaaaacuaugcauagcccuuuuauuuuaaaggucuacuguguuuauaugaguauguauaccugugugugcacauacaaggaccuaugugcauguggggaccauaaagagcaucugaguucugagagcuguaguucuagguauuuucagaauguacagcauguuacguaggugcuggggucguaaaucuucuccucaugauuucauaguuaacacucauaaucacugagccaucucucuaaccuccagugcugauauuuuuaaucauauugcagaaguagagaauaauguaaugaacacacacauauauguguauauauaugcauauauguauauguauacauacacacacacacacacagacaccaugagcuuuggcaaguaacuuguuuuaggugcuuggaauuuaacagaauuuuacaugcagcacaccuaacuuauaucucuaagcauuguccucaacccugagcuguaacucagaagaaacaaguuuguauaaugaaagacuguuguucuaaugacuccauauaaagucauuacugguaguaucuaagagaugugagggcccauaggguaccaugcauauucuuaacuugauaucugcuuuucugcccauucaacacuuuuuagagaacaggcaaggaaccagaacuccauguauaugcgccagcucagugacuuagagucuacuguuucucagcugcguucugaacugagggaguccaaaaggauguaugaagauaaggucaguuuaaacaucacuuccaagggcuguuuuuuugcacauugaaucauuuuuaauaguuuguuugaaaaugaacaaucaauaauuucuaacuaaaggaauauuuuuaaaaucaguguuaguugguaaacaaacaugcuaaauuauauguuaacuuauaaacuuuuauuuaaguugauguuuaaauucauuauaaagugauugagaaauauuuuucagguaauuucuagauaauaaauugaguagcacagaguguagggacaacacuacuccugcaugccugaagcucuagauuaauccucacuaccacaaaauugaguuaaaaguaaagaauagaacuaugccauuuaucuuuugcuaaggcuuggcuuggcaaguguggccagcugucugugucucccaccaaugcuuugggggcuuaauucaucccuucaacuucuagucauuuuugugucuagaaaacuaaacuuuaagauuacucaaaauaauaaaguaaaaauuaggaaacucagucuuccuauuucaucauauaauuucucuuuaaaagcagauaauaauauuuugcaggaggugagucuggagagauggcucagcagucaagauuguguacugcuuuuacagagagaccugaguucaguuacugccacccacagcauaugguucccagucccuggagcccacagcuccagcuccaggaugcccaccaucuccaugauuccauauuauuaucaaccauuuauucagagcuuagauuuuuguuaauuucaaccauuugaaaacagugaaauuccuaaaacuagaaaaacaagaguugccuuucagaggaggucauguucugcaucccugagaaggguguugauguuugccuuaagugguugcguuccacuuacuguacagugucuuacuuugugaauguuuggaagaugaguucacuuagguuaucauagagcaguaguucucacccuuugggaucugcucacccuuucacagagguggcauuucagauauccugcauaucagauauuuauauuaugauucauaacaguagcaaaauuacaguuaugaaauagcaaugaaauaauuuuaugguugggucaccacaacaugaagaacuguauuaaagggucacagcaucaggacggggaaccccugcuuuagagagccuugcagagauaacucagguacaguuuuuccuauaccuuaguuauuuauuuuaggguggucauuuagaauagaggguaaugcagcuaccaccccuuucauaaaugacaaccauccuguuagcugcaauagaggaagcuggucucugugcuggcagacuuaauggacagacagugcagcacugucuuccacacauugacuuacugucuugugcacagcacagcuuagcuuccacugccauuccagugaugaccacagggaggugcugucuuccuuggcucaaugauguacauuagaugucuaccuuuaacucuguagcaagaggaggaaauuuucacacgguuuuaucaaagucagcagaggaaauuaacaggaacuguauacucucaccccagccaugucuugcaaacaucuugaucacuacucacaggaagggaguccaugcaguaagagaagaaagccauuuaccucuauuaaaugucaggugguauucucucucuucagauguugaguugaagaucauuaaacugauuuuaugauuaacuagggguuguaguuugaauagcauccauccuuuuuaaaucucuauguauagcuucuagucucggggcaagauaauuuuaauuacuacuaccucaaagcaucccucgggacccaacucaauaaagccaagagaagcucacuuuugccuucuaguuucuuuucucaggacaaaccuuuguguugauggcgauuguccacucccuguagacaaagcacucuauacaaagggcaugacccucccuucagaagccagagcagaaggguggucauggucucaauaaagcauggcuaggaggaugucacaugauaaucugacagacagaggagcaccauuguauuauaguccaguaaaaaggugcuauuauuuuuaaaguguuauucuugacuauccaaaccauucugaaaagacagauauuuacugacauaagacuccgaaaagucacaaacuacuaaaucaagcucaauucgccuauguuuucuuaugucauuuguaauuacuaugguucuucauuauauuguagcuugaaaaaaugaucucuucauaagcuucauccaguuugcuuauuuaucuugucuaauauaucauguugacauauuaggacuauuguccuaauguguucuaauguaaauaauugaucaccaauacuuuuuuguuuguuuguuuguuugguugguuuguuuuguuuuuucgagucagaguuucucuguguagcccuggcuguccugaaacucacuuuguagaccaggauggccuuaaacucagaaauccaccugccucugccucccgagugcugggauuaaaggcgugcgccaccacgcccagcucucaccaagacuuuugauaaucuucuuuuaaguauuuauuuauuuaauguauaugaaugcuuuaucugcauguacaccugcaugccagaagaggacaucagaucacauuauagaugguuuugagcuaccaguugguugcuggcaauugaacucuggaagaacagucagugcucuuaaccacugggucaugucuccagcccugacuucugacagucuuaaguaguaaacacuuacuaaggaggauagccagcacaugggaugcugauuuaggaagcucgcacauucaaggccugccugagcuacaucuuaaggccccaucucaaaaaaggggcuucuagguuuaaucagauccuugaaguguugauaaaauacaucauuaacugaagggauucgaaccugcugacggauaacuaggcucuccuggagaagcaacuccugcugccugcuugguguaacugagcaacaaagaucaggcauguuacaaugaggauuugauuuggaggaacacaaaauaucauacuaugaagugguuuuguuaggaagacuuggaagcaggauuuaaaaagcauauucuugugcacaguuuguuuaauuuucguauauugugacuucauguuguuaaaaucuuaagauacauggucuccuuugguguuucaguacagauuuuaguauauaauguucaaacaccaagagaaaaaaagcaaagaaaauaaugcagaaagguuaaggauagagcucaguugggggagugccugcuuagcauucuuaguucugaguggacccccagaacauagcuaacauggugugcuagagcacaccuaacacgguagcacaugcuugacaugccagugacugggcaguaggagcagggucaugagagguucacgguuguccuuggcuacaugaggaguuuaagaccgccugagguaccugagacugccuuaaaaacaagauguuuuugauaagccugaacaaaacuuuucuaccuagaauguggaaauucagagaaaagcuguuacaaagaauaauuuuuuucagguuaacaaguauuucauauuggugaaaacagacauucuauaucuaggaaaauuuuagauguagccuuuuuaaaagcugacaaaaguguuuuacuauaaugcugucuucuauucuuuucuuuccguuuaggagccuccagaauuccccuuuacgaaucuggaccaguagaagcugucacuauugacucuguagauuuggcuuuacuuuuaacuuucgcuuuuugacaacaacaacaacaaaagcauagcacuaucuuucuaaguucauccuguguugacaguaguuggugcuggauugccuaguccauagugaagauggagcagcacugucuggagcuguccacugugcuagcagagcguauaacggcuucagaguucugugcagcuucaagcugaagcacagaaucagagcgaaagaaagcacacucauaaaaacaaaaaauaaagcauagcuguaauaugauuugaugugauuggccgauacuccuaaaaucagugaaauuugaauagaaaucuuguacuaauuuguacugauccaacccaaaaagucuguucauggauggugaaaagggaaaaccaggcaagaaaggaggaggaagcuugucugucugucugucucucccguguccgugcuucugcacauucugaaggcuuuucuuggcaguuuugucuuacagcuguuuguaucagcucggcugcgacuccacugguuuucccuuucacuguccauccgugugugcgagcgauggauuaaugcacacaccgugcauacaggcgugugugcucuaaaaagugaaagguaaaagcagagcuuagcagccgagucaguacugacagcuacagagccaggucccugccugccagccgggggguggggaggggggugcuuugccggaggacgggaggggaggacaggcgacgggcaggugggugccagaaagugugcccuccccuuccccucccccucucccuccuaucucucuaguuuuggccuccuguuauugucaaguuugauauugugaaagagccaccccaauuuugauuuuucuuuuugcaguaaagacagagcuauuuugaaagaacauauacaaauaacccuuugcucaaggagcgaagguuugcacccagcuaggagaguggugauucagacuaaagacuuuuguucaacuuagggcccaacguagaggacguauagaauccagucuaaucuuuuuuugauacuuuucuuauaagucaugaaaaacuuaaauaauaagaaaaaauauuuuuaaaaaguaaagguacacaauuggagggaacaugagagaccauguagaacaucuuuaaaaauuguaccucagcaaaguggaggcauggugguaugugaccagagcccagcacagucucccugagccugccagcccacagaauugcugugacgcaguaagauguugcggcuccuacucccuccugagugugcucacucaggcuuucuucucagacugaauugacaaggccaccucggcugaugauucauuugcucagaagccacguagguuagagguuacacucccaucuuucucuguaucugcccucagauggggcauacgaaucaaaguuuucucacugguguggguauugguuguuuuguuuguuuuguuuguuuguuuguuuguuuguuuguuuguuuuaguacuagggguugaaucuaacaggcacucuuccacugagcuguaucucagguuaaagauacuucuuaagcuagguauagcagaacaagccaguaaucaauuaauucuugugaaauuguuuauaaaaugcaucuuacaaucaaauacaaucuauaaccuaauauuucauguguacuuaauacuugugagaaugcauuguagcguuauaaagcauaaucagucagagcuuugugcuuuauguacuuaacccucauggaauauuuuuaauauauaacauaaucacucaaagccaacuuaaacauauauucaguguaaaugucaaaauuuauguucuaaguucuauaggcugauacuacauuauagacaaaugcauaacuguaugauauuucuauauuagcucuuagauuacuuauguauccauguaaauggauauagaagcccuacacguguaugcuuucuugucaaggagauagguauauauguguauguguauauguguaaugucauuauugacuauauauugguuuaauaaaugaacauuuuaaaugaaucuguuucaaguaaaaauaaaaaguuauuaagaaaaaauuugucuuggucauguuuuccaguuaagaaaguuugaucacauccaaacuguuuuacucuugacacaaauuuucaagccuauuuaauagccuuaggaauaggaagaaaugugcaguauuuaugccaguaugaaaccuuuuugaauucuagaaaguagaugauuauuuuuuaaauaguuguaacuauggugagguucauugcauaacacuaaguauuaacauguucuuaugaaaugguucauuaucuaauucuucauauuguguggcuccgcucagaucaaaacccauagucuccguagucugggaucuccacucuguguugaaggcuguaggaacauuugcgguccugaaggcaaugcccuccuguagaccugcgaagugcugaguuugugaaaggaaucccucugugauacaucauugguucagugaacuacauuucucuuucuucagaaaaacagcugcccugacugaaggaaaaauacauucauuaaagcuggcucucauuccuguuuguaguugaagagaaugaaguuuugaagcuuaaauuguccagugcuauauucuccugacucuaaaucuauagauauccacucauucuucugaaacauggcaccaugaugacagcaggaauacuauccugacucauucuuuuauauucaguaucugagacucucucucucucucucucucucucucucucucucuaucucucucucucucucguguguguguguguguguguguguguguguguguuuucaagacaaggucucauuauguggcucugacuauccuggaacucacucuguagaccaggcuggccuuuagcucucagagauccggcugccuuuaucucccacgugcugggacuaaaggcaugcauguaccacuaugcugaucugagacacugauaugcuaaagcaaaauagcucuuuuugguauuccaagagucacuuguuggggucuacaacacauuaugccauaagaagauaaauucuucacagacgauaaauucugaggcguaaaaacucaguguacugugcccagauacagcagucacaagugcuuuauuuugauuaauauccacacuaacuccuauggagauguuaaggcuagaaaacccugcauaagaccuuuccguuucaacucucagggagaccagcuguucucggaaggcuuuguuugaguauagccagccuggcugcauguguuugauuuggaauuucuuccagauagaagagcuggagaagcaguuaguccuugccaauucagagcucaccgaggcgcgcacagagcgggaccaguucagucaggagucaggaaaucuggacgaccaacuccaaaagcucuuggugagauuuugcucuaaaguacaggauuuggagucugggggaauucucauuacauuucacaaacuaauuaacauuauaaaauuauggcuuuuauaaaauauuugugcauacacauggaauaucauucuauauacgucauguguuuuuaaaaagguauuauauucucugggucuuuuuccuuagucauggcuauuacagugcuaaaugauauaagcuuucaaguagccauaguuuuugaguuagaacugccauuuacuaaauucaagugauguauucauuuugaagcaaaaugauguucaaaacacaaaugauguacuuaccaaauguagagauuacaguuaugagaugcuacucagagacuagcaaaaauauuuaagcaaaauauuaguguaauuuucuaggaaauaaucacucuuagucaagcuguugagaauuaucuauaucuaaggcuucucagaucacacagcuccaaaucaggugaggcaaacaggugagcuuguuucauacgacauaugaucauaugacaguggguggagaaagaacguugucacuucuuuuaggcagaucuucacaagagggagaaggaacugagucuggagaaggagcagaacaagcgucugugggaccgagacacaggcaacagcaucacuaucgaccaccugcggcgagagcuggaugacagaaacauggaggugcagaggcuggaggcccugcucaaggccaugaagagcgagugucagggccagauggagcggcaggugagaacauacaagcugugccauugcuggguggcuggcuucuuccugggggaagaauguucuuuauguuugcuuacagagcuccugcuccugcuccugcuccugcuccugcuccugcuccugcuccugcuccugcuccuccuccugcuccugcuccuccuccuccuccuccuccugcuccuccuccuccugcuccugcuccuccuccugcuccuccuccuccuccugcuccugcuccuccugcuccugcuccuccugcuccuguuccuccugcuccugcuccuccugcuccugcuccuccuccuccuccugcuccugcugcuguuccugcuccuccuccugcuccugcugcuguuccugcuccuccuccugcuccugcuccugcuccuccugcuccugcuccuccuucugcuccuccuccuccuccuccuucuucuuuuuaauauuuuaaaagauuuauuuuauuuaugugaguacacuguagaaaagggcaucagauccaauugcagauggugugagccaccaugugguugcugggaauugaacucaggaccucuggaagagcucuuaaccacugagacaucucuccaacccacagagcuucauuauacacacacacacacacacacacacacacacacacacauacacagaguccugaugaucugacagcaaaaugauuuaaguuaggcuauuugaacuguucaguucaggauuucaugcuuugaguuaacuugccugccucccaccaaauaauaauaacaauaauaauaguaauaauggugacauuuccuuuuacuaaagauggcagccauucaggggaagaaugagagucuggagaaaguguccucccucacugcacagcuggaguccaccaaggagaugcugcgcaaggugguggaagaguugacagccaagaagaugaaccuugagagcucugagaggacggugucugaccugacagcuucccuccaggagaaggaacgcgccauugaggccaccaaugcagagaucacgaagcuccgcucccggguggacuugaaguugcaggagcuucaacaccugaagaaugagggcgaucaccucagaaacgugcagacggaaugugaggcgcucaaacuccagauggcggaaaaggacaaggucauugagauucugaggcagcagauugaaaacaugacucagcugguaggccagcauggacggaccgcaggugccaugcaaguggagaaggcucagcuggagaaagagauuaaugaucggaagcuggagcugcaggaguuuaaggucugcguggugcuugugggccgguuagcucuugaauguucuguucucaaagcagcaaagaccuaauuauugggaaggguucuugagguuugcggccuacuguagaaaguaucugaguugauaugcaugugugauuuuuaagaagagaucucuacuuucacucuguaaaaaggaaugugggacuccaaaauggcucagggucaaaaggaaaacggcaaggagugcagccucucuguggaguggucccacagaaccuggagugggagauguguucucagacgggagcucgauccccauguccucgcuccuaauaacuauauagcaugggccugcucgcuccaugcaugugucugugacaauuacaaggaaacagaaagacacaacuugauuggacuauuguguggcuuagauaagaaaauaugcaucaaagucaagcuggccuauguaaauauuauucuuuccccccauucuguaaucccguucaaauaaugagccuccuuacugcauaagugagucaaaucaaaguuaaagcagggcacacagcuuaguugucucccucucucucucucuuuuuuuuuuuuuuuaaagaucuaugggcuggagacauggcucagugguaaagagcacugacugcucuuccagagguccugaguucaaaucccagcaaccacaugguggcucacaaccaucugugacaagaccugauucccuccucuggugugugaagacagcuacagugucuuuaaaaaaaaauuuauuuuuuauguauaugaguacacuguagcugucuucagacacacuggaagaggguagcagaucucauuaacagaugguugugagccaccaugugguugcugggauuugaacuccggaccuucagaagaguagucagugcuauuaaccacugagcuaucucuccagcucccuugguuaucauuguaggguuuuuuucuccccauaucuuuaugaauuuuuuuuugaagccaaggcccacaaaucucaugauguuggcuuaagcuaaccucagacuugcagugauuauucuaccaagcucugggauuccaagaacaaaucacaaaacacaaaaucuggcuuuuucuuuuugagauaguuucacuauguaaccauggcuguccuggaauuuacuauauagaucaguaagcaaaguggacuggguguaaccuuuaaaggcuuguccugguggucuauuucuauuaagacgguacucaaagcugggcagugguggcgcacgccuuuaaucccagcacuugggaggcagaggcaggcggauuucugaguuugaggcuagccuagucuauagaaugaguuccaggacagccagggcuacacagagaaaccuugacugaaagaaagaaagaaagaaagaaagaaagaaagaaagaaagaaagaaagaaagaaagagagagaaaagaaagaaagaaagaaagaaagaaagaaagaaagaaagaaagaaaggaaggaaggaaggaagaggaaaagagaaaaaaaaaaaguacuuaaaguagcaccgccagcuagguaacaagcauucagaucaugagccuguggagggagcccuagauucaaacaguaagagcugccaaaagaaaaagguaaugugguaaagcccagagaaaaucaguuuccagaagucgcuuuaugcuccauacauacucaacuaccccagcaagaaaccaugaaaacuaaaaugcugcccacagagcuuauugugggcacagucccaggaugguuuaauggaggcugaugauguaugugccuauuuguggcaggguucaguuuuuugucuccaagaagggaagcagguauucagccuaacuacacagcucacagaaacaguuuacacaaugagccacucuuagcagcuaagucucaaaaagguuucaugaauuccuaaaugccagccagagaccagccuugugagccaucuugaugaacaggaacaggcagccccuccccucacauccaucucccucccucaaucuaucccccucccucacauccaucccccucccucacauccaucucccucccucacauccaucccccucccucacauccaucucccucccucacauccauccccaucccucacauccaucccccuuccucacauccaucucccucccucacauccaucucucucccucacauccaucccccucccucacauccaucccccucccucacauccaucucccuuccucacauccaucccccuuccucacauccaucucccucccucacauccaucucucucccucacauccaucccccucccucacauccaucucccucccucacauccaucccccucccucacauccaucccccucccucacauccaucccccucccuuccauccaucucccucccucauauccaucccccucccucacauccaucacccucucucacaccuccuuccaucucuguugcuaaucucuguccuuuaccaacuauuaugguuugaguuugggauguccucccaagucuuguggcuugaaugcuuguucccaggugacagugauguguuagaugguuguaaaaccguugguucugugaccuagccagcaaaaaugggugacuggaggaaggucuugaagguaauauuugcuuuggguucuggcuugaguucuuugcuuuuugaccugccaagaugucaggaacccucacagcacgucucugccacuggacugagauguccuagcucccauaccuuccugucaugaugcauccucagaaacugggagccaaaguaccacccauacauauucacuaaguugcuccucauggguauucuaucacaaggaaauucuauuaguguccuuagaaguacugacauuaaaaguagauagaguaucaaugagacugguuugugcuauauauguacacguucuuuuacuguauuuugucuuugucaaaccagauuuuaaaagauaaaaaagaugcaaagauuagggagcuugaagcccgagugagugaccucgaacuggagaaggugaagcuggugaaugcaggcucugagcggcuccgagcggugaaggacaucagacaugagagagaucagcugcuaaaugaggugaagacuaguaggacugaacuaaaccaucucucagguauggcaccucaguuuccucuguccuaaaugcugugaggucccacaccacaaaugcagauagccacacugcuccagcuaugugaucugcgccccacuucuucucacaguugucugcgaggagcuugcuucuugaugcuuacuaaccauuaccuguauucaguccucgguuccaaagagugggacgagguauugagacacugggcuuccuaagggguugucuuuacugcuuuguuauucuggaaaugggagccuugcauccuuugagccaaauuacuugauuaaagguuuaauaaacugacauguauaaauagaaauuaugcaaaacaggagaaauccauaugagggaacagaggcaguggcagcaagaaugggagaagagcaaagaauugagacuccuuugggcagugugguugugcacaccuuuaaacccagcaguggggagguggaggugauggaucucugaguucaagaccagccugaucuacacagugaguuccagggcagccagagcuauauagugacauccuuucucaaaacaacaacaaacaaaaccauacacaccccucuacccaccaacaaacaaaaccauacacaccccucuacccaccaacaaacaaaaccauacacaccccucuacccacccccaugcaaaacaaagaauaauuuggaagguugcugcaguagaauuagugacugguccauuuguucuggguuuuuaguuugugggauuaggaagcaauaauagcaguaacuaaaaagagagcuagggaaaaggcagaggcagucagaugaggcagcacggaggacauguagggcuggacuuguguauguaaaucuguaugguagccaaguguggugcaugacaaggagagucaugcuuauuuucagcaauauauuaagcuugagacaagccugacugcauaagaccuugucuuccccucaaaaaucuauaucauauucuuaggaaaauagaauguaugguggaugaguuuguggcaaauguuuuuagaguagagaagucuuugaaacguugacacacauaugcacugcauuuggucauacccauuccuccuacuuguguucuacucucucugggacccucuccugucucccucccaucugcguguccucuuacuauuauuuauuauagcccacuaauuccaauuaguguugcuuaaauaugcauugauuuagggccauccaccgaagcauaggcaaccuacaacaccccugaaaaacaaauaaaaaacgaggucuuccccggcagccaucaacuaccaaucguuccucagcugugagcggggucugggagucucuccugucauuaaugcuggaauguugacuguguuccagauauuuugauaguuacuagagagagauagacagacagacagauagauagauagauagauagauagauagauagauagauagauagauagauaaaugaaauaacuugguaguaaaauacuugccuguauaggcaaggccuuggguucaguauauagacaguauauaucuuagggugggaugaagacgagacccuuggaagucuguagugagugaguuugucuccagccucugagaugcugcaaucacugaggacauugucguuguguucuguagaggacuaugaagucuuaaagaggaacuuccggaacaaaagugaggagauggagagcaccacaaaccgccugaagaugcagcucaagucggcucagucggagcuggagcaaacaaggaacacacucaagaccauggaaggcuccgauggccacgguacgcucugcuccaaccccucugucuguaaacccauugccuagagugucucaaacacaguccuggauauacugcgcggcaccucuucacaaugccccgcaacgugagaaagacacaccucagugugggugcuggguggcacaaauguguuucuaccgauuuaagggagguugacaugugcuuuagucccuaauauaucugaagacauaucacuuuuucuuucuauggcuauuucaguaauuuuuaacaaaucucaccguuucuccuuauuuuuaauuuuuuuauuagauauuuucuucauuuacauuucaaaugcuauccccaaaguuucuccuuauucuuaaagcuagaaacacaagaaauuuuucauuaaaccucauauuuuuacacguacagugucuacauaaacuguagcucaauggcuaauuggcagcucuugacuucuucucugugauaaaaaugagacgagauugguaauaaggccucuagacgaggggucuguaucucacaaaacacuugacaccuucugcucacggccguacuaguccacguacgugagugcccuugaagugcccgugagugcccaugaggcucgucagugagagcagcugcuccucucagggccuucugccaugcuggguauaucuguauuagcugacuauacaaauuuaagcauaguuuuuguauuuuaugacuucuuuaauaugugugugcauguaaguaugugugcagaggucaacaugaggugucuacuuccauuauucuccacuuuauuuuuugagacagucuuucuugcuugcugaccuggagguccugauuuuguuacauugccuagccagagaguacaggauugcauguggcugcuccaugccaggcuuuguuguuguuguuguuguuguuguuguuguuguuguugugugugugugugugugugugugaaaauucgguccucacacuuccacagcaaguauuuaccaacuaagccaucuccuagccccuaucuuuuuuuguuauuuaaguuaaaaaauugugugugugugugugugugcguguguguauguguguguguugaggucagaggacaacacucuagagcuggcugucuccugagacaucuguuggccccugagguuauuuguuuuuuuguuguuguuguuuuuuuuuugucuguuuguuuguucuaauuaguuaggagauucauuuaugcuuguccagcagcacaguuuguuuuguuugcccagauuggucucaaaguugcuguguagcugagcugacucugagcuccugcucuuccgguuucuauuuccggaagcugggguuaaaggcauuccgaaccacaccuggcaagaaccagaugcuguuaaugaaaaaaucagacuuagcauuuuucugauggguuguuuucaacagauaguauguuuuucuuuuccuuuuaaacuucuaauuuauagcuaggccugacucaaagcagcauuaguuucaaacagacuuucucaacugacuuguaauaaaagauagggucuucugacuuuacacuucuauguaaagacagguucaccauaauguuuccuuagcuuaccacacccuaaagaguccaugguguguaucuagcuaaaacauucucauggggagaugcuggggacacagcucaguggauuagaguaucuguuacucuuccagaggaccaggguugaauucccaguacucaaauaggugguucacagucaucauaacuccuguuccuggggcucugacucccucuucuggccuucacagacggcacaaagcacacaugugguguacauacauacaugcaggcaaaaagcucauccauauaaaauaaaauaaaauaaaauaaaauaaaucuuuuuuaaaaaauggucucauuuuuuuccaaaaacaaucauuuguaugcuucuaugauauuuuuacuacugagacuguagugaguucuagcauaugacaauaucuuuugaggaugaaauugaauggcuugugacaucccuggaaucuuuuagaagucuguuaauaguagauaucuuaaaugauauuuaaaacauggguuucugaaaaaaaucaucuugguuaaacaucuaugacuauuuauguguuuauuuccuauauguguauaaauuuauuauuauuaccaaugaaaacaugaaacuaacuagucagugaaauuaauucuaauagcaaagaaaccacaaaacaucagcauaggggcuggagagauggcucagcgguuaagagcacugacugcucuuccaaagguccugaguucaauucccagcaaccacaugguggcucacaaccaucuguaacaagaacugacgcccucuucuggugugucugaaaacagcuacaguguacuuacuuacauacaauaaauaaaucuuuaaaaaaaaacauuagcauauauauuuuucuuaguugagaaucugugaguguuugcugcaguuguuauauaacccaauacugugaauccuaaaguccuuacuucaugauauuuaaugggcacuucccaggaaccuuagugcuuuucacuugcugucuugucaagaauuucaguaggcuuucaaaauguacagcuugcaucuuucucucagcuaugaagguggcaaugggcaugcagaagcaaaucacagccaagagaggucaaauagaugcccugcagagcaaggugcaguuuuuagaagaggccgugacaagugccaauaaggugagucuuuguccugagaaaccagcaugguuacucacucacucguuugcucguuguacuggcuaguuuugugucaacuugacacagcuggaguuaucacagaaaaggagcuucaguugaggaaaugccuccaugugauccaacuguaaggcauuuucucaauuagugaucaaggggaaaggccccuugugggugggaccaucucugggcugguagucuuaguucuauaagagcaggcugagcaagccaggggaagcaagccaguaaagaacaucccuccauggccucugcaucagcuccugcuuccugaccugcuugaguuccaguccugacuuccuuuuagugaugaacagcaguauggaaguguaagccaaauaaacccuuuccuccccagacugcuucuuggucaugauguuugugcaggaauagaaacccugacuaagacacucguuaauacaccauaaggcagaagaaggcauagcacaggaagugcaguuggggagacauuucugauugagagaaugagggaaagauuccaaaggagucuugaaugaggaauuuuuaaauuuaauuuaauuuuuaggguuuuuaguuuauguguaugacuguuuugucugcauauauguguguacauauguguauauauauauauauauauauauauauaugcacacacauguauauauauguguguguauguaccacaugcauccauaugugugcagacacagaagaugugucagaugcccuggcacuggauuuaugaauagcugugagcuaccauguggacgcugugacccacaccuggguccucugcaauagcaacaaguucuaaacugcugagucaccuccaggauccuagucacauagaguuaucacagucauugacugaaaauguucagaagcagacaugaaauuuguguuauguccaaauguucucugaugacaguuugaagcaaauuuacauuuuuauauuauaacagaacugaaugcaaugaacaugcaaaagaaauggcauaaguaaaaauaaucaguguaacuaaauuaauuacuagcugaucacccacagugagcccuggggauccuuuagaauguacauauauugcuuuaccccuuaucuuauguaccuaucggauuuccuuuuucuguucuuucccauuuuccugaacauauucuuuucucuuucucuuuauuccuuccuucugggaaucugaaguagugcuucucccaguugaugguacuuagggauuugugcauuacugcuugaugucaacccaugccugccuccaccugaaacagcucagagacacucgcucagacaaagcaagaggagacuggcaaaacaaacccaacuuccaaucuacggauguuccugcccaauccaagcagaaaaaggggaggggggaacacacacacacacacacacugugucaugacaacacuuucugauguauuuguaacaaacacaaugauuaugaaaaaaauacaaaaaagcagacuagauaauguggugcccauguuucauguuaacaauuagccacucuuuguauucguuccaugguacuuuucuaaaggagaaaacuaauuuggaaaguuuuuuguuuaauacugaccauauuacaucagcuauuuuauuugcacuacuguccugacagguagcuugagagcuagauaugucugucccauguguuucugucauacgaccuacaguagacauuggugaaagaaccaugagcaaaauugaaacucuugagacuuucaaauaaaugcaucuucuuuaacuauguuauuguuuaaaauaaaucucaguaaaauuuaguauacaguuauucaauccuacugcaccaaaauucuauuuuuuaaauuuaauuuuguuuuauuuauucucuuuacaccccacucacugucccccucccagucaccccucccacaguccuuuccucuuuccccaucccccauccccuucuccucugagcaggugcccccuuacugggugucccuuaacccuggcacuucaagucucuucaaggcuaggcacauccucucccacugaggccagaugaggcaucccagguagacaaacauaucauacaggcaacagcuuuuaggauagccuccauuucaguuguucaggacccacaugaagaacaagcugcacaucugcuacauaugugugagaggccuagguccaaucuguguaugcucuuugauuggugguucagacucugagaacugcaaggguccauguuaguugacucuguuggucuuccuuuggaguuccuguccccuucagggcccacaaucuuuccugcuauucuuccauaagaguccucaaacuccauccaguguuuggcuaucccuguauugucugagucagaugcuggguggagccucucagaggucaacaugcugucugcaagcauagcaaaguaucauuaauaguguuaaggauuggugcuugcccaugggaugggccucaaguuuggccaguuauugguuggcuauucccucaguccuccaugucuguauuucuuauagaaaggauaaauuuugaguugaaagucuuguagguggguugguaucucuuaucgcuccacugggguuccugacugacuacaggagguggccucuucagguuccauaucccuaguguagugagucacaguuaaggucacccccauugauucuugaaagccucccuuaucccaggucucuaucucuaccuagagaugccccuccccuccucaccccagucaguugcagauuucuauucauacucauggccaccuagucaucucuccuguccuuucucguaccugauccugaaccgccccccacucccuuucccauccccccucucaguacccuuucuccaucugccuuuuaugacuauuuuauuccuccuuuuaagugagagucaggcuuccucacuugggccuuccuucuuguuuagcuccuuugguucuguggaguuuaacaugguaccuguauuuuauggcuaauauccacuuacaagugaauauauaccauguaugcccuuugugacuggguuaccucacucaggaugauauucucaaguuccauccauuugccugcacaauccaugaugucuuuguuuuuaauagcugaauaauauuccauuguguagcuguaccacauuuuucuuuaucuauucuucaguugagugacaucuauguugcuucaaguuucuguguauuauacauaaaacugcuaugaauguaguugagcuagugucuuuguggaauguuggagcaucuuuuggcuauaugcccaggagugguauagcuggaucuugaaguagaacuauuuccaauuuucugagaaaaugccaaauugauucccaaaguaguuauacaaguuugcccucccaccagcaaugaaaaaguguucccuuugcuccacaaucuucuccagcaggugcuaucucuugagguuuugaucuuagccauucugacggguguaagaaccucagagauguuuugauuuguauuuucccugaugacuaaggacuuugaacauuucuuuaagcucuucuuggcauucaagauuccuccguugagaauuuucuguuuagcucuguaccccauuuuuaaauggguuauuuggguuguugaugucuaacuucuugaguccuuuauaaauuuuggauauuagcccucugucagauguaggguuggugaagauccuuuccccaucugaggcugccaauuuguccuauugacaauguccuuugccuugcaguuucaugaggucccauuuaucaauuauuagucuuagagccugagccacugguguucaggaaauugucuucuguaccaauucauucaacaguauuucccacuuucucuucucugagaguuaguauaucugguuuuauguucagauccuuuaucuacuuggacuuaaguuuugcacaggguaauaaguauggaucuauuuucauuuuucuacaugaagcuauccaguuagucagcaccauuuguugaagaugcuuucauuuuuucauuuuuuaguuuuggcuucuuuaucaaaaaucaagugucuguagguguguggcuuuauuuuggggucuuugauuugacuccauugaacaauaugucuguuucuguaccaauccauggaguuuuuaucacuauugcuuuaaccaaauaagugacaagaacuuccagucccugaagaaagaaauugaagaugaucucagaagauggaaagaucuccuaugcucauggauagguaggauuaacauagugaaaauggccauccuaccaaaagcaaucuacagauucaauacaauccccaucaaaauuccaacaauuuuuuauagaucuugaaagaacaauucucaacuucacguggaaaaacaaaacacccaggauagccaaaacaaucuugaacgauaaaagaacuucaggaugaaucaccaucccuagucugaagcucuacuacagaucaaaauucugcuuuucacaaugcauggcugcuucauauuuuguagauguuaucaaagaucugaggaccuaagaagugauacuaguagagaugaaaauguaucagaguccuuugucagaagucuuagacuucagcacuuaucacacuuuuaucagcaauuauuccugauucuuucucuuccauaacuguaggagagacacuuuuugaaagaagagaagaguaagcucagccaggaguugaguaccguagcaacagaaaaaaacaagauggcuggggaguuagaagugcuacggucucaggaacgacgcuugaaggagaagguugccaacauggaagucgcucuugacaagguaguuuauuagcugaggugaugugggaauuagcaccaggacaacagcucgguaggauaguucucaguggaaguucuguaccaucaacuugcaucauaucucagucuuacagcacagaggcaggcugucacugaggagacauuuagagaucugccauugcauagguagucaguaccucugugugguuguugccugggagggacaggagaggcuuguuuucagucuugauuucauguuucucucaguacaucaugaaaggaagguugcuguggaacucacaguaguaggaagaaugguagccacacucauaucaugacauaucagggagccaagugaagaaaagguaccaggguaaagaaaagccugucucuagggcugugguucuuaaacuuccuaaugcugugaccuuuuaaugcagcuccucauguuguagugaccuguaaccauaauauuacuuuuguugcuacuucauaacuauaauuuugcuauguuaugaauaauagauguaaauaucugauauuuuugauggucuuaggugaccccugugaaagggucauucauucagcuccuaaagggugagaacugcugcucuauggggcuuuuugucugcugggccccacuuccuaaagcuuccacagccugugggaaacauuuuugacucaagucauaauagcauaguccuucuccccaaaaugagcauuuucuguugaaguugaggucugauucuuccucccaauuccauguucccagaaauaagacucaaacucaaaauauauuuacaaacaccuuggccauauggcuaggcucuucucugacuagaaucauaacaagauaaccuauuucuuuuagucuaccuucugccacuugcuugguuaccugugcucagguaccaugugucugucuccucacaucuucccgggguugggggaacucccacuuggcuuuaucccagaauucuuucuccucccacauuucccauuuucuauuuccugucuaagccauaggccauagacuuuuuaauugacaggugaugcauccauuccgugguugguacacaagauauucucucugcaguuaccaagguaacacagucauaggagcaguagauauaaucuauccuugcuaguuuuacucaccugaguaaacaugccucugugagcaucagcccuaccgucaaaagugaucuacacuuuaggugcaauacagucucuuaaauguuaauaaaaugauagugcuaauaucugaugcccugcugggucuggaaagguuggguagaagacagaaagaaggagaagggccuggcacugauuaucauuguuacacgaggauaaaucugucuuccuguuacuuagaaaccccgaaaaaccuaaagguaucaaaaucaaucacuaguuccuaagaagcuagaccuucgugguuagauaaaauacuccaugaucugacugugccagccauguuuccuaaaacaugcuauucugaauucagggggaguuuugcaguuuugaguguggccccaaucuugcuaucuauauacagcccagggugacauugaaauacugaucuuucugccuccaccuccuagcccuacaccucucagcccagauauaaauuuuaugcuuuaauaaagcuuuuugcucaucucacccuucguucauucacucauacuaauuacugcauauaugcuguguguacacuggauaagauagaccacaugacugaauaggacagauacauggaucacuagaauacagugugccgggguagaugguuuuccuugaagagcugaaaacuauauuacagguuaaugaauuaaaagugccuaaagaaugggggauaaaccacuuaugguugcucgauuguaggcaucuuugcaguuugcagagugucaagauauaauacagcgccaggaacaggaaucggugcgucuaaaacuucagcacacuuuggauguaaaaguaaggguguuuucauaauacauaguuuaagcugaaacaaugccuaugcuugauaugcucugauauuuucuuuacauacauucugugugugagagagaggggggagggguucauauuugcguguuuuuaagugaucacuguagaggccagagguucaugucaggcuccuuccccagucacuucccagcaggaucucucacugagccuggaacucacugacuaggucagacaggcuggccagcacggccccaggauccucaccucuccaccucucugcacagggugacagacguuuggcucauuuggcauugcacgaguaugggaguucaaguccuuaugcuugcacacaagcccuuuaccaucugggccaacucccaggucccugcauaucuuauauuuaaugauagucuguggugguguuacuucucaguguguccaccuugugauuuaagauaacauggaagcaucccaguuuagaccuacuugacacuaagcaaguaaaacagugccccccagcgccugccuugaguacccaaggggagaguuuuacacacacugaaugaacucaaagacccaaaggaucaauguuuagcucguuuuuuggaauaaucuacgugacagugaaacaucucuucuuaaaaagggugcuuuuauacugaaauguggauauuuuucagaaguauaguuuaaguugaucauuauuuuaaaguuuuaauaauagguuugccugugaaauuaaaaaaauaauuuugauuucauaauucuuuguagcuguaaguuggcauuacuuuacucacaucugcauuauuuguaggaacuucagggcccuggauacaccucuaauucuucagugaaaccucgccuucuccagccagcaucugugacucggucucauucuaacauaccauccucccagucgacaaccagcuuccugucucauguuaguaaccagccauguaauuauaaaaugagugggaaacgucaccuucaaagucauguuuaucaugaacauugcaaugagaauccagacugaaaaagcucuuuacuauuaauuauuuucuuagaaaagacaaaaugaaauaaucauuggaauugaugguaacaaaaauauuaauuuuuagacauucucugcagaacuuuuuauacuuucuuuuuuuguuuuuguuuuuguuuuuguuucuguuucuguuuuuugagacaggguuucucuguguagcccuggcuguccuggaacucacauuguagaccaggcuggccuugaacucagaaaucugccugccucugccucccaagugcugggauuaaaggugugugccaccacugcccggcuauacuuucaaaacacaagaaaaauauggacaauauaaauucaggcuuucucugaagauguacaaauuccuuauaauugguagccagcucuaacucuuaaaaaagaaagacuuguucuauacaucaguuccaauaaucaaaaucuuuuacuuuuaaaagcucugucuuuaaaauggaggaucaucagaaccacugcaaauccuauugaaauaaaagcugggugugagccaaaugacuaguaguuggaauggaccugugcgcugcaauuaaaccaucauuuauucugcuuuuccauaaugucugucuauaaauaauguacugaugugugcauugcuuuacucagcacucuauaaaaaccaacacaccgaaggaggacccgacgagggaccugaagcagcuccugcaggaguugagaaccgugaucaacgaggagccggccauggcccugagcaagacugaggaggauggaaggacuccaucucuuggagcacuguaggugacucucuacgacugcaugcucacaauggcaaagcuccucccaggagugugccaccauuaagugguccacaugcuccuuuggaaggucaaggguuaaacaacuuugaaccagcauaaagguggagagguuaggcaaaagcaaaaaggccagcccccacgagcaaaagaaagagugcucauucaguccagaaaguggccagugcacaguguuagucaguguucauuuguaguaauuuaagauucccaagagauuucacauccauaaucuuacugaguaucacacgguaagugaguaggugguguugcucauagguuuugcuacugcgguuuaagcucaggcagacugugcucccagcuccacccagaguuccucagaucaguggaugaaagacgcgcacgcgcuagcacacacacacacagggcgcuucuaaccucccauggcuagcgggcccuuccgauacucugucugcccucagcuuuaguugccuuucuaaucuccugccuggggaaauggccuauggcugcuccaccugagaucucacauggcuggucaccuuuugucucucugaggcauggugaaaaaacaugacaguacaaggugggacagcauuuauuugucccaccuuacaagcaaaagaaacaaaucccaaagggcugauuuguguacaacaacacacagucuauugcaaaacuagaacuauguagcacugggaacuaggaacacucaaggcauaagcuaauaggaaaagcccaggucucuggcuguucuugacaauggcuuauaucaaauuaauaagucucacccagggcuggugagauggcucagcugguaagagcacugacugcucuucugaagguccugaguucaaaucccagcaaccacaugguggcucacaaccaccuguaaugagaucugacgcccucuucugaugugucugaagucagcuacaguguacuuauguauaauaauaaauaaauagaucuguaaaaaaaaagugucauccaaaacagauugagucagcucagcagcccccccgcccauaucuacagagaucagugaaauuccuaugugcuuuccaagugcucugaaauaguuauuuagauaaacucauauuaaacauuuaacaugguauccauguugguguuaaucuuaauuuuguaauauuaauguguuuauaaggcaaauacaugaaaguaaaaguuucugaauaucucuguaacucauuuccaguuccuuaagauguucugagaacaugcauauuuaaucuaaaugcugacacuagcuggacugauauaauugcuguaauaacaguaaagcauuagugauacaucacuucuauaucaugacauugcauuaccucuggcacacaauggcagaaaugugcuguuggcuaguccagcaaagaguccuuugacuugcagaacucguccuuuuccgugugugagggggaaucaggcagggucacuguguagcccuggcugugcuggaauucacuguguaaaccugguuaccugccugccucugccuccugagugcugggauuaaaguguguacuaccacaaacuguuuuguuuuguuuuguuuuguuuuguuuuguuuuguuuuguuuuguuuugaaacaaucuuaccccaggcuggcuuugaacgcuugauccuccugccucaacauucagaguguuaggauuacaagcaugcaugugcuaccaugccacgcugaucacucucacuuuucuuguaacucuagcaggcccucugugcaugggcaguguuguaaggugaauugacugaugaguaaauaucggcauaggcugaccuuucucauaugaaaccaagcgagugucacgagucugguccugagcacuaaugaugcggaggguuaccauagcuucccuagucaguuuccauuacugcuguccccaguggccuugaacuugggacuacaucaaacaaauguaucuggugauaauuccagugaauuuucuguaaucccccaaauggcccugucacuaaagucugacuucucccuaaugcugaagaaggccugcaagaaagccuguguaguggugcacgccuggaauccuagcacuuauggagcagaggcaggaggauugucgccagccugguuuacauugugaguuccaggccagccagugcuauacugcuccaaccuguuaaaacaacaaagaacuacacaccaaaaacaaacucaugaaagaaagcguuguccgaguugaaauccagagcuagcuggcucuugguagguuugcuuggaucgcuuaaauacagugauggguagguagccuagagaaauacagugauggguagguagccuagagaaauacagugauggguagguagccuagagaaauacagugauggguagguagccuagagaaauacagugauggguagguagccuagagaaauacagugauggguagguagccuagagaaauacagugauggguagguagccuagagaaauacagugauggguagguagccuagagaaauacagugauggguagguagccuaaagaaauacagugauggguagguagccuagagaaauacagugauggguagguagccuagagaaauacagugauggguagguagccuagagaaauacagugauggguagguagccuagagaaaaauuaagcaucagugaguagucgauuguuucuaaaagaugaacccugagaugcacauguguuuaacucaguuaacuggguugucugucuccacagagaagacagaguaagagacugcaucaccgagucaagucugagagcagagcucugccacagguaagaauaucagacucuuaggccgagccguugugcaggacugugguuuccauggaaccugaugugcguauuggcuucagagaaggaaaccuguuccauggcuuaacucugaaagggacguccagguucucgaagugaacugaaagcauuuucuucucuucuuugccuauuuccaaucuugcugauugugagccucagccuucugucauuauagcacacugccugagggaacuuaacaagaacaaaaguugaugucccccacaucccugagguuccaauccacggucaggcacacccacugcuuugggacccuguugacggugucagauggcagugguaaagcuguguaagacucugaggcaggcuguacaccucacugcugagaagcaagagagacaaguccccuuggauaucacucauggugacacaaggccccaccuccugaagggccaacugccuuccagugguuccaagcuggggaccaagccuuaauucuucauuuaacucaggggacuuaggaggauguucagcauccagauaaaagcucugaucuguagccauaugagcuauggguaugguaugccacaccaaaggacuuucucuauauuuacauguauuuacagugucugcuguaacuuugaaaggugguucagaaggaaguuauaacagcaccaauguaagauugugcuaaagaugauccuauguucaucaacuuaauagcugaauucuaaauaaaaucauuaaaaugaagaaaacuuacaacauucuaaaaaacucuacaaaggacaauuucugagagcaaugugagcaaaagaaaaaaagucuaauggucauuauucagagaggacacaaaacuccuugcuuuaaaaacccugucucaucacugccuguugcaaugaacacugaucucccaggcuggcaucaaaaacugacuucuaguaacuagucugugguggcuaguuuaagucaacauaaugcaagcuacagucgcuugaggagaggaaacuaccguugagaaaugcaagccuaggugguauucucaggaugaaugauugaugugggaggcugaacccacaggcaguggcaccauugcuaggcaagugguccugaguuguuuaagaaagcuggcugaguaagccauaaggagcgggccauuaagcaggauuucucuaucagaaaucugcuucaguuccugucucuagguuaccuugaguuccugcccugacuuuccucagugcuuuuggccaugguguuuccugaccacaaugauaacccuaagucacacccuguacugauguacugugcucuaaucuaacuagaucguuccaccauuaccagcacccuuuuuaaaaucgugaggcaggaucuuacauauauccaggaaugggugaucuugaguaacuccugauccuccugccuccacugccaguuuauaugguguucgugaucaaagccagagcuuuguacaugacaggcaagcauauacuaagcugucuuuagucccuaagugccacaagacacucugcaggagucuagucucuccauggcacuccagggaucaaauucauguugucagacuuggcagcgagccuuuuacggaaaggcgucccacagcugucuuucuugugacuucgcauucucucauagaagagccagagugucagccucauucuuuucugucuauaucugcccaaaaucagugcucaaaugaaaauguguuuuauccuaaagcuaacacuugaugauauaucuagcuaucaauauaaaaauaaauuguccuugcaguguagcuuguuuuuacacacagcccuggguucaauucccagcacccucccccacuaaagaauaaacuauuucucuuacagauguuuauuauaccaauaagaaaauaacaaccuaucuuuuuugugguuuuuguguuguuuuguuuuucaagacagggucucacuauguagcccuggcugaccuacaacucacuauguaggccaagguggccuggaacacccagagauuggcuugccucugccuucugagugcugugaugccuggccacugugcccagcuuucuaacauuguaucuuuaauuccugcucuucucuuaccaacaggagcaacaacuccuugagggaguccacugaaggcagcaaauccagugagacucugagcaggugagaaauggcuucacugccugcccuugcuuauaaaauguccuuuuuguucaguucucugccuuaaagccuggaacucuguaauguaccaaaugugcuguccuaggcccauggaauauaagcaagcagauuucaguccugacucuucaguugcauaaaauuauaauguguguuuauagaguaacguauagaaaauccuuaaucuuuuuuguuuucaugacccauaaaaauauaagccaucuuuauaucuuucuuaagaguauaagaauguuuuuuugugggacuccuaacagugggcgauguguuauaaaaagauaaagagguuuaagaauauguucuauggggguguggugagguaugggggaaaggggaugccuuagcgggcccaugcuaaggcaucucuucccucugagggaccagccacaggaugcuuuauucagggcaugaggaggggaguuaagaggguaguagaggcagagaaaggcagagagaaggagagaguagaaaaguagaggccagccaugaccacguggagaaaggagagaagggaauggggagaggggggagcaagaggcaagagagcaagagaaguggaggggggccaaguagccccuuuuauagugggucaggccuaccuggcugcugccagguaacuguggggaggagcauaccuggcuguugccagguaacugccggguggaguuuagacagaaugcuaacaguaguagugggggugucuuugacucauucaccugcucuugggacccuuuuucuccuacuggguugcuucacccagcccugauauuagagcugguugugccauguucauuugauaucccuaggaggccugcucuuuucugaagggaaauggaggagaaguggaugaggggagaagggagguggggaguggagacggguggagggagggaaucugugguugggauguauuguaugagagaugaauaaaaaaaggaauaugaaaaugauugcauaguggaaacugcuuacauuuuaguuauugugcuggcuaguuuugccaaccugacacaagcuagaguugccagagaggauggagccucaacugagaaaaugauuccauaagcucccgcuaggcaagccuguggggcacaugguaauuagugauugauggggaaaggcccagccuauuguagguugugucaguccugggcuggugguccuggguucuauaagaaagcugacugagcaagccaggggaagcaagccaguaagcagcaccucuucacggccucugcaucagcuccuaccccaggucucugccuuguuugaguuccuguccugacuuccuuuggugaugagcugugguguagaaggguaagcuaaauaaugccuuuccuccccagguugcuuugguccuggugauucauggcagcaauaguaacucugacuaaguuacgaaugagcuuuuucauccccaugugcucagcacuugugcacaacgccuaccaaaaaccacucaguaaauacuuuuuagugaaugaaucaagacaguaucuucaauacuguuucugugucuugaucacaauacaauaaauugaaucuuucuaacucugucuuucuuuucaucuaaucagaaauuauugauuuucuacuuucuuggauauauaguacuauacuguacuauaauaacuauauuauaauucuaucucuccucuuuucuaguugcuuuagaguuaucucaucuuguuuaucuaauguaugugguagcuauuaucuucuuuuuaggcuagaaaugaagaaaaucagauuguguaagcaacuugccaagggcauucaacuuguaaucucugaacuugagccuuaguggcuucaaagcacauguuuguagccacugcuguguacugccucuggggacuuacgcugagcuaccugggaggaagccagucacaggcauagggcacaguuacuuccccuagguagcaaaggcuccacuguagaguuucuuugugguuagaaaaaucuguuucuuucaguaaugaaauugccaauacuuauuuuauuauuuuaaaaaugucacugagggccggagagauggcucagugguuaagagcgcugacuguucuuccaaagguugugaguucaaauuccagcaaccacaugauggcucacaaccaucuguaaugagaucugaugcccucuucuggggugucuaaagacaacuauagugagcgagcgggacuggagugagaagaaaaaaggcugaagacagcuacaguguacuuacauauaauaaauaagucuuuuuuaaaaaggcacugaaaagauaguauuuuacagcuggaugacuagcauagccgaagcaaccaggacucucacaccugcauuugcauaaaauguauugugauaaccagcugucagcggagcuucccaggacuccacuguacacuuuucugagacuuuuuucuuuaaaaaucuucacguuuauugugaugugugugagugugugugcaugcacgucccagagcacauguguggcagucagaggaacaaccugugggagccaguucucucccugcacugucugaccagggacugaacucagaacaagcgguuuucccugaggcaccaucugggaagccaccacaccauuuuucguugcuguaguuacguucuuacugagccuuaccacuuuuguucucuaguaacucaaaguuacuacaaaacugacagaguaacccccagugcuuauuuacauuagucaucucuuuaacuuguaccaugggugaugauggcuaugacuaaagcacuuaaccgcaaugaagaaaagcuaguaccaucccugugucacagcaccaauuguaagcucaguuacccagaggacucagagugucagucucagaacugcagggcagggccaggccucuuuccacccacugagccgacuguaucugaguucuguaaccuugcauuauuaaugcugaguucuuguuaacucucuuugguuucuuccguuuccuuucuggucacuuguuugccauauagugcuggcuggucuagaacucagcucccucugccuuagccucccaagggcagggguuacaggcauguaccaacacacucagcugcuuaccucacuccuaaaugagugguuaaaauagcaacuuacaggauauaugagaaauuuauaucuacuuacaauuuuuauuauacaaaaauuaaaauuucuaaccaagauuccauuaauaugauuuuagugaguaggccgggguugccugccuauaaucccagcauucagcaggaaugagcaggaaggccacaaguucaaggucauccucagcuacauugcgggagcuguagagcagccuaggcuacagacccugucuuaaagggggaggagggaacccuuuuugaguacugaauuaaaaacuacaauguauuuuggcuuucccacuacagguguuugagaacuuaacagcuuacaguuaugauugggcaucuuaaguuuauauuccaagcugcuacaugugccugcauuggcuuccauuaguccauauaucucaguacugggcuucagaaaacaaaguuugcauuggccuuuauguuagcuucucucuaacucuuaugccugaaagaaagaacagaagggaggaaaggauuuuauuugggcuucagggugugcuuggacagaacucaucauaggaguauguggcagagaaaacuguuuauacauggaagagaggaaaagagaacguggggagaauacuggaaggauccuccacaagucuccgguggcuuacucccaugacuaggcuccuccccuuccuccucccucaacuucacucguggagagccuccacaguccagucgucucugggaaccccagcgaugcccugccuggcucugggaaccccagagaugcccugcccggcuguaugccucccucaucuccauguguuucucaguguagucaaaugggcaaaguuaaccugcacacuguccuuacguuuccagagagccugucccucugcaucccggagaccuagaagacccgucuagcugcuucacguucacaucuacaggugaguuuucaguggacuccacagaggugccucacucccaagagaagaaagccaaagucacacagcgguguuuaagccccauggacucucacuuccuacagcucccguucaguuuuuuccaccuacagugccaacauugccaaccaccucagauucuuugaaguaauguaaaugucacuuucucggaaacccuuagcucucaccauuauuaaaaaaaaaaaaaucacaaccuucccacacuuuccaguuccccugaccuuucccacuacauuacacaucauccuggaacguaucauguaacguacuaauucauguugcuagugugugccacggccugggaaauaaggcccaguagucuuucccuuucugacauaccuggguguuuagagccuuccugacacagagcaggugcuaaggaaauggucauugaauggcuggagucaaagggagaaucacaacucuccagaucauuucccgugauguacaaagugacucccauaaaaacaaaagagacagacagacugaaagaucagacucuguuuagaacucgcguggcucagacucagaaagggaaagaggaaugaaaauauuauagagagugacuuaaauuguagccaagaaacaaauuacaggaagcaaacuucauuaggaagacaaauuauagaaagcauauuagaugccuuaggaagcaagggcaagacaguaaacauaauuuaccucacagaagagaaaacaauugggaaagaaugaaacaaacaguuacucaaugaaaacauggcuauaaaucuggccugugcuaugugaaaagagcuucauuauagaggaauguuaauguaguuaaaacgugugugcauuugugugugcaggugugcauguguucguguguguguguguguguguguguguguguguguguguguguguaugugugagagaugagcccugaggucauccuugaguaucauuccccaggaugccguccaucuuacuuuagggaacagaguguuucaccugaaacucccaaguuaggcuagcuguuagcuggcagccccggggacccuuucucugcaugaccagugcugacauuuccagcuuaugcugccacaguuuaugguuuacgugagccccaaccaucaaacucaggcacucuuguuugcauaacacauauuuuaccaucggaguuauuucuccagcccuuugucaugguuacuuuaaugauuagugaggacacgagagcaauacucugucugauuggauuacucuaaaugagaauguuugccuucucacauauucugaauaccauagagcacuuuaaccccacucaguauccuuccaacucucaacaauugguguaaugcacauuaauaugaacaugguuguuacggcuuagcuagcugccuauuccugugauaaaacguggcuuacugaaagccacuugaagaagaaaggauuugguuuauaauucugcagcacaguccaucaucaaaggaacucagggcaggaacugaagcagagaccauggaggagcacagcuuacuggcuuuauccucauggcuggcuccaccugcuuucuuauaguacccagaaucacucucuguuauucgacgcguucucacgaccggccaggaagaacacaacaaccagaaucuucuacggcaaagcuuuauugcuuacaucuuauggggccagaguguaagaagcaagagagagcgaagcaagagagcgagaaaacgaaaccccuuuccucuuuaaagagaacaacaauugccuaggacgcaucacucccugauuggcugcagcccauggccgagcugacguucacgggaaaaacagaguacaaguagucguaaauacccuuggcucaugcgcagauuauuuguuuaccaacuuagaacacaggaugucagcgccaucuugugacggcgaaugugggggcggcuucccacaguucccccuuuucuauuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucuugaaagaugacaugucucccuagaauaggcucauauaugccgcagagcccuucuacugcagugcuuagccuugcaacucucucgggcugcugaagcacacucacucuaucucgugcaaugagucuagccucgugagauauaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccaauuuuuuaaagaaagaaaaugcugaggagauccaauuggguaauccuuuggucagcgacagguccaagcgcguggaguugaccugaagucucaauucucgaaggaucuguucaaauucagccauccaauucuguaacauauacugaaaaagacuuuuugacaaauuagcuguccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucucuguaucuugacauuagcugaggccuguuuaucuaugacuguagucacugaggcugacaaaguguuaauggugucagucaucuggaccuguccagacagaaccaaggcugucugaauuaaggccaaacccaguucuccuaguuagugguaaaaaagcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguacccaaaauggguugucuucauucugugggaaaacacagauagcuccccuggaucuuaucaaaauaggauccgggccauaccauuuauuaucaagaacauuuuuccauuuaaccaucucauugggccuaucuggcucugaacaaugacguucagccgcaguauggccaugagcaucaauauuuaaaaaauugaguguaaagagugccaaagacaccgacacucuuggugcucgggguacagucuccucaaaaguuccccucuucuguuuuauaagauaggcuuugagggugcgaugcgcacgcucaacaauacccuguccuugaggguuguacggaaguccagucagguggguuacguccaucugacggcagaacugcugaaauuuuugagacguauaagcugguccauuaucagucuuaaggagucuggguuucccccaagcacuccaugccucaagacaauguugaaucacaugugaggcuuuuucuccgguuaacggagaggcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuuaccacauaacaggaaucugacacaauauuaagggguucuaaaaagguuuuuaaaacuucuaagaccacuaaacauucuaccacuugcggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauuuugccacaaaacugcaguuggcaauugugcugucuuaaagacacacaaacugaaaggcugcgaauccucaauacguuguaauugugcauucuguaaggcuuuuuccaccuuuuguaaggccugguuagcagcuagaguaagaguccuaggggaggagauaugaggaucuccuucuaaaauacuaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguagaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuuguacauaaaguugacacauaguaggacuauuggacauucccugugguaagaccuuccauugauaccucuuaucagguuccaugugauuaauagaggggaugguaaaggcaaaucugggccuaucccuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagaggguucaauauggccuaguuuuaauuguuccucuaccaguugaaucacagcuucuaguuuuucagaggauaggugccauugaggaacccacacuggguccccuguuuuccaugguaugggucgugcugccccaauggccgcuaaggaaaacccagacccugucugucuugguuuccauuaggugagaugggcucuauccuucccuguucuugauguccuaacccuuuuccuucuuuauaacccaucuucgccaugauauuuuuugcuuuagcugaauacccuccugauggggcguuuucauuggacaaaauaaggcccaaaugcugcauaauaucccuuccccagagguuaaccgggagugggagcacauaagguaugaauuucccuugcugcccuucagaggauucccacgucaaggcaacggagcuuauagugggacaugauugauauccuaggcccuguaaugaaugagaugacucuguggugggccaugcuuugggccaccaauguguagaaauuauacuuuuaucugcuccgguaucaaggaugccuucaaacucuuuuccauuaaucuuaaggcggagcuuaggucuaucauuuaaagauacaaccaaauaggcagaaucauuuccugaggagcccauuuucuuuaucucagguccugcagauuucucccugguauuaucagggaggagcagcagcugagcuauccuaucuccuuuacuaauagaaaaaacgccuuuagggcuugagcacaggaccuguauuucaggggaauguugacaauccauaacuccaggguggacuacuaagcccugcaaggugagugaaccucggccgagaauaaggcccaugguucccgggggcaaggaugguauaggcuccaccggcaccggcugaauacucauuugaggcauuaauaggaagucggaggcggcacgcagguccacccuugugggucuuccugggucgucucucugacugcuuccuggguccugacaaaccgguucccauaucuuugagggcccugggaccgagggcccgaugacccguuuuuuggcacaucaguugauugacuaucaggugggggaaggacucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaauuaaaacauguccucugauuauuucugcucauggagcgguucugagauugaaggauggcagccgcuaaaccugcauugcugagaggucccccaagcucucgacagacccugagccagucuuguaagccuuuguucuuucuuggggcuauggccgcucggcacuccuuuguggcuugcucguagauuagcuguucuaugagaggcgcagcuugcucugacucuccaaaaauacgcucugcugccucugucauucuggccacaaaaucugagaaagauuccugaggucccuggauuauuuuuguuaacugaccagugguuucaccugcucgagagagcgccuuccaggcccuaauagccguggaagaaaucugggcauaagcuccccaaugguaguuugucugaucagcagaauaagcucccugacccguuaacaagucaaaaguccaaucucucugcucuggaguuaaagcagcagcguuugcucgguccugcgccugugcagccucucgccacagagaucuccauuucacauauuugcccauacuagggagagcggcuuuugcaaucauuugccagucggcaggaguuagugccaugcuggcgagccugucuaacugcaccaagguaaaauuagcauugguuccguauuuacgaaccgacucggcaauuuccuuaaucuguacguauucuaccggagcguggacacgcccacccucggcuccuucaaagaccggaaaugccuguuguauuuuccuuuguuccucucugggaaugaaugagucugcgcacugccucucugcgcacugccucucugcgcauugcugacgcacuacgggcugacgcacuacgcagggcggggacuccgcauagggcgggagugcaccugguagccgauugcccugaggccaauuagcaaacuggccuucgccagccgcuuuuggcuuuuuccuuaaaugacuaguuagcacuuuacuuggcggcugguauccuuuucuuucauaaugagccgcuuuuuucucccagucuguuucuucagagcacaggcuccuucuccuagagaccuccgcuaauugaucuuucuucuuuucccuuuuuccucuuuuucuucuaaucucucuccagguauuccuaccuaaccuuaacuuuuccucggguucaagacccuuggaaaggccuguauacuuauuuuguguaccauauuuccuuuuuguuccuacucucucuccccgcuuuacuucugauagcuuguccugaauuuccucuagaauuuucagcccuaucuuaaccacuauauaacaugugaaaaggaacaaaagggcuucuaacacuagaaaaaauucaaggccaaacauaacuuguaaagccauuuuccacuuuacuucugauagacugucuugaauuuccuuagaaaguucaagaucagacuuaccucguuccccagcugaaaaguucugaauucauacaguugaauccuucuuaacagucugcuuuacgggaaccuuuaucaccgucguuccccagcugaugaguucugaauucggcaguugaauccuucucaacagucuguuuuaugggaacacuuuaucaccgucguuccccagcugaugaguucugaauucggcaguugaauccuucucaacagucuguguuacgggaaccuuuauaaacgugauccgcaguucugguuccggaaugagggauccuccuugcgccagucccgaguuuuuuuuucucgucccggaauucggcaccaauuguuauucgacgcguucucacgaccggccaggaagaacacaacaaccagaaucuucuacggcaaagcuuuauugcuuacaucuuauggggccagaguguaagaagcaagagagagcgaagcaagagagcgagaaaacgaaaccccuuuccucuuuaaagagaacaacaauugccuaggacgcaucacucccugauuggcugcagcccauggccgagcugacguucacgggaaaaacagaguacaaguagucguaaauacccuuggcucaugcgcagauuauuuguuuaccaacuuagaacacaggaugucagcgccaucuugugacggcgaaugugggggcggcuucccacaacucuccaggggugacaucucccucagugagcuaggcccucccacaucagucaucaaucaagaaaaugcaccacaggcuuuucuacaggccagucugauggaggcauucucucaacugugguuccuuccucagaugaaucuagguugugucaaacugacaaaaaccauacaagauaggguuuuguuugguuuugcuuuguuuuguuauuugagguagguuucuuaugaagcccaagcuggccucaaacucacagaguucaacuugcuucugcuucccaagcucucagauuaaaggugugugccaccacaccuggcuuaggacagguuauuuguauuuuccuguuuaaucaauauucaccuugauaugcugacaucuugguucuuuacuuucuaacuaguauaauuuuacuuagugcuuuuaauguaugucugagggugguaaauuuucucaguuccugacauuguguauuucaucuucauuuugagggacuacugaguauagaauuccaggucaggauuucuucaccacucuaguaauguggguaacuuuccccacucaggguuucugcuauaucuaagaagucagcuguaaauuuaauggauaccuauuuaaauguuguagcugugauauuuuugccuuuuguuugcuugcuuguuuuagcaguucuuacccaauuagccauuuucuuucuaugaguagaacacaucugcugugugaagucaugugguuugaaucagcggaagucucaguugcauugucuggucucccucuguaccaguaaucuccuaguuacauuuuuuuucucuugguuuucuuuuuucuuuuuuucuuuuucguuucuuuccuuuuuuuuuuuuuuuuuuuuuuuuuaagauuuauuuaauguaugugaguacacucucgcugucuucagacacaccagaagagggcauuggaucccauuacagaucguugugagccaccaugugauugcugagaauugaacucaggaccucuggaagagcagucuuaaccucugagccaucucugcagccccucuugguuuucuaccaugucaucuuuucuucguacacccccaguuagguuuuauuauaugauacuggauucagacuuagaucgagacuaccuucuucuagacaaaauucacuuuuuguuuguauuuguagacagcuaagagauuugacaauuccaaaucaguuugaucaaaccgucaguggaucugauuugaagugagaccucuggauaucacgauucuguacauucucauuccuacagcaggguucaccagaggagcaagccaugaaaugcuuauauaacuauagacugauguacaugaucagaggcggggguccuacaaaggccaucugcaaguuaguaacagggaagaacaacugcuuagccuaagaaucuuugaagguucagcaagagaggcaaugcuucacccuguguggggcugaggccuggagacuugcuagaguguacacucaagggugaagaaucugggcccuggggucuccagguaacggcaguauccaaaccaaacccacccaugcagaacuaagcuaguacccaugggccaguuuuccguaccacugugugcuccagccggacuuugccccuggccaguccuacccauguauaagggaggccugccucguccaguuuguugaugucaaugccacuugucucagaaacucccucccacacaaacaacucagaaauggacucuaccaguuuucuagcagucucucaaucuaguuaacuaagauuaacuuaucauauaagguacaacccuuuuuaggacauaacuauuuaaaguucuaaccagaaacuuuagguauuuuccucccaacccugucauuggggguguuucuuuauuaagugcagugcacuguuuuuaacuaauuuuuuuuuuaccuuuguccuuacgcaauuuuagcaaguccaucugggaaaaugucagcuucucguuccuucaguucuucuccuaagaagucuccggugcacucccuccugacuagcucagcugaggaguccgugaacuccacaccacaguaucgcucuaccaagccuauucauucacccaccucugcaaaagguaagaaggacccgguauugccaaugggguuggcugguuucuuucuuucuuuuuuuauuagguauuuauuucauuuacauuuccaaugcuaucccaaaaguuccccacccgcuccccacccacucccccacucccccacucccacuucuuggcccuggcguuccccuguacugaggcagauaaaguuugcacgaccaaugggccucucuuuccacugauggccgacuaggccaucuucugauacauaugcagcuagagucaagagcuccgggguacugguuaguucauauuguuguuccaccuauaggguugcagaucucuuuagcuccuugguuacuuucucuagcuccuccauugggggcccugugauccauccaauagcugaccgugagcaucuacuucuguguuugcuaggccccagcauagucucacaagagacagcuauaucuggguccuuucagcaaaaucuugcuaguauaugcaauggugucagcguuuggaagcugauuaugggauggauccccggauauggcagucucuagaugguccauccuuucgucucagcuccaaacugugucucuguaacuccuuccauggguguuuuguucccaauucuaagaaggggcaaaguguccacacuuuggucuucguucuucuugaguuucauguguuaggaaauuguaucuuauauuuuuucuuaauccaggggauuguaggauucugcacacacugcccauauguagccugaaguuggugcuauuaaguaauaugguguuuaaauuagacagcuauuacagcauauacacacucaugccuuaguauaauaaaagcuuaacuauuguauauaaauacacuuuuacacuuuugugacaugaacaucgaaucuuuuucuuguuuuuuuguugcuguuauuuguugguuuaauaauuuuuauaauacuuugugucuaagugcugagacuuuccauucuugcucaguuaaaguaggauuuuccuucagccaacaucuuuucaaguauaaaugucugcuauacaaacucauuaaaaauuucaucaaaauuuuuaaguucagcuuuuguuuuauaaaaaaaauuaaaaaaauaauuugauuuggacuaagugccuuaaaauaugugaguugcauauaggucgaauuguacuugaaaugucuuccauucuauacagcagugaccaaaaccagcccaucauucccguugauaagaaauaagcugcacaagguguugggucauagucaaaacaucuuagucuuuugguauucuaugccauacauauuucuagauccuaaaaaaguauaaaaaucagaaccuaauccuauuugaguacauguuacucuuuacuguuaucugcaauauacucugaaucuuuugauucuaagcucuuuguggccuuagucaggccacagaaagcaggucuccaaaguccaaagccuucucuccauacauaguaaaccacaagcucuccauggcuaccuaauuacccaguucaugaccgcaucgcgauaccccgucuguggcuacaucguaauagcccaugugaaagaaagcaaacucagcacacacgcguaagaaucagcugugaccgguccagagugauggcgagaggagcggcagugccuguaacugcacagggauagggcacgucccccauucgcagguccucaccacgcaucaugcuacauauuacuuuuguucaaagauuccuaaucuauccuaacuuugaagaagucuuaagauuuguucuaagauacugcugcucauccucuugaacugaaaaacauuuagacaauuaucuuuaauuuacaaugaaaagguacuuuggaauaaaaaguaagucaauaaaaauguuuucaaaauuauucaucuaguugggggcugagauccauuugcuagccaaguauuuucagaaacugacagaacuucacacacuuaguagagacagcuuucgugccucugggcccuugucaguugcugccauagcauuguagggucauuaugcugugucagcaugcauacagcccuuucccaccacauagaccauccacacccaggugacaggcacacaccgagaagcccccaauuagaaacuacucagguuuggugucuagcugacccauauagucuaucgcuaacuucuucccaugaguuuguuuaauacuauguaauugaaucauaguaaaucaaauugauuucaaacaaaaccaaauaagcuaguauugcucuauuuaagugggaaacauuuuuauuuuaaaauaguguuuuaaauuuuucauaagaaaaguuguuugacuugucauuugaagauuuacaaaauaaauauugaauagacuuuuaauaucacaucuaagcaauuuucuaauagauucacagucuccgucauuagaaacaacaggaaaaacaugccaaaaacugcagaacagacuggaaaguuugcaaacccugguagaagauuuacagcugaagaaccaagguacaguauacagagcagucuggggaguuagcucagugauagaguacuugccuagcuaacgaaagcccuggguucaguccccagcaauaggggggaaacucacagaaagauauauacaugcgugcacacacaagaaauauuuuucuaacaacaaacauuugaacaaugaauguaagcauguuacuaauacucaguggcauccacuaagaacucacucacuguuauucgucuucaugccgccuucacagcagcaugggaguguggggccugaugacacaguaagucccaugucacauagugaacgggauagcugaggcuugauccuugcaauuucugaugcuaaagucaauauccuuuaacacacuuuguacaucacuuuacuguuuaagaaaaucucaaguaaauuguguuagcccagcucucucugagcagugagaaaacauuuugcacugcucauauuauugugaguuuuggguuuucuuuuucuuuuuuuuuuuuuuaaaaaaaaacauagauugguuuuuggucccacuuacacccacacuuucuaagucccuccugcuuaugccaucccagcggugucuauauggaagacaugcggcaucuguuuaauaggaacagugccuugggccagaugcaaugccuggcaagauggugcuugaggucugaacaaauauuuuuggaguuuuuuggacagaauuuaucaaaauuuaaacuacagggcuguagguagagcuugauauuaagagacugccuagcccccaauggaggagcuagagaaaguacccaaggagcugaagggaucugcaacccuauagguggaacaacaauaugaacuaaccaguacccuggagcucgugucucuagcugccuauguagcagaagauggccuagucagccaucauugggaagagaggccccuuggucuugcaaacuuuauaugccccaguacaggggaacaucagggucaugaagugagaguggguggguaggggagugggggaggguaugggggacuuuugggauagcauuugaaauguaaauaaagaaaacaccuaauaaaaauauauauaaaaagagagagagagagagagccuagcaugugcaggaguguggguugaguccccagcucaagcagaagccaaaaccauacaccuauugugugcaugcgcacaagagcacagagaaauuccccaaacuacuugcaguaaucaaguuuggucccagagauggaaggacaggcggcuucccucugggacccuccugaggugcuuggcuuauaucccuguuaucugucccgcuuccaggaggcuguuacaguuguuacaaaagggcgcugcauugaagucuuaaugcgucucagggucugaccugcaggcuaacagcucauccuugaagaggagugugaagggguuucaaaccugaguugacuuuacaaucuaacuuuguuuuauugauauuucagcaaugucuucaaugaucagaaaucaagaaaagaggauucagaaagugaaagaccaggaaaaaauguuacuaaaaugaugcguugcuugcccgcucucuacagagggcugacacccgauuaauugugguguuacuuauaauuagugcccugugaacuuuuuucuuuuuaugugaauuuuaauaaaagauacccugaccuguauacucuauuuugaaauaaacuuccugaaugcucucacaguaaaacuuguaacauuaccaguuagauuugagaguauucauauauuauaauauauuaauuuaugcuaaugcuagcauguugguauaauuguuuuaaauuauuuuacugguucuaagauagcagaguuaauuuuucccccugcuuuaacaaauucuggguuucaggagugggggaacguguucagaugguguaagaggcgcagagccaagaacagaaggacaaacuccagcaugcuggacaaacaccaggcuuuauuagugaccuugcgcucacuguucugucaauaucaauaaucaacaaa

SEQ ID NO: 2534 - RNA, 3613 nt, Mus musculus
ugguugauuuuuauuuauucuaauauggcuucauugauguauaaguucuuuuuuauuuuuauuuuuuuuccuuuuuggugucuugcauaugcuaggcaagggcucuaccacugagcuaugcucccagcccaaacauguuucauaauauauuuuuauuugauauguauaguuguuuugucaacauguaugucucugaaucucauguaauggcugccaacgcuaaaagaaggagccagaucucuugggaucugagcuacagauagcugugagccaccaugugagugcugagaauugaacccagguccuuuggaagagcagcuggugcuguuaacugcugagccaccucuccagccccuuauaguaaauuauuagagcaguuuuaagcucauaacaaaauugaaguuacagagaugucccaaacuccccaguccccacacaagcaaguuagacucuucuauuauuaacacaaacagguguguuugguuuuuuuuuuuaaggcugauuucugguguaugaagggccaauauugagauuuuucucuccucaacucagaggagcuuacaacuauacaaaggucucacucuucugaagacacacugaggguggcuuuggugauggaauucagccuuaaggcccuccuguggcuuaagacuucccgcuucccucucccuuggccgggccuuucucccuagccagcucucucucaccagucucuucuggcucuaacuucuuuuuccccuguggauuucuccauucagcuguguguuuagcuucuccccacaaacaaaucgucccuacuaucgucgagacuccaggaagguugccagagucuagcuuuugacuccuuaaaaaggaaagauauuaacuaaaauccuacgccugugugagcuccccaagucccccagccuuccacaugccuguuugcuuacuaagcuuuucucgguuuccccacgagcauccacaacggacagaaaacucucuccucugucccucucccuucccuucuucauuuccaccccccccccccaccuccccgguaucauuucuuggccugugcaaauugucaguuacagcacagcaagucacaucagcauucugccugugcccaaggccacccucuucuucugguuagccugggugauuaauuagaggcacauaagggcuacagcauugggcaauuaguccuaguagugacacagccccgaaaaaggcccuuuuuacccacccuuccaaaaacggaaccucuugcauaagaguggauuuauaagccgagcccugugucugugaguccacuaaaccaccccucagcggacugacugcuuugucuccuguucuucccagcucuucgaccagugaccucuccaacuacgaccaugcuuaucugaggcggagcccugaccagugcagcucccaggggagcauggaaagccuggagcccaguggcggauacccacccugccaucuccuuucuccugccaaguccacgagcagcaucgaccagcuaggccaccuucauaacaaaagggacuccgcauauagcuccuucuccaccaguucgagcaucuucgaguacccacccccugguggcucugcccgagaacguucggguuccauggacgugauuucugcccgggguggccuccuagaagggaugaggcaggcagacauccgcuacgucaagacggucuaugauacccggagaggaguaucuucagaguaugaggugaacccuucagccuugcuccuucaagguagggaugcccaugccucagccgacagucagggcugugcuaaauggcacagcauuccucggggcaagggaacgccuuccccgucuuggagccagcaguguucugguucccuggagacugcuacugacaaccugccccagaaggcaggcgcaccccugccccccacccgcagugauagcuaugcagccuuccgccaucgcgagcgucccagcuccugguccagccuugaucagaaaagguucugccggccucagacaaacucuucaggcucccagaaaaccccauucgcugaggaccagcugcauacagucccagagaggaguccagagaacagccccccagugaaaucuaagcauaauuauacccagaaggcgcagccuggccaaccucugcugcccacuggcaucuauccgguaccuucuccggagccucacuuugcccaggugccccagcccucugugaguaguaauggcaccgucuacccugcgcuagucaaagagaguggauacacagcugcucagggaaccuguaacaagauggcuaccuuagaugagaacgggaaucaaaaugaagcuagcaggccuggguuugccuucugucagccccuagaacacaacucggugacuccgguggagaaaaggccagaacccacggccaaauacaucuacaaaguccauuuuucuucagugccugaaaaugaagacuccucccuaaagaggcacaucacaccuccccacggccauaguccauaucccagcgagagaaagaacauccacgguggcagcagagcguguuccaaucaccacagucucucguccccccaggcccaggcccugcacgugggugaugacaggaggccuuccaggcucucucagcccugggagggugacuuucaggaagaucacaaugccaaccucaggcagaaaguggagagggagggccaaggccagggccugucgggcaacucuggcaggaccagaucggccuucucaucucugcagaauauuccagagagucugagaagacaaagcaacguggagcuuggagaagcccaggagguucaccccgggggcagguccaagguggaggacccuggaaggaaagcaggggcuucagacaucaggggcuaccuggacagaucuguuuccuauccgaggcccgaggggaaaaugaacgccguagacuccguccacagugcagacuccagguaugaggaguccccggccccagcgcugccacagacauccggugcgagccagcggcggcucagcuccagcagcuccgccgccccgcaguacaggaagccccauugcuccgugcuggagaagguuucuagaauagaggaacgagagcaggggcgccacagaccccugagcgugggcagcucugcauacggccccggcuacaggccugggaggaccggcccgacccccaguacuuccagcagugaccucgacgauccaaaagccggcagcguccauuucucggaguccacugaacaccugcgcaauggggagcagaaccccccaaacggggaggcuaagcaggaagaggcuucccggccccagugcagccauuugauccggagggccccugcggacggccguggaccuccugcccgaggcggcgagcccucaaggccggaggcccgccugcuccgcagccagagcaccuuucagcucuacagugaggcggagagggaagccucguggucagaggacaggcccgguaccccugagucgccccugcucgaugcgccuuucagccgcgccuacagaaacagcaucaaggaugcccagucccgcguccugggggccacgucguuucgucgccgagaccuggaaccgggcacccccgccacc

SEQ ID NO: 2535 - RNA, 2364 nt, Mus musculus
ugcagagagauccccagccccagccgagcagacgaacgcagcaggugaaccgugauccuggucagcugauaagaugauacgcuuugaagucagccaccuuccuuccuguggcuuucuuccgucccauuaaagcguccugugccgggacacugcccgacacucccccuguugcaacacgugcugggguccgcguaaaagccuaggcgcggaggucccaaccccgagcugccacgcgcugcgcggagccggcaccuggggcugcuaugggguggggcagggaggcuaggggaccgcagggugcagagguuguaccucuggaaaauugaccuggugacacgccccacccggaggagcccucuuagaaggugcgguggguaacuuacuagggccgagcgcgccccacgaggaaagaauugccggucugcugggccuuccaucagaaaggagacuaaaccagcugcuggaagccgucgcuguggugugcggccgggcuggggaccgcuuuuccagaaaaagaggaccuagucgugaacgacccaaccaccgcugcuggggacagggaaauuaauuaauuaauuaaaaaaacuugagugcucgcuggaaaaauuaagccguuugugagcuugcuccagagcuuuucccaccgugucacacuggagagguuacuggugcgaagaggucaguggacgugauauuggaucccggagacagaccggaugacccagggcccggaggcgugcaagcucaauccuggcugcgggguguggugcacagcgaaggcgagaagcgggugacaagugggugcgacucacagcacagggaacugggagggcuccuccaccacuaagaaggacuuccccccacccccacccccagcagauguuggaauaauuacagugucugaguggcaggcgaaauggcgggguccuuguacauacaucugacauaggcuuaacagggagaaguguaaugcgcuguggguguccacgcaugguagacccacgaucacgugaggauagcuacucacgugaguugaggaaaguaggugacuugaagcgcaggggaagaggcaagggaagggcuguauuuagcccacaugaacgcgcccacggggcaggggcguggggggagaacuagggcgggcaucugagagucauaccugagacuucaaacauccaaguuucugggaacccacuuuuggcuacgggauucagaugcucucuguccagucuuuggcugaggguaagugacuagcacugguucaccaguagcugaucugaugcugggcugcucugguaggugagugaggagcuagaagcugccuagagugaauuccacccuuggcgguggaaccuagggaagaguguguugaaagaggaaggcucugauguaaagccagauucuggcucacucagaccugaacagcacuaacuuguucugauuacucccuguucuauagagaagaugucuuuugagaauagggaccucauuuacaccguuacacagugucgaguuuguaagaugucacucgagugcuccgcaagagcucucaaaaacaagaauuaccuuuccucugugacucuaaugcagugcuuucuuguucuucgguuggggguggggggugggggugcgaauaauuucuuauucaaacuuaaaccuuuuaagauuaaaaggagaggcccggugcuauauauaaccucagaugacaacaggcaggaacugugacuuacuuucaccccagccauuguugcagaugaaccaggccguuaagagguugucauaguaauauucaucucucaauagacuaugaacucaagaguucuugccuuuuggcuucuagcacacaccguacauguugaacaggacuguccuccaagccaaacaacugucaucuuggugcaaaugaacaucccagcuguggcuacugacuguuuaucucacucagagaggggagugaggcucaggagccccacacuggguauccagucacuuacuaccacgcuuucuaugugcaucugccuuccuugcauguggccuccaggaaaggcuagaguguauauaggcugagaagcuaggagaguggggauccaucugugugacuaguggaaagccuucaucccugcugggucauguuaguuuucaguguggccucuaagaaaagagcacuuacccuucacuaaguaaccccucaccugugauccaaggaaguccaaugaacucacugcuuuccagagugaacuucgguugcguggugccucgguuugucuguggaccuuaggaggaaggguagaugcugcuaaugccuccccuagggaggaauuugagcaacauuugcaauauucaauaaaguugaaugaucaauac

SEQ ID NO: 2536 - RNA, 3173 nt, Mus musculus
ccagauggacagcucccaguugauccacugucgggagcugguggcauaucaccuuucugcucugcagucugcccugccucuaaauuccguuuaugucuaccguccccucaagcacacccugguaaccugugacaaaggagcauucaaauuacaucccuccucugucucaggcccagauuucuccaaggacaacagcaagccagaagugccaguccgagguccagcagccuuccaccugcaucuccccgcugccagugggugcaagcaaaccucugcuaaacggaaaguggaggagauggagguggaugacuucuacgaugggaucaagcggcucuauaaugaggacaaugguccugagaauguggguucuguauguggcacugauuuaucaaggcaagagggccaugcuucccccuguccaccuuugcagccuguuucugucauguaguuucaggugucagcuuccagugcacacgaaggcugacuacucggggugagacuagaaacccagggaaggcuguggagaaggcaugugcuuuaucagacugacugaagugagccaggaaaaaaagaaaaccacucuuaaucuuucgugcgguuacuuacaauccaacguaauuuaauauaaaggcuauauuuguagacucaagauccaaaauauauuuaaaaguaaagcaaaaguucuuuguacuaugucaguuccaccauuguuaaauaaguuugccccaugucaaaaaaaaauguuuagcggaaaguugcaaacucucagcuaggaaccuuguuccaguguccuuauuuuccucuugccuuuucuugccucgguugaauacuuaacuaagcugugugcuuguugaucuauguauucugacuucacuugaguaccacccaccuuuucuuuuaaaguaauucaguaaguaaauuauuuuuguguggcagccauguuuaauccacaguucaaguauguuaguuugaaaagggcacuuugaagcuauccccaugaaucaguggcaguaggaaaaguucucuuuuuuugugucucauuucaguuuuuaguuuaaaauuauuauuguccuuuuuuuguuuaucuugaagcucaauaaaauggcacguaauuaggacauuuuaagcauuuuugacauuuauauaaaagaauuucugauaagguuaauauauccaggugcucaccaaagaaacauguauguaauauacacguagauuuuuguaacugaucuguucuugcucauuuauaauccguagaagcaacugucuagauacuggggcagcccugauuugagucuguaacuuauaauuuaauucauuacccuaguuucauauuaugccauuaggauuuucuugauaaggaauuauucccuuguuucucucugagcaaugucuggacccugagcucccuuugcagucugaaggcacugcagucagaaccauguacugcugauaaagccucugguagcaauaaaauguuguccuuaacguugguuuguguaggaguuuuuguuggucuguuuugcugaugagaagguaugguuucugacuucuuggacacuuuguuuucaacuaaggaaaccagcaaggagccuaagcacaagcuuagacaggguguuggguguccucucccauuccugauuuuaauggggcuuauuaaugguuuuauucauuuaggauauuggccaugaguuugucauacauaaccuuuauuauguuggaauauguuuccuacaguccuacuuguucuagggcuuuuauucagaaugcauguugaagccggacagugguggcucacgccuuuaaucccagcacucaggaggcaaaggcaggcggauuucugaguacagagugaguuccaggacagccaggacuucgaaaaacaaacagaaaagaaugcauguugaaucuuaaaaaaaaaaaaaaaaaaaauuuaaaaagauggaggggguugacugcaaguuucacauuuguaguauuuucuuccugugggcuagagaccuuacaaccaacugggauugcuuaugagggagggcaggcuccagcuuacagauaaggaauuuuauucuuagcucauugauuuuuaaguuuaacagcaagaguauuuucagaucacuaacauuuagaaaguuguagaagacuuuaacugcuaaauuucuaugaccuugaaaauccaauuggaguaagcauuaagugugcaaggaugggguuugggagagccaugaacaaaggguuguaugcaaaggauuggccucacacagguauguauuuuuauaaaaaucacacguccucauuaucuuucuugacauuaauuaugggagcuuuggguucacaguucaauguguucauaaugugugugauaugaaugggacaccacacacacacaaaccuacacaugcacuuagaugcacaucugaucuauaauacagacgauccagacugcagaaguuggagacaacaggacuuuagcugcuccaucuugagguuccuuaaugcugauggugaacuggugcuggcaugcaucugugguccuagcuacuaaagagacuaagacaagaagacugcuuuagcccaggaagucugggcaguagugagaccucuagagugaggcuggaugacccagguucaaaucccagcacccacauggugguucacaaccaacugugauuccaauuccagaaaccauaguaccaucgcuuuacugggccuauacauacaugcaagcaaggcaccuacaugaauaaaaauaacaaacuuuagagcagaguauguuuggguuguucuuuugauuugggucagugguaauuaauacuuaauagcugcuguccuuucagcuaaaucuaguaaauauccagagcccucggcauuuuucaaaaccagccugagacugaaauagcaaacacugaacacuguagagccucgaugaagaguauuccugcauuaagaauauuccugaugcucacuuaguuccuugggguaauuguugccuccuggugguuaaaaggugcaucauucuugggcucuccagaaaguucaaaggaugggcuuaguaacuaauccaccaaaagcaaaacaggacuaugauauauucacaagugagaugagaaacucuccauccucugaaagcugggcaaguugguuauuggcaaacaagaugcuuucucuaccagagg

SEQ ID NO: 2537 - RNA, 24561 nt, Mus musculus
guuaaggacaacauuuuauugcuaccagaggcuuuaucagcaguacaugguucugacugcagugccuucagacugcaaagggagcucaggguccagacauugcucagagagaaacaagggaauaauuccuuaucaagaaaauccuaauggcauaauaugaaacuaggguaaugaauuaaauuauaaguuacagacucaaaucagggcugccccaguaucuagacaguugcuucuacggauuauaaaugagcaagaacagaucaguuacaaaaaucuacguguauauuacauacauguuucuuuggugagcaccuggauauauuaaccuuaucagaaauucuuuuauauaaaugucaaaaaugcuuaaaauguccuaauuacgugccauuuuauugagcuucaagauaaacaaaaaaaggacaauaauaauuuuaaacuaaaaacugaaaugagacacaaaaaaagagaacuuuuccuacugccacugauucauggggauagcuucaaagugcccuuuucaaacuaacauacuugaacuguggauuaaacauggcugccacacaaaaauaauuuacuuacugaauuacuuuaaaagaaaaggugggugguacucaagugaagucagaauacauagaucaacaagcacacagcuuaguuaaguauucaaccgaggcaagaaaaggcaagaggaaaauaaggacacuggaacaagguuccuagcugagaguuugcaacuuuccgcuaaacauuuuuuuuugacauggggcaaacuuauuuaacaaugguggaacugacauaguacaaagaacuuuugcuuuacuuuuaaauauauuuuggaucuugagucuacaaauauagccuuuauauuaaauuacguuggauuguaaguaaccgcacgaaagauuaagagugguuuucuuuuuuuccuggcucacuucagucagucugauaaagcacaugccuucuccacagccuucccuggguuucuagucucaccccgaguagucagccuucgugugcacuggaagcugacaccugaaacuacaugacagaaacaggcugcaaagguggacagggggaagcauggcccucuugccuugauaaaucagugccacauacagaacccacauucucaggaccauuguccucauuauagagccgcuugaucccaucguagaagucauccaccuccaucuccuccacuuuccguuuagcagagguuugcuugcacccacuggcagcggggagaugcagguggaaggcugcuggaccucggacuggcacuucuggcuugcuguuguccuuggagaaaucugggccugagacagaggagggauguaauuugaaugcuccuuugucacagguuaccagggugugcuugaggggacgguagacauaaacggaauuuagaggcagggcagacugcagagcagaaaggugauaugccaccagcucccgacaguggaucaacugggagcuguccaucuggaucaaggaaagaaacaaaaccacacuggucaguaacauggcccacuguucccuuuacugccacuggccucacccuggaccuucucucccuucagcuugcuuuccuccgccacacccuccaccccacugauuacucuaccuacagagccuucuucugaaauacgugcacaugcuugcgcuuccaacauacaucugguuuugugugugagcacucacaugaaggcagaacuugucuuuguccauugcuuuauuagcaaugucugcuuucuucugucuaugccuccugucuauaaggccagucccuauucucuugcccucuucuaacuucuccggugaaggccaaaaucaagaaaggcacggagcagccaucaacuauuuaaggaagagucaaaagcaacggaaaacauuaagcuagggauaauggggaagcuuguuuagcuaauuuuuuauuuuauuuuaaguaucauguuacaaaacaauugcaaauguuaagcaagcauauuuuuguagaaaauaguuaacaaaacuacauaguuugggaauugguauuuuuuuccuuauccuuuggaauaguucagguauuaauccauucuggaguaacacacauuugauccccucaaccucuugagcaauuccauggucauauguuucuguuucaauaugcccucaguuaagcaaucaaucaaucaaucacaaccauccagguaacaaaucuacccuugcaucugccgacuucaagacucaaguuuuaggcauuaugucuuagccauugcuuucauucucuaugagucacaacccuuuggggguuggguccuuucauaaggguugccuaaaaccauuagaaaacacauauguuuacauuagaguucauaacaguagcaaaauuacaguuaugaaguagcaaugaaaauaauuguaugguugggucaccacaacaugagaaauuuuacuaaaggguuguagcauuacaaagcauuugagaaccacugcuuuauaucaaauauuaauaacuacagugaaaggccuucaaaguuuuccuagcagguaucugccuuacuuuuaacuuguagcacugagugaccuucucugucacuauccacuucucuucuagucaacauuucuucagcagcauggcagugucuucagaguaagccaaauacucucugguguaacauggacaaggcucucuauaacucucauaacugcacuucccaguguaucccauacugacaguuuacacuccuggcauaggccuagucuacguaaugcgcacuggccccucugccacugugccuugcauaccugccucugcauacucaaacuguugcccuuucccuccaggaugcuccugggccacguaggcacgggaagcacuucccuauuggaugugcacucccuugacgcucccuuuccgcaucuuuccuuccuguuucuagcugggagcucaggcugguuuucauucuuggcccuugcaccucagccucccaggugcuggcacuagggguguguaccaucacaccaagcucauuuuggacauuucuuacccacauuuuacccaucccacagaccgaaguacacagcagaacuauuuguaauacuaugaagaaguaaguaccacucuacaaguacacauuuugucacaaaauuagcucaucucuaaauguauucacuauguugaucaggaaagaaucaaugggaaaaacauaaauguacaguuacaugaaacuaucagaauacuuaaaucaagacuuuggcauccgccauuucccccuuuuuaaaauacuuuagaagacacuacaguaguaagacaucaaguaucagaauuuauuuuauugaaaagccauuuuaauagucccuaauuuuguuugugcaugcauucaugcaugcuuaugaugugugaguggacacgugugccauagcacacacauggagguaccccuuccaccuuacagguggcuaggugugauguggacuagaucuaauuauuagcccagcgaugaagaccccugcuaaaaacuauaacauguaagaaguggaguuuccaauauuucaagcagaauacaaaagagaaccaauaaacagagaaaaggcuuugaagacauuuggcauccaagaagaggaaaagugccacaaauucacuggucaugauccugaacaugcguuuaaaagaaaugcucacuaugaucucugauggugaaaaagagaaaugagaguuauuauuuggagguaaagacuaucaaaaaauaguaaggcauuauaaaauauuaaaaauacuuuccauuggaguuucaaaacaaacucuguccaaaauaaacccuaaucuaguacaauaugaacucgaucuugaaaaguaacaagccacccccaccccaccgcuucuguaguaaagugcacuuguuuaggugcaugcacuacgauuaccagcucuagaugcacacaaguccuugaucuugcgcuuaaaauuuaagcauuuuaaaugaaccauuuuuuuguuuauuuacuuaucucacuuauuaugagaaucaagagaaccuuuacuggccauccuuauaacuaucuugcccaaauuucaauauaguaaucauugcuaagugaucuuaucaaaaacagcaacaacaaguugcuaaccauuuaguugaccaggagacugugucaagcagcaauaaaauaaggccacacauagauuuccaaugaagagggugaagagaaugacaugauacacgugacagaucccagaggacccacauauggugagcaggguaaaauccugaaaauaccuguuagaauauuaggcaccuuucaagguaaccaagaguccaugguaggaggguaugcguuuuaauucucuacuuuaguuuuauuuaagaacaucuacuuugaccacugacuagcaggcagcuaggaagaccacaauagaaucuauacccugacaaucagggugggucacuacaguuaagaaagcaaaggacaugaacacagccauauaaauaaacuccaggaagggagggguaaugagaaaggugcagccguccuacuguggagaucaacaguggcacagaagaauuggcauaggcuggguaggaaagcucucaaaccagagaauauguaccaaguacaaaagaugcacaggcagagcuaagacagaacaaagugcaucaagaauggggguguaacucaaugguacaaaacuugcuuaccaugugcaaagcccuagauuugaucccagcaccaggggcagcaggagggggcaauacuggcaugaucugauacaaagcuucugauacuagaaccuaccccaagucgaagucuugccauagguuuacuuacaaagaaacaagaccuuauauucugaucuaaaucaacacaggugagccuagcaaggacaggaaccaugcccagaagaacuagcagccauccuugggucccaaagguugcuccccaugcuugcaacaacuucacccaccaauccaauucuccagccugcucuagacucuuuaagguuuguguguuaucaaaaagagaagaguuggagauggcucugugguuaagagcacaaacugcucuugcagaggacacaaguucaaaucccagcacccacaccagguagcucacggcauguacagaguaaucaaaccaccacugacucuuucuagucuucacaaccgaggaguucuaugucacucuaaugaacucucaaauucccuagacugaaacucuaauucaugaguaaaaugauuucugagauccuguacagcuaaggaaaaaauaaaauuaaacaaauuucucugagcaucagaauguauacaaagaaaaucaacuccuagagcugugcaguagagaagggaaagaaagcucaucagucucuauggaugucagguugcaaaucuaaacuugauuucucugagguaguuacuaacaaacagcacgacuacuuuaucacaucugcuaucuaauguuuucauuaaauugagguagcauuugaagaugccaguuacaaacugauuuuuuuuuuuuuuuuuuuuuuuuuuugcuaaagucagggccuucucuaucaugaacuaacucucccaccccucuucucaguuuuauuuaaaaccauagaguagcccucucaauucaaccaagggaaaaaauaguggaaugaacaaaagucaagcuugauaccugugcuuucugaagcaguucaaucguaagaggaagccaaucaggaaugaguuucuccauuuccagacuaaccauggccagagcaagcauggacccuuugaacugcagaaguugguugcaggccauacagugaagcagcugcuuggucaggacugccaaauguugagaugggcucaauuugggcaaacugaaaaguaacugaggccuagcugacaccgcaauggcauggaacuggagguuugggggagaaaacacaaaauuguuacuuaaggaaaauaucuaagaaaguauacacagaaauaacaucucagguacgaugcaaguuuguaacuuuuaucuguggugauuugauacauuuucagagucuaauuuuuuccuugacuaacuuuaauaguuuccccuaaauccauaggaagaggcaaccucuguccaaguuacuggacuaggacuuuguauuccaaguaagaacuaaaacauuuuagauauacuuacaaugugaagaaaauccaaugguguagccgugugaagaucccaauucaauuuauccagaauaauucucuccauucucaaaaucucagaugaggaacauccacagaaacugucucuugccaauaccuuuagcacuggaauuuucuauccaaggcaaaaggaguaagaaacaaggucagaaauguaaauagagaaaaauaauauuaaaaaaccaaaaugaacuggagagguggcucagucgcuaagagcagggcugcuuuucccaggccuaaguucaauucucaacuacauggcaacucacaacugucuuuauaccagucccagggaaaccaaugccguucugacuugugugcaccaggcaugcaugcaguguacuuacauacacuggggcaaaacacuaaaaaucaggaggcagaggcaggcaggcaguuguaggagagccuggucuaccaagcaaguucuaggacaaccagggcuacccgaagaaguccugucuuaaauaaauaaauaaauaaaucuuucaaagagacagcugaucuuccaaagaagcauauuagaggauuaaugcaucaaaaacacuuaacuaaaauuggaguuuuaaagacagcauucauuuuuaagccucucaaggcucaaguagccuggcccugccccuauauacucuuuaaugguuguuuccagccccucaaggugcaggcacccaaauuacacccuacagagaaaaagagcccaagaucaggccaaagaauucuaccauuccagaccaucccacaaaccaucucccacaguucuaaggagcccuauauacagucugucuccugcucaguucuuugcuguuucucuccugagcacaggcggcuggccuccuaugucuuucccaaucucucaugugaggcuuguuguguggugugacucuaugguauuucuuggcuccugacuaccaggagaccuuuacucucagagcugaacauuuacauauuuaguaauaaagguuucauuaaaaacaaacaaaaaaagccuccaagugaaccaaccaaaccuaaagaauaaaccuugaaaggauuccuuaccucaucuuccucaacagucuuagcagccagaaaaaaacagcugauugcaauacaauucaaauauuuuggaugggccuaaaauuuuaaaaagaaaaaaaaagacauuaaugauuauuuugaauuaagcucuuuguuuuuaaaaucuaaacauacauuuaaguuuacaauucuccuaguuuacaucuucuuaggcacaaaaauaaguuucuuuucuguucauuuauaccagucauugaauaagugcuaugcaaaacucugaacuuacugagucacuuccaaaauuuuaaaacaaaagaaauaauguccucacaaaauccuacaucuacugucaugacaacacauuuacuaguagccugugguuuaacacaaaagucacugaaaaagaugcuguguuugaaugugucuuacaauacuuacuuuuacuguagcuaaaaaccuauccaaaagacugcuugccagagcaaauguuucuggauagagguugaacugguauuugaguuuggccaaccauugaauuacuucaucucucugggauggagaaacauucuagaaggaaauaauuaaaaaauaagagaucacaaaguuucaguuaucguuuagagcucucuaaauacagggcugacagacagcucagcagggaacagcacuugcugccaagcuuggugaccugaguucacucacugagacucacacggucaaaggagagaaacaacucuuacaaguuuccucugaccuccaacaugugcuauggcacaugcaugcccacauacacaaaguaaauacacguacauauuuuuaaauguuaggaaauaaaacaaaaaugcauuaauaguuaaaauguuugaagaucauucaaaaaccacacuugagauagaugaaaauuuuauauaccauaucacauuuaguaucaucugauacuuuacuauaaaucuucacuauucauuucaccaaauaucuacaauuugaauuaaauucagauauuuaggaaacaaaacauuuuaaaaauuacuacuaaucgauaauuuaaguuuuccuaacuuuuaagaaagaaguaacuucugagccagaaaauauccauuagcuuaucuuaggaaauauaaauaggcugugaaauaucaauauuuaguaguauccuaaaaaaaaaaaaaaaaaaaaaaaaaagagguugaggaucgucugugaaaugaaacagaaggauuauuucuuuaaaaacaacaauaaaaagcauuuuaauuuaccuaaauaguauuuugaacuuuuggguaaaggcuuaaguuuuaagauaugugucuguguguauuuuuuaaauagcaggcauuuuacuuuuauuugauuuucaguuguggcugaacuguuaguauacuacuaaugcuaaaugaaagauccuuuugaggacuacuuauacggccauacguagcccaggcuugccucaaacucacuauguaguugagggugaccuuaaaaugaggacccuccugccugcccuccaccucucaggugcuggggugcagcggugcacuagcaugcccagguuacacagugcuugggauguuagagcuucuacauggacacaaacuaccugcugagacccauguccuagccccuuacgccacaccgugucauguaacacaauggaguacaaaauuacuugaaugauacuaacuuaucuuuaugaaguauagugcagugaucaugggacccuuuuccugauuaaugccaaccuaagcuaauucuuuuauccuacaaaaaaccuaacagcuauuaaaauaaacguucaaugacuguaucuaugguauagcuccucaaacaggaauucuagcuacaacuguucuugguuugcucuagaguuccaggauugacuauugcucaucacaucccugccccugccacugugacuucuguugugaguccuccuugcugucaucugcuugucagcugugacacgacaaaguguucuuccucauuagccacaccaagaugcuuacauaauuccuauaccuaguucuaaacuugguuauuaacagguauuuuuaguggggaauuaacauacaccuaccuucuguucaacccuuugggaacgucacagugaugaauagaaauacuaguaagauacaggugauuuacaaucuauacuuacucacuacaaaguugauaaaugaguaaaaguuguuuacccuuccaaacuuaagucuuacagucagacagaccauaaaaagguguuaaaccaaaccagaguuaccugguuuaauagcuggugugggaguaaugaaaucuuagaagaaacagcaacuaaguaguguguuaaaaaagaaagagguuggggaucauaugugcuacuagaaaaaaagucuuaguguuuaagcacauagacuuuccuauggaggacagagaugauuucaaacccaggacaguaacauaguuaagcucuucagaagaacagucaagauuaagaucgguagagacucccaggaacuguuguccagagaaucaauccuagaauuuuaugaucaaacaucaaaaaaaaaagacuuaaggaagguuugagaauaaaacugccagccugaagguucuuacugcaugaguaccagggaaacuuauaaccuguuugacagagaaacagugaucauuuuuuuuucuuuaaaagacuggaucucauguagcccaggcucaccucaaaccugcuauauaggcaaggaugacuuuaaaauucuguuucuccugcuuccaccauuacuaggauaacagguauacacaccacaccugguuuaugcagugcuggguacaaaacccagggcuucauauaugcccgacaagcacuccaacaacagcguaauauacaccuauagccaggagucaggccaucaauaagauagggagaaucaauccuuugacaaaacgcuacugucuagagcuaucacuucuuuagguaagaggauaucacuccagccuuagcuagaaucuucguaacuaucaguuggcaagguccuuaauuacauuaauuuccuguauuuuuagagccccaagaugcuacuaguaaaaucuacuucuguccccuaaagaucucucaaaguaaagguagucucuucuaaauaagaaguuaagcacuuaaggaaaauucagccagccuaaugaaccaacaaugaagaaacaaauucaugaaagagaggaaggcagugguaccaccugauauguuccagggcucucgggggaggaaaggaacaaugaucuggggucacaagaaagaagaacaacacuaacuacacugacacuucagacauacagucaagaggcagaaaaaacauucccaaagagcagacuauauccuuaucugguacacuucacuuuaaacaaauacaaacaaaaauuuaaggagaauuauaaaagaugaauagaaggaauacaaucacuuauauagaugguuaccauaguuaugguagcuaagugauauaaacuguauaaguauacagaugauuuagaaaagaauuaaauauuacuucucuucugcccuccugcuauacuaccugauuaagaacaaaacuuugggggcuggagagauggcucaucgguuaagagcacugacuguucuuccaaagguccugaguucaauucccagcaaccacaugguggcucacaaccaucuguaauaagacccgaugcccucuuuuggagugucugaagacagcuacaacauacucacauuaaauaaaucuuuuuuuaaaaaaagaacaaauauucauaaaauguuaugcaucaguuauuuuuaaauauaguaauuagucauggaaagaugaaucggaccaaaaaaaaaaaaaaaaaagcccacucacucuuaguaacaaaacucucagaaggugacagcugagaugcauuuguacuucaguaaugcugauucuagaccacugcuaauaucagcucaagagcacucaacagcaaaacuaucuggacagcuuugugaaaaauaguuccaaaucuaagauucucuaaucauauaaaagaaaggaucaaugaauggaagaagggaacaguacaagucccagaugccacuucucauaggcaaugccuaagagguuaagaggguaaaguugaaaagagaauuuauucacauggugagacacaauaacauguccuagucuccuuuacucaaccaugcaucuggcuuagcuuuaaucucuaaaagauucaccgauuaauaacaguaguauaguucccaugcuugacagacaaaaccccucuaucuucccaccccugcauaccuuuuauuacuuucuacauuaaccuucauacuauaacaacaguacuuagacuaugauucuuccucaccaugcaauuuuacaucccugcuuccuugcuuagucauucccucuagcugaaauucuuuuuuuuuauuuuacuugauuuaacauaacauacacacacacacacuaaauuucaaaacacugaaugugcuuuuuaaaaguuacaauacugcuguggcaaccagguccugaacgaugauucaggagaggaaguaaugaagugauaagucagcacugugagaucagggcaagcagcuaggaguaauccaguugagcccuuagaagaguuauagagcgagagacaaaaucugggacuugaaaaaccaaggaauaguaggaauaggaggucagaaaucugaaggaaaaaaagucaccugacuuauggcaucaguuaguuuuccucagaacugcaacccaguaccuggcagaacaauuuacaagcagggaagauguauucuggccccauuucugagauuucagugugaucacucuccagugagagugaggaaggagaguaaaggaaggaggcagacgaguaaauaaaaaggauuagacaggaugggauccuaaaugaccagaaaggggaaaugguaugaaagaagaggcaggcaaacaaaaaaggggaaaagaggccagggacaaaauaccauguagaacccuagugaggccccauuuacuaaaguucccagcaccucugagcaaagugcuaucugcuggggacuaggcuucuauguauugagucugcaggagauaauuuauauucacacuuuaacaaugauuuuccucuuaaaacauuuccugaaugaaacccuuaagaucucuaguuagagauccaagaaccuaagcgugcacacacauauauagcuucacuccuaguaauagguaaagaagucacauccaacuguggucuagcccucaauuagcacagcccuuccuuggacggaaguguuuaauccccauuuaguuugcccaccagagaagacugaacccucuacagagggaaauaccucuaagucccuauaacagguucagaauguagcucaaugguagaaugcuugcuugauaaacagaacauccuggguuugaccucucaacaacacaaagauaaaaaauaaccuaagccuguaucauuauuaaaacgguagaauguucaguguuacauaaaaaauuuaucagaaacauaaaaagaacaaaguaaacaauuacuaaagacaagagaagaaaccagggaacaggaagguagaucuuuauuagaauaaaggauuuauuauacacugggcggaggggcaagauaucucagugaugaacuauuagagaacuugaauucagauuucagcccccacaucagguuacucaaaccccuuuaacuucaaggagucagauaaagcccccuucugcguguacacccacauccaccauaagucuuuauuuaaaaagacaauggugaauuuuacuacguaaaugaauaugacccaagagcuaaaaaugagaaauucaguacugaaaauuaaaaauucaaguguccaucugacaaaaauuacaugugauugggcagcuauguuuauagucuugaagaaaauuugaagucuaggagccagagagauggcccacaaaguaaaggcauauggugguaacccuagaaccugaguuugacccccaagacccacauguuagaaggaaggaaccaaccucgacaaaucugucuucugauccccacacaaaugccaugccacacacacagguauccacauccacucacacuaaguagauaaauguaaaaaaaaaaaaaaacaaaaacaaaaccauaaagcauagagaagagaauuuaugaaucuaaacacauuacaguuaaaaauacuaaaaaauaauuuaaguaucuacguuaaagaauauuauguuguauuuuugaaaaauaaaacagcaaguaauaaaaugauaaaguucugauuuuaaaaaagcaguauuuggaaacaaauguacucuauuuaaguugcaagcuaacccuuccuucuauauucaugaccaaggaaacugcugguaguggugauaaaguuuuagaguuaggguauaguucuuugcuaguauuugccggacccugggcucacugccuagcacaccaaaaagcaaacacaugcacaauauacauaaaauccauucggcuaaagaagaaauacaagccaacauuguacuguuaccuaaauaaaacaaagauuagggcuaaacuaguaaaagaagccaaaguaagucaaaggcauagucuaauuuuacuacgcauuaaugacaucugaaacaccaguuuaagagucacagucuggagcgagcgagcuagaggcuguugguaggcuggagcagagcaaugccuaaauuaaaggaacuuguuucuucaagcucuucaggcagugauuuggacagggaaguucaaaaaaaguuaaagaggaaaaagcaagugguuccagagaaacccgugaagcagcagcagccuggugagccuucuagagcgcuggcauccuccaagcagagcagcagcagcagagaugacaacaugcuccagauuggaaagacgagauacgucaguguucaagacguuaaaggaaaaauucaauugauauuagagaacguuggauggacucagaaggugaaaugaaacagggagaaaagguauuucuuuaaacauggaacaauggagccagcugaaggaacagaucucugacacagaugauacaguaagaaagcuguaaaaucugagccauaucaaaccuauacuauacuguuguaguugucuuuuuacauuggcuuuuguuuucuaaauguuguuuuccaagcuguugcauauuuggauugcagaacaauuguaagacaaauacuuuuuuguuuguuuguuuuuccagacaggacuucucuguagcccuggcuguccuggaacucacuuuguagaccaggcuggccucaaacucagaaauccaccuguuucuaccucccgagugcugggauuaaaggcgugcgucaccacgcccggccaaauacuuuuuuuugaugugcauuauuaaaauguucuaagugaagcuaauugucaauuuauuaaagauugcuuugugccccuuaccuaguguaaaauaaagucagaucauuacaaucuuaaaaaaaaaaaaaaaagaaacaaccaagaaaagaaaagaaauauaagagucugagaaagaaaauacuggaauggagaaggguaagucugaucaaaugaaaaauggcuaaugaauaagaugugugaugacuuuguggaaguaaaaucuagcuuuaaauauauaaagagccaucauuuaaaacacagauuuacucugcacuaucuacauggauggaaccagaacucacuaagugauuagaagcaauauuuguaugugcauggguguaugauuguguguguguguguguguuugugugugaauacacuggugugcauaucuaagccagaggacaaccauggguaucaagaaugccaccuacuuccuuugaagcaggguccucauuggccugaagugccuaacuaggcuaggcuggccuuugaacuccagagguucuccugccucugccacaccaaugcugggcuacaagugugaacuaccacacccagaauguuuacauggguucuggggaauuaaacucaguuucucaugcuugugagcuguccaguagaaguauuucugagguccaauuuaggaaaagccuugaaauaauuagaaauuagaacuuuucuuauaauggaccaaaaagcagaggaacauuacugcacuaucaguaguuagauguuaaacaaaauguuccuuuuuacuguacaguuagauccguucccaaacuucauacaacaaauacaagaaagaagcagcuuuaaaauacaaauucuagggccaggaaaguggcuaaguaagggaccuugcaauucaagcuugacugaucuaaguuuaaccccuggagcucuaaugaaaguaaagcagaaaaccgagucagucaguccucacccccacaugaaggguguagccacccccacaagagcagaaaaguuauuauaaaauucaacaguugccacuauuauucaaagggucuggauaugagaacuaaaaugaucccuugucucuuuugagauaggguguuauucuuagccugcuggccuguaaguuucugaaauccuacugccccagccucccaaaugcuggcaucacuagcaugcuccacuacacccagcugaaacuucaauuuuuacaacuuucagacaauccucaucuaucuaguugccaagugauucaugcacaccucuguaugucucagcuguccuuagcauacaucuguuuuuucaaaacuauauaaccagauagccuuugacuccuuagugucccaaaauaccaacaaaaaucacuuugaaguuugugacaggguuuucuuuguaaucaaaaagacuucagcaaaauaaauguagauuaucugaaaguguuuuuuaaguuuucccuaaauucauuuaaugcacaaacuucaacuacucuacagaagaacuuuucuguaaguaccaaagaacacacaacagaccaacaaugaauaaauuacaaagaagcuguccauuaaaaguuuaacuggugugcuaacacacaccuaaaacccagacucaccgacagaccuagaaggaucaugaaaagcuagucugagccagccugggcuacuugagacccugacucagaacaucauuaaagaguaacaaauguuucagaaaacaaggacacaacaucaccaccaaggaaacucagucagauuauacuguguuaccacaagggaagugcagaguucuacgggagaagcaggggagucacaggcguaacagggauauucucuugccuggacacauuuugcucaacacuggauauuggaguuaaaauuaaaaaacgagcugugagaaugaccuugcuaggacaaggaaagggaaguaaaaggaagcagaagcaaguggcauaaaaggaagcucuuaaaaaaaaaaaaaaagcacuuuccuauuuuuaccagcucuuaaaacuauguaacaggagaaaggccagucuauaaccaggaauuagaacugcucuuuuaagccuaaauccauauccucuccuauuccccucagaccaagcccacucaaaguucuaguacuaaguagaacuauuuggcauuacuaaagcaaguccuaaaauagguaaaacgccuuaucgccauccguccuggauucauccccucuuccccuaacggucacaucugccuugccaucccaucgccuugacuaugguccagauguauuaagcaaaguaacuaagcuaaaauaacuagaaaagauguaagucaaaaaugauuggcaugguacauguaaaauaauuacaaugcucugacaggaaugaacauuucaagguuaccccgacccccaucuaacuuugauauaaauuaugguuuuuguggguuugccuuuauaaccucuguaucccuaagcuuggcaccaagagacuuuucagaggcaaaagccugcucuuggucugcccaucaauaaaaaggacuagacuuuuaauugcuuuaaucagcaugaucgucaagaaaucucuccaguggcucaaucacagguccucugcucucagugcacaggaaggguggaaaagccugcaucugcugguucucagugucccgaccugaugacucacucugggugccuuaaccaaaaguccauucaaagauuuaguauccaaggcuuccaaguuuauuauuugaaaauaaugaacacugaugucaacuugaugcugaaaaucagguggaacagaaggaaaaagaacaugacaauguuggaauuccaauacacucuuggaaaucuuucuuaagaacauaaggaaaaagauggaaagcuaaaauuagaaaaucaaauucuuacgacgauauaugcaaaaccucguaccaucucuagugcuuuucuagcugaagcaagcccauuuccuuuuucuggagcugcugcuuucaaaacaaaaaacuguguauauuuugagauuuuucuagagaacugaauugucauaugaagaaaguuuaucaauaacuccuuuaguacaaaauaacccguuugguaucuaaaaauacaggcauucuagucccugguauuagaaaagcugccugggaaaggcugaggacuagcucagccacgggaaagggucacucuucuucccucaccauggcaugcugcucagggcugcucagggcugugcagugugggcccuauuuucagccuuuuugaguugcuacccaugcugggguggacuuugauauaucuauugagucguuuuugauccuguaaguaacuccaauaaagcucacugauuuaccaaggacuuuagggguaucuguacuuugaucuguugugggcucucuaucucucuacuuguggggacaaguagacauguauugugccuccucaggaagucugucacacagcagcaagcuucguguuaaaagcacccaguucagaguuuggucccaaggauuacuuguaguacucagaucaacuuuugcaaaauguaugaguguauugcucuuagggucagcucuuagggucagcaggauggcuuaggagguggaggccccugcagcucagaccuagcaagcuguuugaccccuaaggagaggaagagcaccaacucccacauguuguccuuuguccuccacauaaaugcuacagcacccacacacauacauacauaaauuaggaguguaguagugggcuggagagauggcucagugguuaagagcacugacugcucuuccaaacguccugaguucaauucccagcaaccacaugguggcucacaaccaucaguaaugggaucugaugcccucuucuggugugucugaagacagugacaguuuacucacauacaugaaauaaaucuuuaaaauaaaaaaaaaggaguguauuaguaucagaaucauaaauagggguuuuguguauauuauauguaaguguuaaucuuaguacuuuaucucacaugucccagaauuuucuguaaacuaaacuauuuggcuaaagaauuuuauucauucuuuaacaaaauuuaaaaauguaguuuguauauucuauuugauaagugaaucaauaucagagauaauauauaaauguaaggaaagagaaucuguaagcaaugccauaaauacuuuguaucuuucuuugugaccaaauuacaaauauucuaaauuguguuguaguuguccugcuguuuaagaaguuguuucagacagggagaaggagaaagguagguuugccuuauaaguugugauccugucuugugcucugguauuaccucacugauaccuguuaacuuggcuacauguuaaaagaccaggcaacaugguaacucagccauuuacugcagucacaggaaaaugucaccuucacagcugugcugcaaaugguuguuaggguuagcuacauacugauuuaaggagauggcaggagaaaggagaaagacagagcucuucuuagaacucugucgaaggguuuuaaauucuaacagagucaagaaauuuggaguuuucuccauucauaucuucaguguguagaauuguaccuggaagcauagcaaauauucaauauacauuuaaagaaaucuaaaccacacauacauacaaaaauaaauggaaaaguagaacuagaagagucugccucaaguaaagauucaaauuauaacuauuauuugauaucgaagucuugaacaacacagaacugugccuaauuuaagaaaaccaaacuauccacuaaaugauagugucuaaguguuucaaccacagacaguacuuauucaaagucaacuagucuucaaugugcacaaugacagacaguaaaugugaaacagauuucuucagcuuguaggaagaguuaaggguagaaccagaaaacgcagacuucaacagccuauaaaucuaaaacuaauguaaaacagcuguuugccauuugaucacuggcaacauuaaaauuuucuuggcuacucuucugcacuccaagcaccuuaugagacaaaagggauaaaaagauguauaaauuuuacauauucaacuguuaagauaaaacuuuuaguuauuaaaauuuaucuuccagaauaugaucaaaguguaaaaugucuaaaaguaaaaguguauaggugacuggagugauggcucagugguuaagaucacuuguugaucuugcagaggacaugaguucaaguuccaguacccacauagcuaacaacuaucuccaacuccagucccaggggccuuuucugaccaccaaaggcacuaggcacacagauauacauccaggcaaaauacuaacagacauaaaauaguuuuuaaaaaguguacagcaacagcaaagaguucagcuaauaucucaagacuuucagcacugccauuaccuaguaauccacuugaacuccuuagaaauauugacaagagauuuuugcuguuguuguucccuaaacuuaauacuaugaagauguuucccucuucaugacuaacuacacaauuagaaauaaagaaaccuauggcuguauuagucuauacagaaaaugaauggaugucauuaaaucagauaaaaaaguuuuaucugcuuuguuucagaaagaugauguuucuaaacgagccuuuugcuuccuugagacacagucuuguguaggucaggcuagccuccaucuaauacuggccuugaacucucuuaagcuuuaggguuacaaauaugcaucagcacacacagcugagaacauguuuaacaguacaaauauucccaguguagcaucacauuaugcaacaguguauaucuaauaacgagcucuugucucgagugagaaauuaccugauuuguagguauuuucggcacauucaccuuccacaucugggcuucccuggagauugcccuuuccaacagagaagacaaucucugguuuuccaaagguccuggaaacuucaugguaucccuuuggaucugccugccacccagcuugauguagcuaccuauuaacaaauacaaauaauguacaucacauaguuacagaauaaguauguuauacacauuuauaaaugucaaugcuuauuaagcaauuuauaaaacaaaguaagaauguuaugaggcaguauacgauuuuauagcucuuuaaaauaccauauauuaaaguuggcaacaaugucaucuaaaguaaccucacuuuaaauuugaaauucaguuauaauucaguauuguguaaaacuaagaccacuaacuuuuuuuauuagaaauucuuagauauaguuaucccaaauauucucccuagaagugaaauaaaauuaaucacuaagggucauuacuuuuauuuaccacuuaaauacauuaagaauuacauuaaagcauuugaagucacgugagggugaagacugcuuuaagggagccucugcucuacaauuaagguccuuaguaagauuuucaaauguucagauguuauuaaaaaaaaaaucuagaauauauucugagaugaguaaaaaugaagaaauuuaaaacguauaagauacaaagaaagugggguuaaggggaaaauuaauuccugaaaaugcuuguauuaaaacaucccaaaucauuuacuuaaccuccaccuaaagacaauguaagcauaggaagcggugcauguuuguaaucucagaacuucugaggaccugugcuacacagccaggcuuggucuuuaaaauaaauuuaaaauguccuuaaacuuaaaaaacaaaacaaaacaaaacaaaacaaaaccaacaacaacaaacagaacuguaaaccaggccuugugcacacaccugucaauuuggguagagacaagaggaugagaaguucaaagucacccuugguuacauaucacauuuauuaucagccugggcuuuucaaauaauuagcuguugacacaagaugaggaaaaacacugaaucaauugagaauuaguauuaagaaguugaggcuuaaaugcagcuuuaacugaauuggauccuguauaaaaacaaggcaauuuucaggagcauuaccuaaagagguacugacugcaggccucagaacuacauuuacuaaauuuaacugugcugugauucugaauggaaacacuccuauccauaggguacagaguccaggaguauacaccacauucacaagacuauaaaaugggcaaaaacuuaaauaugcauagaauuaaguuguaaauuauuugucaauauuguaggagaaacauuuuuacacuccuuuaagacagcugcucacagguagcagggaauucaguuuuugcuccuuuuacagaaaacuuacaggucuauccucuaacauauaagagauuuaagcuaaaugaauaaggaauuuugcuaacauaaacccuuaaaagugucaugagaacuuuccuguuauguagcccaggccagcccugaaugccccaccucagccucucaggacaacucuuauuuuaaugauagaauuuuauuguuucuuguucaucuuuacccacuauuaguuacaugcacaaaugugaauuaucuuuuuagucucuaaaaacaaaagggcuauagagguugggcaucccuuauauaauguguccaauuuuuucauauauuguaugugugguuuuagaauauuuacauauacauaauuagaagggaauccaauauaaauaugaaauccauauauaccuauauauaugccagauaauuuucuauaauuuaaaaauaauuuuucacuugugaacuuaugaaauuacuuuccacaaauuuagggugcucaauuugauuuuugcuuggcauauucuaaaugaacuguuaaacuuuaaauuuuccuuaacauuuaaaauagcuuuacauauuccucccauugucucaaauacuucuauacuguucaugcuuauuaaaaggcuuagauuuugcauuaacaagcuagcauaaugcuuaccuuacaucaaacuguacuaccaacauacauccaggacccccugaucuuaagaguggaacacaaugccgguaaacaaccacauuaauagcaagcuucaucaauacauaauuauccuauuauggugaucacaaugccaacucuauuaauaauccuguacugacuguugacuucugguccuuccuuccuuuucugaacagagaagaucaaugugagccuuuaagguuuuuguagcuacuauucccuccuugacuuuaugaaccagcaauaccgggucauaggcgaucccacaucaccgucuagaauugugcagaaacacacuacccugccuuucuguauccauacuuggacauaauccugccuuuguauguaauuacugucaugaccauugcuagaccugcuuucucaacuaaucaugaguaucuuuaccacuaacaguuuccaaacuuuagcacuguaccucccugccccccaaaucacagcuuacccuugucaggugcuuaucaauagcccucaaugcuuugcuacuacuuggcuagcuauuguucauauuacucuaaguaauccuuguuuaacccuaugaugguggaauuacuaaauccauuuaaaagaugaacaaacacacagguagguugaauacucuuaauuuuuaagaauuacuugaccagaauaaacaaauacucuuggcuuuuaaccuaacccuuuuuuuaaccccuuuuaagacaggguacauacauauauguauguguguguaugucuccaucccuagcuguccagaaaguuucuagguuuaccaggcugcuguucaaacacucaauggcucuucacugacaaagugaaacguaaguauuuuacuuugcuauucuaagaccuucaguugauccauuuaccucguugaucuauuuaccucacacuuuccacgaauuuacuacacaauguucaacuucugccuaaaugaccugcgguggagcaggcuaacucugcagagagcauuuagcucuugcaaaauucggcauuuuucuguccuuuaugaugcaacucaguucccucaccucucuaguuuccuccaccggcccaagcccuagacgacguuacacucccgcgcgcgguguguggguggcggggggggggggggguagggcagaggaagauaacuauuggcuugacauucacaauacucugcccgguaaauuauguucgguggucacgagggaucgguggcuucugugggugggggugugucaccuucuuuauuagcacuggcucgcggagccuggaacuggcaccccagucggugacgggcuguggcuacaaguuacuuggggaccaaaaaaaaaaaaaaaaaagaaaaaaaggccgggcucaaaggaaacccacgcagcgcugccagagacggcgaggggguccccgaggugcccaggaaagguucgccgaggggaccgguccucgggggagcggcgcgcgcccccgcgagcucccacuccagcggcgcgcacggcgaccgcgccgcgcccccgcccucaccuucuucuucuccuccucuuccuccuccuccuccuccccggcagagcuguaggccucacaguggugacgcggggucauccgggggcccguuaccaccucaugauccucggcgcgcggcagcggggcgcgcgggaccagggccgggccgucugaggagggagaagagggcaaaccgggccggcgggcgcggguacucgggcgggacgcacggcugcggccgaggggucacucagcgaacuaguuccaugaugacccugggcccgaggccgccgccgccggucccgcuccuccgaccgccgccgcuggugcccgggugaggagggggcgcccucucgccauagggcggcgggggccggggagaggcgcggggugaggccggcucugccccugcccgagggaaacgccuccgaggggaaaugguggaaggggggaaggggaaaaaagaaaagaaaaggaaggggaaagggggagaaaauaagaaaaagcgagacagaggcgcuggcgcguccgcucgcgggggaaggcuggggagggaggagcguacgaaaaagcgccggccgccuagccccgcccucgcggacug

SEQ ID NO: 2538 - RNA, 2972 nt, Mus musculus
cuuuuuuuuuauuuuacuugauuuaacauaacauacacacacacacacuaaauuucaaaacacugaaugugcuuuuuaaaaguuacaauacugcuguggcaaccagguccugaacgaugauucaggagaggaaguaaugaagugauaagucagcacugugagaucagggcaagcagcuaggaguaauccaguugagcccuuagaagaguuauagagcgagagacaaaaucugggacuugaaaaaccaaggaauaguaggaauaggaggucagaaaucugaaggaaaaaaagucaccugacuuauggcaucaguuaguuuuccucagaacugcaacccaguaccuggcagaacaauuuacaagcagggaagauguauucuggccccauuucugagauuucagugugaucacucuccagugagagugaggaaggagaguaaaggaaggaggcagacgaguaaauaaaaaggauuagacaggaugggauccuaaaugaccagaaaggggaaaugguaugaaagaagaggcaggcaaacaaaaaaggggaaaagaggccagggacaaaauaccauguagaacccuagugaggccccauuuacuaaaguucccagcaccucugagcaaagugcuaucugcuggggacuaggcuucuauguauugagucugcaggagauaauuuauauucacacuuuaacaaugauuuuccucuuaaaacauuuccugaaugaaacccuuaagaucucuaguuagagauccaagaaccuaagcgugcacacacauauauagcuucacuccuaguaauagguaaagaagucacauccaacuguggucuagcccucaauuagcacagcccuuccuuggacggaaguguuuaauccccauuuaguuugcccaccagagaagacugaacccucuacagagggaaauaccucuaagucccuauaacagguucagaauguagcucaaugguagaaugcuugcuugauaaacagaacauccuggguuugaccucucaacaacacaaagauaaaaaauaaccuaagccuguaucauuauuaaaacgguagaauguucaguguuacauaaaaaauuuaucagaaacauaaaaagaacaaaguaaacaauuacuaaagacaagagaagaaaccagggaacaggaagguagaucuuuauuagaauaaaggauuuauuauacacugggcggaggggcaagauaucucagugaugaacuauuagagaacuugaauucagauuucagcccccacaucagguuacucaaaccccuuuaacuucaaggagucagauaaagcccccuucugcguguacacccacauccaccauaagucuuuauuuaaaaagacaauggugaauuuuacuacguaaaugaauaugacccaagagcuaaaaaugagaaauucaguacugaaaauuaaaaauucaaguguccaucugacaaaaauuacaugugauugggcagcuauguuuauagucuugaagaaaauuugaagucuaggagccagagagauggcccacaaaguaaaggcauauggugguaacccuagaaccugaguuugacccccaagacccacauguuagaaggaaggaaccaaccucgacaaaucugucuucugauccccacacaaaugccaugccacacacacagguauccacauccacucacacuaaguagauaaauguaaaaaaaaaaaaaaacaaaaacaaaaccauaaagcauagagaagagaauuuaugaaucuaaacacauuacaguuaaaaauacuaaaaaauaauuuaaguaucuacguuaaagaauauuauguuguauuuuugaaaaauaaaacagcaaguaauaaaaugauaaaguucugauuuuaaaaaagcaguauuuggaaacaaauguacucuauuuaaguugcaagcuaacccuuccuucuauauucaugaccaaggaaacugcugguaguggugauaaaguuuuagaguuaggguauaguucuuugcuaguauuugccggacccugggcucacugccuagcacaccaaaaagcaaacacaugcacaauauacauaaaauccauucggcuaaagaagaaauacaagccaacauuguacuguuaccuaaauaaaacaaagauuagggcuaaacuaguaaaagaagccaaaguaagucaaaggcauagucuaauuuuacuacgcauuaaugacaucugaaacaccaguuuaagagucacagucuggagcgagcgagcuagaggcuguugguaggcuggagcagagcaaugccuaaauuaaaggaacuuguuucuucaagcucuucaggcagugauuuggacagggaaguucaaaaaaaguuaaagaggaaaaagcaagugguuccagagaaacccgugaagcagcagcagccuggugagccuucuagagcgcuggcauccuccaagcagagcagcagcagcagagaugacaacaugcuccagauuggaaagacgagauacgucaguguucaagacguuaaaggaaaaauucaauugauauuagagaacguuggauggacucagaaggugaaaugaaacagggagaaaagguauuucuuuaaacauggaacaauggagccagcugaaggaacagaucucugacacagaugauacaguaagaaagcuguaaaaucugagccauaucaaaccuauacuauacuguuguaguugucuuuuuacauuggcuuuuguuuucuaaauguuguuuuccaagcuguugcauauuuggauugcagaacaauuguaagacaaauacuuuuuuguuuguuuguuuuuccagacaggacuucucuguagcccuggcuguccuggaacucacuuuguagaccaggcuggccucaaacucagaaauccaccuguuucuaccucccgagugcugggauuaaaggcgugcgucaccacgcccggccaaauacuuuuuuuugaugugcauuauuaaaaug

SEQ ID NO: 2539 - RNA, 2972 nt, Mus musculus
cauuuuaauaaugcacaucaaaaaaaaguauuuggccgggcguggugacgcacgccuuuaaucccagcacucgggagguagaaacagguggauuucugaguuugaggccagccuggucuacaaagugaguuccaggacagccagggcuacagagaaguccugucuggaaaaacaaacaaacaaaaaaguauuugucuuacaauuguucugcaauccaaauaugcaacagcuuggaaaacaacauuuagaaaacaaaagccaauguaaaaagacaacuacaacaguauaguauagguuugauauggcucagauuuuacagcuuucuuacuguaucaucugugucagagaucuguuccuucagcuggcuccauuguuccauguuuaaagaaauaccuuuucucccuguuucauuucaccuucugaguccauccaacguucucuaauaucaauugaauuuuuccuuuaacgucuugaacacugacguaucucgucuuuccaaucuggagcauguugucaucucugcugcugcugcucugcuuggaggaugccagcgcucuagaaggcucaccaggcugcugcugcuucacggguuucucuggaaccacuugcuuuuuccucuuuaacuuuuuuugaacuucccuguccaaaucacugccugaagagcuugaagaaacaaguuccuuuaauuuaggcauugcucugcuccagccuaccaacagccucuagcucgcucgcuccagacugugacucuuaaacugguguuucagaugucauuaaugcguaguaaaauuagacuaugccuuugacuuacuuuggcuucuuuuacuaguuuagcccuaaucuuuguuuuauuuagguaacaguacaauguuggcuuguauuucuucuuuagccgaauggauuuuauguauauugugcauguguuugcuuuuuggugugcuaggcagugagcccaggguccggcaaauacuagcaaagaacuauacccuaacucuaaaacuuuaucaccacuaccagcaguuuccuuggucaugaauauagaaggaaggguuagcuugcaacuuaaauagaguacauuuguuuccaaauacugcuuuuuuaaaaucagaacuuuaucauuuuauuacuugcuguuuuauuuuucaaaaauacaacauaauauucuuuaacguagauacuuaaauuauuuuuuaguauuuuuaacuguaauguguuuagauucauaaauucucuucucuaugcuuuaugguuuuguuuuuguuuuuuuuuuuuuuuacauuuaucuacuuagugugaguggauguggauaccuguguguguggcauggcauuuguguggggaucagaagacagauuugucgagguugguuccuuccuucuaacaugugggucuugggggucaaacucagguucuaggguuaccaccauaugccuuuacuuugugggccaucucucuggcuccuagacuucaaauuuucuucaagacuauaaacauagcugcccaaucacauguaauuuuugucagauggacacuugaauuuuuaauuuucaguacugaauuucucauuuuuagcucuugggucauauucauuuacguaguaaaauucaccauugucuuuuuaaauaaagacuuaugguggauguggguguacacgcagaagggggcuuuaucugacuccuugaaguuaaagggguuugaguaaccugaugugggggcugaaaucugaauucaaguucucuaauaguucaucacugagauaucuugccccuccgcccaguguauaauaaauccuuuauucuaauaaagaucuaccuuccuguucccugguuucuucucuugucuuuaguaauuguuuacuuuguucuuuuuauguuucugauaaauuuuuuauguaacacugaacauucuaccguuuuaauaaugauacaggcuuagguuauuuuuuaucuuuguguuguugagaggucaaacccaggauguucuguuuaucaagcaagcauucuaccauugagcuacauucugaaccuguuauagggacuuagagguauuucccucuguagaggguucagucuucucuggugggcaaacuaaauggggauuaaacacuuccguccaaggaagggcugugcuaauugagggcuagaccacaguuggaugugacuucuuuaccuauuacuaggagugaagcuauauaugugugugcacgcuuagguucuuggaucucuaacuagagaucuuaaggguuucauucaggaaauguuuuaagaggaaaaucauuguuaaagugugaauauaaauuaucuccugcagacucaauacauagaagccuaguccccagcagauagcacuuugcucagaggugcugggaacuuuaguaaauggggccucacuaggguucuacaugguauuuugucccuggccucuuuuccccuuuuuuguuugccugccucuucuuucauaccauuuccccuuucuggucauuuaggaucccauccugucuaauccuuuuuauuuacucgucugccuccuuccuuuacucuccuuccucacucucacuggagagugaucacacugaaaucucagaaauggggccagaauacaucuucccugcuuguaaauuguucugccagguacuggguugcaguucugaggaaaacuaacugaugccauaagucaggugacuuuuuuuccuucagauuucugaccuccuauuccuacuauuccuugguuuuucaagucccagauuuugucucucgcucuauaacucuucuaagggcucaacuggauuacuccuagcugcuugcccugaucucacagugcugacuuaucacuucauuacuuccucuccugaaucaucguucaggaccugguugccacagcaguauuguaacuuuuaaaaagcacauucaguguuuugaaauuuaguguguguguguguauguuauguuaaaucaaguaaaauaaaaaaaaag

SEQ ID NO: 2540 - RNA, 7134 nt, Mus musculus
ucuguaaacaacgccaguguucucgucucuuccuggccaccuccggugucccacggacgcauaggagaguuugaacaaagacgaacuuccgugucuuauggacgcacaggagaguuugaacaaagacgagcuuccggagacgaccuggggaaggcgcugggacugggaugaaaagggaaagugcauuuugugugcacaaagagaaggaaaggugcgcggacucuuuuuccucgggcgcgcggaagaacccccgccgccuguucggugacguaagaggcuuguuagccgaggaggcgugcaguggccggagagugugcugcgcaugcgccucuggaaagaaaggagccuagccucagggaaggguuucugggugagcgccugcgcccaaccuagagucucccaguguuucccagcccaacuuguccuuagcccuccugaacgaauuuauuagacguggauggagaucuuuuguguaaagaucacauucuuuguugaccuuacgcaaaauuauguugucccguuccuauuagugaguaaggacaugcaucuuuuuaaccauccugugggugaugggagacugaagcacuuuagaauuaagaaaauuaaggggaucauauccugcgugcuuaaggcuacuuguaaaaacaguggauuagacuacugacggcuuggcugugcgccaauggaauucuagucaugagccaguaugucuaguauuucaggguccuguuuaucacuaacuagguccuuaacgaaugugaacuaaauguguuuuauuuacuugaguacuuuuuacuccaguugguaaauuuugcaaaucuuacaaugguucuacuuaugaaaagaaugcagauagcuuugggaagaaggggagaccuggaacuuaaccauuuaccuagucaagcauucauuuuacaucacuggaaaaaaacaaaaacaaaaacaaaaaaaaaacccgaucagguuuuuacagaacuggaauuagcuugaaaacaaaaggcuccugucuucaaggaguuugcaacucaggcacagagauacccauugaucacuguaugaaauuacccaaaagacuguuuuacucuauagccauccccuccccauaugaacucauggauggccuggaucuuguauaguuuguuuuauacugcauuucuguaugugaaaggcucucaguauuugauuucugaccucauaaacaagugucaguagcagaaggauuaagauggaaaauuucagaccaguguggaaacgccuuuaaccugcucugggcucucaguaaagguuucucugaggaagugacauuuaagaugagucuugaaaccacugggcaaagaaaaauauaggcacaggaagcaacauauggaaagcacugaagcuuacauugccucugagacucaaggggcagaaagcugaggucagagaggauucuauagggcacagcggggcucaggaagcacuggaggguuuuaaguagguucuacgugugccugcauuucccacccccaucuagucuuuuucuguauuguuacacguucuuuuuuuuuuuuuuaauaugaccaacauuuuuuuuuccuggauaaaagucucaagaguauggccuuucugcauaacuuaucguggcacaacuauugugacaccguggaaucguuucugccucucauuucuucaaggaagacuggguaagaguguagcacagcaguaguggccguguguaugugugugugugugugaauucauauauaugggagcuggauagaugauucauuaguuaagggcaaguacaagacccaaguuacaguggcucacagugauucacuccuagucaucugauccccucuucugaacuccaucgggaccugcaguacgcaggugcauagcucccaugcacauauauacacauaauuaaaaauaaaauaugcauucuuaaaaagaaguucuauguggauggucacagaagcauuguucauaagagguaaaagauaaagcaacagaaagugguuucucagcugccugguguuacguguauaucuccauaucuuaccguggauuaaauggccacuagcauucaugaacuucaaaaaaaaaguuuauaauuaagugagagcucuuaaauacuccugguuauguuucauuggcuuaacucuuauaucaaacaacuuggcaaaauagucaucaaaagccauaagaauguaaguccugcuggaugcagaaauaaccucaaaggagguuacgcauggagauacuagaugacucuuuucccauuuuucccaguagcagcuuuauugacacguaaacuauccauuuaaagcaugugguucaccucgcugagcacucaucaucacaauccauuucagaacauuuucaucaccuugaaaauaaaccuagcauccuucccgaaucaccugccagugcugugcccaccccagcccaaagccaugugaguuccuuccuccguagaccuguguauuugggacauucccugaaauaggccuucugugauggugugucuucuagaaaccagugucaguugucuaaagaaaaauauauucuucacuauuuuaaaaaaauuuaaccuuuuauuuuaugugaauggguguucuguucuacagcauguguugucuagacauccugcauguguuuggaucccugguauuuaugcacuguugggagcugccaugcgggugcugggaauugaacccaggucaucuggaagagcauccagagcucucaacccccgaaccaucucucaacccaccaccacucauucguuaaacauugguucgggaucuuuucuugcuugauaacuguauuuuacaugaagcacuguugcacaguagaaaguuauaaaguccccugagaaaagaagucuuauaaagacaaauguauugauuaggaauggcucccaaauaauaaguuuuuagaguacccuucuacauggacuuugagacuauggcucaugauguaguaguuguggcaauaagcgcaucauuuuuuuuuuuuaaauccugaaaucacucuauacaguagguauuuuugcugccccugugcaguggaagacaguagaugucuaagguugaccacacagaaagacacagcuaggacucaaccccagcuugaccuacuccacacuugccuguacuuucagggaccacuuuggacuugucccuguggauauuucuggcuuuguuaaauuauagaauaaaaacacuauauuuuugguuugccuuuaaucuuuuuuuuuuuucccauucuagugaguaguuuuuacuuugguuucuaaaguguuuugccuuguuuuggagaagggauaauuaaaauucuuguuagacaugcuaggcauguuggcacaugccuuuggucccagcacuugaggggcaaaggcaagugaaucucugaguguuugaggcuagccuggucuacauagugaguuccaggcuuugugguugagagugcugggugcuuuuccagaggacuuauguucaauuugcacuaccuacacuguggcuaaugaccaccaguaacuccaguuccaagggauucaguguucucuucuggcuucugggagcaucacacacacacacacacacacacacacaggucaaacacuugugaaacaacacaaauuaaucaaauuaauauacacugguuugauauacuuaauuuuuucaagaaauauagaaaugcuguguucacauuuuuauauguaaagaagauaagccuauuaaucuuuuuuauauuagaauacauccuuuuuucuuuuauugaaaaauauuuuucucauauaauauauccuaguuacaguuuccucucccucuccuccucccaguuccuccacacucgcccuccuuucuccauccaucuucuuucugucucucauuagaaaacaaacuggcuucuaagagauaacaauaaaagaugauacaacaaaaacuaacauauucaaauagcauaaaacagaagagaaagagcccaagaaaggcacaaggaacagauccagaugcagagaccaacucuuuugcacacucaggaaucccauaaaaacacuaaacuagaagccaugauauaaacacacacacacaggaccuguaggguacucuagugagagacagagacagagagagaauaugaauauaaaauaauacauuuuaaagauuaaaaaaaaaaagccuugacacaacauuacaagacaaggaaccucuaagccagcaguucucaacccuccuaaugcugcgaccccuuaauacaguugcucauguugugaugacacccaaccauaaaauuauucuccccuccucccaaagggguccugaccuauaauuuaggaauacuacucuaagccauuuuaguucauuuucugcaugugaccuacccuuaaaaguaguuuguuuccccacugagauucucuugggaaaaaacuaaauuuucuuuucuuucuuucuuucuuuuuuuuuucuuuuuuuuuuuuuuuuuuuuuuuuuuuuuuuuuuuuuugagacaggguuucucuguauagcccuggcuguccuggaacuggcucuguagaccaggcuggccucaaacucagaaaucugucugccucugucucccaagugcugggauuaaaggcaugugccaccacugcccagccuaaaguuucuuuuguaagugguuaucagucagagauaucuucuggguuagcuuggauggggcuuguguccauuucuccuuucagcucuaggacccccgcugguccuauucaggcccugugcaugcugccucagccucugugaguucaaaugugcaucgauucuguugauuugaaggccuuguugccuuggugucugcuauccccucuggcuuuuacaaucuuucuaccuccucuucagcaggauucccugaguccugaugagagagauuugaugugucuucagcaauaggacauuuuuaucauuuuguggagaacaaacuauauagucuucuucuugccaaaaacccuggguuguuugugguuucucauggaacccuuuuggccaacaacucaauuagauguacccuuuccuaguacuggaagcuucauuuagugacaagauaacuaguuagggacaugucucccccauuauuugucaguuucauguagauugccuucauauauguaggaagcuacuaccccucagauggcucuuaauuuuagcugucucuccccacaaaccuucaucaaccucuucucucccccucccccaucucuucuauuucccuuuacuagggagaucuaucugcucuccccaccccaucccuuacucuauaccuaaccucugugguucagugguuuauagcuuaguaaucaugacuuaauggcuaauauccacauucaaguggacauauaccauauuugucuuucucgguuaccucaccagaaugauuuuuuuuucugguuccauccauuuaccuacgaauuucaugauuucaguuuuuuaacagcugagugacauucuauugugaaaaugaaccacauuuucuuugcccauuuaucugaugagagacaucuagguguccaauuucugacuauucuagauugagcagcaaugaccgggguugagcaguccucagcgguaggauggaguguccuuugggugugcccaagagugguagagcuggaucuggagauugauuaguucccaucuuccugaggaacugccacacacugauuuccauaguguuggccuauugauauugagugaguagaauugccugucuccuuugucuuaaaugagcucuuuagaugaaguuuucaugcagcaauuuaugaaggcacugucuuguagaagagggugagaacaggagcaaucugcacaccauuauaaauaaucacgugucucuagaaucuaccugcugcucucacccaucucugcagagacugaaugcaagaguaacuuucccaaaccaacaaccaugaccucaggaggaaggaaacaucaauuuaaaaacauaaggaucucucuaucucucuaucugucucucucuuucucucucucucucaguuuuuuguuuuguuuuguuuuguuuuguuuugagacaggguuucucuguguagcccuggcuguccuagaacucacucuggagaccaggcuggccucgaacucagagaucugccugccucugccucccgauugcugggauuaaaggcaugagccaccaccaccuggcuacauaaagaauucuuaaugcguaugaaaagggaagaaagguucagagaagcacguaaaagucacagugcuggggaagggauggagacucaaccauaugaaguguguguggcggugcuguauggagggcuggagagggggcucagccauuaagagcacuuggccacucuugcugagaacugggcuucuguucucagcgcaguagcuaccacuccuguuccagaucugaugcccucuucuggccuucacagacacaggaaacugaggcaggaucaucauaaguucaaggucuaccugacaacucagcgaaacccuguucaaaguaaauacaagaauccaacugggaguguagaucagggcagagcccuugccuagcacauugggggggcggaggggggcgaggccaacauccaacccucagcauugaaaacaacuuuaugauguuaauaaccacuugcauuuagaagaaaaaauuacacacacaguacuugaaauucauuauucuaauguauaauauaauaucucuuucagaauuaaauuccuuucugaauccuugaagauaauguuggauauugagagaaaaaaaauagcaucagagauauguggugaaaggaaucagucuguuugugagaacaacucaccuccuccccaaauaucagauguucucuaccacgucucuuggagauggccccugaucgauuuuuauugguccacugaaacuauaacucaggaaguuacagcacacguauaauaaugaauauuaaaaggcugauguggaugccaguucaucuuuuuuccucccagaguaucccugaauggauucacacuguguuucacagcuacucccacauuccuuauacgccauauuccucaaaguacaaggucuuaauuaaaguuacagaaacuggaucuuagaugugugaaaaaaacaaaacaaaacaaaacaaaa

SEQ ID NO: 2541 - RNA, 8977 nt, Mus musculus
caaaacaaaucgggggaccuuuaaaaggugugaggcguccagaaacugucuccuuccgcucuccgaucggcucgcucaucuuugcucccuuccgguuccauucugaaaugaggcuggaauccagauuccacucccuaccauagauccuggcuccgcaaggccaagaggaacagaaggggccaagagaggcugggaacugaggcucggagcagggacucuuuuucucagauccacugggcgagcgagcgaggaucccuccgcgcgcagucacgcgccccgccccuugggggcgucgcagacucaaaacaaaaacaagggguuugcucagcuccggaggcugcggcggagccgggaggagguggcggugcagggcgggcgcugagccccgcugaggagcaagaugcagccggggcugugaggccgggcggcggcggggaggucggaugcgggucucggggugccgcugaggaggcuggucccugagcucggagacggguccggacgcccccgccgcgccgguccgugacgccggggccgacacggugagugggccucccggguggcucuggguuugguggcuccgggucuggaucgcgguuugcuuugaugguggagucccccagccgcagcugagggacugacaggggcuccaggguguucugaggcuauacgguggguugacagccccggggcuucgcaccguuacugagcccaaguauuaggcuacugcucgcugcgggcguacuggacuccccacugucuccccagcaucccccaagcuacugggccgcccugucucgaguugcggggcucgucaaagcugcagaagcugcggggguagcuuggaggugggcuccgcgacgggcucccggggcggggcuccgaagccgccuccuuccaguucuuuguucagucucgagacucccccucccuucucuccuauugugcaacgccccgccccagaacccgcuucgguggcuucagucuuccggucccccgcuuuccucuagggccuagagucuaguuagaagucccugcugugcuguccaggugaugcggacaguaggggacauuacgcuucuuggacacuuuuccuguacgucaaacgcugucggccacagagcugaucagaacuagcccuggccagcggaggugaccgagauacugcccccccaugccacgccuccaugucuuuaggggaggauuccccugaggcuggcggacgugaccgaucccccccucacccgguucuggcuugcgugaucuggggcgccccuagcuggagggaucgcggccagcuccuucugcucucacacccuacguauccggauuauauucuuaaccggccgcgguguauuugcugcagaugaaggauuugggggccaagcacuuggcagguggcgaagggguucagcuuuucggauuguugaacuucuaccuggaacaagaacagagauaccaaccucgggaaaaagggcugaucuugauggaggcuaccccggagguaaauuugagaauugauaggacuugggggaaggugggaagguaacuuuuugguuuuccucguaccaaaucaguaccaaaggcuaaaaaguuaaauccaaaauuggccucaccguacuaagaaaaaacgugaaacgugaaaggguucugcuuuuguuuuuagugaauguggaaguuauaccaaguguacuguagaggcguuucuucugguggugggaaauuccuagagaauauuucuaauaggaucuuagauugugucagaaaaaccucaucaaggaacccacauucugcuguaacuaccuuggguggggcaacacuucacguuauauugaguuggcuaaaguucuguauuggauaaauuuuaaaaguagugauuuaucugaacguagugugauagcuuuaggaggucauguguacaauggggaaaacuaaagggagaguagguuuugaaccaccucuauuccauucuaagaaaauaaacuuugauucuugguuuuuaauuucagaaugauaacacuuuguguucaagacugagaaaugccaaaguggaagauuuaagaaguuuaacuaacuucuuuggaucuggcacugaaacuuucguucuggcugucaauauuuuggauagauucuuggcccuuaugaagguauuuaauugcuuuuuauaaaauccauauuauauuuuauaucuuuauuuuuuguuaauuuuuauuuuaucuuuugauacacgguuucucuguguagcucugacuguuguggaacuaguucuauagacucggcuggccuccaaccucagaguucugcucgcuucugccucccacucccaagugcuagggucaaaaguguguguuuccacuucugacaaaucaacauguuuccaauggccagugcccaacacagucucuaacacauacagggcucaauauuugucaaaugaaauguaauaaagccuccugauuauaaacuuauauuagucaaauugugaucauucauacuagagagacuggaaaacuguauuucugcgucuucaauaagguuuugcugugccucuuaaacauguccucuaguaagacauuacagaggcaggccacuauacuuuaaguacucugugcgugcuuccagggguucagggagucaagaagaauuaacuaaaauucacuuugugaaaaauacuguaauaucuguuacaggcucauuuauaaaagugcccaaacugagugagaggaaagaagcuagacuuuuuauaaaaauaaaauacuguguguggugugugugugugugugagagagagagagagugagagagagagauuuucauuaguuauccuguuucccuuggagccuucgugguuuuaacacugaagcaggacaaagaaguauaaaauuaugcuaacguugaucugcucccuucucuguaaggcccuucaaagcaggcagccaccgucuuauuaauagucagcagcaaccguuaaaaacauggaaauucucuggccaauaggaucgcugucagcugcugggucacuuuuuagggcccugagaagaaaagggcagccauuuguccgcagcagcagcuguacauauguccuccacccugcaggguucgugggggugcuuuuccugggcaagauuacaucacauaaugguagaguuucauacaaaaagagaagaugcagaauaguuucccuucauccagucaggagagugugugugguauguguucagagaguuuuuuuuuuuuuuuuuuuuuuugagggaagauguacuauucucaguuuuacuaagucagaaauacaaacuauauuucagugccagaaagcaagcuuuuaaaccaguuuugggauuuuuuuuaauuugcauuuaaauuuaauaaaugcuuauauagccauuuuuuuuucuuguuaaagaguuuaugguggucugaaauguaaaaugauuguggguaaaggugagugcaucuaagagaagcaacauggcauuauuucaagcgucguuuguugccaaaucaaaguaugauugguuccucguguucuguuuucuaggugaaaccgaaacaccuguccugcauuggcgucugcugcuuuuugcuggccgccaggcuggcggaagaagaaggugacguuccccccacgcacgaugugauccgcaucagucaguguaaaugcacagcgucugacauuaaacgcauggagaaaaucaucucagagaaacugcacuaugagcuggaagcuaccacugccuuaaacuuuuugcacuuguaccacgcgauuguauuuugucacacuucagaaaggugaguggggcucagcggagucaccccaggccuucagcguggcugccgccaacagauuguuguuuuagucuguccagacuuucgacuuggaugugagugcuuagaaaugaaggaacuguuguaaggguucaccacagccccccuugcuuuguacaggaaggagauucucagccucgauaaacucgaagcgcagcugaaagcuugcaacugccgaguugucuucuccaaagcaagagugagucucuuucuuguuuacaggucugucuuacaagauucuauuuugauuuuuuucccuaauguuuguuuauuuuuuuguagccaucuguauuagcucugugccuucucaauuuggaaauagaaacgauaaaauccguggaacugcuggaaauucucuugcuuguuaaaaaacauuugaagguaaauaucuuuguuuuuguuuuuuuaagcaaucgucuuuucuuguguuaccuuuuuuuuucuuccuuguggugucuuaauuacucgauacaauccuucaugaaauuuucaaugucuuuguuuauuuuucucuuguaggucagguguuagaauuuuuugacccagacaguauuaguccagaagaaacucugacuuggucagcuuccuucugaaugcaggugcucguucuggggacucgugcccuaugugcccuauacaggauagcuguccuaguccucaacucugcacuacaacauacucuaaguacacuccuggcuaggcgugcccaaaggcaggagagcggugcauauccccaaugacuguucuuagcuguggaccagaaaguauacuagcuauaccaaggugaucgaggaauccccucaugucugugucuguagagcugagucaucgcaguagcacuaccaaaggucauuagcaguuuuuuuuuuaaagcuccuuaggugggcuacuucuguaaguuuuugcaguugugaaaaccaaaaccaaaagcccagugcuuuuccuugcuuaaacuaauagucuaguuaaggaaaugcaaaauuuaacaugaaacgguaugcuuguuauauugugacuuaguguuagauaauggugaauaugagaaguaguuugggauuauuagcaaagaaguagacaauccaggaugugugugcugacugggagccuggaccaucaucugugagaaugaagguuuggacugcaagggcuuaugcuaagacauggguaggcuaaguaaguuggggaagucauuuuuagguuggacaugcagguugaauauccaggcugcagucacaaacaagguaaguguauccaacucaaaagguagcucucuagaagccaaguauguaggugaauagggaaacauggauagccauuucaauucaguacccagaauccacagugagagaacugacuucauaaaguugucucccucccccccauacacacacacacccuaaaaacaauagaguuuguccugaguuuugaagaaagggcuaaugagaaucaaaggagaucauugaggacauauguagggacugcuaguugcuguguuacaaagagcuaaauauggccagcuucaguggaauauagaggccagaaugguuugaaaggauccauuuuuaagucagaggugauggcaucacucagaagacugaggugggaggauugugagcaggaagucaguggaguccacacagugggugaaugcaaggacuuccgggcucagugagccuguaaaacauggacagaagccuuguguuagcuucugucugucacagcuuucucucucucugaacgugagcauggcaguaauacgugagaccaucuucaugucuggugggaucaguccagauagcauucuuuagguggggaggaccugccuuugggaacuuccuugauaaugcuaacuuuaguuuguaucuucugucauaauaaaaauguguaccauaagcaauugaaacugugauuuguuuaagaaacauuuauuacagaaagaaaacaauuuuuauagcagauguuaaauuucuuuuguucagcacuacuaaacaguguacuugguugguguuuucuuagaauaggcagauauuuuuuguggguuuuuuccuguguaaguaauacuuggaguguuauuucaaccagcaguucccauguuuugacugcacauuacaauugacuguaggacuuuagagacacuuagcagccaggucauauucucaucuguugaaucaggguaccuggcaccaaugaccaugugacuuuaaggggcagcaaagugugagaaccacuguuacagcaucuucaucuuccuacgcagcucagcgacacugaauucuuuuacuggagggaacugguuucuaaaugucuagcagaguauucuucgccucgcugcugcaagccugaucugaagaagcugguauggauuguuucgcgacgcacugcgcagaaccuccacagcagcuacuacaguguuccugagcugcccacuaucccagagggggguugcuuugacggaagugaaagguaagcaggcgucuuccacagacuaaauguaaugguggguuuuguuaaaaacaaaacaaaacaaaacaaaacaaaucuguaagggccagcaaggugucugagcagguaaggccacuugcugacaagcuggaguuugaguccagaacccacacuggaaggaguaccaaccaccguaagugauuuuuuuuucaacucuacacaugcuguaacauacaauacacccucucccucccucguccucucuguccccucccugucaccugagauaaguaaauacauauaacuuaaaaauugaaagaagaaccgggguggaaacggaacucaguugguaguguuucauggcaugcauggaguguuuugauccccaacaccauuaaaccagguguggaguuggaggcaggagggccagaaauucgaggucauccuuagcuguucaugauuucaagaccauguuacaugugagaugcugucucaaaaagaaauaaaaucccuugcggagaguuaaaagagaaaaucccuccucacauggcagugguuuuucaugccagaaaaugaacuaguuuuuaaaaaauagacaauuuguaaaccucaccucaaaggauacuuuuaucuucucauuuuacuuacuuuggagacacaguuugguuauuaaaacaaaagcaaugcaaacgcaaacaguauccgggcuuuuccugguuggcagggaucgcagacgccacacagacaucucuuuuuccagcgcuacacuuacuucuguaaagugaauuuuaguaaauuugauugugugugcuaucaucuaaggaccagaaacuccaguuucauagugugcucuugcuuugguguuugagggaaccggagaaggagugacugauacaaaggaugccuuuaaacagaugcagauuggcagacuucugugguuaccucugcugcaguuaaugguacaggcagaagagauggcacuuuugugcagcucucuuaagaaaacuauuguuagccggacauggcaguacaugccauuaaucccagcacuugggaggcagaagcaagcagauuucugucaguucaaggccagccugaucuacauagugaguuccaggacagccagggcuacauagagaaacccugucagugaaugaaugaacgaacauuauuguuaaggaaagaacaucuuauaacuagaauagacuugacgugaaacucaguucaacuguguacaugaugauuagcuuuugaauauaauaucuguguaaacugcagcagucagaguuguaauuugcugauagucauguguguuuucagcagugacacccuccugucuuuuuccuuucagugaggacucuggugaagacaugaguuguggagaggagagucucagcagcuccccacccagcgaucaggagugcaccuucuucuuugacuuccaaguggcucagacacugugcuuuccaccauagaggucacaugucugugucaggguuuaaaguguguguaccuauuucaaagcaauacuuggggguguggguaguuuucuaguccagcccccgucuagacaggaauuucacagacuggaauaccuaccuucuauuuauuauucagaucagaucuggccuauuuucauauuuaauccuaagccaucaaauggguuagugccucuuaacaguacuuaaaacguuggcacuuuauuuuuuguugacauuuaucuuggggaggagggaaggugcugauuccuucauuccuuucaggccuuugaaagaugaacaguguagccugucugaaacuguagagccuucaggugucuuuauuuaauagguugggagugugcaagggcuuccuuagcagggacagaaggcaauccuuucaugguuuaucuuggauuuccuucucccuuguucucagaacagagacugcaguacucuugagugucaaacaccaauucuguuuuucuaauggugguguauuguccgauacagauccuacauguuaagaauugacaugucugugaauuuuaguucauaaaugucuugagcuuucugcugaagcagaaguugccaucaagcuaggacuguuaguugcauucuuaauaccuaaguauugucagacuguaguauuauuuuaguguuaccuaaaaaaguucauaaucugcuagcuuugcaugcaccugugugaaagcagaacagggaauggaguugauaagugcugauuuagcucaucucacuuucuuguauuaaaauaucugcaugauuacuuucuaauuguuuuauaauucacauuucauaauguauuguauaugggugccaagaugugaauaugaagugaaagaccuccaguguuuguaguguuaguuuaaagcaauucuguguggugauggagccauaaggaugaagauguguacacucuguacacugaagcuuuuguacagagaauuuuuaacuuuauaaaccuaugugaaaauguaaaucuuuaaaaauguacauaaaauacuguauuuuuuuaccuuugugugugauaauuggucagugcauguaaauauaauuuauuguguguucuauauuauacucagacauugaugacuuacuuuuuauuaguaagucaacacccagugagguguuuuccaaaguagauuuuuuuugaauuccgaauaggucauaauucaaaaauaaaaauauuaaugaauucuccuuacauguau

SEQ ID NO: 2542 - RNA, 3140 nt, Mus musculus
uggggaaccugccuauccacucgggcuggucucuuaagguucuaucucccuugugcugcacauuuuggauugggccaucaacauuaaguccugugagucuuguuaauucaauauuuuuuucaugcuuucauuuuuuaagcgugucacaaacaaaauuuuugauccaauaauuauauaccacuuuuggugauagagagccuggcaugacgcuagugugagggacugucuguccauaaccaguuaaggaugcagagguaaauugaugucucuaucauugcuugagcaguaacucagaagcuuggugguuaaugugauggugaggaaguuuuauaaacuuugucuuaaacguauaugcauuucuggcuccuuccccaggaaucuuuugauuggagaccuuuagaagaugaguguucauacccaacccacacuccagaagcuggcaauucagauuuuggugaaagaggaggcucuaggcaguucugaucuggaggagauagcccauggacucuucccagcacuguucaaggaggccuuugauggcagacauaucaagcucauaaaggcauuggugauagccuggccuuuccgaugucucccugugggggcauugaugaagacuccugaccuggaaacauugcaggcugugcuagauggaguagaaauucauugaacaagaggauuucacaccagguaagcaauuuccaaguccuguagaagggagcagaaggaguacacauuaaacauugucagggagauuagcuuugucauaaauggauuagaugcuucugauggcaucaucaggcagggauacaggguucuugacagcuacuguuuacuuguacugagcacaguuggauauggauuagauuugaauauggacuagaguaaauguggccucacauuggaaugagccuaucccugacauccgcacaagaacuaauaauauauguaaggagaaguaaaguguaccuuacugaaagaaaaguauucauguguacagaagcacaggaaagccucaguaguaagccugaguccaacuuggauaucagguccugaaaaaaaaaauguacacuuuagcagggaagagagacgaguuuagauauauguaguaaaagcuaauucaaggucugccaucauacuuauguuucaccuacaggaggaaaaaacuucaguuucucaaccugcaaaaugugcaccauaauuucugggacauaugcacugauucagaggacagugacucuucaacugagaucuuggaugaaaagcaagcggugaagguccaucccagauaugcacugagccagcaucugaaggucacaguugaccugugcauuagguccugccuugaugaaccacaagcaugguucucgaagugggcccaggaaagaaagggcucccuauauuucugcuguacaaagaugaagaucuuggcucugccuguaaaagaucucagacagaucuuccauguuuuugauccagagcacaucauggaguuagaacuaaauacugaauggacucugauagaguugacacauuuugcccccuauuucgggcagaugagaaaucuucacaaaguauuccuggaaccccuccacaaaaucgacuuccauuuacccaauagaaccagagucaccgaagucaaguguaucaacaaguuugcuucucaguucuccaaauucaacuaucugcagcaucuuuucauguucugcguccauuuucucagaucccaaaugaaucagguccuaggguaagccaugauggagagcugguucagcuaucagagcaaaucugucugucuuauauaaaagauuagugguacaugaugccagucagucacuaggaacaaacauuuagagauucauaagacucuuaaaguugucucuuuuuuccauguuugcugagauauacaagggaaauuuuacaagugaaaucaguaucugaaaugagcacucaugaucuagagaagugauuuugcauaaagaguaggucagaacuaguaagaauaggaagucauucuuucuggaaucaagcccacauaaucaaauggaaagggaagagaaaguggagucuguagugaggagucaggguacucauuagcacagcaugaacuugaguuauaugcucagaacuagaagaguagccuucuauauuccccagucaccauggguaaaauauuuugagcccaagaagugcugagugcaugggacaggaggaugugccugggcuguaaugagaucaaguaugacuacagagagaaugauaaaauacagauucagugagaccacagcaaauauugagauccugucagaauuuuauagggauguuauuucuucugugugcuuucugggauuagagagcaaacugguuuucagguuuagaguaaggccaugagauaaauugugagguugacaugacugaggaguuuccaaaaggaagcaucauagaugauguccuugaccauuuagucaaacugacacuagggcacuugguuccuucuacaacuuuguauaucccagucaaaccucuacaagacuauuugccagaacuaaccaucugucuacuuuaucccuaggugccugaugacacccuugaagacccucuccauuacuuacucccugauuucacagagagauuugguuuccuuuuccugcugucagagccucuuucagcuaaaacaucuggaguugagagggguggccuuacuugauuuagaucuuaagccucugagagaucuccucaugaaaguggaaggcacucuucagacucuggacuuucagggguguagaaugaaggacucccagcucagugucuuccuaccugcauucaaacacuucucucaaaucuccaaugucaacuucuacaacauugacuucuccaugccuauccugaaggaccuuuugcagcacacagccaacuagaggaagauaaauguggacaauacccugccccucuggaaugcuaugaugaguugggucaugucucuauagaaagauuugcucaacuuugucaggaucucauggauacacuaaggauaauuaggcagaccaagaauagcaccugugcuacagauaucugccacacauguggggagcgcugggucuuugaccagguguccagacuuuguaguuguuggcaauaaa

SEQ ID NO: 2543 - RNA, 93841 nt, Mus musculus
caagcacugugcaguccacaggcgugaggacuguagcggcuugacugucuuucccgugcugggaaagaacacaacacaacuggcauguaugugugcuuacugugcaggaccuagaaagcuaccuacaggcauuuggagacaugugagacauguaaguaucacacuuaucugacuuaaauucugaagucuuuauuuucccccuuugcaacauuugcuagucuuucuauuuugggaguaugugucaagaaauuuacuuagucaggugcuauacaggcagguucacuauucuggccuccugggguaacuuguuggcuuuguuguuuggcuuuguuguuuacaaagccaaagauuacuaauuacuauuaguaucuugucagguuggacuaaaccaguugggauugaauagacuucuugcaugauuaaggccaucuuaacaccucuuacauaaaguguugcuguugguguguguguguguguguguauggggguggggaggaggggggggggagaaguugcuaguaggaaauagaaacugaaccaggauggaaaaaagguagcugguagguuuuuuuuuuuuuuuuuuuuuuuuuuuugacccagaggggcuuuuucacucauucacacuuccugguaacaagaagaaaaugcaguucaguucuccauaaauaauuugcauuuauaauugcacccccuucuucucucaaaagauaaaggcuuuaaacauucaauaacaaggccugagaaaaaggcaaccaacacggugccuuaagagugcugaaaacaacauauauuugagaauaaaacauauugaaucgacucuggaccggcgucgguaaauacccagcacagagccaugcgccgggagagacggaaaagugcaaaauccaaggcagcacucugccuugcagagcacaugcaauuugcuucuagcuuuguuggaagaagcuucagguggcacaaguaaaauccuccggacuuaaaauagcaagcuccauucacacgguaaccaauaauauuuccaguuuacacuuaaauguuuucacuccguaaccgccgcaaacugccaaauacaauuuuaucgcgagagaggauuaaaaauaggacgggguuaucgcagagcgucauaggcuuuuaaacccaccucccgccaugcaauuuacacaugcuguuuuuaaaaagaagaagaagaagucaagaaacccacugaggacgucagaaaacauuuccuugggucguuccaccucaccugaggucuccuuaauuaaccacccagaaugcccugagcucugcugugggccugcgugggccagcgucaggaaacagugcaagcacccgcgugucccuuccccauccccagcaucagcaccuagguucugcuaaucguacgagucuucucggcuucuacccuccacucaaucuaauaaagcaguuuuuuuuuuuuucccaaaacaccagcgagggcgacgguaagaagcgagccaggcgcuuggccgucccgcgcgcacgcgcaacucccgaagcgcggcgcgccggggccccgcccccuuccccucaccccaccccucggcgccggggagugacugacucccgccagccccuccacgucaaucaacucuccuccuccuccuccucgcacucucugcaccuuguuauuaaucucuaaagcgauagcgccuggacuucucuccccggcccucgggguugugagcgugugugaauuagagcgaaggcaucgaaagcucgcgucucucucucucucuucucccucucuuuuucucucuccucggccccggccucggcagcgacccggcucggcaucgacccccgcggcggcggcagccucagcgccaggaggccaaggccaagggcgggcuccgcgaggcuuucgcagcggcgucuccggcgaccgcgggcccucuccuacgcgccccggucgccccgguccugcgcggcgcggcccgcguccccccuccccgccccccgauccgucugcucugcgcucccuucggccgcccuccgccgccucggugguuccucaggcggcccggcccggcccgcccgccccgcguccccuccggccggugccucuccccccggcgggcugccugcaugucuuuacugcccucagccccgccgccaccgccgccgccgccucccccgccgccgcagccccagcagcagccgccccgccgccgccgccgucgccgccguccggacccuggcgcgcugaaugcaggugaggagggggcgcgggccucgacucccggcccugcgcgcucgccuuccggggcccggccucccgccgccgccgcggccccucggggugagcgggcgggcguggguguuuguguuugcgucugaggucuggaggggagcaucuguggggcccuggugcgcgcgcgcguguuuguguguguguguuuccccagccgcggggaaauggcugcuggugcucguucagggcccgcggaggagaaugagguagaguguuuccgugccucggagucggaccgggaguggagcgagggggagcgcgucuccccggggaagugaggugggcgagggacgaacgugugugggugugugaguugggacuuuggcgggcgggaggcggccccgcggcgagugggugugcgugugugucgcgugugugugugucugcgugugugugugucgggcggcgggagccggcccgcgucgccucagggggcgcggguuccaggccgugugcguguggggagggggacggagucggggaccccagagcgucgagguccuuccgcuucgaggccggggcucagagccucacaggugagaacggcucggcgggaacccacgccguggacgcgggaggcagugcggcccccacggcggcgggcggcgggcagcgggggcucgggccgcgguucccgaggccggggccgcggcaggaagcgcgccggccugcagcgcggccuaaccgucuucgcgcccgguggccuccccagacgcuccugggacuccguccucgcgcgggccccgggcgcugccccgggccuggccaggugagggucgggggcgggacacgcggaucguggucgccugugccgccuccgcgucucccaaggggagaggaaggcauauuuuggcguucuaacugcaggccuucccaggcuggcguggggaacccgagggaaagugaaucaaaacaggaaaucucggaauucgugggguucggaucuccucuuuccguccguccuuuaaggcugugcgagcagaggcuugaguaaauacguucuuuguuguugcaguuguugcagcggauacuuuaucguugguuagauuuuucacuucccuggaaaucacucuggaaaggcagagaggaagaaagggaaacuggccuuguuggccugugguguuggugggauuggaucaauuuugugaauuugaaauggcuuauauccugccuccuagagggaaaggcguggacacagaacugaggaggucagugaggaagaggaaguucccggagcugucaucuuaacccuaccggcggcuuauuuagcuuagacuguuuaggcggauuguguucaggaguuuagcugagcuguuuguacacagugaaggcacgcuacagcaguuuuagaugcuaucuuacugauucucguuaucuuaauucuccauggagauagucaugugcaaccaaacguguuuuuccuuaagucucccaaaccuagaucaucagccucuauggucaauuuauugugugcuccuggaaagcuaucucaaaacaaaaagcggaaauaaagguaaaucugccacugagugaauagggcauuucagaacuguauguaaacgguauuuuaguugccgacuaaccucacuuuuuauauuugggucuaguuagaccacacagcuagaccuugacuguggguggagucacacaauacuguaucauuugaagcuuuuaggucguggucacuguaaugaccagagauugcucuuuucugaaccuaggcucacagagaaacaguauguucuucaaugggaggguggggguggggagaggagaaguaaaaagcuguuucuaucaacauuacucgaggaacagccgaaguguggaguuuaauaggaaaagggucuuaacuuuuacagacuaguuagaaccauggccaugucauuaauacuuauugucauguucucuugaugucuaggauuuguguaucuguuuucuuguaucaggaagaugauacucuuucaguaagguugugagaggccauugagaaaacauguuuggcauauaguagaugcgaucuuuuacuacugccugcuacugcucugauuauaaguaucgaaaaguuuuuaaguacaaauacucauuaauuaccuguagcaauauugcuuaauugugaguuagggggucgagaaaauacagcuggggauguagcuuuguguacaaauaugugggcccuggguuugggucccagcaaugaggagaaaaaguauuucagaggccuuuaauauacauaaagucuguguaagcauaugagauguccuuuuuuuuuuucuagacguaaaauugucaauguagccuugcauguuaguuuauagaaaauagccaaacuugcuauauuuauuauuuuugauuaguuuuaguuucauuacuuuuuaaugaauuuaaaaacauagucccugggagaggauccuaaguucuguaaguugauuacaaucaaacaucagaauagaugaaagaaguagauuuuauauacagccacaaacaauaaauguuacaaaacuguuacauaauucuuuuaguucagguugacagauucuuguaaauaaaaccuuugggagcaucuuucugaguuuuucuaccauccuguaauaaucugcuguuucuauuuuguauagaguggguaguaaaugugcuauuuauugaguuuuaauuuuuuuaaauuuaaauuuauguuuuuggaaaaccauaauggugagggguguaaaguaaaaccaguggaaagguuagaagaauuauacuuuuuaaaauuaaguguuuguuuuugagagucuugucuuguagagcagguuuaccaaaaacuuacaauccucucgccuuagcccccuuauggcaauuagaggcauuugcauuucacuugguucuaauuuaagagguuuguuugcuuacuugcuugcuuguuuuauguuuuagggaaugaggauaaagacaguagugagaaugugugaaugauuucauuaagucccuuaaaaauacuaguuugggggguuggagagguagcugagcaaugaaaggaacauuguacucuuucagaggaccagaguuggguuccuaguacccauguugugcagcucacaagugacugacagcuguaggggaucucacacccucuucuggcuucagaggguaccuacauucagugcacaucaaccacauauagauauauaaacauauaauacaaaguaagaaaaugaaucuucaaacgcucaguuuuccuaguuagaucuuaucuuugucuuaaucaauaaucuuaguauuuucuaaaauuuguaaguuaaaagugagauuuucuaaaguuucaaaauauucggugaaaguuuuaauauauaaacauccaggcuucggagauggcucagcagguaagagcacugacugcucuuccgaagguugugaguucaaauuucagcaaccacaugguagcucacaacuauuuguaaugagaucugaugccuucuucuggugugugugaagacagcuacaaguguacuuauguauaauaacaaauaagucuuuaaaaaauuauuauaaauauccacugaaaaauuugacacucgagaaugcaugugugugcagggucacugguuccacucuggcuccauuaagguucaagaucuguaucugcagcuucgucugcaaccuuuccccugugaccaguuccccuucagauaauucgauaaaucuguacuuuuaaugaaagaauuguuaauauaucuaaugggaguagugcacacacacacacacacacacacguagggacagcuuuauuagaaggcaaauguacuuucauuuaucuaacauacaaaguuuuagguaucacuaugguaguuucaaacaaaauuuguuuugauuuaaccccaucucuccuacccuuuaauccucuuuguuuuuaucuugacccacuuuaugguuucauguuauauauguucuuagucguccugucccuuuucccuccucaugaucucuuuacuuguucuugguauccauucuaguauuuuaggcuuuauccacauuuauucccccuuacauacauacaucuauacaagcuaggaucugcauauaaagagagaauauugguuugucuuucugcauucggccacuugacuuaauacaaugcuuuucaggccuaucuuuuuuccuauagauuucacuuuucuuuacagcugaguaaaauuucacuuuauauauauacuacauuuucauuauaggcaucuagauugauuccauuuuccuuguuaucauggcaucuaugcugauuccauuucccuugcuaucaggaauguagcaccaauaagcauguuuaucacuguuguaggauauagagucuauugaguuauagauuuaguaguaauauagcugggucaugugauaguccuguuuuuauuuuuuugagguaauuucuauaacagcuguacuaguuuacagucccaccagcaguaaguagggauuccccuuucccuauauccucuuuagccugcuggcacacgccuauaauucccagcccuugugaggcagaggcccuauagaacauagugaaucucuguuacagaaacuaaaccaaacaaccccucucccuaaacaaacaaacaaacaaacaaaaaacagccccccacuucaagcaaacaaaaaggugaaauauuucgagaguuuauuuuuauuauuguuuuuguuugucugguuguuuguuuuuugaggcaacauuuuucuguguaacaguccuggcuauccuggaacucucuguagaccaggguggucuugagcucacagagcuguuugccucugcaggaaauuauucuaaguguugacauaucuugacuuuuauuauuacuauuauuauuauuauuauuauuaauuggauauuuucuuuauuuauauuucaaauaucccuuuucccgauugauuuccccuucagaaccccccuagcccauccccucccccugcuucuaugaggguguuccccacccacccaugccucccgcccuggcauccucuacacuggggcauugagccuucacaggaccaacgaccucucuucccauugaugccagacaaaggccauccucugcuacauauguggcuggagccaugggucccucuauguguacucuuugauaucuugacuucuuuucuuuuaaugauuauuuuauguauaugaguacacuguacccgucuucagacacaccagaagaaggcaucggaucccauuacagaugauggugagcuaccaugugguugcugggaauuuaaccauugagccaucucuccagccugguuaguuuauuuuuaacacuggaaauacucauucuuuuuguuuaaaguaaagaaauuauaauaaaguuaaaauggaauauuguuuaggguuugugauuuaauguuaccuaagggagcuuuaaguaaccuuuccagaauacucauuauaaauaccuuuaauuaagagggauuggaauauuaggaauuucuguauuuauugcuaaugauaggauaauaaauucaauacaaaauuuuagugcccuaaugcacugguuagcauggcaauuuucuguguggcagucuucuuuacagcuccuuaagcuuugugacuccuccauuccuaggaucuugguauucugcuuauuguucacagacuuuuuuuuuuuuuuuuuaagaacugaaagggacauuuccccaaauuucauggcaagaauuuuucauagcgcacuauuuaaguauaaugagugugagaaguagcccuggacagauuguuuaacuucacugcaaagggcuucaggguauuauuuuaaaugauauuacauacuuguaaaaguauaucugaaaguugaauuaugauacuuaagaauugcuuuccauauucaacguaaaacuuugagggaaaaguuggaggaaaggagagggggaggguggagagaaauacaagaaaauggggaccauaacucuaauaugugaaagacuugaauggcacgugaauuuuagcaacuauuuaaaaguuugcaacuuuaugagcacuuaacaguguugugaauuugguagguauguccuuuacucugcaguaauugauggucauuguguucacuggguucuggcuguuuaauguauuuccuguauuuugaaaucaauugggaucugugagccagaacucuaaauuuuaguuuauggaguuaaauuucacagagcauauuuuuaaaaauuucuuuuacuguuaguauuuacacucuaaagaaucauuacuuaugugaaccuuggcauguucuacuguuugcuuuugcuauuuuguaauuuuaaagucacuaaaauaauacaugugaaucuuaauauagaaacaacacuaaaaucaucaaauuacccuccccacuauaauuuuuaaucaugugcuucaugauaaaaaugcuacaucuuuguuuuacuagcugcacuaauaccuucuagagaugaauuuuaucucuggacaacuucaauuuuaguugaauuauaguucauucuuuuauugcccagaaaucuuacagugugaaacuuugacucaucuuuacuuaccuuucccuaagaacuugacuauguaucucugaguauugcuuagcuuaguuauuuaauuucuccuuucccucuccuccccauuccuuuccuaucguuuuuuuccuucuuccuuuccuccucccuccgcccuuccuuuccccucuuucucugccucccuucccucugaggaagauuuuugaguaguuugguuaacuucuucaugguaaauauuucuaauguuuugcauuuugaaaaauuaaaaacccuacuugaagacccauucuguacccauuaguauacccgauucuaaagugaacgauggaagauguagaggagacauuguaaagccaaucgaggccugugcauacaugcaugucuguuacuuucuaauuauaauguucauuauacuuaagcaaaacaaaaccccuaaaauuaccuacaguauauauucuguagguucauauuuaaugcaacaucuaguguaaauuuuugaaaaauagugaauucuguacaaaauggaaauugcuagucacuugguuacuaugacaaaauagccaagagaaacaaaggagagaaaauuuauuuuagcucaugauuugaaacguuucaauccauaguugauugguuccauauuuuuggaccauggcaaggcagagaaaagcuguucuuuagaguauuuaggaagcugagaugaggugggaacaagacauauccuuccagguaugcccucaaugacacacuuccuccacuuggacccauuuccgaauuuuuaccacuucccaccccaaucaugacaucaaauuauuaguagaaucuauuaguagauuaauccacugaugaguugaaaguccucaugacaucuuccuguagcccaucagcugcuaacuaagccuuucauacagagccugcagaggacauuucagacucagagcauaauaauaaaccuugaaauaggguaaaauuguuucagauuugaaaauuuuuaaucaggaaauguauuaccuagcugggugucuaaguuuacuuuucaauugcugugaagaacuccuucucacaugaccaagacaacuuaaacggcauggugguagauagaggcagguggaucucugcuuuugaggcuagccuacucuacaaagugaguuccaggacagucauggcuacacagagaaaacuguucuggucaaccaaccaaccaagcaaccagccaaaacccauuugauuugcaagguagaggcagagagagaaagcuaacugggaauggugaggguuuugaaaccucaaagccaacucccagugacacaccucuucuaaggccacaccuccuaguucuucccaaacaguucaacuaggaaccaaaaacauucaaguguauuagccuaugggagccauucugauucaaaccagcacacugguauaccugaaauuuuagcacuugauggauuuaggcaagaucgaauccagggugccaagcaugcucucugugugucuuuucacugaguuacaauauucagccugccuucuuccuuccuccuccuccucuauuggaucacaucuuuacuguggaauggaacuaauacuuuuuagauucugaguaccaaggacuaacaaaauucaagcucauagcccuuauacauguaaucugaauuaaucuuucugaaaauacugugagacagacaguauguuucacauuuucuaauagguuaagaauuagaucuucuauuuuguagcugucagaaauucauuuaauuuguuucaguuucuucaucuguaauagggagauaguaauagcauuuaucucagagaugaauaugauuuaaugauguaauucucauagaguguuuacaguaguaccuaacagaucuguaauaaaagcuuuaacuucaguauaugcuugcuauuauuacaacuucuuacuauuaguaaacuuauauuugacauuuccugauuacagugaggcauguuugauucuagagugcuuacuuauuaagagggaauuuaaguuugguuacagcaaacuagugaauaugcuagcuggcaaaaacauuuagugucacuacacacagaguacauaauagguuuuaacuuacagggaugaauaagcagaggucuuuuuucccuuaaugaugagaggaaaggaaggcaagaaaauagguuacagcaacaucuuucucuaucaauuuccaucauuguccucuucguuccuuuauacauacuauuucuggacagauuuauauaaauuucauugcaucuuuuauuucauauguaaaaugcucacguauuccccagguuagccaaagugagugacuuacagucugucaaugcuuuaaaugugccuauaguaccuuaugcuuuaugacccaccccacugccuucuuuaauaauucaccucagguguuacuuacucugggaaaccuuaugugacacuuccaggcuuugcuuuaugauuuuucuuguaugccuuuaacauccuuaacauuccucuuugauaaaauuugccacagggucuuauaauuaucugguuuauguuuuggcuuuucuaauaagaguaugccauuuugaagagugcagaugauguauacuucaucuuuaugguucaaacguuugaaacauaauagggaacaugaaaugcuugguauauaguaagaacuuaggaaauauguauuaaauuaauaagugccauuguaagcagugguaauuacaucaacaaauaucuacuuguggauguuaaguguuuagaaaaucaguuuaacuucugguuagauuccauggcuugaauaggaacaugaaguuaauugggaaaauuaaagcaugauuauagugggauaugugccuaauaaggaauauuaauuuuguccuuaagucauugacauagauuucaacaaagcaagcauuuuuaaauacauaaacugagauuucuuacuaauauuuaaauuaaaaguuauaauguggcuuuauuuuagaggauauucauuaguuaaccacacuaguagauacuauauagcuuugaaaucucauuuuuaccuauacuauuaaagacauugggagcaaguggaugauuuugagcagguuaguaacaaaguuuaaaguuuacucauucuuuuugcugugcuagggauugaaccuggucuugcacaggacaggugaacacccugauuucugaaauuuuuuaaaagaauauuauaaccuggacacuugaagaggucuuuauauggguuguauagccugaucacuagccuagucaagccugagggguguaccuuucguucuucagcagagaagcuuaauuuugcagcauguggaggccacuacagagauccacagcugaugaaaaucagcaagugagugagugucuaacaccaauugggucuaucugcaauacaaccuguacauuuaaggcucagggaaaaucauagaugaggggucagaaagaugguaagagcccagagaaccagauugccugcugcaaggacaugacccagaagcugaaccaugacaucucaacaauaugauuaccuaaacaagaccugcauaaugacaccauucaacaugccauuguggguggguuaaucuuacaagaucccacuccuauaugaggaguuuuagguaaucuguggcugcugcgagaaggggaguuaaguuuuaucaagugucagaaauccuaauacccaauucugagugauuagcccuaauuacauguucauuugaguaacacuaaaaaauggaccuaauggggugugugugugcguguaugugugugugugccugcagaguccagauacauacauacagauguaagugauaaguuuugaauuugggagaaaaucaguuuaacauggaguuggacauuggaggaguuggaguagagagaguagaaaugauguaacuacaguacuuauacgaaauuaaauuaaauuucaguaaauugacauuuuaaguuaaaauauagucugguagacaagaaaucaguugaaaugagaaugguaagagaguuucuuuuagcauuuagaauuacaauauaaaugguuaagucaagaaauagguucuaaaggugugguagauaugaucaagacuuaugaaauucucaacuaauaagauuuauguugggauuaaaaaaaaaacuuucaagaccuaucaacuguuuuguaugauggagagagcucagagccaagucagaacaugaugaagagucaguucagagaaggaaauuaagaauuuuuuguuuguaacuuuaauauuuucaaacccuauuuuuaaugaugguucuuaaauacuuuaaucuccaguuuagcccacuucccaccagagguagugggaaagaaaggauaagggagaaguggaccuguuuagaaagguucuuuggagcagcucccaucuguguugucuggaaaucagcaguucaguccacaggucagcagcgucagcucaguccacuggcaaacaccucacagauagaccagcagucaaguucaguagaaucaccacaaaucaacagugguggcacuagcuagcagagacagccaggccucaguuagcaggagggaccaguaggaacaucagaagcucucagcugugccucucuuaggaaagugaagaucagugaagauuugagacccagcuuagcacagcuagcuauaccagcaagccaaacucagccucugucacugucuguggaguccuauuuaaucccuccaaacaucauguguucucaaagggguuuuugcacaugcaucugucucagcuaacaucacugccaaucagccugaguuggaagcagcaagaaacuucagcacaccaccagaauauuuuuggugcauuucuucucucuauggaguuccaacaaaugcagcuuaacuacacaaaguaagguagacuaauacaugcguguuauuagcaaagaauccuucaucagguguccuuucacaugccugcuuuagcagaacauccucucucucaugucugcuucagugaaauguuugccccagcaaaacaccauccaaaugacuuuccaaagaacacuuaagcuuccgcuuaauuuguuagugguggcacauguuuuuuuaccucagcauuugagaaccagaucauccagaugucugaguuugagcccagccugguuaauaaaccuaguuucauucaggccaaccagagcuacauggugaaaucuugccucagaagacaaaaauaaaugaguaaauaaauaaauaaacacauuuaaaaauguguuagagaaauagguugguguguucucuacuggauugacuuguguuuccugaauuuagacucuccuuaauucuugauugaaugaccuggccugugggcuucagagauucuuaacuuuugcuagguuuugagaacuccacugauagccuagggaaggcugcgguuuauuuguauaauugaagguaaauaaaagaaaguaaauuggauuaaaaggaaccuguugggcugaguauuuaguugauuugguagaucucaagauccuggguuguauuggccugugccuggaaucccagcacgugagagguagaggcaagagaaucacaaauucaaggacacccucugauaccauacaugagaccugguuucaaaaacaaacaaaauuaguucuucccucuaaaaaucccuaaugaaacaaaacuauuaaaauacaugugguaauaaaguauauaugcuucuuucuuaguguauuuaagaagauauagugagucuaauaucagcuauaauuaugaaguaguaaauauuaugagauuuuuaaaacaacuauaaugauaugaacaguaaauuguuuuuuguugacagaaaucauaguuaugaucacuacuauguggauugucuaugucuguaugaaaaaguacuguguuuuagugaaaacugugguacagauuuuuccuauacaaauucagauucccugacauucaugggccacagauuaauaaccuaugcuuauugucuccuggguucucucaacuuuauguauuuuugucuuaguuauguacuuuucuuuacagaugauaguaauuuuacucuuuucaucuuuuugcaaguaauacauguuuuuuuuaaaaagaaaaauuugaaaugauacuggaggauaauuuccugguuauuuucuuucauaguaagacuauuaguauaguauauagaacuauuaucuaggcaauaugcuuuuauauaaccauuaaaacauuucauauaaauaaaagaauuauauuacauaugauguuuuuaauuggaauaccaucacauuaauuuuuuuaucuagagguauguuuuaugcuuucaaauguuuaugugcuacauuaagugcuaaauuccuauuuuaaaguguaucucaaugauuuuagcauaucuacauuauugugacuauaucaccuauguguagaauauccaucaguccuuaaaaaaaaccugauauggaauauuaucucuauuuccccuuucugcugggagcuaucagcuauuugcugguuguuuuguuguuuaaaacauuuuuuuuuucccccagacaggauuucacuauguagcucuggcuggcuuagaacucacagagaacugccugcauuugccuccugagugcugggauucauauuugggauguguuuguuuuuuuuuuuuucgaaacaggguuucucuguguagcccuggcuguccuggaacccacucuguagaccaggcuggccucgaacucagaaaucugacugccucugccucccaagugcugggaucaaaggcgugcgccaccacgcccggcuaauauuugggauuuuuaauggacugccuguucuaggcauuuaauaaaaguagaucauacaugugaucuguguaguauguaauauuaaaaaacaacccaugcuauugcaggcuacucucuagccuccauggcuagccccuugucguggcuagccccauguggcggccacccagcuagugguucacuugcugaggaaccugcucacauucccagccaucugccccuugugguuagcagucaaaaaucuccauaacccagugaaaucauaacuuuagaggcuuguaauuuaucagucagauuuauauuaggaaauucucaauccacaaaacacccacauaaugaacucagagccaauugauauugauacaagcuacccaccuagauuggacaaauuguccuauauuauucuaucccuucuaugacauuuauagcuaccuguuuauaacuaccuguggcuauuuaaagccaugcggauuggguucauccucuccuuccuccaucucucuaaaacucucagcccgccuucuuuuucuguugcccaaaucacaggcucuagccuuaacuugugccucccccucaccugaaucuacacuuuggugcccaacuucuuuuucauuuagcaucauauuucaagaauaagccauuugauaacagguaauacuucauucauuuuuuuuuugagauagugucuccuguaucauguuaauucccaacaugucauggauguuauguaggauguauagcaaaguaugacucuguauccucuugccuccacuuuguaaguguugccaguacagccguguaucagcacaccaguugauagagugcugggaaugaaauucaggacucuguagaugcuaggcagucuuucuaugacugagcuacauucccgguucucauucuuuguuaugguuaauaugggguuaacaugcuuuuuuacauauguauauuuuuggacuauuuuaaauauuuuugcuguaauaguguauagaauuaguugggacauauguuuuaauuuuucuugaguauauacuuaagagugaaguugcuuauauaguaacucugaguuuggaaguaauugauguauguuucuauaagucauuuuuaauggcuucacuuuaaucuuuugauauacugcuucuucaaucuccugcuagcugauaauuuaugaugauuaucaaaacaaaauaaaaaauauaaaugucuuugaauacuuuuguauguguguggguuguuuacuugugucugggaaugccuguucuaggcauuuaaugaaaguagaucauauaugugaucuguguagcguguaauguucaaaaacaacccaugcuauugcaggcuacucucuagccuccauguuauguguguauguaggccagaauacugggaugucuucuucagucauacuucuagagcccacauggguucuggggcucugaacucagacccucgugcuuucccagcaaguacuucacacagucaccucugcagcuuccauauugaaugcuuuuuaaaaaauacuaauuuauuuauguauauauauuuuaaugugggagugcccugucuacauguauaccuacaugcguuaagaggccaucggaucucuuuauagauggucaugaguuaccaugugauuucugggaauugaacucaggaccucuggaagaguaguguuauuaaccaucgagccaucucaccaguccuugaaugcuuuuuuuaaaggauaaauuucuacaagugggcuugcagaaucaaauaaggauauaauuuugauaaaucuugucagauuacucuuuagaaauacauaaaauuuuacuaccguggguuuuggggccugaaaacacaaaacucagugguagaauguuuggcuuagcaagaagcaugagguccugacuucuguucacaguauuccugaaaaaauuuuaucaucagcuuuuuaaaagcugcuucuuucucuaagcucuugucauguuauuaaucauugcuauucagagaauagucauauauuuaaaaaauauuuagcuuuuugcuagugaggauuuuuuugucucauuuuguauucuuuuaauacuuuuacauuguuuugugacuugccugaucaugacauucacccuaaauauuccuauuggaauuuauacuuuucuuuuuaacugaaaaaagaaaacuuguuguuuuagaguaacaacaacaacaacagcaacaacaaauaucccauuguacugaugcuuauaaauauuuuagagaguuuuuguuacaguuucuggggugucuuuugacuuuacucuuugcuuuauuaauguuaaacuuuuugcuuuauuuuuuaaagacaggaucuuacuguauuuaggcuuggcuaucuugaaaccuuguauguagacuaggcuagccuugaacucagagaucugucuaccucugucuccugaguacuggaauuaaaagugucugucacuaagccuccuucauuuuuaauuuuacuggucuuugccuugcugaaaaguucucuacauuaaaacuguaaaacuuguuuuuucucuauuuuuuucuaguaauguacagaacuaagcuugggauugcuuaguaggagcuuacauuuuauagcuggacuuaacuuauauuucauaguuuuggauuuauuuuguuuuuccaaguuaaggaucaaaugauaugcuaggcaaguauuauauguaucucagacacuuaaucuauguuuaaauucuguuaacuacuuuuuaggcuuuugaccaaaaucaaguggaacauuguucuuaccaguuuucuaucugauguguucucuguucaagaacaauacacacacacacacacacacauguauacguguguguguguguuuuugaaguaaggagauggauaggaacaugcuauacauuuauucuauguacagacuggauauugcaggaauagugcauccuguggggacuuaaaagaaauuauauuuagguaucaucugugggauauugauuguuucacaacuuuuauuguaucucaauuuccuuaucuguaaauugacaguugauauauaauuuauaaauuuagugaaaugacauaugagaguucauguugucugggcauuuaguacguguuuucuuuuucuaauucauaaaccccaucuuucuuuauccuacuuaaaguuugguccagaagauaagacaaaguuucaagauacuguaaugcucaguuuucaaaacucaaagucauuugggauuaguacugauuaaaaaggauagcaaaucuucaguuauuaagucauuuuaaaaggcauuuguucaguagccacauuuuaauaggauaagggcuaauuuaagcuguguaauauacauaaagaaugugcgcauguauauacauuuagaaaaauuuuauucaucaaccugauuaagaauuacucaauccagauuuaguucucaguggcuccuuuuugauauuuauauguauuauucauuauauuacauugauuuuuuuuuaauuuuuuuugugcagaguaauaaaauacuuuguaaagaaaugugaacuaggaagauguguauauuugucauaguuccaaaacaguaagaguuuaaaauuuuauuuauaguuuugagauuauaauuuaguuggcaacauuucugucuuuccuuucaucuuuucaaacacucccauauaccuuucccaguucuucaaauucauggucucuuuuuuaauuguuacuacaugccuauauguauauuguauauauacauaucccuaaacauaaccuguuggguuuguauagugucacuguggguauguuuucaggacugacuggcacuggaaaaaucaaugggugugcucuucccuggggagagacauccuuccugcucuccgcuuuacucaguugccuguaguucuuuguguagggucaaggacuugugugagcuuucugguccaauuugacauguuuguugguaucuuuuuguucagcucauguuugggcagucauguugguaagacuuaucaaguauagcuucugauguuacuaggagauacaaucuuauaguuaaagugccuuauauggcucuuagaaucuuuuugccugcuuuccugcaguguuuacugauccuuaggugugggagugucuuguagauguaucuuuugguccugagcugcucaacucugcauacugauuugugguuuucugcaaggaguuuccuugaugaggagacaaagaccauacuuauuugggggguguaaggacaauggucuauagauuguuguuagggaucgugcugguuuaguaaauugauuguggauucuccuccaguaaccauaauuucacuagaauggaguaguuagcuagguuuucaggaccagauuguugaugugguucauaggcaucauaacuggguagaugcuuaugagaacuaguccacagggagugggaguucaggucaguuccagcucagggucucugggcccugcuucugaagugucuucugcaggagggacuuaccuucugcuucugguggguuuccaaggacagcaguaguaggcuauaaguuuugugagucucuuauaggcagcccuggcaaacaacuuaggagagggcuucucauggcuaguauugaguuuuuugguuauuuuuaggacaagggaaacaguucuguuacggguuuuaucgaaauguuucuacaaucuuauauuauuauaucuuuuguaaaaacauaauuucaaaauaaguuuaagaaaaauguagaauuuucucaguuauaguggauauggauuguauguaauuaaguuucaaaaauuguuaaugaguacuauucuuugacuuuauagcuaguagcugggcagugguggugcuugccuuuaaucccagcacuugggaggcagaggcagaggcagaggcagguggauuucugaguucaaggccauccuggucuacagagugaguuccaggacagccagggcuacacagagaaacccugucuaaaacaaaaacaaaaacaaaaacaaaaacaaaaacaaaaacagaacaaagacuuuauagcuaguguuauuccuaaauuguuauauguguguacuguuacuauuuuguauugucuaguuaguggaacaaaaacuuuuuuaugucacagaacuagacauuugcuccucugugaccuuccaugaggucuuaugggggcauuucuacuccaggacuacaauuuggaagaacauuauauuuuguguguuuuguugcuucuguagagugucuaccugccaagaaaacagaaacugaagucagguuccuggaccuuuguaggaaaugaacaaauaaauuaauuuucuucugauaauauacagauuacuucuuucaguggcuggcuuuuguuuuuacuuugggccauagcaugggaacauucuugacuuagagccuuugugaguucucauguuuauuuuaaccauuuauuuuaggaacuauuuuaagguuaccaucccuucuuuccaaaccuuguuggcuugacaccuuuugauagguguuuauaugaguagaauagauauuuuggugagaaauuauccucccugcuucaccaucaucacaagguugauuucuuuguuuuaugcuguaguggacuugucuauaugauauguugacccuuuuacagucacucauguaguuugucucauuuuguuuauagaagcagagaugguuucauuucuaggauuauccaaagaacaaacguuggugcuguaggauuguuugccaauuuuccagacuguacugcugauggauuuucuguacugcuagugggauguucucugugcauaacuuguuauuaauuagcucuuuuaggagauagccuggagggagggagagagaguaugugugugugugagagagaauauguauguaauucauccguuugucugucuagacaugguuucacuauguagcucugccugucccagaacuaaccuugaagaucaggcuggccuugaacucaugcauaucagaaggcuggaauucaaagagagcgucagaauacuacauugaacuacuuaauaaguguuacaguuggcccuuucuucuuuccuauuguguuuuaucuagguuuguuuguuuuuguuuuaucuaccacauccuguccacaacuacugauuccuuuucacucagauuuaucccagugccuuguccccaucacucgugagcuuuaaaauuuagccauucuaauagauguucagucagcuuauuuacaguuccuugaugcuuaauguuuaacaucuuacauguuuauuuacuuuauucugaauaugugcuuauuuguuuuauauguaucuuuagugaggaaucauuuaaagucugugcaggagauccaacucauauccaagguauauauucuacccugagauauacuuguaguuccuuuuaagauauuagauuguuguaauuuguaagguuuuuuuuuuuuuggaugcuuuuuacugauacauauuuugaaaaccuuccuaauaucaugauuaauuuuucaaauaguagaugcuuuaauuguuuauggaauguauuugcuuauuaguaguauucuuguauggauaauuuuguuucuuugaaauuuuuguuuaaauuauggacuuaaaaaguuuauuuuagaacuucuuucuuuuuuuaaauuuacauugguuuucugccuccauguauugacauguaugugaauccccuggaacuggaauuacagacaauugugaacugccaugugggugcugauuugaacccuuauccucuggaagaacagccaguucucucaaccacugaguuaucuuuccuuccucucuuuuagaauuuuuauacuguuugguuuuacauuuaaguucauagucuuuuaaguuuuaauuugauuaaagguauggguuaggguuuaguuuugcauaugaguaucucauuuagcauuuguugaaaauucuauucuuuauugacauucucaccuuuguugaaaauauguuggugauauaugugugaauauauuuggaauugguucuguuguauuauuaguaccaaacuaucuaggaaacuugcuucugauaagucuuaaaaaaaaagugcccauguaaauguauuuuuuuuuuuuaaagaaaaagucuuugagaagaaauaguuugggacaccauaaauucuucuuacauauauuuuagaaucagcuuuuuuuuuuuaaaugauguauuaguggcaauuuauaaauguugcuguuuucuuuuuaccuggcuaguucccaaauaauugagacuagacuauucuauuuauuuaacaagcuuuaagggcacaacaacugagcaguauuacucuuaauuuuuuaaaaaaguuuuuuauuagauauuuucuuuauuuacauuucaaauguuauccccuuuccucguuuccccuccgaaaacccccuauccccuuccuucucccccugcucaccaacccacccacucccgcuuccuggcccuggcauuccccuauacugggguauagaacacaggaccaagggucucuaauacaauucuuuaaacaaugauacuuguauuuuaguacugaucuugcucuuuggacuccagguguuuucucauggcgccccccaccccaacucucccuggggcgaauccccacuuucucucuucauuuccucuuugccuggcuggaaguccagcccuagucccuccccugcucagucauuggaugaacagcuuuuauugacaaaucagagaauaauuggggagcaauguuuauacaauacugaggcaggagguucucagaaugaggauugcuaucagauaugcaggcagagaaaucaacauuugaauaauacaaggauagucuuuacacaguaaauagcuacaagaugauauacuguuaaggugaauagaugaauuaagccaagaaaauugcuuacuuaagacccaugggaaggagugagagguguuacauauaaugaaauacuagaaaacacguaugaaggagaaggcagaaagccaguauaguaguuguuuuucuugucguugugagcaaacacuugccacagacaacuuaagggggaacuauuuaguugacguuuucaaagaauucaggccauggcuuuugaacccaugaauuuagguagaacauuaggguggagaaaaagugugacaggguagucugauaaagcugacgggaagcaguuaaaggaaggaaggcauccuagggauauguaaggcuccacggacaugacuucugugaccuucuuccuccaaauacaucccagcccucacacuuccacacacuuuuaggaaucuguuuagauuuuugaauccauuagcagaacaaaacauuucuuaggucaggucccuuaugaauccaguucuuuugaaaacaucuucagagaugcaucaugggcaugcuuuauuaauggaguuacuucucaguuuagugauagugacaaagggaaaugucagaagaagucaugauucugggagaauugauuuaugaggauuuuauuaacauucacuuucuggaggauaauuagaaaaaacaagagacagugaagcauaaugguuguuaggagacuaagaucuaauuaggaugguagaaaaaucauaagguuugguuuuucaaauugauucuuaucugacaggaauauucauuaaauuugaaccgauggauacaauagccauaguuuuaggucuuguguccuuucuuuuuuacuauuugugcuuuuugucacugcuauuuucuauuauccuaaauacaagagaaagauuauaaacauguaccaaaggaauugugucuugauuuuuuuauaauuuacuuuuaagaugcuaguacauuuauuuauguacuuacuauacauggggguaguggugugccacaguguauuagcaggagucaguucucuccuucuaccaugugguucucagggauugaacucgggucauaggcucauuagcaaauagauacuuuuacucuuugagccaucucuuuuuuuucuucuuuuucuucuucuucuuuuuuauuucuuucauuagcacuaugacaugaucucauccuuuuccagaaacgaaauuuuccuccagaucucucuguauugacauaaauuucuggaauaucuuugaaaaaccauacaacaucucuucuuagucuuuauugcccuuguccccauguuuuuuguuuagguauacuugggauaugagguagagcccuaagaauaaaugaaauaaaaacaagacauugaauuuaguuauuccuaaagacaaagaauucccauuauggauguuaacuaauuuuuugucaauacaaauuguagacauaaauaccauugccacuauagaaaaccauuugcuaucacuuuaaguuaaauauacauguauauguuauguauaugauaugagacuuaucuuagucucauucccaguauaggauauuuguuaucccuguucugggaacucuauccuuuucaccuccuugacuauucuauagguuaucuauuauuaaucgcuuuuacucuuuaugaagagaugguuuccuuuuuagccguuuucauuuuaauauaauaauaguauaaaacaaugcaacuauuugauuaaggggaaauauuaagaagaaaugucauuuaauaaaaagaaaugucauuauuuaaaggauuauuuaaaaguaaaauauucuauguuuucaaguaaucagacauugaagcauuaggacaugauacaaugaaugacagcaguagauagucacugaauauuucuuuuccuccuccuuuucuuucuuucucaagcaaugucucaugaaaccugggcaggccuugagcuggucucagacuaagaggucugccugccucugccucuugaguguuggaauuaaggauguucauguucaaucccaacccaaucaagccaauucauuaguuaauuuuuagacaaggccucuauuuuuucuuuguuuaaaguggucacauagcuggauacaucaaaacuugaaugguuguauuauauagacacuauuaaauuuaucagugaucagugccauccauagaccauugguucaggaguggaucacuaucaaucucuaauugauccaacuauaugcagugccguuuguuuauuuauuuauuuauuuauuuauuuauuuauuuaccuccucccucucauucccuucugccucuugcuccgaccccucugcucacuccagcccauagguuuuuuauuuuucucauuacagauagucgugagucaccaugugguugcugggauuuaaacuuaugaccucaggaagagcaaccagugcucuuaacugcugagccaucucacuaguccgcagugucauuuauuaaguaccuuuuuaaaaguaucagcaggucuaaagauaauaguugguaaugugcuuuuuucagguacgguguaaauuuauuuuauauauuacauauauaugguauaaaaaugacuagugguuaauuuagguauugguuaggaaauaagaacuucaaaaguguacugcaaauauuuuauuuggauaaauagauaagcauauacuuauuuucucagaaagaaaccuuguacugucagauagaaaggaucagagugagaaucaagcaaagaauaauucauguauguguccccccccccccccuucacuucccuuuguuuuggagacaagucuugcugugcagcacaggcugaccuugagcuucugauccuccuauauccaccuucuaaguacugggguuaaagugauauuuuacuguuuuugguguuuugccuucuuuaaccacugagaauagaugccauuauaggacagcuuuguuugagaaauguaugcaguacuauaagccauugaaauuucucuaaaauguaagcugacauaucauacacacauaguuuuugcuagcuuuucuaucugaugucaucauuuaauaucucuguagaaacaguaugaguuuaaugauuuguauuuuagauuuguauuguuagaagucuucauugugaauuacucuuuuggugauuuguaacauucucuauuacucuccaacaaaaucaugcugaacuacagagacaaauuaauuucaacuugugagaggguagccaugguuuaauaucauaagacuuagauguuuacauauacuugaggcuggucucccccggauuuuccucccccucuccucccucucccucuucccuuuucucuccccccucucccccccucuguuguguauaucuguacuauauaguguuguuuaauuagcuaacagugauagagauucaaacuuguuuacuuuagcauagcuuacauaagaacuaagaaguaguaauacacuuucuuaaucaguaauacaugacuaauuucagaacuuuuacaggggguguccaaaggcugcacaggugguauaguagaggacaaaauaggugaaauucaaagcaacuuguguaguuaggauuuagagaaccacauuuuuuccuaguuuuuuuuuuuucaguguuuuuccuagugucauauacgguuuaaauacuuaagaucaguguuguuaaggggcuuuuaguuuauuuuguuacauacucagggccuccagguugcccuaauguuauuauccuuuggaaauugauguaagauauuguaaaaauuggaaaauugggaaacccaacuuaacaucucacuguggguuugauguguaccacuguaagaacaaaauauacaaaacaacaacaacaauaaauauaaagaaaaaccccugugcagcuagguaugaugguaaugucuauagucucugcauuuggaaggcuuaccagguggauuaugcacauaaggcuucuaaugugauugaggccagucugagauaguaagagcuuguguaaaacaacucucuaaaacaacacuaaaaauaaucccuccucaucuugaagagaaaauaugaagaauuagcuguuaauguuuucuaaaagaaaccauuucucuuucuuuggauggaagcugcucaucacucaguguuuaaacccuagacuggcuuguaugcacaguuaaaaaacauaaccagcaucacacuuagggauuuaaauuacguuugagcuuuagggaaaagaguaaggaaauucaaaguaucaucguauuuaaauugugggcagcaucccagggaaagaaaauggcaauuacaccuuucuaccucaggccucaggaaacuagagcagucaaacccaugguagcuauagugguggggagcaggaauggaaaaguauaguuuauuuuaauuuauagcuuaauuuacuccaucuacuucucuaucucuuuagaauagcuuaaguugagccugccuuuguagguauaguuucuugaccaggugauugacuuggcacaacuggaauguuggaucucugccuaggccagugucuucaccagaaggauguuuuucuacuuuaacauuguaacuccaaauagcacaguaugauaagauuacguuugaagaguuaacuuagggacuggagaauuuuacuguuaauaaauaaacaacuaaggaaaacuugcccuccuuuaaguaaagggaaacugacgugagaaauuuugauuucuugguacaugauggaauacuacuaccuuuuuuuuuuuuuugauaugcaacaagcuuaagaccuccugauacuauuucuuaacuuagaaauagauacagauuugaauacuugguuuaagggcacaugugagaaaggacaaagaaauaugagcaaagaaugcugagaaugcagccuaguaguagaacucuuacauggcaugugccaggucccuagauuagaucuguuacugacaaaauaaaacauuaugccagcuguaacuauauauguaauaugcgauaaggauaacauguagauacuuaauuugacacacaugacuuuguugcuugcuguuugaucugaaugaccugaaguggauuuuaucuucuguuugcuaucaaagcaguaguucuagaccccuggaauaaaguuauuuuuagggcuuuuuuuucauauuuaguguauuugaagugauuuuaugauugguguagucaccauugauugugcugugauuaugaaaacaguagcaugaacuuuguuucaguuggcauggcucuguaauuuaccuaguuagguacguuugagaguaaaagggagugccaguaauuacccugguaccacaggguuacaguaagacugacuauggcaaaucaaguuaugcauuuaccugguuaggaugugcugauggcauggagcagaagacaaaacucagcuugcugugugcagggacugcauguaugaguuauugagaaauuugccuuuucuuuuaucuuucuagacuaccuuaugagguccgcuuuucuuguaguuggaaggcuauguggaacaaucuggacuauguucugcuuuguuuaugaucaucaggaaugaggauccuguuucauccacaaacauagaaugaaucuugagcauucucuaaacuaaugccagugucaagggggaaaaucaugugguguuaguuguagguaugagauauuuauuacucagaugggaguuagaauuacacuauucucugagacuaguugaaguuucauuaaauggaaacuaguuguaagaccaacuuuucuaggaaaguagugcuguuaagcauaggggaaggaacuggggagcaacacaauguucucugaagaaucuacuaugguugcuuauuugcauuuccccuuaggcaucuguuaaugaguuucuucagaagccuagaauauuguaguguuuuucuuccagugagaauauaaaaugacuuaacuaggggcguuguucaagaguacaccaagacagauacugugggaacaaggcauuucuuagaagaguuuuuaauccacugauggagggacagcagcaugguggaggcuuugcaugaguucaggacgccaacaacagagacucuggagggaucucugaagagaaucagaguccacuuaucagaggagggagagucauacaccuucugagaaugggcuucagcugcagccagguucucagauucccuggcgggagacuggaacaggcuauggcaccccuuugauguaaagucauuucucaggugagaggcucuggaaaugucaagucugcuugcucuagacucacagaugaaguucuaauaggguacccgugaauauuugugagagucuuaagcaaaaggagagaaaaagaaaacuuagcauauuuuuucuuuuuuauacuauauuauuuuuaauuuaauuuuuauuugcucauauuuuccacacgcacauugauuccccuuuccuccaaaaugaugaauuuccucaaauaacuauaauaauaguaauaauuuuuaauaaaaagcaguaugugaauguguguauguauguguauguguguauguauguauuuguguguguuuggggaaaggguuguccaaagacaacuuugcagaguugcuaaucuuucacugugguuccuggucuggaacucagauuauuaaaauuaugcaacaggcacuguaacugccugagacaucuugcuggcccugacuguaauaauuaaugauccuuuuccccccacagacuaauagggaugccaaaggaaaaauaugauccuccagauccucgcagaauuuacaccaucauguccgcagaggagguagccaaugggaaaaaaucucacugggcagaguuagagaucucgggugaguggaaucugaagcauuuuaucuggaauauaauagcuacaauuguaaagaguauugcuguacuuauaggcucuuuguuguguuuuaacuggaagaacuaauuggaaauacauaagaauccugaggcacuucuuuuuagaucuuuuaaaauauuuuccuuucuuguugagauuaucuugagcaaggguagccauuuacauuuaaagauauucagaguuugguuucugaguaaaauuagguucuauaauacaguaagucuuauguugacauuuccagaguaauuuuuugcaaaugaaagucuuugcuauccuucuuuuauuaucucagugcuaguaaagaaggaaaccuagaugacucuaucuguauaacagacaccagcuaagcuaugaauagagcaugcuuagaauaaaugugauuugaagaauuuggaucccugucugaaaguaaaaaaaaaucauaaaacuaaaacugaagacauugcauaaaauacuuaacugauguacuuccagaguuaccaagauuauuaaaaacaacgacaaaaagugccuuaagucagaggaauguuaagacaugcuaauuaaaaagccugauuugaauucuagaacaaaaagauauaaaaacagguaaauucugaauaaagccugaaguuuuguuacuauuacuauaucaauguuggcuucuuacuuuuaauaaacacaccauggaauauaagacucuaauguuggggaauuuaagcagaguucauauaagaacuucacauuaacuuggcaacuaauaguauuauaaaauuaaguuuauuagaaauagaagaucacuuuuucuuuuaugaauugccacagaacagauuauauguagaaugugaucaggaccccacccccauuggcauuguaguaccaacagcaagacuuaacuuauucauacaacugaaaggaaacugaguagauugcugaaugcucaucauuccgaugggagcagaucucagccuguugguuuuaagauuucucagccuuggcggcuuacugacaguuuggccccuagauacaauuccuugugguggaugguuuuuguguguaguauaggaugcuuaguagcaugcuuggcuuuuaccuagcagauucccuguauacuucuuuacuuauaucaaccuaaaaugccaaaguccuuugaggaaaagaauuccucccaacugaaauugguguguuuaaguuaauggaaguuucucuuuuacccauagccucaucauugaauacuuuguuuuucuauuaagaugcaaaauccuaguugacacuuuguauuugauuauauacagcaggaaagagucugguagaaagaacccuggauagaggauagaaauaaacauugaguuuaguucuauaaacaagauaacauuguuccuuuggaacuuuguguucuucaguuuccauucccaucucucaucuaaauuuuuuuuuuaaugaaaguuauauauacuuaauuaaauacuucuuggguuuggagagauggcucaacuacuaagaacacuggucuucuaaaggauacaagguugguuccuagcacccagaucagguagcucucaagcaccucuaacuacagcuccagagacucuuuagcaguucaggccucugaaagcaccugcauucaugggcacauacccacaccaacuuggauauagacacuuaacuaaagguaaaauaaaccuuaaaacuauugcuuugcuuuuaugcaauuuuguaaaauuaucuuuauguaaauuaugcauuauagcaaauaauucuaaucaggccuggaaugugccucaguugguagagugcuggucuaguuuucacaaaacuuuggcuuggaauuaauucccagcaccaaauaaacuuggcaugggggugcaugccuguaauucuaucacuugguagguagaggcaagaggagcagaauuucaaggaccauccucaucuguauagcaaguugggggccauucaggguuacgugagauuccaccuagcaacuuagaagauagaauaacaucccauuuuauaaaaccugaggcuaaaugguuugcccagaccuauguugcuaauaagugguaaacuagaacucugaaauagguuuucugaguuaguacaugcuguguaccugcggcuuacagaccuugaugugaaaacuguuuccuugagaauguugcauuuaauauaaaauauuaaacuacaguuguuaaucucuaacuauaacaucagaauuuagggaaaauguuuucuuuugggacacuuugcugguggcuaauccaagauugguuuuaaauaauaauucauuauuuauuuaaacuuuguugaccaauccaggcucuggauauagauacaucuuauauuuauaauuuucauugagugugaggaguauuuuguuaugacuuuaaaaaauuaaaaucucaagccuguuucaccaccaaagcucaauuuacccuuaaguuuuauccuuuggaucuggcucugagagagguccaguaagccucacucaaucaaucucucccuccccucccccucccccuccacuuccccuacccccucccgugaaaagugugacuguucaaaguggggugaaauuaaaggaggcuagauaauuuagcgguugcauagcuuugcauacaaaguuaaaaaugucaaagauaagaugauaucucuguauauuugccaccuuuucuagcacuuaccaguacuugggauuccgauuuugucguggaucuggaguuuauguuuuaguauuuugccuuuuagguagagugcggagcuuaaguacaucacucuggucauuaacacacuugacagcacugcaccuaaaugacaauaaccuugcucgcauuccaccugauauugccaagcuucauaaucugguuuaccuggaucugucauccaauaaacucagaaguuuaccagcagaacuaggaaacauggugucucucaggugaggaaacauuucauuauauacaauuacaaauuuaucaaauaaaaaacuuaugggaugcuauuuuauggugggauuucugugucugugaagaucaaaagacagaaauggaguuaagcacagugcaugaguuggccgccauuuaauauuucuuuuccuuugaguuguggcuuccugcuauaaauuucuuuuaacagacuuaagauagaggaaguuaaaagucuuaguguggagucaaacauaauuugcuuauaaaugaaauguuuaggaacaaacuucuguuacaaaauguauguuuauauuuuuauaauacaacucauugaagccuaaagacuugauuaaaauggauuuauaguuaagacauuuguucucgaaacagggucuugccuguggcacucuagcuggcucuugucucccagguuuggggacagaaggcauguacaacaacagugguagcauuccuauaggaggaagcauuuuaaggucauauuaacuguuuccaaaacaagaauugcuuuuuuuuuuuugaucuuaccuauugacuaauaagguuuuuaaaaguugcuuuuccaugguuaaaauuaauaaugguuauguuacuuauuuguucuuuuaccaccuccuaacugguuauaugaauucuuuuuugucuuuuauuaaugaagguguuaauuuuuucauaaucuguucaaaauuucaguuacaaacuuagauuuuuuuucuuuuuuuuuauuagauacuuucuuuauuuacguuucaaauguuauccccuuuccugguuuccccucugaaaacccucuaucucuuccccccugcucaccaacccacccacuccugcuuccugguccuggcaugccccuacacuggagcauagagccuugacaggaucaagggccucuccucccauugaugaccgacuaggccauccucagcuacauaugcagcuggagccaugagucccuccauggguuuucuuugguuggugguuuagucccagggaucucugggguuacugguuaguucauauuguuguuccuccuagggggcugcaaaccccgucagcuagaucuucuuaucucuuucuuuucuguuuuuguuugucuuugcugaucuguuuugugcuuuuggauauauauuguauguuaguuagugguuguucuccagagaacauuuuaucuuuuaauauuuuccuuucuuuuuuuaaaauaccauuuauguguuuguuuaugugugugggugugcacaaaucaacuaucuguauguggaagucagagggcaacuuugugggaguugauucucuccuuccacuggggggucuugaugaucaggcuuagguuguuaguuaggcuuggcaucagaugucuuuaccuacccuuuugccauccuacuuuuuauguuuucuauuuaauuaucauuaacuucuaugauacacugucuuguuuugaauuuguguuuuuauuuuuucccguauguugacacaacuaaguuauaguagauauguaggcaguuggcugcaaauuguaguucguccucaaguuuauuuuagaauuuacuuucuucgugccaagugguuauggcacaugcuuuuaauacugcacuuaagaggcagaggcaggaggaucucuaugauuucaagaccagccugaucugcagagcaaguuccaggauaaucagagagcuacacagagaaucccuguuuugaaaaaaaaauuaauuucuucuguaaauuaagcuugguucaaggucuuacagguuugggguacuaauaacucaugucacucugauuugcauuaugugcaauucauaucucugaauuuaaucugugcuacagaaugagugagucauagaaauauuuaguaaugauaguacuuuaauaauaggguauagcauuuugggauuaguuugaagaagugucuugaauauaaauaucacuuaucauguguuagaagaaagacaaagaaugacaaaugcagacauuaauaaagcauguuauauuacacucaaaucuuuaaauuuuuuuuuuuaaacagggaauugcuuuuaaaugacaauuauuuacggguguugccuuaugaacuuggccggcucuuccagcuacaaacucuagguuuaacaggugagugacuuaaaaaaaaaaaaaaaaaaaagacaacuuaaaacuccauauugagguauuaugaugccuuuaaagaucauuuuuguaaagaauacagguuuuaguauaacugaaagagugagaaggauuuguuaaaggugccggaaauguaauaguugagauaaaugcugggauugcaaauauaagucaccacuuccagcuucauuuuauauuguauaugguaugcuaaaucauacauaguuaaaaaaguuaucuaggcagagguaggauaacggggcaacucuuguuuuugauuuaaaaguuauggaauguuugucaguuuuauagucuuagauuauaaaucucagauucuaaccuauuuauaauuauaauugucuuuaauaaggauaauuauuuucauguaauuuauguacacauuuacauaauuuauauauucuuuuaaauaggaauaauuuuaauugcagaacagccguuuucuacauuucugauuuauugauagaccauuaaugguauauuagcaauuaaauacuggaccuuaauuuuugagccaagaaacauuccugaaauaacaaauguuaauauuuauaugacuuuucauguuaccuccacauccccaaagaugucugcuauacuaccaauggaaugggguauucugauuauuuguaaauuuuacugucuuuuauuuuauuacagucuauaaaacuagguauuaaacuagugguucuagggcugagcauuuuacucaguggugaagugcuugccuaacauacaaggaucuggguuuggucuucaacaacaucaaaaacaaaacagaaaaccaaagugacuacucuuuggcuggucuucauuguaguugcauuuuucuuuucuacuaacacaaacucauucaguuuucuucuuugaccaaaugaucaagauugucagacuaaagaaaaacaacacucagcuauaugcuaauuacucaaguaacaauuugaauuaaauuauaaaacaucuuguaagauaucuaaucuguugguuguuagcuauucuucaccaacuauaacuuagccuuguucuugccuauggaaacguuuuuuucuuauuauuucuguucuaaauuuaaauuaguguuuuuuucccucuuuugaguuuuuaguauuuauacauguguaacaaguuuuuuuuuuuuaaggguauaauucauuuaugguuuuugcacacuauacacauagccugacaguaacaguauagauuucuuucuuuauuuuuuuuuuuuuaauguagcuaggguugacaucucaagugcuaagauuauagguaugugucaccauuucuagcugcauuucuaaauucucagauuuaguaggaauguucagccuguacucaguuuucucuguugugaggaucugcuuuguuuucauucaguuccauuuucuuuucaacacauuauuuauagaagggcaaggaaauuuagaaaggagagcuagagccuuuccugccuuauaacauuucuuuuuuucuuaaguaguugauggaaugaaaugcccuuaacaaaugacagcuuuauauacauauacacaggaacauaaaauuugaaaugauuucuaagucauuuuuuggauacacugaaauauuuuacauguaaugagagaaagaaaagugggugagguauucuaauggcaccgugagauacaguaugagugagcagccccucugauugaugguguuuguuaauugugaagagagcgcuggcacaagccuuuaauuccagcacucagaggcagaggggggcacaucucugugaguucaaguugaguuuaugcuacuaaagagcuccuuuuuuguuugccuguuuucaugccaagugccugaaauagugcaauugaguaauugauagguuugucuaaggcugaccauguuucaaguaaguagcaaauacuguagcaagcuacauaaagcuaguuauguuuuccuugggaaacaguuacaugguaguuacacugcaguugccuugaccuauuuaguugccuacauaaacaguuacaggaacuuucuaguagaaacaauuagguaaagguuuaaacaagggcaguguacuaagaaagcauaggacuuggcucccaaaaacacacuuuaaggauuuuuuucuuuaauuuuugagacuaaaguugaacuuguucuguucauuauuuuuacuuacggguaugguguuuuaugcacuuaaucucccaauacuuggaaggcagaggcaggcugaucuaucucagugaguuucaagccagccugguaccaugacauaguaaguugcagaccagucagggcuauauagugagauuguauuucagaaaaacaguaucaacaacaguaauaaauaaaugaaacaacagcaaaggaaaaacaaaaccauugggcaaauucuguauuuuucauauaaauuguaauaugauugagugaauuuguucuuugaaaguuugguaaaauagguaaaacuaucauuacuuguguguaaucuuuuggaaaauacuuucucgauauauuuauaguaauaaaauaacuacugcgaauuaaaaaaaguuuaaaauuauguguauuugcaugugcccaugugugugcuuuugcuugugaaugcaaagcccauggaggucaguggagguacugaagccuuugcaucuagagucgagugguugugagugagccuuguaggguacuaggaauugaaccuaaguccucugcaagagcaauguaugcucuuaacagccgagccaucucuccagcaucaugacugagaacuucuaguaguuaaugauucaguuuuauuaagcuguucuagcucuacaaaguggagccaaacugaacuugagcuuaauucuccuaccuuguccauuguugcaguuggucaguuaccagggcgcugcaacauccagcuuuuuucuuucuaaauuuuuuuuuuuuccuuuuuuuuuuuuuuuuuauuuauuuuuuuuccauuuuuuauuagguauuuaacucauuuacauuuccaaugcuauaccaaaagucccccauauccacccacccccacuccccugcccacccacucccccuuuuuggcccugguguuucccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauauucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaauugccagacugauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugaaccccauuuuuuaaugggguuauuugauuuucugaaguccaccuucuugaguucuuuauauauguuggauaucaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauuugcauucuucuacacgauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuuccuuaauuucuuucuucagagauuugaaguuuuuaucaugcagaucuuucacuuccuuaguuagagucacuccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauacuggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccugguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcugucucccguuucuucuuggaggcacucagagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucaaguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucauucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuugauguuagaguuggcauucuguucuuguggcugucuucuuuuugguuuguugaaugauuacuuucuugguuguucuagggcgugauuuccauccuuguauugcuucuuuucuguuauuauccuuugaagggcuggauucguggaaagauauugugugaauuugguuuugucguggaauacuuugguuucuccaucuaugguaauugagaguuuggccggguauaguagccugggcuggcauuuguguucucuuagugucuguauaacaucuguccaggcucuucuggcuuucauauucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucaugggcaucucuuuuuuuuauguuugggaaguuuucuucaauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuagguuuucuaucuccagcguugccucgcuuuggguuuucuuuauugugucuacuuccccuuuuaguucuaguaugguuuuguucauuuccaucaccuguuuggauguguuuuccuguuuuucuuuaaugauuucuaccuguuuggcuguguuuuccugcuuuucuuuaagggccuguaacucuuuagcagugcucuccuguaauucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucuggugaucucugaagcuagcuguuuuaguugucacuguuaagagcuuguucuucaggugacucuguuagccucuauaagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagcccagggcucgagucaagcggaagggacuugugccccagaucaggcccggguagccugcuucccuauguaccgcagucucagguucugcgggauuggauuggggcaggcgcuguguuccacucaccagaggucuuagggucccguggggagucccgugugggcccuugcggguguugggcaagacucugcuggcaagguagcccgggggucgagucuccagucgagcggaagggacuugugcaccagaucaggcccggguagccugcuucccuauguaacgcagucucagguucugcgggauuggauuggggcaggcgcuguuuuccacucaccagaggucuuaggaucccguggggaguccugugugggcccuugcggguguugggcaagacucugcuggcaagguagcccgggggucgagucucucucuuucuaaauuuuuacuucuuguguauugaauaaaaggaaaaaaaaagagugacuguaaucuugauauauuuugaguccauuuauuuguaccuguauuaccuaucauuuuaagcaguuuuuaaguuuuucuucucuuauguuguaucuucacauuuugacuuuauuauuuuuuccauuuguugcacguuguaucuacaauugggaauauuuuucuuucuccuuuuuucuuuugagauagugucugcugauauuagcaugcuugcuucaaauaccuugacucaacugauaccuuugccuagguaguaauuucuuauuggaugaauaguuugcaaaucuuauuuuguaggcuuccucuuuauuguacuaauucuuuucaugaagauguaauucuguuuuauuuuuauuugugauuuugaugucauauacaaaagucuuuguguauuaguaugccaaagcaauuaccuuauauuuucuuauacuaucauaguuuucauauaguaauuguuuugaauugcuuuucugauuggugaaagauagagauuauagucucacucugagucagcuuauuaugcauggguuauauguguucaggaguuuuuuucaugcagauuuuacaauuuguuggcuuucuuuuuugccuuuaguaguucauaauaauuccuaaugauccauugauguuucugugguauugguaauacuacuaccuucuucauaucuuuucauuuacugagaucuucuguuucuuuaguacacauaaaauuuauucuguuuaaauuuuuuaaguguuuuguaaaucuuauuuaaaaucucauaaaaucucaucuuuagucuuucaaccuacuaaguuugagcuuuuuuuuuuuuuuuucugguucaucaauagguugcuuauguaaacugguuuuacuuuuuugauauaaguacuuaguacuauuucuguaucacuuaaguuuuggugauaucauauuuccauuuuauuucaagaaaugugaaaauuucacauaaguucuugaaacuagaaggccuuggggucauguuauuuaaucuuuauauauucauaauuuuuauaguucuuuaaaaauucauguggucagagaaaauacauaauuuuguauuuuucaacuuuguugagaaauguuuaguaguguaauauauuauggacuauucuggugaauguccucugugcugauaagcagaaugguauucuguaguagagugaaauauucuauaaaugucuauuaggugcacuuggucuauagcuuacuucaauucucauuuuccuguuuucuuucuggcagaucuggucauuagugaacaugagauagugaauuugguguuugauacauguguauuuuauaauuguuuuuuuuuuuuuuuuuuuuuugguuuuucgagacaggguuucucuguauagcccuggcuguccuggaacucacuuuguagaccaggcuggccucgaacucagaaauccgccugccucugccucccaagugcugggauuaaaggcgugcgccaccacgcccagcccuauaauuguuuuauauuuuuaucauuguauaaugaucucauuuucuuguaauuuuuuuaauuucaaauuuugauauaaauacagcuaggcacuccuggguuccauuuccauugaacaucagcucucaccuccaauacuuucauuuuaaaaaauaauauuucuuugacaauuucaugcauguauacaguugauuauauuugcccccagcuccccucuccauuucucccuagaccccauccuaguguguccucauccuacauucauguacugucccuuucuuuugggagggggauccacuggguuccaauuaguggccucuuuuuggaaugcugacugaugcuggcuugaucuguauaggucuuauguagguaaccauaguuacauugaguucacaagugcaaccacaaugccguguuugaugacagcauuucacagcacuccuucuugucuuccagcuauuauacucuuucugcucccaauucuauauuucugagcauugggggucagaggauugauaaauaugucccauuuaaggcuuagcacucaauaaucacuucuucuccacccuuugaccaguuauaaaguuucuguauaauaaacuguuguccacugugugaagaguuguuuuguccaaggcugcaaucagcacuaauauauggguuuagaagguagguugacagaaugucugcuuaacaaagcauaaguaacauuugauuaagauuuacugugucuggcaugaauuuccuccuguagagcagacuucugauccauucagaaagcaguugguuaccuccaugguauucauacuucuaucauacgaguggguacaucuuuccuggcauguagguauuguagcauucugcauacucuguugaguauuaaugacuuuuucuccuccaguggcacuauccagaacucugaacaucagccaccagggaaaauauuuucaggccauuuccaacucgauuucucuuuguucugcaaacaaaauguuuuguguauuuagcaguagguucuuaccaucucacuauuaacuuguagggaguuuucccauaccugccacugagauuuuaacagucuugucuucugagaagcuuuguccacccaagcaggguaccuguguucaacuuuuucuuuugaauuuuacuuuuuaauuagcuuacaaaauaguagguuucuauaaggacuuuccaucuaaccuuaguuuaguuugcuuaacccaccucucagcacuccuucaccuguccccaacuuaaaccuuauuaaguguauuuuaucccuuaagcccuuaaggucucuucucuuuuuaccucuuaugagcacuuucuagcuuccugaccacuaaagacaccccaguuuagauauacagcucuucacaccuaagauauauauuggggaaguaaauugugguuuucuugcugggccuggguuauuccacuuacuaaguauuccaguuccauccauuucccuccaaauucuauaauuuccccccaucucuguuuuuacagcugaauaaaauuccauuguguauauguuccacauuuucauuauccauucauuaauugauagacauuuacuaaguaacuguugugaauagggcaauaaugaauauggauguggauauauuucuguaggcauauauggaguccuuuggguauauaugcccaggaguaauguaucuuuuuucagguguugagaaaccacuucauugauuucuguaguggcuauacuaguuuacauucccaccaccaacaagaauuccucuuuccccacacuuuugccagcauuuuuuaccauuuguuuuuauuaaucauagccauucugacugagguaaaauggaauuuuuaaguaguuuacauuuacaucuucccuguguuuggugguuuuaacacuuuuaaaaauguuauuagccacuuguauuuuuuuccuuuuagaacuuugcuuaguuccaugauccauuuuguuaaaaaaauuuuuuuuguuuucuugaugcuugcuacuuuaauucuuuguuuauucuaaauacuaauccuguguugaauauauagcuggaaaagauuuucucacucugaggcucuucauuugauugacaguuucauuugcuauacaaauacuucuuacauuuaauuuuaugagccucagguuuguugauuauuccugagugauuggaguccuauucagaaaguucuuaccgaugccuauaucuugacaugugcucccuacuuuuuuuucuagcaguuucagagaccauuaauaaucacaguuaaucuuaaaagguauguauugauuccuguuacuuuguugauuucacagcauuuguuuuuuuucccccuucuaucugucuugcuuacccuauuauucuaggguauuauuuauguccuguggccuuacagaucauuuuguuuuucuccaguccaaaggauuccuucaaguuuuuuuuuuuuuuuuuuguauagcuuaguagucaugaauuuuuuuagccuuuugaaaacauuuuuauuacaucaaguuuuacuuuuuucuucaaugaugacuguuaguuuuauaccugucuggguuggcaguugucuuucagaacuugaaauacaucuacacaggcuugcuuggcuuuugcauuuucaauugaguaaccuguuuuauucugauggccuguguaugacuuggacuucucuuuuacuauuuuuaaacuuuauuuuguauguuuaguguuuuaauuaccacaugaucaagggagguucucuuuucuuugauuuuuuuuuuucuuuguuucuuccuuccccaccccguuugguauccuaaaugccuccuguguuugaauagcaccuccuccccuaauucuaggaaacuuuccaucaugauucacuuuaacaauguuugcugugccuuucuucagacuuuucuaugcuccuuauccauagguuuggucuguuuaagcagugucagcgugcaccuuagacuucccacuggucuaaguguucucugucuguccuuguucauuccacaaccccagccucugccuuaagcucucuuccuacaucuggggaauucucuuaggauuauuuaaggcauguuucgccuuuagaacuagguucuuuuucuuuuauuccuaccaugauaaauuuguuccuuucagaauuuuauuuaugccuuauuuccacuguaacuuucuuacuguuagagcuuugucucugucugauuguucuaguucuacuuuuuucaugcccagauauugugucucuuugaucuaugcuaauggcugagaccuaagagcuuuuuacuuuacuugacuuacuaugcuuuuuaauauccagcauuuugucuucucuucucuucucuucucuucucuucucuucucuucucuucucuucucuuuuucuuucuuccuuccuuucuuccuuccuuucuuucuuucuuucuuucuuucuuucuuucuuucuuucuuucuuucuuucuuucuuucuuucaauucauguagaauucuuuuguaucuggcuuuguccugcuuauuucauucagcuguuuguguccucggucaguaacuuuguucuuugauuuauuuuaacacacuuagauuucuggaauuucaucucaacuuacuaucuaacuagaugccaugacuguagccucagugauuuuaaaaagaguuauguuuuuuuuccuuuuuauuaugcaucugguauuacuuuguuugguuuuauguauguauuaucaguuuucauucuuucaguugaaguauuugcaguguucaugugggccuuguaugugguagaguugaguguauagugaagaccucagcuccucagucuaggaggucaggguaccuguuguaaacucuggauuguucccuggauaggauauuaacugcuaaagcaaccacagcuucuuguuauuacagguguuagacuagucaguuaauagcaauaaccucauuugaauuuaguaucugugggaggauaaacaaccaagggugguauagagaauucucauauuuuagauaauaaaauaaggacuuggaggguaaggauaaggauuaaauauuaaucuugaaaacaaaauugaaguggguaaaguaguuggggguuuuacugguuuacagauuuuagagguuguuaaagcuaugacggcacaaagaggcuaaggaggggagagagaagaaaacuuguaggaauauggaguauuugagauguggcugaagcauauaguaaacagugguuuauaguaaacugaguagagaaacacaaaaaacaguccugagaccugacugagcaaucagacaaaacuaucaucauaacuguaaguacaagaguggagguuaaguaauagaaaguaaaauaaaaagaauguuuauugaguaagucuuugugaguaaguagaagugaaguucugaaauggcuauggcuccaacaaucuccauauggggccugugcaggaguggagaguugaaaccuacuuuuaaucuauuugcauggcaagaccaguugcuugugugccguucaacuaguaagcuaagugaggauguguccacgguacuuuacuuuuccuccucucuugaaaauugucuuuauauuggauuucccauaguuuuucuacaauguauuuaguuguucaacuuuagcauuuguccuacuuggaauuugguaagguugacggauauguauaccaaugguuuucaucuauuuaagaugguuuuggccacgaacucuuuaacuuuuuuuuucuguucuucugggacucauauaauguguacccuucaugguauguaucugaggugccuuucaucguuacuuucuuuacagacuuagaaucucucaugucugcaccuuuggucguuugguccuagcuguucaagauuuguuguugagccauucuagacaguuguacuguuuguuguuuucuaucuuucucguuuucuuuggcuucuuuuuauagauuuuuuuuuguuuguuuguuuuugauaugucuguuuuucaugugguuaaaauauuaauuugaaacuauucuuugaucuuuguuuuugagacaguuucucauuguuuggcuugugauguccuugauuuugugauccuccuaucagccuucuaauaucagggauuauaugcuugaaauuuuaaaaauuucagacaauuuuuugaagcucauuacauaugcagguaguucucugauuaugauggaauuacauucuaauaaaucccuuguaauuggaaaaugaauuuauugcaccaaaaucagccacagaguacacugaagaucccugugaucuugugccuaccuggaaccugcaacuuguuauaguugccuaucaucacaagauaguuuacuacauuuucuguagccugauaagauacuagaauugaaguaugguuucuucuaaauacauacugcucuugaacaguucuaaagcuuaagagcuguuaaauugaaccacccaagaucagacuguugguauuuuaaguaacugaugggcaagguuuuuguuuguuugguuuuuuuccuuuguaaauucauuaucuccucccuuaguuuugcucauaguguuuguuuguuuguuuguuuuuuuaaucuuuauagguuuuuacuuguuuguuucuuagaauuguacuuuuaaguaaaggugacaauucagaaaucaaauuuuuaccuuguucuuuguuauaugcguuaguguuauuugccacuuuucuucuugcuuuaguuaauuuucagaagcaauacuguauuguggccacuaaaaucuuuacucagaguauuagucagcuaaugauuuguaugagauugucuuuaaaugccuauaacgauaaaucuuuccucuugcuuugugguucgguuuggaacauauuuucacuacuaagcaggaacuuuacaacuucuguuaucuuuguuuccugccuaggcauaguuucaaggucagaggugaaacuugagcugugguuuagccuuuucucuauauaauucaacccuuugcauguggauggucaagcccuuauggauauuguauucucaagcuuuucauuuggucagucuguuguuuguuuugccucuuacuggcuuccacauagcuaaaacuugccaguaguaguuuucugcacucuguuaccucuuacucaggcauguggagaaaaaacccuucagcuauggacaagucagacaaaccccaugcagaccagagagugacuagucuuuaucagauggaacaggaagagcuuuagcuccgcugcucugauaguguggauuacaaguaaaaccuucagaaaucuuuucucuuaaucaaauuugucuuuucccuuaaaagaauccucucuggguauugcagucuuuugguaaaauuuucaagauggcaaauagaguaauguauugcuuaaagacaggaccauagucuuagaaauacgcuuuuuggaacuuuaucuuugugugacuauuuuagaauauauuuauguaagccuaaauagcaaagcuaggaacccuaucucaucucuugaugcaauucaauccauaugguaaauaugagauggcgaaguugcuaugauguaacagggcguguaauuuacaauaauuuuuuuaaauuugugggaauaauauuucuaguauacuauaaugcaugaacaaguaacaguuuuauugucauuacauauuauguacccuacauaauaguauauuuuauaaucuuaugcaaugggagcacugccauauuuaacaccaacaaauacucaaauaaugcaucaugcuucaguauuacaaaggccauaauuugcauggaaugaaauguuuucagcuucauuuuaaucuuagggcaggaauuaccauuacauaugucaucucuuacagauaacuagcucuuacucuugcauccagauagaaugaaauaguugauucugagacaaauaugaacauucagauugccacgagcauguucgauagugcaggagaucaagaugaacuucuauagcuauagagcaaaaggaagccauuaaaucaaugcauuuacccaauucauuggaagaggaaugucagauaagugggaauucucuucauagacuuuagaugcuaccuuauucuuagcuuuaggccuuauggaagcugauaguuuacuuaaaauaguauauccuaaaaguugcagccauguuaggucuaguacaggaauugguaauaacuaugaaagugcaaucaagauagccuaggauaauugugucuguugauuuguaacauucugucucuacauuuacauuuuaaucagucacucuccugaaucuucaacacagauuuagccauguuacugaucuaaguugauaguagaaccacuuuuauuuuuauuaguuuuguuguugcuuuuauggaguugcagguuuauuugaagggccuuuccuaugcuacuuuugacuacuuuuuaaauuuuguuuuucuugaaugaauguuuaacaugguuguccucugagaggcugcauccagcagcugauucagaagaaugcggagaucacagccaaagguggauggagcuugggaacucuuacacaagaguugggggcaggauuccacaggaagaccuacaaaagucaacuaaccuggacccaugaggggucucaaagacugaacuaucaaccaaaaaucacauacuggcuggaucuagaccucccugcucauagguagcagaugugcgguuuggucauggguauagagcaguuggagcuggggcuuuuccaaaagcuauugccuguaugugagauauguucuucuagcugugcugccuugucuggccccagugggagaggaugcgacuagcacugcaaagaguugauaugccaggguugggggauacucaggagccccccacccucucagaggagagugggaggaggaaagagaggugaccaggaggaaaggcagugagcaggauguaaagugaauaaauaaaaugaaaaaacaaaacaaaaaagaaauuuauccauuucuuaaagcaauuuucuauucaguucuacuuuagccagguuuuuuguuuuguuaguuuguuuuucugguuuugacugguguuguauucauaguuucuguugauaaaugagaauaagauuugaaaucuccaauauauuuuauaucauaucuugguaauauuuuguuuuuguuuuuagcuuuugaaagauguccucauucuuguuuaucuuuugauguguuugauccuuuuauuuaaggucuucuguuuguuguuaucauggucuaguuuauacuacaauguauuuuguuaagugauauccuuuuguaaacuucuuugauuauauugugaccuguaucagcuuacucauuguguuuuuuccuugaauuaguauacaaaguuaaggguuugauuacagccuuuuccuauauauguacacaauuuuacuuuguuuuuauuuaaucuuccucuuccaguguccucccccauacacccuaagcaaucucucccccucccuccuucccucccuccuuccaucccuccuucccucccucccuccgucccauuagauuuauuuauuuauuugcuugacauuacaauaucagucccccucuucccaguacuccccgugcagaucauccucccauuagauuuauuuauuuauuugcuugacauuacaauaucagucccccucuucccaguacuccccgugcagaucauccucccauucugcucuccccuucuccuuugagaagaggaagccccccucuagguauccaucacacccucccccccccccccacaucaaaucccugcaggacuuggugcaucuucucccacugaggccagacaagacaguggaaccaagggaacaggauucauaggcaggcaggcaguggauucagggacagcucuugcugcuguuguuggagaacccucaugaagaccaagcugcuuauaugcuacaugauaugcagggggccuagguccagacccugcuugcucuuugguuggugauucagucucugggagcucccaaggguccagguuaguugacucuguuggucuuccugccaucuuugaguuccucaguuuucuuccaacucuuucaugagacucccaagcuccauuuaauguuuguguaugggucucugcaucucuuuccauuggcugcuggguggagccucucagaggacaguuaugguaagcuccugucugcaaacauaacagaguaucauuaauaguaucagggauugguuccugcccaugggaugggucucaauuugggccagucauugguuggccauucccucagucucuguucuguuuuugucccugcacaucuuguaggcagcacacauuuugggucaaagguuuuguggguggguuuuguuguccuuaucccuccucccagccuggcuacagaaaguggcuacuuuaggauuauauuucugacugcuaggagucucagcuagagucgcccucauagucacccuggggccuuccccauuccaggucucugucaugucuuagagauuccccaccuccuacucccagccaaauuuccuuuucucuccccugcucucccuauaucugaucucccucacacccuacuccccucuacauccccuuuccuucccaguuuccucccuccauccuccucugauauaaaagauauauauuuuauuuuuccuucugagaaagaaagaaaccauccuccuuguucuuuggcuucuuugggacuauagaguuuacugugggaauccuauauuuuauggcuaauauccacuuaaaagugaguaaauaccaugcauggguuuggguuaccucacccaggaaguauuuucuagguucauccauuugccuacaaaauucaugauuuccuuguuuuaacagcugaguagugucccauugugugauuuaaccacauuaaaaaaaaaaaauccauucuucgguugaaggacauuuagguuguuuccaguuucugguuguuaugaauaaagcugccacuaacauaguugagcaaguguccugugggaugguggagcaucuuuuggguauaugcccuuccugggcucuuuugcugaucucuuauauccagcucaucucaagugauccuucuuuuaggccaauuuuuuuaaaacuuguuuucaauacuuuauaauuuuuuucuauuuauagguuggccaacccccugucuuuugguauaggguuguuuauuauuuuauuuguuguaugagaggcuagaaccgcuucaaauaaauagcguucucuugucucuucuguuuuuguguuugccuaaagacucauuaagcaaugguugacgccaaaggcuuuuucagcaguaaucuucuguuauugugaagguauacuauugauguaguuauaaauaugaagggaaaagagauuuaucaguugauacauagguuuaagggacccucaguugaauauuuuuccaucuguuacuaaaaacuagaggggccuauguggaguacuuuuccuccucuagaucuguuaagccuuacuaaaauuaugauuugaagaaaauaguuuucuuagugguaguacuugugggagacauaaucagcaguguuuggauuaccuauuuuugguuauaaggauaggaguaguaacuugaaguucuucuacauuuuggaccauuuuuuuucgagagcucuaauguauaaauucucuuauuuuaaauuuugugucuuuuccuauucaguauucaacauuuuaagaucuguuaaugcuuuuuggguaauuuuccugaaucuguuuuuccuguuuacugaguuuucuuuucaguaugucuaaucuccugccuaccucauuuguuggaguuuuucuuaacaaccaggaaacucccaugucuagaucuuugaugaguuuuacuuuucuggaucugaaugcuagauaauuguugcaugguuacaucaaucaauuuuucuucauucauauagguacauuaagaaauauaccuauaaaaauuuguuauuggccagccugguuuacaaaaugaguucuaggacauccagggcuacacagagaaacccugucucaaaaaacccccaaaaacaaacaaaaaaaauuguuauugguaucuuguuauuuaauauaacuuuucuuaauacucaagauauuuuugaccacugucagaacaaaguuuuccuuucacauuuugguguuaucuugacaacaaauuuucuucucucuugaaauauuugcauuucuucguguauaauguuaauauaaauauuccgagaagacuucuucucuauguaaaacaauuuguuuuuauuuuacguuuaucuauucauguuggcacguuuuagucacaggauaaaaauauaguuguugguucuccuaccaugugguuccuggcaauaaaccucaggucaucagguuuggcagcaagcaacuuuauucucagucaguucugagaauaaagagaggccagagaccucuuuuuauacgaaucacucauucuuucuuaaauagaauuguuauguuuugguuagcaaacuauuuuuaaaggguaauguagaguuuauaugguaauuucuaaauaaaccaugauuacuauguauguguuuaugaauauguguguauguauuucuuuuugacaagugcagauuuuaggaucauacacugaaaucuggaaauaacucuuuugaaguuacuauuuauggcugucuuaaaguauuuucuuauuauauucauauaauuucuuuagaugugugucacagauaaagcagcaaaauuacuauguuguucuauaacauaugcccugaaauugcaauugucauguuuuauucuuguuuucuguuuaaggcaauccuuuaucacaggauauuaugagcuuauaccaggacccagauggaacccgaaagcuacugaacuucaugcuugacaaucuugcagguaacgcuuacugacgaagcauugaacucuacagaugcuaucaguagcugaugcaccacacacuucuuagacagcugcuuagaggaauuucuggcuuauguaguaauuaaugaaauaggcaguaauuaugaaauuuaugagauuuuuuuuccaugugugaguacuuucuguuuaugaagcgaugugaugagaguuuuaguuauacuauccuguaggaauuuuuacaauuuacuacaacuauggcuacuacuacuuacugcuacuacuacuuacuacuacuuuugcuacuucugagauagagucuuacuggagcccuggagugcucuggacauuauaauguagaccuggcuggcuucaaacucacaagauaaucacuuuccucugaauguuggaauuaaagauacaagauggauucauauaugccauacauguagaggugucagaggccagaagaggguguuagauucucuagagcuggaguuguagguggaaauaaucugucuuaaagugcuaggaacuaaacucagaucuuuugaaagaguagcaagcgcucuuaacuauagaaccaucucucuagucucaggaucuuuacauuuuguaguauaaucauugagauaaaaauggcuaguaauuccaaggcuuaugaacucaagauugucuuaaucacuaagauaaauaguuacuugaauuugguacagauuuuauguaaaaguuuaccuguacuacaauuauuguuuuuuuuucuuuuuguuuuuacuuucaguauaguguucaguaaauuaaaugagauaaacaguacuuuauuauaaauuuggcuuucuguaagauaauuuuuccaacuguaaguuaacaaauauucuguagaccuuuagauaagcuacccuaagguaugauucagguuaaguguuuuaaauacucucuugauuuaguccagagggucuaauuagaacacaaucccauuauaaaucaagguuugucuauaguucaacucauuguacauauguggaacauuugugagcgaucuuuaagaauaccagaguuacaaugguuguaguccguauacaaauuuauuuuacauaagaaggcuauucuguauauaauaacuuaaaaauuuuuugauauuauaacuucuuauugucuuacuuaagcauugaaaauauggguauaagugugagauuaauucuaauuuacauuuuuugaguaaugucuuucuaaaaauauacauauuuugguuguguguguugguuuuguauaugugggguccacgaacuugaauguauggguaugaaugccuguguaugugcacacaugcugaguuaucauacuuuccccuuauugauuaccuggagacagaguuaauuauugaaccagaauuagcuuuuuucagcaauguugacuggccagcagccuucuugggauaugucugcauacuaguguaugcagguacaaccucuuuuuaugugauacuggaaauuugagcuuaggcccucauacuuguagaauaugcacuuuuuuuuuuacccacugagcuaucuucuuugucucuacaccuggccccuuaaaaaauuaaaaaccccauuuauuuaauuauuuauuuaacagauuuauuauagcuuuggcuggccuagagcacacuauguggaccaaacuggccacaaacucacauaaauaauccacuuguuucuccugucuccuaagugcuggguuggaguaaaguuauaugauaguccuauauguguauguuuuuaaauuuuacucugaaccauuuguugauaauuuuauuguuucauugcugguuuuaaaugcugcaugagaaaucaaguguggagcaacugauguaacucaguaaagaggcugccuagcauucacagagcucuguguugauucuagugccacauaaccugcauguggugccagcacguacuugaaaucucagcacuuuggagguagacaggggaugaucagaagccuaaagugguccucaauuacguuugaaaccuagccugaaauauauggaaacagaaggaaacaauauuuccuauuuaaaaaauuuucauacaguacauuuggaucauauucuuucuucuuacucaacuccucccaaauccuucccacccaaauacauacaugucuuuucuaucaaaaacagaaacaaugagaacaaacaaacaaacaaaaaauaauauaaaaaaauaaagccacggguccuuccauguguacucuuugguuggugguuuagucccugcgagcucugcgguaucugguugguugauauuauucuuucuauaggguugcauaggaacccuucaguccuuucucuaacuccucuauuggggaccccaugcuaaguccaaugguuggcugcgagcaucugccucaguauuugucaggcucuggcagagccucucaggagacagcuauaucaggcuccugucagcaagcacuuguuggcauccaaaguacugucugcauuuggugacuguauaugggauggauucccagguggggcagucucuggauggccuuuccuucagucucugcucugcacuuuguccccauauuuccuuuagacaggaguccucugggcuaagaauuuaggggaugaguggguaguccuaucccccaaccaggagccucuacagguucucccuccccuuuguuggcuauuucagcuaaucucaucccuguuggguucugagagccucuugcuuucuuggcaucugggucuugcuuguggcuauccccaguuccugucccccauaccuacacaccucuguucaaauuucugacccuccguauaucaucccugucuccucucauaccugauccuggcccccauuuucucccucuucuuccucucuuccucccaaguuccucccacccucuaccuccugugauuauuuuguucccccuucuaagaaagacugaaacauccacauuuugguuuuccuucuugagcuucagauggccugugaauucuaucuuggguauucugagcuuuugggcuaauauccaccuaucagugagugcauaccguguauguucuuuugugacuggguuaccucacuuaggaugauaccuuuuaguuccacccauuugccuaagaauuucaugaaguaccacauuuucuguaugcauuugucuguugaaggacaucuggguucuuuccagcuucuggcuauuauaaauaagguugcuaugaacauaguggagcauauguccuucuuauauguuggagcaucuuuugaguauaugcccaagaguggcauagcugaguucucagguaguacuauguccaauuuucugaggaauggccacacugauuuccagagugauuguaccagcuuguaaucccaccaacaauggaggaguguuccucuuucuacacacccuugccagcaucugcugucaucugacuaaaccaccaaccaaagaguccacauggagggacccauggcuccagcugcauauguagcaaaggauggcauugucuggcaucaauaggaggagaagcccuugauccugugaaggcuugauuccccaguguuggggaaggccagggcagugaggugagagugggugggugguacagcacccuuauagaagcagggagagggggugggggaaguggaggggggcaggagggaucggauccagaggggaaaccgggaaaggggauaacauuugaaauguaaauauauaaaauauuuuuaaaaaaagauuaaaaaauuauccuuucuguguuggccagcagauacuucuggguauagggccuguucagggaugugguugagugagagacuuuggagcacucagcccugaaaaggaugucuuuaucagauuucuucccuugagacucuuggaucuaugcagaaaaagguuuuaaggaccagaaacgguagaugacuccaaagggggaaaaugugccuauauauauauggauugugguuugaugauagaaguauaaaaagucuugagauuaaagacaguaaaacuucucccuugaucugauuauauuugacuguauggguaguuuguuuuuuauuaauugauuucagauauccuuuucacaaugcugugauaggaacuggagaagugaugcagccauuuaaagcacugguugauuuuucuagaagacagagguuuaauuuccauaccuacauagguuuaauuuccauaccuacauggaagccuacaaccuucucuucagcuugauuguauugugguuagagaauguagucuuuuuauuaaaaaauuuaauaccuuauaagccaacauauucuuaguuuuuguagguguuaagcaugcacuucggaagaauagaccucugcaguuguugauggcagcauucuauuauaccaguuuacguuuguuggugacacuguacuagugugauuaauguauauuuaauaauuugguuuuacuaauuguuuagaauugcaaauguacuuguuucuuauuaucuaccucagaaguuuaauuaugugugcuaaggauacauuuuuguguauuucauucuuuccuaaucuuuuuuuguaucuuuuuaacuuagugcuucuuucuucuguuugguuuauauuuuguuacuuuuuguaacuaaagguaguaacuuaacuuauuaauggaaaucuagccucuuuuaacauaaauauguguguguuauguuuucuuuuguuuuuuugagacaggguuucuccauauagcccuggcuguccuggaacucacucuguagaacagguuguaauuguguuguaguuaugcaagcuuuuuuuuuuuuuuuuucucugucaacuuuugcuucucauguuuuuuuguuuuuguuuuuguuuuuuuuuuuuuuuuuuuuucaagauuucuuuugguuuuuugagacaggcuuucucuguguagcccuggcuguccuggaacucacucuguagaccaggcuggccuugaacucagaaauaugccugccucugccucccaagugcugugauuaaaugugugcgccaucaugcccagcucaagauuuauuuuuauuuuguguauaugaaacuuugcuuucauguauauauguguaucaugagcauuccugaugacugaggaggcuagaauagggcaccugauacccugaaacuagaguuagaaaaggucaugagcuguuguuuggauuuuaguguacuaaaugauuuaacugcugaacuuucucugcagccccugcuucuguuauuuuaagcuguugauuggcacauacauguuuacgauuguuauuguucuauuuuauuuuuuaauuuuggaaacuacuuuaccacauauuaacguagccauucuugguuguugaaaaguuauuuucuaauuuucuauauuguuguaauugaagguauguagaauacuugauuaauuuuuuuauucaccuuacuaagauuuuauuuugacuuuuaauuuaacuaaaguuuagguauucuuacugguaccauaauaguuuuuacaauuuucuccuuugaccaucaaauacuauauaagaacugggagugaagugguaauguuaaugcuccuaguuuuaucuuuuuuuuuuuuuuuuuugaugcuuuagauuuucuucucuuauauuuuucuuuuuguuuggacagcuuccuuuagcacuggccauuauuuaaagguagaucuaucuguuaaugaucagucuuuuugcuuuuuaugacauucugacuuuuauuuccucuugauccuccuuucuacuaauuucagccacacaguaguuuggaauaucuaggauuacaugcaugcacccauggccagcuccuugauuucuaaaggauaguucuuuuguuguagccauuaaaaaauguaguguuuccuuaggcuucccauguaauuuaaauugguguuuuccuauagguaaucuguuaggucuuugauguuucugaaguuauuuuucuaguucucagaaguuuaguuagaauuucaucaaauuuauuugacuuaaauuuauuuacuuucuuugauuccuaguugaauggaaauuuuuauccauuauaucuuagaaaacuuuucagcuuuauauucuuuguucuagacuauuaaugauagaaauuuagacauuuuuauaauuccauaaauaauuucucaauuuauuuuauuuuucaguuuuuugagacaggguuucuuuguguagcccuugccguccuccuagaacuugcucuuuagaccaggcuggccuuaaacucacacagaucuacgugccucugccucccagcuauuggcauuaaaggcaugugucacuacuacccaguguauuuuuauauuuucaaagacuuuuuucuguuuuuguuuuuuauuguuauuuuuaacauauauucauucauuauaaaagucauugacuuuuuuauuuuuuuaaucauuucaguggucucaguucugguugaacaagguggguuugaaaaaguccucacuacuuuauggcauaggauacuucugagggaaugaaugguccugcugcagauguagcacaacaucauagauaauugcuucaucuuguggguaggaguuuucuggaagguuguauuuuccuggaauccaaggugaugacaggauuuggauaaaugucuggagaucuuuggaaacucugggaugugacauuacagaaaguugccagugaaguaccucaacuucuuuguuuccucaauucugaagagaaugagcuagccacucgagugaaguugacauuauaaaacagugaaagaagucgggaguuggugaugcacaccuuuaaucccccaacacuuaacagggggcaggggcagagaaaggggcaggcagauagaugaguuuaaggugagccuggucuacuuuuaagucugaguuccaggacaaugagagcuacacagagaaauuguaucucaaauaacacaaaacaaugaaagaucagguaaugaaagccuuuauuuuauuuacauuuauuuucuuuuucuguuuuaagauacuugcuuuacagauauguuaaauuuuuacauagcuuuaauuuuguagaagggaacaaagaaaaaucaugacuaccuauguaauuaaaacaaaagauuuugcuuaauguuuuaaguuuagggcacuuuucauaaaaucauacauguggaaauaucauuaaugaguuucuuuuuuuuuccuggagauaauuuuuuuuuauuagguauuuuccucaauuacauuuccaaugcuaucccaaaagucccccccgcccccacuccccuacccacccauucccauuuuuuuggcccuggcauuucccuguacuggggcauauaaaguuugccugugcaaugggccucucuuuccagugauggcugacuaggccauuuuuugauacauaugcagcuagagacaagagcuccggggcauuaaugaguuucuuaauguccuuuucuaauacuaguuuuaauguucucugcauagcucuuuuuagaaauuuaauuaggugaauuuacugauuguuuguaagugcuaggugugaggucagaggacagcuuucagaagacuccuuucacuuuguguccuguuguucucacugcucucucuacuccaugcuggcuggcuuggagcuuccagcugauucucuggccucuucucgucucucucaucuuagaagagugcugggauaugcaacagaaugaggcguuuuacauagguuccaaggaugugggucgaguucauucaagcugaaguaacaggaauuuuuacccacugauuccugcuuuuuuuuuuuuuuuuuugaacucuuuuaguuuuuaagucuauguucaaauccaggauuggauuuuuaagccuacuugugggcuuaaaucacaaauagguugauuugguauuaggaacuaaaugacacugauuuuauacauauagaggauuauuuuguuuuuaacuuuuuucuuucaguucauccagagcagcuuccuccgaggccauggauuacauuaaaagaacgagaccaaauucugccaucagguagcuuuucucucuuuuacuuuuaaaauaaagcuuuauuugagcuugugauuacaggcuuucauuuuaucuaccauggguauagaugugccuaaaaguguugauagaauagacuaaaacaacaucaagacuaaaacaacuauuauacaaguaaacaccucuugucuuacacauggcugcacugggcuagaaaguuauucuuugugaugcagcuuuuuagcgcucuuaggugguucuucuaaugagcaauaguaaccuugcuucugaaagguuuuaaguuuccuagguacuuccuugagaggaagacuggcaagauacuuaauguuuaagauaguguguagaaauguuagcagaauuaauuguagaaaugguucagaguauuucagaacucuaagggcauaacuuggcauaucugaaacaguaauauaugaaauuuaagccauuaugucuuuuugcagaugguuaacaguuuuaccuuuuuguaguacuuuuaacugcauguuaagacauuuuagguuuggaacugcuacuuaaaauaaguuauaaaggggcuagagagauggcucagugguuaagagcauuuuuugcucuugaagaccuguguucaguuucuagagcccacauggcagcagucauccguaaccuaguuccagggagucugguucucuaggauauaaggcuguuuggagauacauauaugcaggaguucaugcauauacauaaaauaaaaucuuuaacaaaauugugaauuauuguuuaagugccuuuuaaaugacauccauaaauauuuuuaugauacuuaauuucauuuuaaaauuaaauaaacauuuuuaacuuucauacauuagaccaauuacugaacacuacuacuuuaaugguuuuuaaggguuagaaguuacuaucaacauuuugaacaauauagaccuuucuguuucugaguuguuuguuuguuugguuaggguguucuuguuguuguugucauccuuauuuuguuuuuaaagacagggucucucuauuuaggucugcuuguccuggagcuuguuguguaaaccagacuggucucacagaaaucuaccuucuucugcuuccaagugcugauauugaaagugugugccaccacaccuggccuuuggcuuuauuuuuacuuuuauuuuuacuguucuagaacauucagaacaaaauauuucaguauuggguagaauguaagacuucuucaugcuucucuuuguauuuuaaugaugcugagaaauaacucuucacgauacaguuuuguguuuuucacaggcuuaugauuuuauaucaucacaacuauaggaaaacaucagccuguuaaauagacauuguuucaaaauuaccacaaauaacauuuguuuuagcaugauacauauugaaugauuuaaguaaaggaaacacuucauguuuuuagagugccuugaauuagauagauugguuuucuguagugugguuuauauccuuucuacucuacccuccuccaucuuucuuagaaauggaaagcucuucuuugguuagauuuccaucuucuguuaaguggaauuaagccagauacugaaauaaaaauauuuugucuuuuguauuugaaauuuagauuuaugaaaaaaaauucaccuaagacaugaagauagguggggaggaaacuauuugggaagagagcagaagggaacccuaugggggggcauucaacaggggcugggguaguuaggugaugggggggcauucaacaggggcugggguaguuaggugauggggaggcauucaacagggacugggguaguuaggugauggggggggcauucaacaggggcugggguaguuaggugaugggggggcauucaacaggggcugggguaguuaggugauggggggcauucaacaggggcugggguaguuaggugauggggggggcauucaacaggggcugggguaguuaggugaugggggggcauucaacaggggcugggguaguuaggugacggguuaauaugaacaaaguaucuuagguacaaaaaucucagugaacauacacuaauuaaaaugaaaaccaguguaaagguuagcuuuuuacauuaaagaugaacauauauuuugagcucuuuaaucccuucuugaacacaaaugagcauaacuuauaaggcuucuacuauuacauagccacauaucuauuaagaaaaggaagagguacauacagcuaaauauuacguagucagagauuccuaaaguaauguuuucuuaggguuaacugugaugaagaaccuaguaaagauuuuccuuaguuuuguacuaacugaguagaugucaauauugaaaaaugccccuuucuuuugcuguauagagacauguguguaauaacucagguaguguagagugauuguauacugaaauuauuacaaucauuaacugcaauaauuaggcccaauuagagaaaaaucuuccagauagaaauggaaauuggaaauucuaucugcagcuuaauuaauuuccacuuuaaaacuuguaaaaauuucauuaaugcagaauuuaguuuuuauuggagaaauuuucacuccuagacuuuucuagaaaaaucuuacaucaaaaagucucuauauuaacaaaaccaauaaccacaacaaucuacauaacuucuuuuccucuucaaaucuggagaggcagaacacgcuaaacuugggguacuaaguuucacagaaucguggcuuaugaauuguucagggucguuuccaaaguaaauacaaaggauauaaauaauuccaacugaaacguagacuucaguauacaaaauggccaugaaucuaacacuuuucugucuuuucuauuauugaaagugaacccagcuucaacaaaguuacuuuaacuuuaguugcuuagaaauuuaugaaauugaugguuuuuaaccaugcagguuuauuaaccuaagugcuaucuucuugaaaauauguaugccaaaaacccaaugcucugacuuagcauggggauauccuuuauaucaggguuucuuuguuauuuaauguuuuuuuuuguuguuguuguaguuuuugaaaaacaucuacauggugacuaaaauggguaccuaagauggagaauuuuuuaggaaauuuaggccuuauuuuuguuuaacauaauaucuaauuugagucaauucaggauuuuguuaaacuuuaauuucuguuucacagauacuuaggggccagaagugguggguuuccaaguauuaagguuguugacucucagagcauaauuuagaguagugagggaaucuggauuauuaguuugcuauauuuguaguugugguuuuuaauaagucagaaucuuacagaauaauaacuuuacuucagaaaugaauauuagauuggcagaaaggauucucuuauggcuaaauuuggucacccuuuuuuggcuuagauuaguagaaauaauaauaggucccuaaaauguuagcuaucaaauuuuugauaaaaaguaaagaaauuagaacacuuuaaucuaaauuaaacuaaaauuugaauuuguuuaaauuuaaaaaaccuuucuccauaaaucacaugcaaauaauacucugaguuucagaaguugaauuuauuaaauuuccuucaaaauuuucaauauggauaguuaaauuuagacuguuaaacauuagugcauuguacuucaucauaagauagcacuguaagugaaauugccuuuaacuugaaaugugaauguaaaagucauagaagauacuacauuuuugagaaauccugcauuccaaguuaaacaaaaguaaauacuuuaucauaauuugcuucuccuggcauuuugccauaauccuaugugaacuguuuuuaugugcuuaugcaugcauauucuugauacugaguaacaaaaaguugccuaauuuccuccuuuugucuguuuuuuucuccccuucuuagcaucauucacgguuauguguuacaauguguuaugugauaaauaugcuaccaggcagcuauauggcuauuguccguccugggcauuaaacugggaauacaggaaaaagggaauuauggaagaaauuguuaacugggacgcagauaucauuagucuucagguaacacuauagaaauuaaauuguguuuaaccuaaagaugaacuaaaaauaguagaaaaugcuaccucuggggggaaaaagcccauguucaaagcaaaacugaaaaagaauauuuuuuucuccuuuaaaagggcaauaauuuuaguaaaaaugaaagagauuuucauaguguaacuguauugcugacugaggacacauguguauuuauuuucauuuacuguuuucugaaauuaaucuugccuccuauccauguuaacaguuccuugugagcauuuuauuggaauuauugaaagagaaaauugcagauuagucuuucaggaauaaaaguuuuacuuaagaguugaguucagaagaagaaaaauuucuuaaagauguuucuuaaucauuaaaaaaaacccugcccaguuaauucauaaaauuuuuuuuacuugaugaacuauuucuaaaauuuagaccuaucugaauguuucuccuuuuaaaacagaucuguauugguaaaauuuuuauaucuguuugacuucucaaaaauaauuuuaaaauuccuuuucaguuuguuuaaauacuuauuaaggguucaaaucucucaggagguagaccacucacagaagaugggcucaguuguagaaguugcuuaccuagaauugaauuggagaggaggacuuuucacccuucuauuuaaaaacaccauguguugaauuuaacugaagaagaaauuuauauucuuuggaaauugaaauuucucuucaacauuuggcaauaauuagcccagaauuuugaguagguuuuuuuuuuuuuuuuuuuuuuuugguuaguaauuuuauugauuucaaagcaucuuaaauauuuucauuugaaaaaauucaaauagacaauuauguuuauuuaauuagauacagcaugauacuuaaauauauguguacagugugguauggcuugcucauaugucuaucaccucaaauaguuuccauuucuuaaggauuucuuaaauuauuguaguaucuuacacauauucccugggaagaaaguugaugacuugcuuuuuguuuuuuggguuuuuuuuuuuuuuuuggcuacacaguaugccccaauccagcuauggcuauguacugaggccccaugucaaaaaagaaaaagaaacauggaaaucaguuuuuuaaaaacuggaauagcuugguaauuuauuguuuuugcaucuuacauugagaguugggaggaggaagcauaugcaguuuggcuguggcucacuguccagcuuucucuucaguauucauagcaccaugcucaggccuuuuaagucaaagguaguuugaaagauaaaucugaauuuaaggagacuuuucuuuuguaaaagccauaguacauuauacaguaugcuccaaaaguugaaaaauuauaaagugugacuaaggaaaaugugaacuauauaugaaaggccugaaauauuuuuuauauacuuuuuuguucuuuucauuuaguuaaaaguauuuuaaugaauagagauuauaauauuggcauauuuucuuuauccacuuaauacauuuuuuucauguuacucaaacucuuaaaaucagcagaugaauacaauuaaaugaauuacaauguuuaaauuguagaacagucacuuggagcuuuuuuuuuuuuuuaaaucaugcuguugagagcaccuuuauaugcacauaucaucacuucuacauuuuuuuggaaagguuuauuuaaaauauucuauggaucaaagaaaaauuucuaacuuaauuauuuaaauuaagagaccauuaaaaauuuuuuauuagguuauuuucuucauuuacauuucaaaugcuaucccagaagucccccauaccccccccuuacuccccuaccuacccauucccacuucuuggcccuggcauucccccauacugaggcauauaaaguuugcaagaccaaggggccucucuucccaaugauacauaugcagcuagagacuuaagagaccauuuuaugaucugaaauuuuagauuuuuuuguuauuguuaaaagaguaucuuuugcacucuucagauaucauuucuuuauaccacaauuuaaaagaauaauuuaaucacuuuucuuuuuacaggaaagauucacuauuuccuaucacuuaauaugugauuuauuuaauuauauuggagugaacccuaauuugggaaacaggaaagcugagauauaaucuuacuccuguuguuaaccaguacaaugaacaugagaaagucaugcuaccuuucuugugccuucaugguuaaaauacugcacaugucaaacacaauugcuugugauaagauugcuggauaauauguuacauaaagugcuuuguuguaaucaauucuuacucauuacagaauauuuuuaugucuuaacuauuugaacugucauguagauaacaauuuuuccuucaucuuaggaaguggaaacagagcaauacuuuacucucuuucugccagcauugaaggaucguggauaugauggauuuuuuucuccaaagucacgugccaaaaucaugucugagcaggaaagaaagcauguggaugguugugcaauauucuucaaaacagaaaagugagucaagagagaaagcacagcaauguacacuuaauuacuuuuaacuuucuuuuucuuggaaaaaauuuuuauugguuauuuuauuuauuuauacuucaaauguuagcccccuuccugguuuuccuuccauaacccccaccccugcuuuuaugagguugcuuccccacccacccacccuuccacuccugucucauugcccuagcauuccccaacacuggggcaucaagccuccacaggaccaagggccuccccuccaauuguugaggccauccucugcuacauauacagcuggagccauggaucccuccacguguacucuuugguuggugguuuaguucuugggagcucuagggggucugguugguugauauuguuguucuuccugugggguugcaaacccuucagcuccuucaguccuucgccuuucuccuucauugagggcccagugcucauguucacugcaagcauccacaucuguauugauuaggcucuggcagagccucauaggggacaacuauaccaggcuccugccagcaagcacuuguuggcaucagcaauagugucuggguuuggugucugcagauggaauggaucuccaggugggacagucucuggauguccuuuccuucagucucuguuccacucuuugcccugcauuuuucuuaggagcaauucuggauuaauauuuuugagauggguggguggccucaugccucaaccgguggucaugccuaaccucuggauaugaucuccacagguacucucuccccuuuguugggcauuucagcuaauguccuccccguuggguccugggagccucuugcuuuccuggcaucccggacuuucauugaaaauagucuuuaguuugauucuaaaagaguaaagcuagaaauugcaauacuguuuuucuuagguaauauacaagaaaugaagauauuuauuauauuguuauuggcagauuacugugaaauuuugagauggauuugaagauaacaguuuuaaauuuccauagaguaaaauaucaguuauauguaaaguauaauuaauaagggcaauauaugauauggauuuccuucugugauuucauuuucaauuaauauuucauuaauaguaauauuacuguuuaauauuaaauauaacuaauaauuuacuuccuaaaugcauauugaauucuuuugugacaugucuuugcuaagcacgaauaaguucuagucucauuagaacuuuguuugaucacuguuuugaaagagaaauuuaaauuccuugguaauuuacuagaggugcuuaauauuuugcagagcaguuacaacugcaaucuaggacacuuuaaccauuauagcuguagauucauucuuggauuauuacaguacagaggaaauaguuuguugcauucuuuuucuuucccuucuuagcuguuucuuuccuaaauaguauaguaucauggauugcauaacaaugaagaauuuugagugugacacauuucauuaaaccauuugcuaacagucuaagcacucuacuuuugaagacuguuucuucugcucucuaaucccuuaguugacuguaguucuucaucuggggugaggcuucaggggccccacuuuuacucucuucuuucuucauggcagagguaauaguacaaaggcuaggaaaucauagcucuaguauuuagucagcuguauaaucgugaguaaguuguuugcacuuuuacaucaguuccuuuacuugcuuauucuuguaagaaacaacauuuuauguuguuuacaaaaguagcaaaguaaaaaugauagcuagaagggaauuuugauuucauauucacuuucaaagucucuuaaaucaguauagacaguaauuuuuaucaaaacacuuauccauauggugaaagaauggaguaauuugggggggguaaaagcuaggauauauauuaaagacauauaaagaauuagaguacaguaaaagauucuagugauuucuuuuuaagaugggagggggucacugauuguugaacuuaagacuucaagcaggcacucugccacugagccacacuguaaccugccaagauuuaauguggcagucucaucaggaccuuuuauuuuagguaucauaagcaucauuuguucuuaguuaaagguacugcaaaauuauauuuugaucuaaugccagaaaugaguuuugcuuugucuuuuaugucaaauaugaucuacaguagguaaacauaauacacauacaugcauuuuuuuuuuauauguaguguguauagagaacugcauuaaagacggauuuuugucuagacaggguaggagaggaagagaauacggaagaggagggggcagaggaggagagggggaggguaaagcacaggugggacaacagcuuggugucuuuagacgccucacugucaucacauaguuuuaaaauauauuauuucaaagaaaaguuucuaugaacauugcuaauaaaugauaaauugaaggcauuuuucccgaaugagguaaccuuuagauuuauuguguuaguuauucacaguugcugcucaguguugucucucuagcuuuaagugcaaucacauggcaacauucuagaauucauccaaaauuaauucuagacugcacacuguuaagaaguuguugcuucuuuguuugaaagcuuauuuuggacauguucuccuacacaagagauucuucauaaucuuucucaaauauaugauuuuuugugcuguuguuauaguuuugguuuuguagucauaucagucuugauuauguucuuuauauacucacuugagcuccugcucaaauuuuucaaaaaggugaacauacagaaaaaaaccacagaacuaaauaugauaaaauagcuuuaggaaugcugcuuacaaagcagaguacacuaaucagaauagaaucaucaggugaaucugaaaaacaaggcaaacuuaacacuuuacauauuaccaaagauugcuagcuaaaauuaauaacuggaaaguaacuauaaaccaaugcaugcuaguaaaagaaaaauuccaguacaguagaggaauuuuaaaauuuccuguauggcucucucugcaacagaaaguagaagccacauggaacauauuuuguguaugguaguuggagaagaugugacugucuuaaguuaguguugguagaauguaaauauuuuuauuuauuuauuuauuuaaaaacugaguuucacuauguggcauuggcuagccuggaacuggcuguguagaccaggcuagcuuugaacuuagaucuacuuguuucugccucccaagaacuagauuaaagacaugugccacuacacaugucuuuauuuuuauuuauguguaugucauguauauguggguguccauggagaccagaggagagugucagguccuauggagcuagaguuacaguugguugugucauugccuguuaugcaugcugggaaccaaagucuguccauuugaaauugcagcaagugcucuuuacuuauaaucccuguuuauuuuaucuccaguaccauuucauacucugccauauucucauucauuuucucucucucucucucucucucucucucucucucucucucucucucucucucucugucauuuaucugguuuuguuuguuuguuuguuuagaaagcuauuugcuguuuuugggauuuccucccacuuuuaccugaaaugcucuuaacuucagucuucacaaugauggcuuuuucagcuuaaggaccaccucuuuacgggaacagggugaaaacugcuuuuuuuuuaaagaacucuggguuugaaauaggccacgugaccagacacauuacacuuuauguauucugagcacaucugagacauucagaauuggaauaagaagcugauaggaagaauauuauuuuagcuagcaugguauauuacagcauugcaagcuuuauaguuaauaauuuuugaaggguuguaugugguuuaauuuucagcucuagaaaugauuauaaagugguagguagauuguuaugaaagcaaaacaugucuuugaaagucuagugaaaauuaguauguuaagccaugucuguuagagcauguucuaaucucauuucuaaggaucaaaggcaggaagagagaguuagcugcaaguucaaguucaggggcucuggcuuaccccaaagaacuauuuugguucucuagauauuuuaaaaaguuaauaaaauuggguaacugauguuaaauaguaucuuacuuuuggccucuaacacucuaagaccaugaucaaaagcaacuuggaggaaagguuuaauucaucuuaaacuuuagaaguaauacuuacuugaucauuaagggaagucagggcaggaaacuggaggcaggaacugaagcagaggccauggaggaaugcugcuuacugguguuuuccaucuaugcuuaccaagucuacuugguuguaccagcaccaccugcccaggagugaacugugccuucucauauuaacuugccuagaggccgucugauagaggcuuuuuuuuuuuccucagauaagucuugcuugugucaagcugacagaacaaccaguacaggcaacuugaccaaguucacaguuauuaaauguuagcauuagaugaauuuguauuauauucuacaauucuacuauaacuugccaucaucacagagauccauuuuuuuuuuuacaauauaauuuauuucucugaacacuuauaccuaauuagucuuucuguaaaaacuagucaaggaugugaucauuuuuagcugggaaaaagaucauauuccuguauuuucuugacuguuaccuugauaugguauuuaaaaauuggcaaguagacuuuauucuuucucuuuuaaacuguucauuuaagauuguauguaccuuuaaaugucaggaaaaucugaacaguagcuuaaguacaugaguuuuguacacacaagaagcaguuuagagagaacuggcucagcugcuuccucauucucagaagauuggcuuguacccuucugcuuaguucacauuuaguauuaguccuuuagauaguaaauuuccccuacuaggaagcuaguaggggaaaagacauaaaaggaugaagaggauauauauuuuaccuuuguuagaugggccuucauaaauuguuuauagaaaccauauuucuuauuucucacuggccagaauuauauaaugugagcaucuguagcuauagaugugacuauagauuaucaauaguguuuauacucaugcccccucuacuuucaauguguuagccugacaguauaacuacccaaguuaucugaauauaugugccuuuuagauuuacauuggugcagaagcauacaguggaauucaaccagguagcaauggcaaauucagauggauccgaagcaaugcuaaacagaguaaugacgaaagauaacauuggcguugcugugguguuagagguccacaaggagcuuuuuggaacaggugagugccaucuacauagauuuccuaagggaagacaaucuuauuauuacaagauuauuucuuuaucuugagaacuauuaaggagauggaaaagaaaauagcauuaauuauguaaaguauuacacauuucuugugaauucuugauuuauucuauaguuuuugucagcauuuuuacuuaacagguaauuucugccccuuuaacacaccauucauugagaaaauucuuugaaauaggguauggcuugguuaggcugaauuagaaguuauacuuagcccucucuuguaguuugagcuucacacguguguacccuuuauuuuuuaagguuaaauaguuggcaugcuuucuuuaauuucuuuguuacaucucaagucuuugucagggugagaacaauaucuuuuaucuaugugauacuuuucagaguuuuuagauuauuuauagcuucccagagagucugaaauucauuguauacuuggcauuaucaaggucuuucauugaccucucuucugccugccuuggaacacuauuauguuuuaaugucucaagcagaacaagcugauaagaccacaugggugcacuucucuuccugugcuacuuugucuggaguacuaguuuaaauuauucagaugacacauaguaucagauuuccuuuuucuuacaguucuuuaguuuaucauuaaacaguccaucuuuaaugugagauuuuguguuuacuucuguuuuagccuuuucaauuuuuuuuuuuuuuuuuuuuuuuuggucuuuucccauuacauuguucugguggguuuuguucuguuuauuacaaugaucuuuuuuuggaguuucaccccuuuuuaauuugcagaagaguaauucuaaauuauguaauacauacuucuacuuccuaaaaccuguuccuuuccuuauaaaaggaaaauuuaauggguaagagcaaauggauuuuugggacacauuuuuaauauuuaacauagugaacaugcauuuauagacagaagugacaguuaaacuucuaggaaauggagacagcauacaaaaaguuguaaaguauuccuucaguuucacauagcacauuacuuugguaauuuauuuucucaacauuggaaaaaaguuacaguuugguaagauaagaaggaaacauaauuuuaccuaaauauuagacuuagaaauugguccuuuuucuuuagaguuuguauguguuucauuggaaaaaucugaacuauuuuuauguacauuucaauagaaauguuaauuuugaguguucacuugauacuucaacagcccaaaaguacaugaacuuuaaaaaaggagaacuuuuugauuacauucuagaaaugcuaaguggcauuggauuuucuuccuugaacuuaguuucuugcuacugcacaauacuuauccaucuugcauuucauaagcuuaguaguaaaggucuguagcaaaagugaguaacaguauuugaaccuaaagaaaaugaaauaaggaaauaaauuugcuguccaaauaaaauuaaucuuacaaugaaaauuaagagacuagauaguuuuuuuuccuccccagucaucuuucugccaauacuuauuaaguuuacuucucacacuuuauauuggauuuauuaccauguccaccauuuggaaaauauuauguuaauguuuauuuuaacagaguuuuaguggaaaaaagaauuuaaaauuaucuagcugguuauccuuuuucaaauuaaccuaaguaucaaaaacccuaaguggcaaacuagccugaguccacacaaaguaauuaauaauaaaaucaacucuaaaaugaaaguauccagaguuuugaagcacacaguuuuuuaauuuuuguuuuaagauuaaugccuacauggacgcacaugugugcgcgcacacacaaacacacacacacacacgcgugccugcuacccauggcagucugaagguguguuggaucccuuggaaguagaguuaccagguaguggugagcagucugauaugcgugcuggaaacaaaacccuuguccucuucaagagcagcaagugcuuuuaaccgcugagucauuaucgagucccacaauuuccauuauaaaauuaauuuuauuugggaauuuacuuggguguaacacauuuguuuccuuauuuaauuuucuguuagugauuuuugcuauugaccuuuacuacuaagcuugugaaaugcaagaugaauaauuauuuguugugcaguggcaagaaauuaaguauuaguuaauucaccuggaaacaucucucacuagauauuaugcuauuuaaauaagagucacuuaaaagugcuugcuucauguuggagagaugccucagcaguuaagagcgugcauuauuuccccagaauuugaaaugcuggaauuugguucuuagcaccuacuuuggauggcucccaaccaccuuucauuuaacuuaaguuccaugagaucagaugcccucuucucagccuuugcaggcacuacacucaugcacaaaccccauacucagauaccacauacacacagcacuuaaaauuaaaaagacaaaaaacaaaacaaaaaaaacaacaaaaacaaaaaaauguucuuuguuaaacuaacaauacagcagaugaaaaguacuauaacccagauauugauuaucucauguaauaauuucuaccuuaaccauguacagcaggaaucagcaacacugucuaacgguauagauacuaaauauuuuuggcucuguggacacauaggaucucuuugaaaauguaagacugaacuuagcuuaccaaggcuauaaauggaaauauauaguagacuuaaguuuuauucaauaggcuaccauuuguuuacaugauugagaugaauaacuuaacuaauguaucaugguuuccaggauuacccuuuagcuucucagauaaguuugagaugaaaaucaguauaaauauauagaaaagauuaaugaaguagcuauggaucuuuuucagaaaaguuuuaaaguaccuuuuuuagaaaaaagaaacaugaauauaacauucugcaucuuuuuuaugcuguuuaaauuuagguaugaagccuauucaugcugcagacaaacagcugcuuauaguggcaaaugcccacaugcauugggacccagaguauucugaugugaaacuuauucagaccaugauguuugucucagagguuaaaaacauucuggagaaagccucaaguaggccuggcagcccaacugcagaucccaauuccaucccgcuggugcuaugugcagaucuuaacucauugccagauucagguauuuaccacaucuuuuuuccccuugcuuucaguuucacauuuagucuugauuggaagaccauccagcuccuacagagcucuucuaaauuaaggaacauaccaguuggaauuugagagaugagacaguaacuaauugauaaacaaacaaacaaggaaacugcuuccaaaggaggguucaggcuuaauuaagugaaacaaaacaaugaauauuuuuguacuuuaaccauuacuacucuugcucuuaacuggaaaaaaugguaugagauguccccagacuuuggaaguguuguauuuauagacgagggucaauaauugacgugauggcuuggaauugaaugguacaaucggugccugccaaauuauaagaagggagcugggggaagagaaugcccucucucacucugcucucaccuuuccaucuucugccagggcugcccauuaaucaaguccaggcagaagcuaugggggguaggggaauauuugcaccaaugcgagauuaaccucccgaggcacagaguuaagcaaagguggacacucuuuagagaauauucaucacagauagcugucucacuuaauaauauuggcagguucucugugaucuuuauauacuuacuacuaguuuuagaagaaugaucacaguucuagcaaggugguauaucacaccacuggacuacuuuaugucuggauaucaucuuuguaaaacuuaguucuccauuuuagauccugaauuucaaaugcaaaacaaaagaauguaagucuguauuauuagcaaaacauauuccaaauauuacauauuauuaauaagcuguuaauccuuaccaggaaucaaauccaagcuuauugcauguuaggcaagcauuccuagccaucaauaguacaaauauaaaauacccauauuuggaaauuguaaauagucacugaauuuagaaaauaucuguucguaguaaguaaaugaugagauuuuugcaaauacuugguuuugaucucuaggccaguuugccccucccaaucccauguguaugugcacggauacauugugguaugugcauguguguaugcucacccacucaauagaagucagccuuguguguuccucaggugucauuccuuguuugucagauugggucccugccagucuagggaucaccaaguaggcuaggccuaccuaguuggccaaugagccccagggauugucugcuguacacccccagugcugguauuacaagagcucuccacuauaauugacucuuuuuuucucugguuccgaggcuuggacaugagcaucaugcucaugcuuguaugauagucacuuuacugaccgaguugucucuucaucccacaucccucuuucuuaauucucuacaaaaaauaaucauuuaaguuucucuaaaaguacaaguuuuuguuguauuauuucacaugauuuccuaaaaccauuuaugauagcuauuaauaucacuguuaccauagcauagcucauuggcucaaaucacacuguuaggguuggacccugauuauuucuuagcagcuauacauguuauucauuauggauaaggggauaaacguauuauuggucucauuaaauuguuuguaugccuagcauaucauaaaugcuagauaaauugugguuccuuuugaguuauucacgacacugauacucauuuuccuucauauuuugucauccuuaauuguuaauagaugaauuuaacauuauugcaaaguaauuauaaaaggggagagagaguuuuguuugcuaauuugguggaaacuugaagcugauaccacuaucaacuuuuuauacacaucuaauauuuuuggucucugguauaaaauguuuuucauaggugucagacugagacuuaguuaacucaaaauaaaugaggguuggagagauggcucaaugguuaagaucauggcuguuuuccuagagggaugggguuugauuccuagcacccacauaguggcucacaaccaucuguaaucaguaauucagguacuagggaaccugauaacccucuucuaaccuguggagacagacuugcaacuaaaacacucaucuacauaaaauaguaagauaagaauuagaaaauaaagauuuuucuaagcuaaccuuggacauugcauuguugaggaugaaaaaccuguuuuuauugcaaauaauuuuuuauuauaaguguuuuuuuauuuuuuuauauuuuccuauguuguugauugacuauuuugaguacugcuaaagacauaguaguuuagaguaauauuaccaaagcaguuaaugucaagaccuuucuggugaaugcucucuagauucuagaagucaucugaaccuaaagaacuacuaagguuaacaguauuccuagugauccugauacuuuuucugaaguaggcaaaugccuuuuagugauguuaaguuauaugaaauugcuaguguuuaagaauuuaaacaccagcaacaagaacccauuauuuuauuuguuuuguuuuugagacgggaucucuuuacagagcccuggcuugccuggaguuuccuguguagaccaagcuguccuggaccuuagagaaaacagccugccuuucugcuuccugggugcuaggauuaaaaacauguaccaccaagcccagcuaagaauuuuauaggauuuaagcaaacucuaaccaucgugugucuauagaauaagauuuaguaauacagcuuugcuguaaacauuaaaggguaguguucuuuauucugcuagguguuguggaauauuuaagcaacgguggaguagcugacaaccauaaagacuucaaggaacuaagguacaaugagugucuuaugaacuucagcuguaguggaaagaauggaagcucagaagggagaaucacacauggcuuccaacuuaagagcgccuaugaaaauaacuugaugccuuauaccaauuacaccuuugauuucaaaguaaguagcagucuguggacuagcaucugaacuauuucaaauaaaagcaugcacauagaaaaguaaacccugaugaugaagaguuuucagggcugccgguggugguggugguggcggcacaugucuguaggauuggcuaaagagucugcagggcucuggccucugccagaccaggcaagcaaauguuucacagacauacaugcaggcaaaauacagaaauaaaagaagaauuagcaucgaaucaaaaacaagcaaacaaauacaaacuaguuuagugucuggcuuaaauauacaacuaaacaaggaacuuuguugggcuucaugaucacaauugaugucauuuaaauucuuuuuuuaaacuuuuauuuguugacauuucagauaauagugauaauagcucauaguucuaaaacuuuuuuacuauguaucacuguugacauucaaucagucuuuaccuguuuauuaccaccugugcuuagcaagaauuuuagcaccugauauagcuaagcuucccuggaaugaacauacacuauucugucaaaaguuuucuuugaauaucuuauuuaucuuaugauuucccaaguuuccuguaggaguagaguuagagauuguacuuaaugucagucuuaucucuguaguugcauuaguauauucccaugucauccauggaacacuucaauuuuuaaaagaaaaggaaguccugcuguucauguucagaacaagauguuccuugaugaacugauggcaacggcucauugugguuacuccccuuuuguuuauuuccugaucauuuugucuacuuguagcuauugccuuuaccucuauuugacuuucugucauuuucagaaugaguuguauaucuuguucuauccuaaaaaauacauauauagaggaaguuguuuaguauacaaagcuuagagaauuuauaauauaauacaaaagggaaauauuaaauaggcucauucacauuuucaauaaccuuuuuccuuuuuuguucuguuuuauuuuuugagacuggguuucucuggguaacccuggcugaccaggaacugacuauguagaccaggcuggcuucaaaaucauagaaauuaacucccuuugccaccugugugcugggauuaaagguugaaaccaccgugccagccuccuuuuuucauuuuuuuauucuuuugaaaccaagacaggaggaagaaagauuuguguuuugauauuagucagcuuuaauagaaaugggacaaaaacugcuuagaaguuaauauaguuuuacuaguacauaaaucuauccgcuuauagcuugcauuguuuuggucacucauacauggugaugcacaguuaagcauuuaacuagcucucugggguaaauaagccuugauugguaguguuuucuguggauuaugugcuuguccgaucugaugugauacguuuguucacauuguugcgaaagguauuguucaaguuagaaaucaccagcucuaguauuuuguagaaguugaaagaaauacuucugaacuuaacuuagugauauauaguuuaaauccuauguuuauaauuauaauauauaauauugcaaacauaacccagaagaacuaauaaaagcucuccaaaauacguguucaguaacuagcuguuauuauugucuuaguauacaguagguuaagagaaaauauuacuuuuuccauacuuuuuagauucuuacuuuuuaacuuguccauaaacuauuagaaaaaaaauuggcauauuaguuuaagccuugauuuucugagcuggucuaaaaucacuauuucuuuaacauaucuucaaugcaucagguguuauagcacauaccuguaaucucagcaugugauagggugagggucuugaagucaagccuagcuggauuacauagcaaggccuuguuacauuaaaugaauaaaugaauaaauuucacauguagaaauacuucuuucugcuugaguaugggcucuuugcuauaguuaaauacuagguuaagugaagucuaugcagcuuggauuagugaaggcacauuaguuuugcuauuuacuaaucccauaaauuaaaucaucuagcucugggaaauagaauaaauguuauaauacaaguaugugucugcaugugcaugucucuuccugcuaauggauauuuugcuucaguccagaacuuguagaaaugaauauuuugaaguaaauaaauuuagacaguuaacuguauaguauguuagacuuuacuaaaccaagaaagucuuuuagaggugccuagacauacauuuguguguuuagcauuuuuguuuuauaauuuauguacaaauguaaaacuuuuugaugcaguaagaugcuguguuucuuuauugagccacguuuauucauauaauaacccaucaaacauuagagccuuguugaaucuacagucagaguaacagguaucgggaauuacagguuuucuuauuuagauuuuuccaaagaaaaaauuguucuuuucauggaguuuuucucuuuuuaaacauauuuuccuuuccccuuguguucucccuaaucucuuuccagggugugauugacuacauuuucuauuccaagacucauaugaacgugcuugguguccuggggccuuuagauccucaauggcugguugagaacaacaucacuggguguccacacccucacaucccuucagaccacuucucacuguuaacacaacuugaacuccacccuccacuccugccucuugucaaugguguucacuugccuaaucggagguaguggaguacagccccgcagagacggggaucugucgcuauggaccuguacaguuguaaaucaaaguauguaggagugaaguauggccaucuuuaacgcugcuucuucagguuccuuucacuauguguuugcuauaagacuguauauuuuugugcauacugauaucauuuggcacuagggcuggaaccaaaguauugcugucugucucuauccaaaaguuuaauacacuuuaaaauuggauuuauuuuccuauuauauuaggaaccaacauucacgauugauaaaucacuaauuugagaccccacaccauuguuguucucuaaaaacaaauacauucuuuugaauguuuucaaauaagccaaucauuuuuguaaaaggugauuuaaaaaaaaaaaaaaaacuccaaauacaagauuuucaauugaaugaugguaugccuuauaggaaaaacuuugaguuucuguuuucuuucauaacaagcugauuuuuggcucucaagucauuugcacauuaucaaagcacuuaaauuugcuugauuuguacauuaaauuugauauagccacuagcuauaacaagacaauucgggaaaugaaagacaauugcauaacaugcuuuaaaaucaagcauaguaugugacaguuuguuggccaaaugcugguuguuuuguuugaggaaucuuuucucuucucuucuuuuuuccuuuuccuuuucccuuucucuuuucucuuuuuucuuuucuugucugccuguuaguccuaaucucuuuagaaguauuaacuuuaagcccaucucucaaguucauuuauaaggaaauagcagauaauacugccauauaucuugaaaguaaaauuugguauuuuuaggaugcccacaaaauuagugucugguauuuuucauuuucgugcccaaacuuuuauuuucuguccgguuguacuggaaaaauaugaucuauaucuuuaccacuacaguuuaacacuuaaggaaaauugcugaaugaaaagccccuggucaguuucagaaagggcaagccagauaauauuauacguguuuuccaaaguaaguaaaauggcuguuuguuuguuguuuugguuuuuuuuguuucauuuuaagguaacaguagagaugauuuagaggaaaggacagauuuggggacauaauugaaaaccuuggaucacuuuuuucugacucuagcugccaaauggccaucauaugcuuuuaaucuucguugccauacugucuagauuugaauuaagcuacuguuuuauucccaaaguuugaugccucuauauguauugggaaacaccaccaccaccaccauuuauuguuggccaggaggugccacuugagaaucuuacguaagaggcagagagcauaaacaccauuuguggggagaaaauuaguuggcaaaauuagaaaauguuaauuauggcacaguaacauuggaaaagguugugucuguguuuuuaaguuuuucuuuauucugcuuuuuugcugcuauaagaguuuucugaaauuuauauuguaaacuuuucaugcacuuuacuguuucuaguaucaaaaugugauauuuuuaauaaacaagaaauuuuccauuaugugaugaaauuuaaaaagaaaauaaccuauauuugugucucacuaauauauaaaguacaagucaaauuuaaauuauuuaauuagcuuuaaauauauacaaauugucuccucuuccaaaccugaccucuuaggcuguuuuauuagucuuaaaugauacauuuccuguggucauuuuauacuaauuucuuccauaguuuacugaucaggcuauauaaaagaauauuucccgaaggguaauuuuagugggaugagggugguggggugauguaauaucacgcaggauugcauccagaagagcucuguaaagccuaaacucccuuuaaaaagugccuagugacagaggcguugucaucuauuguaauuggaaugucauuguaguucagcaaaguuugauguaaauaaaauauucuuuuaaaaauguuaaaguaccugaauaaacaaacaaaagaaacccuugaugacagauuuuccucaguguucagguaucccuucuuauauaccucaagcauccaacaucuagccaugaagauugauuaccugacgcauaguacuggaaaguagaauagcaugaaaaacuuaacuguguggacauuaccuuuuucuguaaucagcuacugucuguuuaguuuucuccuguuucgggugggcuuucuucucuggagguaugugcacuaacagaacauccuucuuuuuuucauagaugcauguuaacuagcaaugugagcaauauuuccuaccauacuucacucccaauauuuuugagauguuuguauaaaaugaaauuuaaaguucacuuaugauuguauaugaaccacagaggagcccauuuauuaauacaaaucuuuuuuaauaguuaaauguagagggggaaaauaaaaaaaugggaaacauuguaaacagcuuaaguuuauuuuguguaugaucgaggcacucuguugcaagaagguguguaauugggucucucugcuuccaaaugcacucuuucaaaccauucauuauccuguguauuuuaaugugguuuucguaaauguugguaguagcucuguugaaguaggugauuguguuuuguuuuggguggcacacaccuagggcaugguaucccaaauuucaugugcacgguuucccuuuagccucuugcccaaauuuaacacacuguuuccccucguucccuuuguaaaaggagugguaucuuguuuugagcugccaguucagaugaucagaaaugcugcuguccucagcauugucuuguuaaaugcaugccauuuggaacuuuggcagugagaagcccaaaggacaaggugaaugacgugauauauauucgauaaaagugaaauauauauacucauauacuuucuaguucucagaauaaguuaauaagcuuuaugccuuugggcugcugcauauuuuaucugauaagagaaaauuugggcauuuuuagauugugcuauguauuuuuuuaaauguucaauaugauuucugguaauugucuuaagaacuggaguguuaaguuuauuaaaaugguguuguuugaagaaggggaaacugcacuguuugccauuauaaaaguaauacaagugcaugucccgucacccacugucaggcaucaguauccucauagcuuuacacacucugauggggaauauugcagcauucucaggacugacaucuggaaaaggcucaaaucacuuacugcuccuugcuuguugacuuuguuuuacaauauugugccuggugucaacuuuuaagcaacagcacugccuaaaagcaagcagagaacagaaucccagcaccauucuauaggcaacuuuuuagaauucagauacaguaaaucuguucaagauuuaugauguuuuauguaaaaaaaauuuuguacuacauagcugaauauuuuuguuugauuuauuugauguaaggcgugugaacauucauuugaauaucacauguuaaagucagguauggcacaaugggcucugagaccagcuuccccccgcaccccccccccauuugccuuguucuaaucucuuucuuuucaaauugcauuucugguauucauaagcagauauuuaauuuuacuaauaagcauccugugugaauguacuuuaaaagccacuauguuuuaguguuaugguuuguagaauuaugaaacuuaccuucucccccuccuuuuuuugucuuaaagucauaaaucucugagaagggagaaaguuaaaauccaagacucauaucacuugaaucuguggcagauuauguuaaaauugaggguguggcaauuaaaccuagaacauggacaauauugugcuguuuaaaaauucugucuccugaguaugucuugucaauaggugaaauuuuaagucuguauuguacuuccaagaauuaguaaaacucgcaaauaccaccuguauacucaauagcgaauagcaaagggaaggggagcacacaggagugguaggucagguaugcgccuggaagggguuagagagcgccaucucuaacacaggcuacauuccccagugguaaaauuugauguuggcuuaauaccgauuuaaaauuucaucuuuuauauucuuguguuuuuugaaauauuuuaauaguuuugcaaaguauacuaacugguucguagcuucagucacagaaaacaaauuguauuucaguaaugguccuguagcaagcaagaauucuuuguuacauguucuaaguaacaaacauuuugacugaaaagugagcuguuguguuuguaagguuuucuucuucucuccacccauaaaacccaaaguaacaccuuucuaauguguuaaaaauuuguuuaccgacuuuuauuugguuuguauccuauuuguaugacuuuugcguauuagaaguagauagauuagguagagacauuagacuuauuuuucuaaaucaggaacuuaaacugaaguuuugaauuuguagacagaggacauuuaugcuuaugauuguucuggaagauuuuaauuucuguaaaugcaccaugauccccaaauuuaaaauucaaacacaaguaaaugauaguacaucuuuaaccugcuuauuuaccaaaguuuaagaauagggugccaagagcaucuuucauaauugucaccugaaugcuuaaaacgauaaaagaaaacccuuauguguucugagcaagagccacagaaagaaaacuaggaagggaagcagaagggugggagccugcucaggaagaggauacggaagagcauguaugcuuguucugaccaaaggcauucgugucgacgucucagguaaaaggccuggaggaagaagcagauuccaggggaaguuuuauuaacccaguaauuuuggcauaaguuugguuaacuugauuuauucuagauuugauuuacuuuuggauccaaaggacagacugaaaguacucuuuauuuaguaagauaagcuaauuuucaaaggauaugaauuaagggcgugccuauuaaauguugacuuuuauggugcagccuauaaaacagauagcacugaacugaaauuagaagugugccaucagaagccaugacgccuggagcgguggcaugaugcaccuuucaggaugacauguguuccugguuauuuucuucagcgggaucccugcauuuguuuguuuuccguuuaucugucccuuggaaaaucaugguagcaucccucuggaaggugacccuugcucacgauuucagaggacucacauauuuucuuagcuauuauuguucuguguaccacguuguuuaauuuguguguguaguuacuugaacucagacuauaggcucaauacuggugugccaaacaauggcucugcuucuuaugguacagacuuaguguccugcuuacuguuucaacuuuaaugcgguaaguguugcaguguguggguugcucuuuauucagaaacuacuguccuuucucugugcuuaacuugcuaaaaguaaauucccuuaccuguguaauuccugagcggugcucugcugaccuuugagagaggagggguuuggauggcuguuacuacacacuggaucuggaauuguucaguguugugaguggcagauuucuuaaacaccagcagcacugagaagugcacuacgggcauuuguaaaguuaguuguccaaaugcaagcaguacuuucauccaaaagaagcugagguguguuggguucaauaggaguacuuugaguaucucaaggaggacaaaugauuaacucuguuguaucugaagugggguagcccuuucuccaccccccuuguguuuuuguuuucuaaagauaaaauauacccuuuugcuuucuuugaaaaggccaggauguuugauuauauugaccagagauuaaaucguaucuaguuuucaacuauauaagugccaaguaauuguccauggacuuuuuaaccauuugauuagggaagagauuauuuauuuuuguuuccuggcauuaagaugauuaauuuauuguuuugcguacacuugagucauucuguggccuauauaguguuuuuguaacuaacuauacaaaaagcaaagcacaugacccuaagacuaagcaagauguuucaguaguucucuccgugaauacuugaucauuucuauuaauacuguucuaagcagauucuacuguuuuagguuguguauuuauuuuucccccuaagaaaaagccaagcacuaaaucaacuuguguucugauaaucacuuacaaucuuaagcuuuccuuucuucuuuucuuaggugauuuaaugaagugccauguaauuguagcuuacuaauuaauguuugauagacugguucugugauauucuaaacauuuaacucuuucuugucaucucuggagaagaugguucuauucucauucucucugauaaaaucaccagcugcuuuauuuuucuauuuauuacacaguugauaaggucuggaucuugaccgaacugcucagcugagauguuuucauaguggacacuauagaaaaugugugugcaaaacgacacaguuggguggugguauucuuuuucauuaaugugaacauugacuaaacaaagcaguccugccuuuuaaaucuuguggcagcucagaagggaggugcuuaagaaccuuaacuauuaugucagaugacaaauacuuuuuuuccauuuuggagauuggguacugcucacacaugauguauagggcuaaauauaugcuuguuuccuugcaccuguguacucuuccccuucucucccacuuuuccuuucccuguaggcaauaaauggccauuuugcaaccgcac

SEQ ID NO: 2544 - RNA, 1357 nt, Mus musculus
uggaaaagagcuaacagagaucccacugauggcuacuaaccaacucugcaagaggcuguggguuucacccuacacaagaaacuaccaaauugacuuccggcguggggcuuaagccagguauguuugcucagauggaaaagauacuacaauacaagaggaaucauauuucuuccuggccauauggaagcacugaguggaaaaugcauaauuaagcuuucuucuucacugccugcucuucacaggagguuauaaauaagcccuagaaagccgagugcugcuguucuagaggaagcaagugauugucucaucaguuagcuugaagagaaggucauaccagaaauaaucguuuugagaaauaacuuggcuuucuggcuaugaucucacccugccuuggauuauuuuugcuuauuuccccuuucauuacaaauuguacuguuuauuuuauucugugcauauguacucggaguaaaauuaggucaauuuaauuuucuccuccaguuuguuuccaaaaugaugaguuuuucuuuucuucuuuuguuuguugagaccgggucuuucaauguaguccugcugucuuagaacaagcuauguuaaguaggcuggccucgaacucacagagauccaccugccaaguacugggucuaaaggcaugacccaccauggccagcaaugguaguuuucuuaaaucaaacacaugccaaaauguuuuuguuuguauuauauugguccauuuuaaauuuaagcgauccacauggggguucuuaaccaagggcacccuaccuuguagggacucuugcuuuagccacugagaacccaucagaaaccagguucuauugcgagugcuugggauagaaagaugaccacaugaugguauaaaaguccuuauagcuuacagcaacaacaucaguguuuaauaucugauaccauagagaagugauguacuaaauagaccuaagaccuuaucguuacagguggccgucaaagucacauuccaccucgugcccucuuuucucauggaccaggaaaaugucagaggaagcaccucagacuacagaggggacacaagcugcuggggucaauccaauuagguugcugcuguucaaggacauuuacucuccagagcagcaugcacacucucaggcucucuggcugugcaugcuggcucccagaucacuugguuuuguuugcuuuuaauuacucaccugcuaagaucgccaguuugcuuguuuuuuguuucucuuuauggggauuaaaaauggauuuuccugguuuuguauguguuuuaaaauaauaacaagaagaauuauuucaaguaguuaugagaauagaauuacauaaaugcaauuaaaaggagcua

SEQ ID NO: 2545 - RNA, 6823 nt, Mus musculus
aguuuccaaaauagcauuuauuuuuuaguuuugucaauuuuguugaaccuacugauagcaacaaaacacaugucugcaggcauaacgaugguauaguugauaaucccgacagccaacaccacuucuggcugcucacuccacacugcuuauugggaaagaaucucauccuuaaaaagacaggaaagaaaacuccaaguucuggacaauuuucagucccugugucccaccauuaaauauuauauuuacaucagcuucaaugcaacauaauacuguuuauuugaguccugaugaaauaguucagauauuauguaaaugggggggacucagagacaauggcugcuaaaggaacaaagacaguggaccaccaccaggcauuggauaaugaaguuagcagucccuagaaagaaacuacacauauauuuucaaagaaggaagcaagaaguaacaugagucaauauuucuuuuaggccuuucuuuguuuuucucuuugacuugaagaaaaagaaugugucacaugcuguuaccuuuguaaaguuguuacauggcaacuuccacuaccauaugagagcaagucaguguggcccaacagucgccaugaaaagacauuguuuaaauguacagcaauuaugauucagacccccaggauuuuggcccacagauagaauguauaguagcugugauauuuuuagagagaaaauugguagauauucugcuaauacaguuacuucauuuacccacagauaaugagccuaucguggcugaagacuccuacaacgguguagaaaacacucucacccuuaaagaggcaggaaaggaagcacauuagcaggugacuauaaaauuuuaaaaguaaaaacaauuugcgauugaggucaugucaaaacacuauucccacggcucccugaauuauucagaaauauaaugaaauuucagaaaacaucagaugcugcagguacacgaagauaauuuuguuuuuauaaccaauuucgggcagauaaauacuagaauccuuuccaauuucuccccuaugaaacugaggugucaccaagauuuacagccuccucaaguucccucuucacagggacauucauuuacauaaacagauaauccuagauaaaaauuuccauuagacaaaggugaaauggaucaauuuucucugccaagacaaaucuuaaaucuugaacagauagggucauuauuacaccagcccuauuucagaaauaauguauuuuuuuaaaaaaucggccgauagcagccauuuccagcuuuccaauuaucuuuaagaaaagcuuauucugugcacaauaaagcacauuacugcacaauaugauacaguccauaaagaucacaauguuuuaugaaagguuaaggaaagcucagcacauuuaggggaaugucauaacccgaaaagucuuucaagacuuaggugaagcugagggcgcguugugcacgcagagcugggugaggcaccuuaggcaaaggagaagcgggugccaggauggucacguugugaacccuggauuccuacagagagaaugggguagagaaucaaaagaaauagcucuccaauugaugagcacacccaaauccaccuuccugagaacucgugcuggcaggaaggcaacucuauugucuuggcacccaguggucugcuucuuccuuugcuuaucaagcaacuucuccacaugcauuuuugcaaauauuaauaagacuauggagagcugaggaaggucucaguuuuccuucaugcucuguaaaaggcuccagucaugcuuaagugacuaagaaggcguguagccaaugauacucuuguaauguugugaaagaagugaaaauccuugaaccuaugaaauaaaaaauaagagcaugggagaucuauaucuuaugucauaauaaccaaucacugcucaagacagcuucugggaccgacacuucuucaucagguucagagaguaagaguucuuccucuaucguuuugaaagaaugcaccgaguuauaauugagauaaagaaacauuuaauccaucucucguuauccaggguuggcugagauacuuaaucaccaacucuaccacuuuauccaggguugccugagauacucacccaccacccgucaugguccaggagggggaaaugucugcaucuucuagaagcuuugaaagagggaguaauguuaaaggauaaucuauccauaaauauuaguuuaaaaauaaaauacauuucaaaacaaucuuuuaaaucaaguaacuaaaagcagauugccuacccuuggcauaucugaguccaguuagauacuuaaguuuaaauuuuaaaucuuuauuugcugaaaauuuacagucgagugaaauacucuaauuggauagaucaucugggagaagccagagguggaccacagaaacaguuacucuguuccacauuucccaaaugcaaguuucuuauauagugaaccagaauaaggauggaggaaguugacacucacuggucauugagaugauauauauucacauuguuuaaaugaacgagauuuagauuacuugcucaugagguucuggggcuauaccaauuagaccacacagaggcaaaucuuaucugggcuggacgucuucacauuucaguaaagacagaaaacuuaucucagcuucccuucuaaagcugcccauccuuggcaggcuuugaguauagccauccaggcugggaguguguggccaguaacaucaacagaaguagaaguccaagggcagcgaggucuuguuuaugaagcucuuccaugcuaggguccucucugcacaagccuagaaaauaagaaagucaagaggacauucaggaaaaauuucuuaauaguguacauuuaucugguuaugagaaaaauacuuaauaaggacagaaaauaagucuucaauugugugauaagaagggaaaaugguuauuacaugcuuaaacuuaacacagcagacacuuugaaauuuugauaaguaacuacagugagaaaugagucaagaguagggauugcuggagauaaacucugagcaaaacggggagagaaaggugcauaccaggaagauagaugacaaaggaggaggugaggccagaggaagggcaggaagcuguaauguacacaaagugacuuucaguucuuuuacuuaaauucacaacacacucaccaaauguuugaugcaaacaagcacuuaguggguaugcagaaaucaggggagcaggacauuaaauugaagggauacagagauucugccuacaaagacuggaacagaaugucaguauacuguuagugacaucaacagaagucuucaugguguguagaaguccaaggguaggaaggucaggccugguggcaaccugaccugucaaaguaagacauguguugagugucuauauaugacuucuaacuuacuuuugguuuuuucagaggaucucaauaagaagucaagaagcaaacugugguauugucuuacaagcacacuuuucugagugaaguacaccuuaaaugucauuuuaacuuuuuaugugcacguaaauagcuauuauuucuguugcuggaauauuaguuauaacaucuaaugaugugaagauugucgccuuauaaaacucacagcuggguagcuacauggcucaaggcaaaagcuuauuucaaaacccauugcuuuaggaggcaaauguuuauuaaaacauauaucuauuaaaaauauaugaugcaucauugagcauucucuguguugcugugccaaccagcauuuccagcaaggcuuuuugaguugauaccugaaaaccuggcaagguccaugggccaucaaaaaauaaauaaaucccaacgaccagaaaguaagucacaauaggugccugcacaacagcccauaaacuuguguuuauaugggcuggggggcgggggggcugccgcugccaaauuauuuccagccuugugggguaguggcuguucaaaaggaagaacugcuugaucuccuuguaacagaaguucuaugaauuaauaauaaagauacaguagguguggcugguagcuguaaaauaugucugugaagaugggagagaaaggagagacuagcaacugaacucauaaggacuugaguaaacguguacugacccucgaaaauaagcuguaauuccccuuuggagggucucaugguguugcuuaagguaugggugauaauauauuuuuguuugguguuaaaugccuucaaucccaggauucagaucuugcacuuuaggucagccuaaauaaaugauaaauaaauaaauaaauaaauaaacuaacaaacuacuuagcuuggcauguuaauguccacuaugccuaaccugaggcaggaggauugaggguuugaggcuaaccuggauguggugauuuaaaugggaacaaccuucaccggcuuauauguuagaauacuugaucaccaguuguacuggcugcuuuuguguaucaacuugacacaagcuggaguuaucacagagaaaggagccucccuugagaaaaugccuccaugagauccagcuguaaggcauuuccccaauuagugaucaagggugggggggcccagcccauuguggguggugccaucccuaggcugauagucucggguucaauaauuaaagcaagcugagcaagccagggaaagcaagccaguaaguaacaucccuccauggccucugcaucagcuccugcuucuugaccuguuugaguuccaguccugacuuucuuuggugaugaacagcaauguggaaguguaagcugaauaaacucuucucucucuccaacuugcuucuuggucaugauguuggugcaggaauagagucccugacuaagacaccaguuaauggaauuguuuaggaagaacuaggagggcuuaaaugaaagagaugauucacugcagagggugggggcagcaacauugagaguucaagagcucauguccuucccaagagcucucugccuccuccuuguggaucagccacugcuccagugccauggcugccugccugcugccaugcucccugccacgauggucacagacucauccucugaaacuguaaaccagcacaaauaaacuuucuucaauaaguugccuugguuauggugucuucacagcaauagcaaaauaacuaagacacugggaaacacagcaagacuuggucucaagaaaacaaaggauguuuucaagauuguuuaaccuauagauuuucaauaaucucaaauaaauugcugacaaagauauauauuuagucuagacccagaaguuucauagacauaugacauacggaaucaaaaucuuuuuaauuguguuuauuuuuccuucuaccauccaacuucacacaauuaucuuaacacuauuuuaaucaggcaaagcaaagaaaggcagagauacaaauguuuaaagaagguggaugcaacuagacauguggaaaugcuuuuucagcaugguuaaaauuugagguuuaaaauaaggcuuauucuauaccuuggaguucauuucucuuugcugucacaggaauauagaagcaauguaaagagugucucuagaagaauaguccagagccuuucaauuuaacuaugcacucauuuguuuguuuagcauguguacgugugugugugugugugugugugugagugugugugugugugugcacauuuacaggugcacaugcagaggccagagaaggcugucagguuuccuacucuaccaucauuuuuaccuuacuuccuugaaacagggaucucucguuaacccuagaacuagauugguggucagugauccccaauaauucuccugucuccacuccucacugugaugagauuguauaucuacauagucauguccagcuucuuuuccaagggugcuaggguuagaacucaagaccccauguuuaucuagcaagcacauuuuuuaaauuuacuugauuauuuuguauguaaugguguuuccugcaugcauguauguauacuguguguguugcauaauuuggggguaaauauaaaauaacaugcuuucucuggagcuuuaucaagcaaccuuaauguucccugucucuuuccuccuccucccacuguauugcccuuccucccugcucccuaguuggagccccuuccuucucauucugucucucaccucuuagcaccuguacccugcucuucuaaaaucuuauagaaauuucagagggaacguccaucuccuuacuuuuucuggauucucgaggcuuuccacugcccuagcuuauggcuccauccucccacuucaaagucaccaguguggcaucuucaaacauuucucuucauuuugaugauuuccuuacuccaaaucuccagcuucccucgaacagcaacucuggucaguauacuuggcccacuggcaaauucaggguaaccucccuucucagcuuccuugacguuaucacuaucugacaaguaucucuugucuuauguugaacuucuucaaagccuuaagcauggauguguuggggagguccauuuucaaucugcuuuuaaaagcuauucaguuuuccacagaaaugagauauaauuauccaaaaucuauagaacgaauucugaaguucugguuacaacccaccucauugaugcugguccgggaucucucuguggaguugcaacugaauaaucacucacuacugugcaauaaggcuuacccaucugacggccugaguucuuuuaacucagcugagcaccuuacaccuucagugaauccauguguaagggaauccucuccucaguuucaguggugacaaguucagaucacagccugcuuugcagaaggacaaaaacaaaacacccuugugaccaugagcac

SEQ ID NO: 2546 - RNA, 1267 nt, Mus musculus
uccuggaugcuuuuuuuuuuuugguuuugguuuuagguauuuuuauuucuucaauuuuuuauuaucaggagugacugaaauaaaaaauauaauugagucccaucaucauugucauuauggaaauggcuuuaagagaaaacgggucagaugaauauuauugcuucucacuuuucaacugguaaauaguugccacugauaaaacagacaagcccagagagucuguccagaauguucaagauaugguauaucauacaacaugcccguucucggggagaacaccuaggacuuaauuaugugaacuucuugaucucaucguacaagacaagcacaaaggcgccacccaugccucugagaacguuggaccgugcgcccuugaaaaaagccuugcucccuucaucgcgcgcgaucuuccgccagcagucaagcgugccuguguacaugauaucaguuccuuugcguccagacugcaucaucauacgacggcgaaccgugucaaaaggauaggaagucuggccaacgacagcagugacagacugugcaaucauccagcugaugaagaugugaguauucuugggaucugggagcauucccuuugcagugucauagauaccaaaguaggcagcucuguagaugauaaugcccuguacugacacauuaaagccuugguacaggcccuuaauuccaucagauuuguagaucuuaaccaggcagucaccaaggccuuugaauucccuuucagcuccagcuuugcccacaucagcugcuagacggguacgggcaaaaucaagagggugcacaaagcacaaagauguagcuccagcggcaccaccugaugccagguuccuugcaaaguagcgccagaacuggguccucuuguccacaccacccagaaagaucugcuuguauuuaucuuugaaggaaaaguugagagccuggguggggaaguaucugaugacauuggccagguucccacgccagaaggacaggacucccuguuccuuggggauacgaaccacgcagucuuugaugcccuuguaaugcuuaucugccgugauuugcuugcuggcaugcugcaccugcagcagcagcuugacccucucgaugggugcuaccgcugucuuggagauggcuguggccacuccaccggccaagaaguccuuggcaaaggacacagcggcaucugucauguugaaagcaaaaaaagaagaggcaggugagugcgggacaggacuggguugacaaccggcuuugacucccgggcucuuuc

SEQ ID NO: 2547 - RNA, 4882 nt, Mus musculus
uuggcauucauacacaaaacaguuaagucaacuaccaaagcaacaagaccaugcagaauggagaugauaaagaaugacaucuaugaggguuggcaagcaguuuuacccaggaaaccacaagccagguacuguuguggauugcccugguguuguuugaauuuugauguuuauuuugcuuccccaagagggguugucugggcugaggagugaaugauguacucaggugaccucaugugaaccuuucccccauuuuaacuuguaaaauaaaggcuaaagucggugguugggcaguggaagggaagguggagcuaaaaaguuugagggagaggaggagagagaggaagacuaaagagaaauagguggaacgaaaauggagcagaagcacauggccuagagaaaccacacauuauaagggaucuuguagcuggggaauacagcaguguagugggagaucugccaaucuaggugugcagcuuguauucauauugacuucuggauuccuuacaugggcuuauuuggguuggagauuuacugcaacuauguacuugggagcuuaacauacuguaaacuccaaagcuuuaagauuaaucucuguguugguuuucauuucccugguucauucucucaccuuucuauuucauaggguaagugaggauagucggcuccccagcacacaccagggggccauggaauacaucacauguguagacuuucuaaauggauggccuguacuuagcauuaaugugggauaaauccauuuuuguuguuuuucucuugaguccuuucuaaguuagagauucuuacuuauucaucccacagucacccuagugccaccuuccccaaugucaauguauugaaaucuacucauaauugcugcucuucuauaccugcugcauuaacuuuucuuugagaaacucuucuuaccaaaugucuaucaaccuuccaaugaggauauucaggacuucaggaugaguucuuugaaauaauaauaauaaaaaaaacuauaaugaucuuccuuuauagacaguucucaaauagauuacacccauuucauucucaaagcaaaguaguagaauuauuauguagagcuguaacauucauaggagaagacacauauccuuagaacacugaagugaucuguccaagauugucauuaacaagucauaagaauguaagucaagugugugcuuaccaugcccacguaauucauuaaugccacuucaucccugaucaucacauucccuucauugucccaggucacucccacacaucuucauaucuaucaaacaauaccaucacugacuucuguacccaguauauuacuguccaguggcacauagaacagucagauaccgauauggaaauaaucuggcaauaaugaaacaguuuauggugccccuacaaguuauaagucaaccaucacuuccuuuaccuuauuaaaucauucauuaguaccuagauuguuuaaguucucuaucuugaacuugaaaaguagcuguaaauuauaaauucacauuaaacacauaauggauugccacaauucuuauaccagucagcaaucugccaugaaaccaccccauguaauuuaaacugaggaaauuuaauacauagacagugaaugauacaacaggcaugaggccaacacgggaugguaaaacaaccaaaagauuagcaacaguaguacuugccgauaggagccuaacaugacuguucucugagaggcccuaccaaacagcugacugagacaaaugcagaaagauaacuuauagccaaucacuggauugagauugaggacccuauggaagaguuaggggaaggacugaagggccucaaggagauggcaaccuacaggaagaucaacaguuucaacuaaccuggucuaaacccuuggagcucccagagacugagccaccagcccaagagcacacaugagcugauccugaggccccuagaacauauguagcagagggcuaucuugccuggccucagugagagaggaugcaccuaauccuauaaagacuugaugccucuggguugggggauacaagaugggagggggaguuugcacucucuuagagguaagggagagagggggcaaaaauuauguaaggggggacgaaggggacaacauuugggauguaaauaaaauaauaauaauaauaauaauaauaauaauaauaauaauaauaauagaaauuacucuuacuucuaagacagggugaaaaaguuaaguuucuguuagucaaagacuuaaacacugucuagcugggagcuaaaaccaacuacccuugugagcugucaccaaagauggcuuccucuugcccuuuucuccuacucuccugaccacucugcaagccacagaucaaaucuaccuagagucagcuagccaugaaaucugaggaacaucuugcagguauacagugggaaaugcauauuagugaaacagacuacucaccuccgaaggccugaaagagaaguuuagaacuguaaugugauugcuuaauucaugagauuuauuucugggucagauaaugaaaugaucugcaaaccucugagaagcccagacauuaaagcauuugcuagauaaugcagcugguuagagaaaaugacacgaaguauacaauauuaaaaguaguguggcauaaauaucuucacauuuucucauuaaauacuuuaaguaagaaaacuugguaguauuccauaaaaauauguacuauaaucgugcaauuuauuuguacccaauacaggaagauugcuuauucugucucaaauuaugggugccucugaugacauauccauacuauacgcauccacucaagacauauuaggcaguauguaguuugcaaaucccuggaagaaaaaaauuauuuucaugugacagggaaaguccucagaaagugaaggaaaaaaaugagaauuagauacacagauaaccagguuaugagugauguaaguccaaucuuaaggucugccaaggaccagccucugcuuggagaaggguucugaaagaagagguguuuaagagcagcaaaacaaggaagugaaauuauggguccaagcuggcagcauagguuuugcucaggacagcuuucuagauugcucacucuguguucugcuagagacaguucuccaagcaguucucucuggccauucuaaauauucucuggauagcucauuucuugcagagcaaaagccuaggcuuuuuaaaaaauuugcauaucaauagucauuauugcagguuccccuucggccauccuugaaucagcaucccaugaucccagcccugauucuuaggagauaacaagcacuuuuuuuuuuuaaccuuguaaaagaauucagagaucugcuugccucuguaaaguacaggugauaaacuaguugggugggacccugcccugaaauuaccauuuauaccuaaccuugcucucuucuaggccaacccugaccucaagaaucugccugcccuuguaagcauaaacaaaaaaaccuagcugaccgggaucuccugccaucaccacucccuaaaaucucugucuccaaugucggcucauaacacagcugucucugucccuuuacauuugugaggcuccuuauacaauucauacugcauucuuauauuuuacauaguugaaaaguucuagauuuuugaacucauguuuuuagaguucuuuuccacagccugaagggcuguccuaaaggucccagcauuggccauuuugcugagacauuagccacaccuccaugucccagauuugugagguuucuaauuaucauggagucauuaacguuaacaggguggacauuuguugaaggagaaacaugaaaauauguacauuauuauacaaauaagccuuaagcccauagaagcuaucgauauucauggagguccaugccugcuguucuaggggugggaaccacauccuuccaccccucccaaggccaugccuaagcucacaucaucgguguccaacuggagucuauagcacuggccugccuguguuucucaucuguuccccaccucccuuugcaggggaauggucaucgacacagugcugaguccuuugaccugacacuggcuucauauccuaaaaggaguguagauaagugaaacccacacacagcuacuucugccuauaauccuucgaaguacaaccagauuugcucaucugauacuggugcccauuauacaucagaagaaacaaaggcuuccucagagccguccuggauauugguacagagauucgggaacaggggaauagaaaggaggagguaaggagcugauuaacugaaacuaaggacugugaaaaacccuuaugggaacucacccauuacucggcaaugggguguugcccugaguuacaggguagggaggucacagagguugcugaaacaacaaaagcuguugccacugcuccugguaacccaccauaacucuaugacaagggccuaaugauguagacaccacaugcuuuggguguaggacauagagaaaucaacuucaaacugaggaggaaacuuccucucugcuagcugagcgucauagugccagaggggcgaugugguagcauccguggucuuccccaauguugggcccugaauggugccauacagaccagccaggcaagaucuauccaauaguggcaugcaauggucacauggcuaauauggaguaaccaaccauuuucugacugaguuuuaggccugcuccauaggagggaaaucaugucugcuaaaccucuuuaaaaguccaugguugagguugucaaaagugguaccuuagaacuuagcauuguuguucugcuaaauagucauguuuucaaacugcucucuaaauauguauguuuacagacauagauauggauguucucaacguuggccaaaa

SEQ ID NO: 2548 - RNA, 2869 nt, Mus musculus
guuggcaucuuuaaagcaugacagauugaucggcuuuauuuuuaaaguaggagcuauguaaaaaagccggcaagugcaaagaaaauaugucugguagcggaaacgcucugccgagguucguagcagaaaaggcaauaacaacucucuucucguccuggguaucugucuccagugauggaggauucaggcauccagagaggcaucugggauggagaugccaaggcuguccaacagugucugacagacauuuuuaccaguguauauacaaccugcgacaucccagagaacgccauauucggucccuguguacugagccauacuucccuguaugacagcauagccuucguagcccucaaguccacggacaagagaacaguaccuuacaucuuccgggugagucucagcaagugugauggaggugucugaggguaauuuccuguugggagugaggaaggagacauccuaaggacaauguaaucaucugagcagucagagcagagcgaacacaacaaaaauuagaaaagaaaaacuagauucaaaucaucaagugauuuuacugagaaaaagaaaaagacaaugccaagguugccugaaucgguacucuaguucuggguucccuagauuagggcuuccuaaauugcuaaggagaccuuguuaguacuggggcuauuuacauauuaaguaguccuugagagaacuuuuacaaguauugaguauauuuauuuuguaaccugggaggucuccccaucgccugauuauugcuuucuuuaguuaacauuagcuaguguucagaguuuguauuuaaauuaaaacguuaauuguuuuggcagcaaagcaucuauaauccacguuuguguuuguaacaggccucuuucuuccuaguaguucuuuuuuuauuaauuauuuuauuuauuuacaugcuaaauguuacucccaguuuccccaccccagaguuccuagucuuucaucaugaaguaaagcuguuaguccuucaugucaguuaggaagaugggcgugagugccauagaauaauuacuaagacccgaacuugccuuuuacuucugaaacacgggaaauuuccucuccuuuugucaugugagguaacugaaagggagauucuaaagaggcuacucuguaagacugacccaauauugcaaaggauggccacugugcccauugaccacaaaugcagggaugcaguucgacuuuggucaacuuuugcaaacuugguuucagauaauuguuuggaaagaacaaaagccagacagaugaaauaucucugguuucucugguugccgucuuucacguggaucccucucuucuugucuuucuuaaauacuguagguagacacuucggcggcaaaugguuccucagaaggucucauguggcugcggcugguccaaucagcccgagauaaggaagaacagaaucucgaagcuuauauaaaaaauggacagcuguucuaccgcucucuccgcaggauugccaaagaugaagaguuacuaguuugguacgggaaagaacugacugaauugcucuugcucugcccgucuagagcucacaaaaugaacgguagguuggcucgggugccugggcucaccuugcacaucauaggguggacgaagcuucugagguguugucccgaauggaacuaggacagaaggggaaggaaaaguuggggagcguuugacuuaguaaaugcacaaaucaagaaaguaaguugcaccaaauaggauaguguauucauuuuuuugggcacucagcccagaaagauaaaguggauuuguuauggggaggauggcuaaguggccuaggggcgaugcuaacuaaccaugugggguguguguguguguguguguguguguguguguguguguguguguguguguguuugcucacuaagcagggucgucuccuuacacaugccuggaaugcagccaacguuuccaguuugaguuccccuauguggcacaucugcgauuccgcugccccaagagacuucacagcacugaugcgaauccccaagacgagcaagggggcggcuugggcacuaaggaccacggcggcggcggcggugguaaagagcaacagcagcagcaacagcagcagcaacaggaggcgccguugaucccgggccccaaguucugcaaagccggccccauacaccacuaccccgcgucauccccggaggcgagcaacccgccgggcuccgcgggugccggcagcgccaagccguccacggacuuccacaacuuggcucgggaacuggaaaacucccggggaagcagcaguugcguagcggccccgggcgucggcaguggcggcagcggccaccaggaggcggagcugagucccgacggcgucgccaccggcggcugcaaaggcaagaggcgguucccagaggaggcggcggcggagggcggcggcgcggggcuggcgggcggccgugcgcgcuucuccgagaggccgcuggcgaccuccaaggaggaguuggugugcacgccgcagcaguaccgcgccgccggcagcuacuucggccuggaggagaacggccggcucuucgcgccgcccagcccggagacuggcgaggcgaagcgcagcgccuucguggaggugaagaaggcgggccgcgcggugggcuugcaggaggaggcggcggcgacagacggcgcagggggcacggccgaggaccccgacgcgggaggcggugucgccggcggcggcagcaacggcucguccacccccgcggcggggucgccuggggcccccgagaaguugcuggcuccgcgucccggaggcucucugcccggacggcuggagggcgggagccccgcgcgcggcagcgccuucaccucggugucgcagcug

SEQ ID NO: 2549 - RNA, 1235 nt, Mus musculus
caacacagacuuaccauuuuguaaccuuagaggucagagucuuaguaaaggcuguguuuguucagaguuuggggauaaacucuugccuuuuccagcucccagauaguguuuacuaauucaacucauggccugugucccuccaaccucugucucuguggucacaucuccuucccugaccucggcucucccccguaucuuauggagaccauuugccuuuggccacgugaacaauccuguaccaucuuuucaccucgagauccacaauuuaauccugucuggaaagaaagcuguuugcucucccaggcuuuggacaagccauuguuccauuuaccacugucaccauuuagggaagucacacacuuauuguaauacucuucucucguuggugucuugcuguguccuccagagccccauugucagacauucaauuuaaaaagguacagauuuaugaucucuuuguaugucuauacagccuugcuguuccuauuauuuaguuuauuuauuuuccuuguauuucuucugugacacuggaagacuuuuugcauuauaugugcauaguugauauccaggcacgugguaaaggguuccucuuuacaaaauauuagagcaugaugugguggguacuuaggacauauaaguuagccucagcuacacaggaguucaaggcuagccugaacuauuuucaaagugcaauaauuauuuuuauugaguugacugugcuuggaaaaccuaccacgccagauaaaucugguuuuagaaaccguagcaaguuggcuuucuauaaaauccaccaauaaagcaggcagacgugcuugcagugugcugcuaacauauaugaacccccuuuccugcccugcccuuccugccuuucagcuccuuacugucagacuccuacccugcaggcauggagggagggaaggauaaugaagccuuggacagucagcccaggaaucccagacaacagaacucuuuacaguuucaugaagcaucgaacaagugcugugguccacacugucagaagcuccgcauuaaaguguaaugauggcugcagaggcggaguggccaggaagagcaggaaggccgcgagugaagggaaaggaaaacauaucaacugagacugggaagagagagucagaaggagccccacuggacuugccuggguugcaguaaacaccuugggcugucucuaugaagauaaagcugucaauuaaaacuaacuguaaauucuguuaaaa

SEQ ID NO: 2550 - RNA, 23105 nt, Mus musculus
augcaugagugcuggaaaguuuaauuguuaagacaaagcacuacauuauaaacauaagugaucuuucagaaaauaaaauuuagugcaaaucaaaaccccaagaaagcacacuguaagcuucauuugaagaaucuauaaggaagcuucuacaauggaaacaguccaguggaauuugccuagaaagaauaaauccuggaaauguuaaaacgguacagagagcaucuuauaauuuaaaaugaggucaaccuaaaaaagacaugcugauaggucuuaauacauaaaacugauuggcaauagcaugcuauauagagcaaugauuguagaagcaauuuacaacgaauuaguuucaagcuuuauuuacucucuuaguugaaucucuacuguaauccucaaaggccauuuuccacauuuaauaaggauuccacuucagucucacagcuguuuuauaaaaaugauuacgcucauuaaaccacacccauucacucaacaacaaaaacggcaauuauuucauuccuuuucucaaguauuuauucaaagcaguuuccaugacauguuaaaugccacauucagguauuagcauuaacagaucuuuugaaguuucuuucaguguuuuuucuuucuuuaaaaaaaaaaaaauuaaaaagcagagguaaccuugccuucaaauucuagagugcaacagaauacaaccaaucaaauuacaaacauauacaaaugaacuuagaaguguugccacauccguuuccaccuuuaucagugaaguuaaugagugucgacugaucuguauauuuaaaaauuccucccacugcaagucuacaauaacaaauuuggacuguucuaacacccucaccuuccacagaaucuaauucugaaacauuguuaggcauucuuucuuaagcugggggauaaacccaggguuucccacugaacuuggaaguaucauuuuucaccuuccuaaccgauauacuccccucuuuaccuaaggcuguuuacaauaaagccacaaccagacauccuuucgacuuuaaggugcucaagucaacaggguaaaugcaugagaccaacucaagacuucaguagcaagacaacuugagucagccaguuaguccgcaaugcaaugacuccgguaacugaugagagguguguacagaagugugugcugccuccguaacuuacagccacggucagugagcccagccacggcugccugcugcucuuuacugccgucaucgcgauacucacuagaaugcucaccaucuuccacacuguagccaucaccacggcuaagacuugggaguuuaugugaacuagagaaucccaggcaacaacgcuguacaacugaugcaguuauagauggucuacaggccucuuccaaguacauuagaauuaaccuccuuccaacugauaacugagagcaaauuauaacagcaaauugaauuugcacaacaggguauugaacuggcuagaaucuuuuugcccaaggaaauucagacaagacuucucaacuauuaacuuuaauguggccagcauugauuauaggauuccauuuucagccuugccaaauuuugguuaaaaaagaacaaguucuaggacagccuacagagaaacccugucuuggggggggggggaggacccacaaacaaaacaaacaaaaagccuucauuaucacuguuaagcauggaucuaguuugacaauguagguaaaacaaccccaaaucaaaaaaagcauacauuuauagagcaacacgaacacugugcccagauaguggguucagucuuucuggcugucaagaauccuaacaccucaacauccuaaacagagcacucaaaguggaagguagucuaaggaaaaugcuccaagaauaaaagcacaccaacaaguuucuaaugugcugaauguaaauccugguaacaggaacuuauucgggacgaacugaugucaaaucagcacacugaauucugacuugggaacagcaauugucauauaaugaagcaauugccaucccagugcacaaagaauggacugaaaagccagacuuuuuaauacauauuaaguuuagggaaagauuuuaaaagaaaacagaaccccaggaaaugacucaccugguaguauauaucuaguaaacaagauacagaaagcucauugcuugaggacuggcaauacuagcaggucuacccacaaguaaucaaagcuaccuaacagcccaccaaauguuucuauucugaaguacaauucuaaaaggaugagcugucauuaccugauuuuccacaaacuucucucucucucucucucucucucucucucucucucucucucucucucucucucucacacacacacacacacacacacacacacacacacacacacaccuaccugccauuacucuucugaaauucuaaguaccagggcuuguuaaaugugggguggauuaagagaaaguaagcuuuacaaguuuaugagcaaauguuaagaaaccuguauauuuguuagcauggagggggucucaaaacaccccuacaaaggcccuaauggcuuaaguguuagcccaaguacugguagacauauggguaaugaagaaaggccagguuucaagucugauuaagaccacuagaucuuccagcccauucuagugucucugaagcaaacugugauggcucucucuggacacagccaucugccuucuucccuuugagaugagaacacuguaagccagauucacccuucaggcagggugggaaacuccaguaacccucaccagacaauaaaaauaucuaucuagagguucauucuaaaguguuccacuccucaguggaagcaaagaucacuuagcauccacuaaaaacuuugagcaggaagaaguccaagcaacaggauguaagguaagauggccuugcauguguuuguucuaagcuggguucuugccaacacccaggucagccuugaaaugagcucaagaauccacuucagccuucccaggguugaagaguacggaauuacacuaucaguaaaagccuuaggaaggaaaaaagaugaagggcauacuuaagauugauuagaauaguuggggaagagggugaaaaauucuaagaugaauucuguuuuuaauuuaaauuguagaaaccagaacuagggaaguuuuuguccagggcucaacaaagaaccaaaacaacaaaaaacaaaccaaaaccauaaaaacccacugcaggaagaaguucauaauucccucacauuuugcagaacugcuuagacuggacaguuuagugucaagguaaaaacccuauuugaaagacgucauguaagaccuagauucaaaugaacaaacucccucagcaaaccccuguccagccuaaccaggguuaccuaccccuauggugcugagaggacacggaggucucacuggccugggaagacuugugccaaacaagcaggaugauuuaggaaacaaaggaccuaauucagagacaaagggauuccuggaaagacaacuagcucagccuggacaaugcauaaucaagaacaaagcugacaagauuuaugcaaauggcaaaaguucaagaaauaagucagugaguggccagaaagauaucuaggucaacagauaauuaacucagguaggcgugaggauaaguuuuuaaaugugacuuaauggaaacaaaguuaacauuaaaaaccaaguuauuuaucuacuauucuuugugaaaauguuuaaucacacugugaugacuuccaaucaggaaguugaaucugagugcagugacuuucuacauuccaccagcacagcuguuuacagacauuuggccuauuauauaggaucaagaccaaucugauagcagcucaugaacuaggcucaaacugccccaagcaaguuuuuggugugguauuuauggaaaacaggcauaaugaaguaugcuagcuaauacuaauguauucaauugacagagugauuuauuuagacacuuucuaugauaggccagguaaucauagaucugaggcuuucccaguuuaaguacacaaaccugccacuguaauacaaaggcagggauauguaaacaaaugugcauacuuuuguauuauaauguuuuuaaaaaugggcugcagcccucauuguaugucucucaugaacuuucaacuuuacagcacugacuuuuaucauuaaaaugucuuuagacacaauucacuaucacagacucaggcaucugaccacagaucgacugcacccauggcucacgugacuaacagcucuucaagucugcuuccaacuaacugaucaaacugaaaacuuaccaggacugaacacauuaacacacaauucaguaguaacuauaaauuguccauccaaguugaaaucaauguccugaaugcuaacauaagagacuuaccaauuugagugauuucacacauaaagcagugacccugacugaacccugaaguuucaccuuagcgcccgccccuuugggaugacaagauuucuaggaacaucuuaccuuuaaauccuagacucaguuaacagaccaaccccccaaaaauugacuuaaaaaaagagcacacauacaaauaaacacuaugcauuuuuuaaaaucuucccuaauuacaccaaagcuuuaagaaaaaaauacucucuaaacuagcugcaguucuauuuaaauuaauagauuuccuuaaguccacauuuuuuuuauuuaauggaagcuuaaaaacaauugucugcaaauguucuugcccauuuuuccagauuuguuuuuaaaaagcacaauacauauaaagaaaaacguggguauuugggaaguuacucauaaaacuuaauggcuacagaaguaauauuaagacaaccaacaagcacauugacuacauuaagucauuuccaauucagacagggauucuugggcaaaaucaaauuuugcuaaaaacauuuaaaauucacuacauuuuuaaccaugcccucuuucagacaaaguuuaccguuguuuuuauccccucaaauuuaugcuucuagugacuugaauccaagacaaacauuuguaguauuucacuuccuccuauucugaugauaaaagagccaauacauuuuuauacaaaaggauuuauuaaaaaaccaguaagacacuacuacaucaugacacugucacacugggcuuuuuuuaacacaagacuugcucuacaauacugggggggagggggggcauaaaacacaaauugauacugaagcauagcaauuaagaaauaaaacaaugaaagcaaauucuuuuaaugagaacucagaauuaaacuucagagggacccaacgucauacuuccauucaggaacuugauagaaaaaauuuaguuugaacugcuauuagcagguggcaggagccaccuucaaaugaaucuucaaauuggaaaauacugcuucaccaccuggagacaaagaaaaagggacaaagucacucggggcaggccaugauacuuaagcaaaaacuuacauaaaacugaauuaucccuauguuucacuacauguaaauacuguauauaacauuaaauguguggguaugcuuuauaaauuaaagcugaacaguagaguccaugagcuguaaauccacaugugcaccacugguuuaagaugugauaugcucucaucaaaauucuuuaaaauuacaaaaagauuuucaaaaaguauuaccuaaagaacucauaaaaggccagucaauuuuugauaaaaggacauuuugacccaagagcaucuauuauuuaacuuauuuuacuggaucagcauaucucuuguucaucacaaguuauagaagaguuaucuaugacuagaagaaaaaguuaucuuauuguaaguaaucaauagauacauaggcaguugucacaacaggaauucagcucaagaacuucuugcaauuacugcuacaacgucuauaaaugggaaaagcaagcauuaaaauagauuaauaaaauauaaauuaagacuggaaaauccagagacaagcuguauccuuagaagaauaaauaguuaaaauuauucaguaagcugacguauuuaaccauuacugggccuguaaaaaaugcauuaaaauuacauuacaaauaguuuuuaaaaagcaaagaaauaagugaaggcaaagcuugaaguauccacuuuauuuuauaaugcugauacaggauguuggaagagaccauaccaaacggcagcauucgagagcgugagcaucucguacccuguccgcauugagcgggccugugagaaucgugaagucagcgcgacacagggccugcaaugaaguucccgcuggcggguacaaacaagguauaaugucagaguuaguaggcaauauuucuuuuugcugcaauuccuuaauuuguacccauuagcaguacuuuaccuguuaacuuuacugacuuguuaauaauaggacaaaagggcaaaaagcuuaaaagcaccuguguuauuuaucuugaaaaaucacuauauaauaaauugguaagcacuccugggugcugugaaauucuaaaauauuaugcauuguuuuguauacaauauagauuauuauauuaacuacuauguuauauuaacuuaaaaauauauuucuaaaacauaccuguuggggauaaguugcaaauggaauaauuuaguaugguuuguagcuauuuugauguccaccucgccuggauacuuucccauaaccacucugcugaucuaaaauaauuuuuaaagaaaguguuagaagcacacaugcaaugguuaccucuuagucauuauaacaauguguaauaauuuaaauaacugcaaaucccuaaguauaaaaguuucaccaaggaacaauucaacaaguaauuaucaaauauacaguggauuuauuuucacuauagcaagcagccaggucaaaccugauuauugaauugcuugcauaaacucagaauucccuggcccuuacaacauaaaagucuucaaugucaaaguagagucagcugaaccuuucacaacuagcagguugaaucaccuccaaaucaacuacuacagucggugcuucguaucucugcccuucuaagcagagggccccgucuacccaauacaucuuugcugaccuucuucugacuuuaguuaaccuauuauugugcagcaggccuagucaccuaagaaaaggacauaacucuaaacacuggucuaaccaaggaaagaaacaccacuugacacagcuaaucccuuaaaagaauggaaggcggcugcuuacacagcccuuucuuucccagcugacuggaaagucaccagacagggccagccaucuuaguugcacaaugaagccagggcuuucuaucugaaauuuuaagguuuuuuuccuuuucucuaucaaguucaacaucuaagagguucuaacaguaaucuuaaagagaaaauacaguuaguuuuuaacuggcaacaugugauaucauucaauuuuauaaaauuaagacacaucaugccaagauuauugguugguccaagaagugacauuuaaaaauuccuguagcuuagaaaaucugaccuaaacuuuaauuguuucuuuaaugcaagagaaaugaaagcccagcauauauauacauacauacauauauauaaauauacauaaagaggcucacacgcacccuacccuuacaguguacaugugauaaaggcugggaggaaccuaagcaagaaaauggcugcaguuuauuuuccaggaauugguaaccugaacaaguuugcccuuggcaaaagcuacacuaacuuuucuaccuauccaaauuugcacaaaguaaaugucaaauagcaguuaauauaaaaaguauaguacuuacugcuauaaucaccauauccauaguaguuguuguaaccaguguagucauauccuccauaaccuccguaaccuuggcuguuauauccauaguugccauagccuugauuccaauaguuacuauaucccugguuccaguuuugacuggggccugcagcacauuaauagguucacuaaagucagaucagcaaagaucuuuacuucaggguaaguaaaagcagaaaagcuugagagagucaacuuagguuacagcuuaccuccaccucuuccgcgagcucugccugcaaacccuccucuagauccccacugcugcugcugcugauacuguuccuuugacauggcuacuuuuauuucacacuaacaaggagggaaaaaaaagacaaauuauuauauugacucaggagaacaaaggugcucacaagccuacaauccucagaauagcaaguucuguuagguuaaccuaguccuucccuccacaccagcucugcauugcaacucagagggguucucucauuucuggugugaucaaagccaugcuugccuaagaccuaauaacuuguuuugauagguccuaaaaaaguauuugauuacauuuacauaaaaauacauuuuaaugcugguggugacauacaccuuuaaucuuagcacuugaaagacagaggcagguacaucucuuaagaggucacccuauucuacagagcaaguuccagaacagccagagcuacacugagaaacccugucucaaaaauacaaguaaauaauaaaaguauauuauaacaaauacauuccugcugcucaaaaaguucaccugugacccaguaaguaaaaaguaacuuaguaaguaaaaagugaguaggcccuuaagcauccuagauccuaaaaccaagcauuacauuguagcagcagguuuuucuaagccacucaauggauacuuuuaacuuacuuuacuaagaccaacauugugguauuucuuuuccauuaucuucuucacuggcuccucuuccuuaaagguaauaaaacagaacccacgccucuuauuggucuuguuguccauagggagcucuauggauucaaccugauagcaauaaaacaaagacuuaguauucuaguuuguguucuauugucauuaauagcuuauauacuacagggaagguagcacaaagaaaaugcauuuaauucucaagcuauauucuccugucuccccauuuuucuaauauuuuaaagauauucuucaauuacaaccuccaaguuaccuaaggccucacacuuaaucauaagaccaaucguuagugguuuaucaauauuucuaccuaucugaagaaucacaaacccagagugccacaaaaacacaauggucauuuuaagagaagcaaggcagacucugcauuugagaauaaagaucuauauauauaaucuagcaacaacacugcaaacugaagaaccuguggcuacuccaggcagaagcuacaacugcagucuuaaauggcugcugcugaauaggcaagcaguagcaauccaacuuuugcuuguucccacaaccacacaagaaacuuuauauaccuggauuuuuguguauaguauuuuugaguauuaagcauuucauuuguaaguccuagcacaaaagcauguauucuuauuugaaucaaguaacagaugccagcauacuauccuuggagaccaaagccacauauaccucagcuuacauuuaauuauuaauucaugcaugauaggaacugguagcucauuaugucacuaagucuaaagucucauuaaacuguacuuauacauauuugagugggcaagaugcuagucuguccuuauuacuuccuuauucuuaagugucuccuuccuuaucucaguauguuaaccaugaccaccuccucauacugccuuccuguucucuuccuuccacuaaauuccgaguuaagaaugcuguccaacucggacacagugggucauuccuguagucuaugugguauagaagcaggaagaugucuuaaguccagaguucaaggagaaaaagagaaguacaaagucagacagccuacauuaccuaacaagaccguucuuugcaguuggggauuguuuauuucaucuuuguaucuguuacuuuauauauacagauacucaaaaauuaagaaaaaaaaauuacccaaucuucagaucuguucacaucaauauccuuauuaccaaaacaaaacuacuucacaacucugaaaaacccagaaggccaaaucuacuuaaugugccaucacacaaaaauguugacauaaauuucaucaaaacacaacauaccucaccaaaaccaccaaaguacucucuuauuuuuucuucaggugugucuggagaaaggccaccaacaaaaauuuuuuugacaggcucuuuuguuuucauggcuuuggcccuuuuaggaucaaugacuuucccauucaauuuauguucuuucugauccaugaccuaaggaaauuaaauuuuucacuuuaauauguaaaaauuaacuacuguucagaaauaaaauacuuacaaauaaucacacaauguaccaauaccaugucaacuggcuuaacugucaagucacagaguaauuaugacaucaacuaacacaaacuagugcccaaguauaaaaaucacugaggccgggcggugguggcacacaucuuuaaucccagcggcacucgggaggcagaggcaggcagauuucugaguucgagaccagccuggucuacaaagugaguuccaggacagccagggcuauacagagaaacccuguuuugaaaaaccaaccaaaaauaaaaauaaaaaaauaaaauaaaagucacugagaauugauguaggggaaacaucaccccaacugaauugauuacuagguaaccaucaccuuuaaccgauaacaauguaaacaaugguugcuacuuccccucagugcagaaccaaaauaaugacaaucaaaaguugaucauccuguagacauuugacugagagaacuacucuauucugagaaucagaguaaaggggggaaacuuuaucuaacauuauuuuaaauugggcccuuuuugccaacuugucauacuguuuauaacauacccccucuauccucuuggaacugaacauaaacaauauacauucuaaccacaagcuacugcccccagacaaaucucuguccuuuuuaaaagucacuuucaauuuaggaaggcuggcacaugaaaaguaucaguaaauaauuccauaaaucuaccucucucuccaaaaaauauacuggcacaaacaggguguguucagcaccucugcugccccaacacuuggaaaguagaggcaugcggcucaggguaguccucagccaugugcacaacuugaggccagccuaagcuacacagaaccuuguuucaaacaacaaaaaauauaagagaacauauaacacaaguuuacuguaucaaacucuccagguuucauuaaucagaauauauguauauauauauauauauaacacacuaccuuaucuacacucuccgacucuuuaaauagcacaaagccaaaaccccuugaucgcccugugauaggaucuaacuucagagugcagucuacaacuucaccaaauuuggaaaaguaguccuucagaucuuucuuuguggugucccagcuaaggccuccuauaaacauuuuccuguaaagacaaaaagcaguauuaaaauguuaagaagaaaauuaaacuuugucuuacauuuacacacaucaguaacacaccuucuuuucaaauguuauucuuauuacagacaccuaccaaacccuacuguuuaaaguuccacucagcacugcuccuucuguucaaauacaauacugagcaagaagcuauuuccugauauuuauauacauauacauauuuauauuugcaugccaaauaaaaguauuaguuuucuuuaacagauaaaaucuuaguuucuagauucuaucaaaucuucauuacagccccagcauccuaucuacagcaagacuccuuucucuacuuuuaauaguucucccauuugcagaacucauauauaaaauggaaaaaugcuaaguccucuaaacugucaacuagaguuuuucgcgugcaggacuccaucaagacgaccacagucaucauguaaacacuccgacagaaagaccacuaaaccacaucuaacuaacuuagaggauuuacuuacaggagagccucaguuaacaaguaauacauguuuaggccuguaaaaugauaaauggaaaacacuccaggaaaggccauuagaacaaagucucaacaugcagcaaaaugcccaaagcaguuucuggcagcagugguaauccuuucuacagcugcuuguuuuaccaguaaguuaguaguaguaauuauaaaagaaaaccuauaccuuuuacucuuuaaaaaggucaaacugaaaacuuaguaguaaaccgauaaaacuaguccuauaaaggcuacacgacuacucagaauuuccucaucuucauaugggugugugugugauggaaaagaaugggaaagacaccaacuuucagcucuagaaagacauaaauaagcaagucuuucauacgaaacaucuccacuuuguagacuuuuaauaggcugccacuacagccuauucuggaaauaagaugcucauuaguuuaucuucaccucuaguacaucuguuuuuaacuggaauguuacagaauauucuuacaagguuaacuuaaugcugauaacaaaacuaacuuuuaauucaaagaaacucuuaggaggcauauugaacuuuccauuuaaaguuaguguuucaaccuugaacauguuauagagcaagccccaauuuucaagacuuccucaaagugucuaguccuaaaauaagauuuauggccauuuaauuuuauaaucaaauaaaucaaaacccauuauguacauuuuaaauaucugcuuauuccauggaaaacuucucaacauacauuucuucuuucaauugaauaacuccuaaaauauaacccuuguuuaaauauccauugcuauaaauaguguuuuaccuacagauccagaauacuacuuucauuaaugaaaacucauugccaacauucagucuuucaaggugagggagaugcuaguuuuuuaaaagaagaaaagacacugacuauaaagcaaaagucucucagauauccauuaucacgcucuagaacagaaacaaacucagcugugacucggcuaccuaaucaucaucugugauacagaauuucccauaacugauuaauuuguaacgauuucagucuugccaaacuaaaauuauuauaaaagacaguacagaauaauaacaaaccucuagaacaagaaaauucugucuagugaaccaauuaucaagacagaauuuguuuuuacuucauaaaagcaauggguaggggaaauguccucaauuuaaaauugcuauguauacuucuuuaauaaaaauaaaagauaauaacauaacacauagaauaagucuacuauuuuuaagucauaugacuucuuuuuagauagaaaauuaauuuucugaaauauuagauauaccaacucaucaguugaccuaaugaagugcucuguaacaaacaaacuuuuccacccauaacagagcuaaaaauguucacgcaaaacucuucuguuaauagaugccuuuuauccagaauauuaaguauucuggucaacauuuuuauuuaucacauuacauuucuuuccucaaguacuaauugucuuuuuaauccacaacuauuuugaacgaaauauguuaagauagugacagggucuuacacuacagcucaagcuugccucaaacuggugggaauucuccagccuccaucuccaguggagcugccacaauuaguuucaaggaaugagauauucuucuacaaaccacacccugccuucaauacaacagucccgaguaacagccuagggaucuguuaucucuauuaagcuacuuuaguauggucaaucucugaaacuggcugugacuaauguggaucgcacucguuuagccuuuaaaacacacauuuuguuuaaguuuugccaacaauucaauuugccaacaagucauuacucguucuauaacgaaaaucucccuuccacacuguaaacagccagguaaguuuuccaaauuuugugugaaguacaacagcuucugagcuuaugacaaauguaucaguauuuugguagcauaaaaaaacuguauuuuucuuaugcuuuaagaaaagcugaacagauaaccagaaaacccaauacauuacaaaacccacaacacuguauucuauuuuacuaaauaggaaguaugaaauccaacccauuuuuauucuguagucacaagcuuuaacuauauaguguacagccuaguguuuguccacuaaccuguauaaacggguaccuccuguaggaucucuagaauacuaacgugaacuuccucucagucugagauuccuuaauauuaacacuaacuuggguuacuuuauacagccauguguguaaagcacaauaccuacuguguguccaauagggagccuuaaacgagaggguuacuuucaaguugcuauucacuccugcagagauguaaacacuuuuuaguaagucaaaagaacuuuaaaauuucuaaguagccaauuuaaaacuaucaagagaauuguucaaguaucaacaaaaugauucuucaugcugcaaucuaaauuuaaaugugauucuuaguucuaagugaaccaauaaucccaauuaaggaacuuacuucuacaagggucaucuguuccccacuacuguaauuuuuuuugaagucucauguaauccugccuguccucaaacuuguagcaaccuuccugccucagccuucccagugcugaguacugugauaauuuaugcacagcaccaugccugccuggcaaaguuugauuucuuucuuucuuucuuuucuuucauuuuuagagacaggguuuuacuguguagccuuggcuguccuggaaacuauucuguagaccaggcuggccucgaacucagagagauacaccugccuccccuauaguuuaauucuuuaaucauacuuauaagcaaaguauuucaauggcccaaagaaaagauagaagucuauuuaaauuagcuauuaaacaguguaaguguuuucacacuuacgggcauguguguguucuguuugggucaugcauguaaguguagauacaccuggaacugguguuucagguggugugccuugguuccucuaguggaaugaaccuuuauaaaugucauuucugaaguccucucccuacccuacauuuaugccaagauuucuuaguaaauaauuaaaagcacuaggcaacaccuaacaagcaaugauggcugacagaaaaugucuuauuaauuccuaauuagcaggguauggugguccaugacuacaauccuagcacuuaggaaacuagcaggaggaccaauagccugaacuacuguuugacucugucuuaaaaaaauaaaauacccucauccucucccaaguacauaaaaagcuaauuuuuucuaaacuaugaagacaacaacacuccaaacucaaugauaaguauuguaucuaaagaugcuuucccugaggcuuuuacccuuacccaauuuucagauaaaacaauguuuaaagucuuccaucagcucauuaucuuacauaaaaaaaaaaaaaaauacaccaaguguuagcuuaauacauuuuucuugagccauaucagcccauucacuggcauccuuuauaguaauauuauucaagaauacuuacuuacauaauucuucugguaccccaucauuaaagcucaacuuuuaaaaugcuacaaugauaaacucuaauaaaaucucccuggcacguauuaauuaacauuuuccuuagaaauuaggguuuauuuuaaacaucaucaugcuacuucuaagaaugaggccauuacuuuuuaacccuggacaacugucaguagggauauacauauaccauauauauaaaaacuauccuggaaauagccugacaaacccuugacaauaacaaaacuuguaucugaugugguuaauggcauuugaaaacuacuuuuuaacuauuuaaaacuguauuguuuagcuaaucaaaaaaaaaaaucaucaguaaaaucuacacaccgauauuagcugcccacuauuaaacaggcaauuacucaguaaguuuuuuucuauauuacacuuuuuaaagcuaagugcuaaaaaggaugcaagacuaacacauaaaagagcauauauuuucaaagcaagauuuuaaauucuuuuauguuaaaucucaaacuucaaaggaaaccgaaaucaaccugcauaaaaaagauaacuagguugaaaacauccucccaguuuucccaggaagacuagagacuucccuccuuucaggaggcagacucuuugggagcuugaggacaguuggucuacacagugaauuccagaccagcaagggcuacauaguuaauaagauccugugucaaaaauauaaagaagaaagguagguauaacaucuaguaaauuaaacacaacagcuuuuaaaaauaaaccuuaagagcuuugcuuaguauuuucaauauacuaacuuucuaaaaaaaucuccaauuuaugauguaaacuccuacucaccuaaagguucaagccugggguggguuucccuagccuagguuaagguucaggguaacuaagaucacuagcuauucacaaucauuuaaguuuucuauuuggcaucaauuuagauaucacuaauaaaaaaagaaugaauguuuaccuuucuuaaaccaggacucuagaauaaguguuccaccaccaauccaaauccccaaccccuaccauuuuucaaugcuuuaaaaucacauuacuuuuuaauauaacaaaaaccugaagaucguucccaaaacauuuaucaguugcuuuuucaguauuauuggcugucacuuuccugucuaagacuagaguagacagaguggauuuccugauucauauauauauuuauguauguagucucaaauguagacaagucucaagugcagacaaacauuucaguauagaacccaauacuuaaagcuaucacuaugagacaaaugucagaaugaaguagucuucuccacucuaaaauacucucaaguacauagcaugaacauacuaguuuaacacuccagaaacuaaaauaugcuuaccuuuacuccacaggaguaaaucacugccaguagcaacuauuagggcauuggauaaauacacacaaaauaggaaagcaggcugugcagucaagucuuccuacggugagcauuguuuccagcaaacagaucagaaaaccaaguaaaaauguguucuauuuauuaucuuagaccacagugguggaaguaacagaaacaaaucccaggcuuccugcauccaguuuaguguccuauuuacuguaacacugaagcacaacuauagucagaucaaaccagccaguuccacaucacuucacuugcuugcaugcacauuugaagcauagucauuaagugaaauaggaagucagucuguauuuauguucucugacauggcuucuaacaucaccuaaaggauaaagaugguuaguuaucuuuccuaauggccuuaagucacagcaaaaugaacuaugagguacagaacuacaugcaucuaccaaucuaacuauaaacaugagaugucuuacauaccucagacuacucagguuaaauuacuaaaacaauauauagaagaugucauuaaacacaaagaaaacuuguugacguuuaagguguugcgucaaaaacaagaaguugccaagaaguggcaguccauaucucugggcuaaaaagugaaauccugucuuggaaaacaaaauacugagacuuuagaugauauuccagucuagucccgggacuguuuauuccaucucucuccuacagacgacaaguguuaucgaaaucuaguauuccuggauggggauauggcucaagaacacaacauugcccacacacuuaagaagccuuaugagcuaucuccacuauggacaggaaaaaaaacacugaauauucuucuccuaaaucuaaggcuucagcuuccaauuuuaccaaaagaaauuaacauggacacacauggacuuacauucuuggccaauaaauccaaucucacuaaaucaaggccagucaaucuagcacuucgauacucaaggucgucguccccccccccccccagagcaauguucaaacuguuccaguaacauugggguuucuauuauacucuccaauauuuuaaagacaugugugauccccuucucaaacagcagagaacaaucuccacaagauucuacuugagcucacacacuaacgguuccaggccagcuggguacugcccugacaagugcuccacugacaacucaaugaaacugucgagcuuccuacucaaccacauucuggagguggggguuagggugggaaugaugagucauuguaucuaagcugguaaaacugucuacaaaacugacacaguauucuagguuuccaauguucuuucaauuuccaaaacuguccuccauacaauguggcaugcacauuucagcagacacuaccuacccccaaagaaccagagcacuauaaagacuacaaacugaaagcaaaaugaggaauuccaaugcaacuaauuauaucuaagaaauaacagggaucuuaaaaguuguagauaguaaaguggccaacaagaugaccagaguccaauccccaggacccacauuacagaaugagagcagacucacuaaccuccucucacacacacacacacacacacacacacacacacacacacacacacacacacacacacgugaacccaacaucaaaacacaauuuuaaaguaacucagaaagcaauuucacuaugaugagacacuuaacaaacucauuaaucuugaaacaagggugcuuuucuaaaaauaacuucauguucacauaugaauaaacaauaauacauaauaaagcaugucaaauaacaaacucaucuuuaaaaaauauuuuagcaggaaaaccaggaagaguagcauuuaccuacaguccccaacacuugagguggacacaggaauauuaggccaaggucagccuaggcauguaggagaccuuuccucaaaaauaguacuucaagaugaaacuucauuuuaacaggagcugcacugcacaccaaaguguuuuuaagaaauuaacuucacagggcauuuaaucuacugacuggucucaucuccacuacagagauuauauuauuaaacugguguggaaaacagaaacauggaguguacacauauagauaccaaaaagguaugcuuaaagaucuucauuguuuugcucagaaagucuagcaucugcaacaaaacggaguuggguaaauugacauuuaucaaaucaaauuagagaaagaggugggaagaacaacaggggacaucuggucacaguggccacacaccuguaguccaagagacuuggcagcugaagagccuccuaagccugggcaacgcagugagacugucuccaaaacaagugcuggagaguaaggaugccgucuaaguacaagacugcuugaguaaaaccuacuacuucagaaaggcugccaguggagacccagcaucaucuaucuggacaguuccauaacauuuacacuuaaguuaucaaacuuucuccaaaaacugaucccagaaagcucuacaagcauuugcuacuuauugaacgaggggacaaagauaacuuuuuuaaacaguaaaaagaaugaccuucuaaucuaaaacauggucaauucaacuuacuacaaacaacuaagguucaaauagaagucaaauaagguuuaauuugccaucauuagucaacuuacugugcccagcaggcaccaagacagaauauucaucuaaacauuauuaugucacacucagacccuaguuuguuuuuuuccauuuuguuucuuuuaucuguuaaacuucuuuacccccaacuuaaaacuggacaaauaucaguagaagggaaguuaaaaaaaaaaaaaacauauaaaauuuaaguguuauccaaaauaacuuaauagaauaugguuuguacagacauaggcaauguacuggcuuucuaaccuccaaugguaaagaucaaaguaugacccuaagggcagagacugacauuucaggggggagaagugggguaaaaagaaugcucaaccuaccagccuccaagggaagucaugcaaaugugaacacaugucaaccaacuguaauuaacaucccagccaaaucacacugaaaauaaaaagccugauaagagcuguaguggaaagccacauuuagcccaccuaugaauauauacacaaugcuuaaaguauacaggacuuugcauaaagcauaguaauacuuaaggaacugucuacuugacagaauacuucaguauaacaugcaagacauuuuaacacgcaguaucuuuaucaaguaaccuuuauauuuagcauuaagcuuagaauuuaaacaaaaauauuucaaccuaauaaaaacuaaaugaaaauacaguaacuuuuguuugcccauauuuaaaagaaaaauuaauaauuacauuuaguuuagguuggucaaauugucaacucaucaugcauuaccacacagcauaucacgcaauggcguucuugcccagauuauuuaggguaucuagaaaggccuuacaucccaggcacaagacucagccuacaguauuaaugucuaaaucuccugggacucaaugggcaacuaaauuacagagccucugcauguuaugacuacugaaaucuuuauaagacagaaauaaaauguaaaaguuuuaccauucuucccgcugugccgccgcugcuucagugugucguggggaggaguuugaauggcuagggaauuaacaaccgguacagcaaccaaucaaaauucuaguuuuaguuuuugacauuguuaggguuaaaaacuaauucauuuauauuucaguucaacaaaaaacuucaaaaacagcuagcuacuuucuaacuucaaaacucaaggguaauagaaagccugccccaguuacaaauuaaccauuuuggugccucuguccaaagaacagaauucagaaagcaaaaaccaaaauguuaaaaaaaaaaaaaaccuuaauuucuucaaauauuuaacauguauucccuucucaaauuaagccacacaucguucaauauuaguuccauuuaauuaaauucacuucccaucccacccucaacuccccacuaaagccaguacaaccauuagcagacugcagagaaucagccugaacugagauuuucuuaaacauuauacuccaaguccuucuccacugucccaacaccccuacaaauuuuauacucuuaaccaguaguggaaaucacggguuaaaaugacaccuuucuaaaaacuccccaccaaaacuuucuccugguuauagugaaaaaaauugcauacgcacagccccacuauaaaaaguaucgaaaccauaacucaagaucagcaaucuguaaugggaacaagaaaaucuaaggacccggaucgaacccccuuuccuugucuccugaaugauacucagcucccaaaggcugcauuuuaacauuauuaaaagcagcuucugguggcgauauaaguuacuucaauuaaaggaagcaaguuaguauuuuaaaaaaaccugaaaaaaacuaauucauugaccaccacaggauuuauugcguauuaaagggugagugggcuccuuugaacaauagugagagggugagacugagaagaaaccaaaacaggcuccugggcacugaaaaggcgggagagagauguaaaaaauguaguugcacagacuaaauaaggaaagacuacaaucuguacaaauaggcaacccagaaucugagggcgcgaaaagggugcauagagagaauaacuuggcagaaugggggaagggcaaccgcaggcgggagguggaagagccccagucaaguacaggccccaucgaccaggaaggacuuaaauggagcccgcggagccacaccaacgcgccagcagaccagggacuuuggcaggcccggucugucuacagcacaaacgcagggccuguaggagcgugucguggugacagcguaaaguggacagaacgaacgaauccuaagacgaaaacuauuuaaaagcaauggccugcggccgacgcgggagaaaagagagguggacagccuacagcuuucccaaagcaagagcgugucaauaaucgcaccgucucgggggcgagggcgaagcgcccgaccaaccuuggcaacccugguaaaaagcuuuucugugcguuugcauuuuuaagccuaagagguuagaaauccgggagacguggggguggggugggaggguaagcuccgacaggcgggaaaaaauccuggcggccacaucggugggaggagacccgcggcgagggaggaaagagggcgggccgcggaguagcauggugacggcuaaagguggaaacgugugugaugggggagggggcgagcaggcagggaaggagaugcaggcccgggggggagcccgagguacaagaggggcggccgagggggcgacugcacuggggccugcgggcgggcgggcggucgcgggagcgaggccuaauggcggggagggggagggggccuggcgagcggcugcccggggccgccccuuacucacccuucauccuccucguucuuacuggcgucgaucuuggcucccucugccucggcgcugccuccuucggugccuccggccgcagagccgccgccgccgcucccgcuucccgccgccgccgccggccccugcgccgccgccgccaccauggcucccuccugcucgcccgccgagccgccuaccgccgccguugccgccgccgccgccccguccccuccgaacugcuccuccgacauagugcuacugccgccgccgaagacgacacccgccgacgccgccgccgccgcgaaccgaaacuagcagcaaaguaauccccgccgccgccgcgcgaugcccgcucuaccucgcgaggcacccuagacaaggcgcgcgcguggcugcaagggcuccugcgccucuccccggccugccccccucgccucccacucucgcgcagcgcgcucucucgcucuccccggcugcacugaaaaaaaaaagaaugaaguagcagcggcggccacucucgccuccuccucgcuuuaauggcgccgccgcggaccaccuaaaauggccgacggaagaacggcgcgucccggucacguggcuccggagcgcgcccuuugcgccucccccgcccccguccaccgcuaggccccgccccccgcgcaggc

SEQ ID NO: 2551 - RNA, 2481 nt, Mus musculus
aucgaccaggaaggacuuaaauggagcccgcggagccacaccaacgcgccagcagaccagggacuuuggcaggcccggucugucuacagcacaaacgcagggccuguaggagcgugucguggugacagcguaaaguggacagaacgaacgaauccuaagacgaaaacuauuuaaaagcaauggccugcggccgacgcgggagaaaagagagguggacagccuacagcuuucccaaagcaagagcgugucaauaaucgcaccgucucgggggcgagggcgaagcgcccgaccaaccuuggcaacccugguaaaaagcuuuucugugcguuugcauuuuuaagccuaagagguuagaaauccgggagacguggggguggggugggaggguaagcuccgacaggcgggaaaaaauccuggcggccacaucggugggaggagacccgcggcgagggaggaaagagggcgggccgcggaguagcauggugacggcuaaagguggaaacgugugugaugggggagggggcgagcaggcagggaaggagaugcaggcccgggggggagcccgagguacaagaggggcggccgagggggcgacugcacuggggccugcgggcgggcgggcggucgcgggagcgaggccuaauggcggggagggggagggggccuggcgagcggcugcccggggccgccccuuacucacccuucauccuccucguucuuacuggcgucgaucuuggcucccucugccucggcgcugccuccuucggugccuccggccgcagagccgccgccgccgcucccgcuucccgccgccgccgccggccccugcgccgccgccgccaccauggcucccuccugcucgcccgccgagccgccuaccgccgccguugccgccgccgccgccccguccccuccgaacugcuccuccgacauagugcuacugccgccgccgaagacgacacccgccgacgccgccgccgccgcgaaccgaaacuagcagcaaaguaauccccgccgccgccgcgcgaugcccgcucuaccucgcgaggcacccuagacaaggcgcgcgcguggcugcaagggcuccugcgccucuccccggccugccccccucgccucccacucucgcgcagcgcgcucucucgcucuccccggcugcacugaaaaaaaaaagaaugaaguagcagcggcggccacucucgccuccuccucgcuuuaauggcgccgccgcggaccaccuaaaauggccgacggaagaacggcgcgucccggucacguggcuccggagcgcgcccuuugcgccucccccgcccccguccaccgcuaggccccgccccccgcgcaggccccgcccuccccgucccuuuccgacuggcucucacgccccgcggucgcgcggcgcgggccuuuaaagaggaccggaaguggcgugcgcaagaggggcgcgcggguaccaucgagaacaaggagcgcugguucgagggcgcggcuagagaggccucccccgcccccgucccuuggccccgcccuuccgcggauuccuggagucaccggccgcuccucggcuuugguuggcaggcgcggccgaccuggaggggugugguucguccauccccagcggagacuucguggaggcugcccucagggagccacggcugugggccccgggaccugcguggggcagcgggccgcgccugugcagugcuccgccgucccugcgccgggugacauugaggcuccgccgcggcgcuguccaaaggcggcuuugauggucgaggcugccucuucucagaguugcuucccuagucuuaagcuuugccuccguuauuacaagagccuaacgccggccacgauucuuugaagucacuauggauugggaaguguauguauuaaggucgacuccagggcuccuuuuuuuuuacgaguuacaguccuuguauuaaacaggauauauaaaugucaugaaucaucuuuacgagguuucuggguuugugguguugagguggcgauuuuauaaaaagaaaaaaaugaaacgccguuaggcgugugauucacgauuuuaaaauuaaucgcuaagaaaccuauuggaauuccuacucaggaguuagacuuugaagcuuccugcaagacuuagaagaaaauggaauuucugguuugguuugguuugguuugguuugguuuuuuuugucgucaaccacucgacugcuuaguaaguauccaguuuccaaacaggguuuggagaaguuuacaaaagacagcauacagggacaggacuucagcccagcuaauuagguacacgcuguaaucccagaacugugaucccagagaagggaggaaggacuguugaggccaaccuggcauuaccccuuagcaaaacacauaaaaaaauuuuaaauaaaugcuucccaugguguacuuuaagucaauuuacaguaacuguacauaaucugaaaaucccaacgauuaaaacaagauuuauca

SEQ ID NO: 2552 - RNA, 43393 nt, Mus musculus
acucaacucggagggcggagcuaauuccugcuccccuauccggcgcucuggcccacagagacgcugcucuauggcaccucgcguccccucugcccgccuccuggaggaccacgcucguuuucuucuuggcagcgagaggucccgcagccguggcugagcuggaggaaagauggcggcugccgugcgacaggauuuggcccagcucaugaauucaagcggcucucauaaagaucuggcgggcaagugaguauuucuuaggaguacagagguaggaaggaagccgcaaguuuaucuucccagaggcgacgggcgcuccggggcgugaggcucgagcuaggccugacucaggggggcgggccugaacucggcuguggcgguaaauguugggagcaacagaaagcuguagggacgguaugcugggguccugaccgucccaggaccccagguggcugccagcuucuuaaguccuugauaacgcccucugcggguucuuuuggcuucuggaagcgagguaagaaagaugacggcucgcccggcggugggcgccuuccuuagagucucuucggcgagcccgacacaccgaguuugacuucgguucgcugccgccccugccuucgccguguuggagguaaauuuauauucuggacuuugaugcagacuuuuauuucgaagagauggcuuuccaggauugauaggggcagaggagguauggaugcugucaugugguccagaacuucucucaguucauagcguguguggguccuuauguucuggauacucgcagucugucaccaacucuggagaagagaacacaggcagaauguccucgggcucaggaugucuagaacagugauauuuccagggucugcuaaggaauuuugucgaaaccuuagggugcuuagagccacgacaggucaaaaauugggacauguuucaguccccucaagcaguuguugaacagcuguagucuucuuuguguagauuuuucacaguuuugccuucuaaugaaaguaugccuucaauuggcccuaacauuuacaccucacagcugagggcauguugaucuaauuaaugaaauauucuugcucaaaccugcacauugaaaugguguguguguuguguggccgcugugcugggcuuuucuguguagaaaguacagucuaccuuauuagugggaaauuuaguuguauaaccugggcuuaacuacaucauucuuuauuuuuccgcuuuaaaaaaauggaaggguaaucgugaggcuuagucuuaucugauuucaaaaugagcaugugucuauguacuaauuacacuucaauaacugagcacagucccugguaucuggaaaaugucauaauguuguuaugaagcagucaguaaguacauacgacuuauuccagggguuggaaauaguucauuuaugucuucaucguuugguuguuuuuccauguauuaauacuuuuauagcuuuggauagaagucaaacuagcuuauguauucccuuauauuuccuuuguuuuuuucucucuuuauuacagaaaauguaaguucauuaauuaucagcuaagaugcagguguuagaacuugaaaaucuuguggaacuucauuacuauuuaucucucuagcccggaauuagaaaugaacaguagcaugucuccaauaggguguuucuuuugccuguuguagcuaaauaaguacacaauugaguaauauaaaagugacaccccccaccccccaccccgggauucuguauguugccuggccuguuuucuugaucuuaccugguucaguuacgcagauuaauuuggcuagcagaugcacuagggcuggccacguguagauagauaccuggcaguuggcuggaucuuuuauucucacuacaugguuuagcuuuggcuuuuuuuucugggacuuccugcaucagaguguucuaacagggugagaguggaagcuguaaggcauaaggcuagucugacaagucucacaucaguucuguaauaccaaugaaagcaaguagcgagaccaguccagauuccaggggaaaggaaauggaauauaucacuaacucuuuagaagcaaagugguauuuugcaggaauaugaauggaggguggagugccagccuaccaaguggauuuccuuaagaggaaaugaaauacuuugcuugauaauggauagcccaugcaguguuaguuggcacccucucaacauugcuuucuuucuuaagaauuagcuuauuauuuuuauuuauguguaugugugccgugugugcaaaugccuauggguguucaaagagggagugcaucccccugaaccuggaguuacagguggugcugagccaccuggguggaugcugggaauugaacucagguccucuggaaaagcagcaagcauucuguuaaccacugagccaucuccaggcuucagugcuuuuuuucugaggauauucuuggccuucccuuuagguauuuaccuaguacuaucugguaagaaugugucagaauuuacuuucauaacaacacaguucugccagccacauacuuuaugauguacauaugucaacucaucuguucguuuaugguuuuuauguugggaacugagaaacaaaggcucucacuuuaagaaauuauagaguacaagauuucuaaugcugacacuuucuguuccaugcaguguaguguucaagaauuguugguuaaaucagugacaagccaagggcuaggguugggggcaugacgucuauuugaacccagguuuuuuucaaaagcucacuuuuaaccauccagaucauauugccuccccuccuccuccuccuucuccuccuccuccuccuccucuucuucuucuucuucuucuucuucuuuuuuuuuuuuuuuugguuuuucgagacaguguuucucuguauagcccuggcuguccuggagcucacuuuguagaccaggcuggccucaaacucagaaauccgccugccucugccucccaagugcugggauuaaaggcgugcgccaccaccgcccggcuaccucucuucuuaaaagcucauuuagacaugcuuucugauuagcuaaaguuaguauaagaaacuagccauauaaauagcauuuuguugugguuguuguugcagauauagacugcuuuuuauauaugauauauauuauauguggguuggguuuuucuuguuuuuuuguuuuguuuuuuuuaaucucuuacaaaguuuagaagagcagacuggagcaauagccuggcuaguaggagcacugacuguucuuccugaggaccuggguucaguucccagcauucacaugguggcucucaaccauuuauaauuccaguuccaugggauccaaugcucuuuucugaccucugagggcaccagacaaacccguggugcacagacacacaugcagacaacacauacacauaaaaguaauuacauuuuuuuuuucaagaaaaguucuagaagccaggugaaggccuuugauuccaguacuugugaguuggaagcaggucggucucuuugaguuccagggcagccaggcuauauaaagagacccuaucucaaaaaauccaaaacucagaacaaaaagcccccagacuuugagaagaggaagagagacuggagaaggagccugcgaaggugauuguugugacagccuggcugacuuaguuggcgagccugcuugguucuucaacauuugauucagaugcgaccuccuggaaaccugcuccucaugcgcacacucaggcgagcacagcauccucacauggcagcuggcuagugagcuuccugugcacagcuggagccuacuuucucguggacagagauuagguuguuuuguucauuucuucacuucccugaccagaauucaauuuuuaaaaaauguuacuuccuugagggcacgaguguuaggucuuuguugaauccaucuuauggaaaucugaccuuuaagacuuccuccucccaguucuaaaguauggaugguguccggaggaggcugggggcuuugcaguuuaaacauuuaucuuuuguuuguuuguuguuuugagacagaguuucuuguagcccagacuagcauccaacacuauagcccaggauggccuuaaacuccuuccaaacugugcuucagacuccccaaaucuggguuuacgaaugugcccugccaggaucugcuaacauuuuauaaguuguuaguuauagaagacuucuuaguaauagaaggccuuugcuuaccaagacuuauuuuuucagaaggaagaaaaauaagauuguacugugcucuagugagguagacauuggauuagaacuuucuguuaauggaggaauagaagucgucagcauucacacccgugucugcaguggcagagaaacuggguaaucucaaagccccuuuugacucagauucuuugcuucucugcugauccuucagggcaguuucagugauuccuauguccaaaauagauaccauuugugugccaaacacuauguggaaguagauaauguuauagggggaaaaaaaacccagagaaaaugucuuuuuaguuuuuucaaagcaaacagcuuuauuuaggagaugugcuacagcccaugucugugagcuccuaacuaaauauagccacaacuuuguccuuacauuauuuugaccaaacuuggcuauguuuuuuaauuuguuuuuugguuuuagugucuuguucauacccuagacugucuugaaacucuuuauauauaguuuauagucaccucaaagucaugacaaacuucuugccucagauuccuaacagaaaaugaacuucuuguuuucaacuaaaaccuguagauuaucuucccccagcauuucccauugccacuaaauuguaauacagugcuuaaagaacaagagauuauuagagauuauuucuccuaaaaauuguguuagcacguacuugcuuuaauuuuggccacuucacuaugaugcgucuauguaaauagcaguucucguuuacugugaauuaagccacugaaaaaagucaccuagugacuuaaaacauaguaacauguuuaguuuacaguuuuggagguugacaggguuucuuaggcugaaguaaauaauuaucugucccaaauggccuugcuuccacuuggucuccuacacacaucuacagagagcugcgaccaggcacagggacagcucugcuuuugugaggugcuuggcuaguaugacaacagggucccagagauaaugacccauucaaggccuccuuagguccaggcccagaagugacauuucaucucugcuacauuccauuggucaacaaguugagaauggaggagacauaaacuuuuuuaugugaagaguuacaaagucaaauugcagagugacauagauccagggagugaaagaaauguggccacuuguugaaaguguuggaagucacuuggcugagcuugcuugggaaguccaguagauaagauucucugaacaguucuggaagugucuguuggacugucugcuuaccugucuaccucuuuuuuuuuuuuuuuggacagugucuuauucuguagcucagacuggcucacuauaaucuuccugccucagucuucuaaguauugugauuccugccaugagccaccauuccuggucuaaguaaccucucucucucucucucucucucucucucucucucucucucucucucucucucucguguuuuccauuucugugcuucauucuagaugguucuucagaccugcugccugcugucuggguuagcuguccuccagcagucucaucugcucuuaaguauuuaaguugguuauaauauuuuucaguucuguaauucuguaauuucucgugguugauguuccaaaugacacuucaccguucuuaaguuuauuauugaacuugaaaucucgccuuauuucuccaggcauagcuguguuacaguuuuucuggcuucaguaucaguuguaguuguugcaguugauuggugcuuuuguuggugcuagcuaauggcucacuggcgcucuuacagucuucucacucccuuuucugugauguucccugagccuuagagacagagguagagaagucccauuuguugaugauuauuuaaucauguguucuuaaccaguugcuauccuuuuuucuuuucuuuucuuuucuuuucuuuucuuuucuuuucuuuucuuuuuuguucuuuuugguuuuucgagacaggguuucucuguguagcccuggcuguccuggaacuuacacuguagaccaggcuggccucgaacucagaaauccgccugccucugccuccuaaaugcugggauuaaaggcgugggccaccaugacugguuguuuguuuguuuuucuuuuucaaaacaguguuucucaguguagccuuggcuguccuggaacucacucuauagaccagccuggccuugaacucagagaucccccugcuuuugacucccaaauucugggaucaaaggugugcaccaccaccaccugggugcccaguuguuaguuuuuaaacuuaccauugcccacuguaaaaagaaguuucuuugaccagagcugaugguagcacuauauauaaacauaaacauaauuuuuuuaaacgccauuugaugucugcuucccgagugcugggauuaaaggcaugcaccaccacgaccggccagcaugagaguuauuaacagcagggaggaagcuucccccccaacaugauuuucuguguguuguauacaaccagagcucgugcacucuucagaaguagcaccuuaccacccaauucuagugggcaaaccacaucuauugccugugugcuuuggcaggggucgggggucgggugacugcaucuguguauacauguguaugugccugugcccucagaggccagagagggcaucagaucuguuggcacuagaguuauauacagauggcugugagcugccauguggugcugggaacugaaccuggauccuuugcaagagcagcgagugcucuaaccacugagccgucugaugccuucuuccguccucugucguacaccagacauacagacaaaacgcccggacacaaaguaaaaguaaauauuguucaaaaauguuuuuaauuuguauuuuuugagucuggguuuuucuggcugaccuggaacucauguagaucugccugcccgugccuccugagugcugggacuaaaggcgugugccaccacccauagcaucaaacaaaucuuaacuucagguuaggcagcacauuugucaaguacuuaguuugaauauuaucaguuugaauauuaguuuguauaaaauacucuaggaguauguaaauacaagacguagcuauaaucuugauuuaauagacuaaucaaauuugaaaaaaaucaaucaaaaugauaaaugacacaucauuagguauaaccuaucugaaaugugcccagauccauaaguagguaaaucugaguguaagagaaauguucuuuucuggagcugugaguguguguguguacauacuguaagugaggaggcuggaaugggguacgucauaggaaggagucucuaauacaguguuaacugugugagugcugggauuaaaggcgugugccaccacacccggcugauaaauguuuuuuaaaagacagaagagagggcuggagagcugggucagugguuagaguucugauuagcuacuucuccagaggacugguuuuggaauuccagacauauacauugggugguucacagcuccagggaaucuguuuucuuggacuccauggguacccagauucauauggcagaugcucaccaaauauacacauaaauaaaaauaaucaaucuuaaaaauuaacaaaaggacagaagauaaaaaguaauaaaauuuagcuuccuuauacugaaauaaaauguucccaguguuaagucauugcuuguuuugugccguaugcuguuuaagacauuguauauuucagugaacaaagcagaaaaaaaaagucccuuguccucuuugaacuuguguuuuaggaaggaacuuagcguugccugguaauggucacuguuuauuuuuagcauuucucuuacucuuuuuauagcgcccguuugcuguggugguggauauguggugguggauauguggugguggagagcagaccaguugcuagaacugaaugcagaugucugacagcaggaagaacauucucucagugcggucacuuggcggaacugguuuuguacacacggagacauccugucucuagcaguucuguucucuaggcaguguuaugcugugguugaugaucaugaagcuggcaagaggaaaagcugaucaacucacuaguguacuugugcgucuguaucacauacuguugaugaaaaaauguagcuuauuuuuaaaaagaaauuugaaagaaaauuggaauuuuaguucugauucaaaaugaaaguuuucaggaagguggcaccuuaaauucauucaguaacauagaguuaugaauuacuccucuucugauggguuuuaaaaguuaaaaaaaaaauucuggaucucaauauuaaaaacuagagguagcaucuuagaauugcagguuuaugacagguauggugacauaguccuuuaaucccaacacuugggaggcaggagcaagcaggucugugaguucuuggccagccuggucuacagaguggguuccagggcagccagggcuguuauacagagaaacccugccucgaaaaacaaaucgagaauuucagguuuaguauuuauuuuuaaaauuguuaagauugcauuuauuuauauuuaguuaguuauugauuuggucugagaacaacuucuagaaaaaucacuucucaccauccauuguguggguucaggaauagaacucagaagucaaaauuggcaggaaaugaguuuaucuguugagcuauuucaccaguccuaaggcuuaguauuuuuugugaugggcuggaaacuuuugaaaaaauauuauuuuaucagugugcuguaaagaaaacugucaacuagagauuaauggaagaaauuaggguaaauugaaaagacagaauguaugucaacauuagugguagaaaugaauaaauaggccagagcaugacggcauucccggaauccuagcauuugagaagcagagacaggaggaucaaguuccagguuagcugggcuacacagugaguucagggcuaaccuggaccuauagcauagugaaaacucuaaaaacaaauagacaauugagaugaguaaauaaacuuuggaguuuguauuagacaauauagguuugagguucaguucucuugcugcuagaaaauacccugacaagccacuuaggggaaagggguucuuuuaguucacagucccaggcuacuguccaucauugcugggaagucaaggcagcaggagcuugaagcagcggcucacaugaugguuaagaauggagagagaauaagugcaggcacgacuaugcucagcuuccuuucucaguucuucuguucagugucccuugcuuagggaauagugaugccaacaguggguaggucuucacccuuuaauugauguaaucaagaguucuagaacuguguccaaaggccaauaugauuaagauaguucuucauugagauuaucuucuucagugauucuagauuguuucaaguugacaauuagaacuaaacauucauuauucuuauuugauacuguuuuagauaucgucagauucuggaaaaagccauucaguuaucugggacagaacaacuagaagcauugaaagcuuuuguggaagcgagugaguagaauggaagagccacgcuugccuugaaugacugaguaguucuuuaaagcuuguuggccuguuuuacgcaaucaguguuaaaugugcuuugagaugaacuuauuccaugcuuuuagccacucauaguugggcuauuuuucaauugaauuaucuucaaaguugaaaucccaauuaaagcuuuauacagaugcucugugcuuugccuuugcacaaaaauaaagaaaagggagaguaaaauuuucaagggauuuuccccgauccuuucuuagaaaaguuacuguauuuuuccugcuuugaucuaguagauaagaaaucaguaaaauccagcauaaagaaacuaauuaugcaacauaugagaagaacaugcaagucucugaauaauacauugaguguauuaagugguaauuuuaaguaaaauuuaauugcuuaauggaaacuuacagguuauugauguuuccuauuuuuuacuuucugaccaguggugaaugagaaugucagccucgugaucucacggcaacugcuaacagauuucugcacacaccucccuaaccugccagacagcacagccaaggaggucuaccauuucaccuuggagaagauccagccucgggucauuuccuuugaagagcagguaaaagucuagagcccuagauuuuauuguuguuuuguucuguuuuaaaagucaggaacuagaagcuccuaauuccuaguaacuuuuuuuuuuuugaaaaaaguuuucauauaauacauuuuuauuauguuuugcccucuaucacuuccucucagauguuccccauccagucagcuuuauguucuuuuucucucuuaaaaaaaaaaaagaacgaggccagccuggucuacagagugaguuucaggacagccaaagcuacacagagaaacccugucucaaaaacacaaaaaaggagcaaacacugggacgcagaggcagguggaucgcugaguucgaggcaacuuggaacuuggucuauagagcaaguuccaggacagccaggccuacacagagaaacccugucuugaauaacuaaaaaacaaaaaccagaagcaaacacacacacacacacuccccacaaaaccacagaaacaaaaaucacaacaaacaaguaaaacacugaugagacaaaaaguguccaaacaaagcaaaauaaaacaaaaagucuacagaaauauugaguugggugugggaccucuguccuugaguguggcucauagaccaagaaagacuuugauuuucccuuugccacaaagguaucaguuguaaacauuucuugguuagguguauuccuguuuccuugcuggggcccuggcugucuugaacuugugcagcaagcugccucagucucugugaguucauauggucacccguccuguuauguuaaaacaguaggucuugagcuuaagauaacacauuauuuuuaugaucuuaugcuauuaaaggagauaguugcucaguuacacauuuuuuauaaaacugaaucaaacagcauuuacaaaaucaaguaaguauuaggacauagcaguuccagcuggagugcucguaaagauuuucuauucaguuuuacucuguguauacaaacauguacuucuguguacagauggaggccagaggacggcucuguggaauuaguucuguucuuccaucuacauaugaauucuguggagcaaacucagguuguaggcuuuuguagcauugugccuugagcaacucaguagcccuaguaagacuguuacaauuaaaaguuuaggaaaacuccaacaucaagaauauagcaacauaaaagcaaaauucaauacugaaaacaaguugccaaaauguacaguguagaaauguguuguucaauuuuuuauuuucauauucugugaauacaaacuugauaggaguaaaauaugggugaccauacauaaauauccugcaguguaauauccuggaggagagcacuguuugauaacaucuuaucugucucucuagguugcuuccauaagacagcaucuggcaucuauuuaugagaaggaggaagacuggagaaaugcagcccaaguguugguggggauuccucuggaaacaggacaaaaguauaguaaauaguggacuuggauaggcaugggugggcgggugucacuaaugcgcauuccuaacuccugacgcaggggguacaaacauuuauagagcguuagaugguagcaagggcuucucaaagacugacugaguggucugagggcagaccucucuuuuagaaaggguguuguuaagacaaagaucuaaggugccaauguauucauagccuuuucuaaggaagacuaagaauaccaguguagguagagugaacaucagaaagacagaaagaagucaguccuagggauugguccagucccugagucuugaagccguugugaggucuucgcuucaaagagaaaugagagugccaggcaagguggugcaugccuuuaaucccagcacucagagggcagaggcuggcaggucgcugugagauugcagccagccuggucaacagagaauaacaggcuagccagugcuacauacuuuagacccugucucccugagccauuaugugauuuugagcagagaugugacauggcgugaugaugugcuuuaaagaaccacugaguaccggguggggacucaggugcuggcagcacugaacgguaggcaugggcugcaccaccacaggcuggggagcuccucagagacucagucugcagaguucccaacggaccacaggaaacgaaacggcugaguccugagguuuuggccagagcacuuggaaacauggaguugcccugccuuguggggaauagauuuugaggguuaugaaguguacauuugggauugugauaagcguaccugguagugagcagaguguuuugucuggaggaaguagagcaguuugggcuacaaggagacauuugggagccuuugccuacuagaccggaucgaccccuuuccaggggaggagaggaugcagacggagaagaggagugcaugcugaggccuggggcguuguggucuuaggagguaaaugguaaaggcaguuguagcaagugggaaggauuguccauugagguaagauugccagaauagggugugcuccuccucaguacccauaugaucagaccugugcugaggaguggguaagcguuggcugguuagcauucaccagguguggaggcagggcgauuugacaagagcuaucguggugagcuggugaaggcugcagcugacuggaaagagugaauggagacagcucuuuggaguuuucauaacaucaaaaagcaaagaaccauacagagacaguaauuaguguaagauagaaaccacagcaaaaguuagauguuuuauaauccauuggaaagcaaacauuuuaauaauugguuuuauaauccauuggaaagcagacauuuuaauaauugacacuggguauaguggugguugccuuuaguccaagcacucggaaggcagagaugggcaggucucuugaguuugaggcuagcuugaucuacaaagcgagcuccagauagccagagugacauagugggaccuugucucagaaaaaaaaagacaggacaaaacacugauauugaggaauugguaacagauucucacgggaguguaugaacagaugggaauccauagcggcggggcauuuagacuggcguggccuuugucuaggggcuguccuguguguaagguuagcagccuggcucuucuuucccaggacagcagcacugcugugccuuguaacagucagaaaugccagaugcucccucguagagggaugacuagagcucaggacaggcugugcgagcacaggacaggcugugugucagugacagugggguuggugcaagucugccuugacagcuucucucagugaacagagcccgcacagcagugacagggcugggcugugacacugagaggacacaggaguguaauggaggagaggaguccuuaagagauuagucauugucacuuuuaaaguaaugaaaggauucccugauuaaaaaaaaaaaaaacuggaaaauuaaagaaguuuagcaugauaggacaguucauaugaauuugaguugugaaugggaaacauaaacugcugauaauaacugagcuaagcaaacaguuugaauucauagaaaucugugccaugaccugccccucucucacaaaacauaaaacaaguaagacugaacuucacagugggagccaggagaauucuaaggauuuuuaaauuuuuuugcuuuguucauuauuuguuguuguuguuuguugcuuguuuuucuugucacaaggcuuuacuguuuuggcugucaaauagaaaagauuacuuuuuuuugaggauuaaucaugaauuacgaguuuggaauuauugaggccuccaguucuucacuccuggaguaaaauauugccuguggaggaggaaagagacugaaaacugucuuuaauucaccacagcccuguacacucuccacaacccuaacugagauuauguuuuguuuauguaaaaauacauuuuacuugauggcagaaauacauuuuaaugauguuuaauauacuauuguauuccauguuguauguuuuugacauagucucacuacuuggcuggccuagaacuuaguauguagaugaggcuggccuagaacuuaguauguagaugaggcuggccuagaacuuaguauguagaugaggcuggccucaaacucacaagagaucugccugccucugcuugcagagugcuggucugaaagauguguauccccaugccuagccauagcccacuuuuuuacuugaaagaaaauacauguugucuguaagcagcuaguaaggaccauagcuguauacuuucuaccuuuuuacacaccauagcuucgcucauauaaauacuauagcagugauuuucauuuuuuccuaacauaaauaauaauuuuacaaauuaauuucuuuguaauuaguacgugagcacauuccuuauugugucuaguaggauuaaaagcauacacauuaaagaauccaaaagcauaauugcagaguuaauugccagauuggucucugggcaggcugagccuggaugcaguuccacuauaguguccgguaagccugaaacuuggcacuugugucuauuucauuuguuugcuugcuuguuuguccuagacaguacaacguagauuauaagcuggagacuuaccugaagauugcaaggcuauaccuggaggaugacgaucccguccaggccgaggcuuacauaaaccgagcguccuuacuucagaacgaauccacaaaugaacaguuacagauacacuauaagguaacaagugaccuaaucgcaacaccugugaugaauguucauauguuucagaaacucucuucaccucuugucuuugacccuccaguuucccuaauuggagcauuuucccccuauagguuugcuaugcgcguguccuugauuacagaaggaaauucauugaggccgcccagagguacaaugagcucucuuacaagacaauaguccaugaaagugagagacuagaggccuuaaagcaugcacugcacugcaccaucuuagcaucggcagguaagcaugauuucagccucagugaaacgaguugucucugcugauaacguuagguagcaaccacuggauuacuuagcaagcaacacuucuaggggugccucaguacaauuaaaguaaguuuaaacaugaaacaaccaggaauaaaaugauuuauucuaaaaacuuaagugaauguaucagcuuguuaccuacacauuaagaauaguuaaaagagguaaguuuauuuuuacagaaagagaaaugguucuuaaaggagaacuacagaggaggaaacaagcccaauugauccccagcacccacccacgugcuggaaggagagaagagacuccugaaagaugugucacccccacagaugugucagcaugggggacucuuucacauacacaaaagaaaccaaaagguuuaaaguauucugcuuucaggguuuuuuaaaccuuuaagcuuaaguuucagacuagcauucauucuuuuccucaauacauaggaaguuuuuacuaaauuguagcauagacgcacauagcuuuuaaauagaaaaggcuguggugaaggaauguucaucccaaaccauggcuuuuuaaaaagauuuauuuauuuaaaaaaaauuuuuaaaguuuauuuguuauuauaaauaagaacacugucagaucucauuacggguguuugugagcuaccaugugguugcugggauuugaacucaggaccuucggaagaacagucagugcucuuacccacugagccaucucuccagcccccaccauagcuuuucuaaaucauucugaagucccagaucuguagucagcugagagcucaugacauguuuaguucuuacacuuaacaacccucuucugcucccucuauuuuuuuucuuuuuccuuuuuuuuggggggggggcacagggucuuuuuauugagucuuggcuguccuggaacuccauguauggaucaggcuguccuccaguuuacagagauuugccugccuccgccuccagagugcugggauuaaggcuuaaaccaccacuuacauuuuuucguagcuaagugccagcuguugucacaucugacagauucacuuugauuuucuguuguuuuacuugaucauccaggcagauccaaccuguggcccagaaacuguaugcagccaaggauggcuauaacugauguccagggugaaacuacaaacacuccuaaaauaagagggguugguuuguuuguuuguuuuguuuuguuuuuguaacucagcuacaugguucuccagugugaacauuguaguuguuaagauuauuucagugucaaaagguuggacacaccuggaugcacagggguuauuuauagggaugaguuuauggauaaauuaaacuccuaaguccaaagaauauauacuuuuaauauuuggauagaaagugaacauugcuguaauguuacaucacuccaaacaaagaugugcuugauguagaccauggugaccuggaacacagauucuccugccagccucugccucccaaauuguucugcuuuuugaugcucacaucuucccaguaugacuuggauauagucccagcaguguuucaauauuucucuguauucuaacauaaaaaaaaauaaccuuucuaugcauuaggaauaucauagauucccagcacuggaaaacaaaacaaaacaaaugcuaaaaaugaugucuuaagaucgaguuuauaaauauuuuuuaucuuuuaauagaauacuuucuuaggauuuuuuuuuuuuaaguuuuuauguguuuguuuguucauuuaaugaguaugaguguuuuggcuacauguaugccuguguaccacaugugugcuuggugccuacagaggcuccuggaacuggaguacauagacuuuugugaguugcaauguaggugcugagacuauaaucgggguacucuggaagagcagcucuuaaucacugccugucucuccagccccuuaguuaguauuucuacugcugugauaaaacagcaggacuaaaagcagccuggggagaaaagggguguguuguuuauacacccuggcucuuaguccauugagagaagccaaggcaggaaccuagagagcaagaacuaacgcagaggccgugggagaaagccucucgcugucgugcuccccauggcucacuccacuugcuuucucacaccauccacaaccaccagcccaggguggccccacccacagugagcucagcccuccuacagucguuacugucaaggaaaaugcccccacaggcucgcucgcaggacagucuaguaaagacauuuucucaguugagguucccuuuuucuaaaugacuccagcuguaucuguuggcauaaaacuagccgggacaaauaccaggauuuagacccuggauguucccacggcuacuagguguagguguccuggugacagaagacagcgguugcugacagcauuguuuccacucacucgguauuagucaccagguguuuaaaggcucuaaauguauacauugagucaguauuguuucuuagcagagaaauacugguuuuguucuguuucugagacacagucuuucuguucaguuugacuggccuacagcuugcuguguaguucagacugguggaagucaugcuucagccuuccugguucugggaucacagaaguguauuccaugcugggcauauauauuuuuuauuaacuaaauaauguacuauuauauauacaagaagaaaauagaaaucaccuaggcuuacaaccuccuggaccauuuugaccucuacccugguccauuaugugaacauucaguuauucucauguaucuacagauuuuuuguuagugaacauaucuagugauuaaaauuuauuuugaacuaacccaaacucucagguuuuucaucauuuccagauaugugcagacuaaguagcaaaaugaguuacccaaucucugucuccaggugagagugggcucagagugcccugccucucuacagcccagcuuucaaccuguaagcaagcgggcuuuugugggcuucgcaggggcuccuccccauaguuuuaugcccuuuuugaugaguuugauguuaaaaugguucccugauggacugcuagaugcugucuagugcucugugugugugugcacgcauguguuuaggugugggugcuagugggaacuagggguagacaaaguguauauauagucuuggcugacucucacugaccucaaauuacaggccugcaccacugugcccucuaguguucauaaguauagacagucugauguggagguuuugugugacaaaauaguauccuguaagcucuaauuugacagcauugcaguguuagcuaugaguucaaagcuaaugaauuaacccuauauguuaaguaaggguguaaacagaagcacgugaaacaaaguugcaguuugauuaaaguugacaaaaaauggacuaggggcuuagaagaaccuaguucuguaucuccaauagaaguagcagcucagcauuaacugugguacaaucaauaacuuucuagaacauacuaaauaaauguauuaauggggauuguauguauuuuaguaagcaaaaaugggaucauagaaugugauucuuuuugucacugaagaaacacuuagaacauuugacccucuguguuucccuaggacagcagcgcucucggaugcuggcuacucuuuuuaaggaugaaaggugccagcaacuagcugcauaugggauccuagagaagauguaccuagacagaaucaucagagggaaccagcuucaagaauuugcugcuaugcugaugccacaccaaaaagcaacgacagcugaugguaaugaucaugucugacgugugugugacagggguaucuagguauagauuaguagaaaauauguuacauuaguauuuucaaguaauacuucugauuaauaaaaagaggacuauugaccaauaaugaguauuaaacacugacauagguuugugguauaaucugaaauaaucccuauuggaaagcaguuuaugaaauacagcauuuuuuucuucuuuuuuuaaaaaaaaaucuuauuuguuuuuugaaacuugugaaaacugaaaaauuauagcuuguaccuaugacaccugaauuuuaaaaagcuuaagccauugguaaauaaaacuaaauaacagauuauauuagagcauaauuauucaucccuaauuaagaguaaaauuuagcucaguagcuugcccaaggacccuugggguaaaaugguccaaauaggaauagguuuccuuucauauuuuuugguuaaaugaugugauugcuuaaaucagaaugucuuugccaggaaaauguccuuuuaauauuuucuaauucauaauagugacuauuuuauguauuuuugucuaagauguuuuaaagucccuugcuaacaugaccaugauacuaaacauagagguguggacacacugaaccaugcauggagcagcaucagcaugcaagccaacuaggcuugcugcccaggucacugucacucuguaccagagagcaauuaguugugaggacucauuuguacugggcuggcugaaaggucuuaacuuuaaggauuuuuauuuaugugcauaagugugugucagugugaauaugugcugaguguguggagguguccugcaaggccagaagacaucagccagugcugugugcugugugcugugugcugugugcugugugcugugagcugugagcugugagcugugagcugugagcugggugcugugagcuugugugcugugugcugugugcugugagcugugagcugggugcugugagcuugugugcugugugcugugagcugugagcugugugcugugagcugugagcugugagcugugagcugggugcugugagcuugugugcugugugcugugugcugugagcugugagcugggugcugugagcuugugugcugugagcugggugcugugagcuugugugcugugugcugugugcugugagcugugagcugggugcugugagcuugugugcugugugcugugagcugugagcugugugcugugagcugugagcugugagcugugagcugggugcugugagcuugugugcugugugcugugagcugugagcugugagcugggugcugugagcuugugugcugugagcugggugcugugagcuugugugaugugagcugugagcugggugcugugagcugggugcugugagcuugugugcugugagcuggguguugugagcuugugugcugugagcugugagcugggugcucugagcugugagcugugcugaggccccagugugccugcucggaaccaaacucagguccucugcaagagcagcccucgaguggaaugugcugaguugugucucuaggccaagguuuucuuuuucauagacuuuucuuaagcaccucaggaaaauuuucucugugguuguaggauuacuaaugguucuucugagcaguuaguuuuuguccuaguuaaacauagugugaauugauaaauugauucucuuauuuuucuugacuucuagaaaaauuaaauuuguaacccaacucugaguaguauguaugggcuuuaguugaagcuaauccuccugcuuuguuuuguuuuaacuugagaauuuuaauucucuguauagucuaagcagccaugacuuuaaaaaaaaaaaaaaaaaaaaaaaaaaaagucugauguacaaauuaauuaaaagcuagguugaaaguugaucuuucagauugacuuugagcuucuagucaugggaagaaaguagaaaacugccccauggguucuugaagagaaggacgcaggucuguguggggcgaaaggcugcuugucugcugcccucaucugacccagcccugagcugcaaucuguucuuuuguuagaucacaaucucauuuuuaaaaaaauaauuuaauguaugugaguacacugucacugccuucagacacaccagaagagggcaucagauccuauuucagaugguugugagccaccaugugguugaugggaauugaacucaagaccucuggaagaacaguaauugcccuuuaccgcugagcuaucucucuagccuccugacuuagcaauuuuaagacauggugucugguuuauuuuuaaauuuaaaguauguucauugguuuucauucugucuccagucauguagcauuacugccgauacaucucuugcccuauagauuugccuguuguggacauuucacguuaauggaaucaugaugcuguuguuauggccugucacaauuggcuucucucacuuagugccauagcucauccgugugauuaauacucauugccaaauaacauucuaguauguggaugcacguucauggacaggaaaauuguucccacgugggggcuguugauauugcugcuguaaggcuuuguguugaaguuguuacauugugugucacugugugcauguguacagucuuucccuuucccacaucugccccuucuuccuuuucuuuugugcuugagguugguuuuguggccucuaaugcagacauucuacuauuggaccagucuacauccccauccuugacuaaaucauuuuuuaucuuccuuucuucuucugucuucuuucuuccuuccuuccuuccuuccuuccuuccuuccuuccuuccuuccuuccuuccuuccuuccuuccuuccuuccuuccuuccuuccuuuccuccuccucuuccuccuucuucuuccuucuccuuucuccuccuccuccuucuuccuucuccuuucuccuccuccuccuucuuccucuuccuccuccuucuuccuccucuuuuuuccuccucuuccucuuccuccuccuccuccuccuccuucuucuuucuucuucuucauuguggaggaguggugagcaguuauaagaaaggguuuuguagaauacuuccuugaaggucucuaaacaucccuguuacagcaacugcucuguaguuguauguuaaacacagucaucacaaaaaaaccuaggagaggccagcaguucaggcuuuguaaggggcuagauucccuaauuuacaggaggauucuguuucugaacuccugagaaaggguagcugacccuaccucugggauaugcccccauguuugccucacaguaaggugaccaaaagaaugagcuaaggggcucaugaguaaguguguacugcucuagugcagaggacucaaucccucugucccuuagcaguugcucaccagcaucauugugugcguuaccuccuugacauaaccucacagaagcagcuaaagucuggauggaucguggcuuacagugugagaauauagagcaccauggugugcacagcaugaggacaggugugugggguggcaggacacacggcaguggaggcgcucccuggcuuucuccuuuucagucuaggaccucagcccagggaauggcgugccacauucaggguagcccuucgcucuuaaauuaagccugucugggaacacccucacagacacacccagagguguuuccauggugauugacuauuggagauuaccuaucgcauuaguuuucuaaauacuguauuuuauuucauuguauauaaacuauaauuguaaauauacucugauauauuagugcuugccuuuaaccuuagcacuuggaaggcagaggcaagcagaucuuaguuuaaagcuauccuggucuacagagugaguuccaggacagccagggcuacacagagaaacccugucuggaauaacaguaauaguaucaaauguaaguuuuagugacauguugauuagaaguauaaaacugauuacuacauggcuagaaauaaaaauaaagguauaucuuuuaaaaguauaaaacuaguuucaaacauuuaaugaguuuauuuauguuuauuuaagguuccagcaucuuggacagagcuguuauugagcauaauuuguugucagcaagcaaauuauauaacaauaucaccuuugaagaacuuggagcucuuuuagagaucccugcagcuaagguauuuuucuuaauucacuacuuuauaucagggaaauugaaaccccagacuauuaaaguaauggagagauaccuacgagauaauguucgugagcacaacaaaagcuacauguuucuaagccucaggggaaacgggaggagacuggugaaaugcuguugucaugaaacuuaguggcuuuagcuuuuuaacuuucuaaugacaguuacuuagaauggaaaucuucuagaaguaccaaguuauaccuuuugcauaaggaugucuuuguguagugucuuaaagacacugauaacaaaguucuuggaauauuagauggugauugcugcuguccuuguuccucuacccucaauggacucaaagguuuagugcucaucucugaccccaagcuguccugcucuacuuuccuucccagugggguuucaccuaaaggguaguuaaccuucuagggaaucuuagugcgguuuuuggauuugguuggucauacacaaauuacagcacaauaccaauuguauugauacuguaucacuucugaaacaucuuaauuucagauaauauugagaguaagcaaucaaucuuucaccuuaauuaaagucauguaguuuaucugauuaugaaguuuuuuuguuuuucgagacaggguuucucuguauagcccuggcuguccuggaacucacucuguaagugugagugcauacguuguuaguaauagauuauaaucagucaguaggaguggugguguauugauuguaaagaugucaggggcuggagagacagcucagcaguuaagaacacugacuguucuuccagagauccugaguucaauucccagcaaccacauaguggcucacagccaucuauaaaugggauccaaugccaucuucuggugugucugaacacagugacaguguaccuacauacaugaaauaaauaaauaaaucuuuaaaaaaauuggcuuuuuuucacagaggaccuggcuuugauuccuggcacccaaacagugacucacgaucaucuguaacuccagugucaggagaucaaaugcccucuccuggccuccaccaaaagaaaagagcaaaaagaaaaacaaauuuuuguuuuuccccagaauccuaaggcaauuuguuauuauuuuaagauuuuucuuucaaaucuuuuuuaagauuuugauuauuucuuucuguauggauuuuaaaaacuuuauuauuuuuauauauguguguauauucaugugaguauauaucugugugugcuuaugugugcccaauaaagccagaagagggcuucaggucuucuaggacuagaauuacagucauuugugagccacaagugagggugcugggagcugggcugggagccucugcaggagaagugcacacucuggaccauugagcugcuucuagucccguguguuggcugcuuugccugccuuugugucucugcaucacaugugggccuggugccuguagaugucagcagaggguguuggagccccugagaccggaguuauggacaguggugagcugcugugugggacucgaaccccagugcuauugaccacuaagcucauuguggcacauugcagggaagcagugggcaguggcaggagcagaacuuugugucugccugcaguuuuaaccaaccucccuuccucccucccucccucccucccucccucccuuucucucucucuuuaagauuuggguccuagugaacuuuugaggcugucuuuguagcucaguuggcgagugucugcuuagccauacacaggcucuggaguaaauccccagggccacagagacugcacgcaugcuacccuccuguaauccuggcgcguggggagagaggcaggcagggggcucagaaggucaggaucauccucagcuacauaggggucagccagggacaaggagacucuucaucaaaaaauaaaaugaaauaaaauacaauuuuaagcagaggggaaaaugguuaaaaaaaaaaaaaaagaaaggcuggauucuugucuagccagucuggcaugucuguauuccuagcacuugaaggagauuacaagacacgucccucaacaagugacaggcaagcacaguagcaacaggggcuaagccaaaggcucucacucaguucuccgugaacggcugcuaaaugugaucucucagguccugagauuguuuugcuuuuguuucuaauaggcagaaaagauagcaucucagaugauaacggaaggacgcaugaauggguuuauugaccagaucgauggaauaguucauuuugaaaguaagagcauuuaugcauucuuaucaagugaaauggcaguaaacuguuauaugauuaaaauguguugaauuauuucuuuaggcccagaacuauguuccucgugagcauauguccaaaggaaaucauuuaaaauaaccuuaaaaggcuauauuuaugaauauuuuuuaaacauuucuaagcuaaggaaaauguaacugaaaugguaucagguuacuuguuuggucaucugaccuucguugaacuccaaccauguguggcucccauggagugacaguugcaguuccuauucggaaagucacggagcuaauguaggcaugcaggugagugaccucccacugcgugagaccugcagcucuuguuccugcuucacgucuggagcagagcacugcucacuaugaagaugcugcucaggccuggggcuguguugugcucacugauccaucucccucacuccugcuuucuguacagcuccucucuggucgcaagagccacugugugcucucuuccacuuccuuccagucagcgcagcccuuucucucuucucuucugcuuagguggacccagugaucccuugcucaguucuguucucacugauucccuagaacaaggucacggccuccuuuuccguugacuguugugacaugcauauguauguggauaugcacaugcauguguaugcauauguauguggauaugcacaugcauguguaugcauauguauguggauaugcacauauauuccuaacuacaaccuccucagucuggguaaugcugcuugucuguguuuucagagcugagcuuuugguguuggggaaacgauuguugugcucuucccugugaggacugguucccccucucucucggccuuccucaguugccugugggacacuguuagagccuacugaccuuguaucccagcugugcauccagacccgccgccucuguccugcuucacuuaggcuaggcuagucaguguugcugguggacagucaggaaccagacagcaccgugaguucaaggucacggggucugcgucacccccuggauccaugcuucauuuucuaagccaucccguuuccuacacugcaguauguccuucagguuugaggggguuuugucuuguuuuuauuuuuuaacuuuuucuaaagagaaaccauuucccauuucauuuuuuaaaacugucuugaucagauuuaugaagcccuaaaugugagguauagguauuauuauuauuuauuaucuucuaucugcccuuucccgugcuccaagggucccuuccugagccccgcucuucacacacucgccaaaaggagcuguguuagaagcccgaaggaaacacuguuuuagcuuuuuaaaauucugcugacuucuuuccauugguccuaaacacgcacaggucuuccaaguaggccagaugccuuuuaucuuucaggccuuuucuuuucuucugaaguggagucucugccacccagccgcccagacuggccccugauguggagcuucccccaucuuugcuuccugagugcagagcucacaggggugaacuggcaagccugcuuuagacuuuaucuugguuuuaauaaagccaauauugcuggucccuuuuccuugugcacgcgguaccacaccauggccauccugaugcugucgacucugccgcccuguccugccccugccgccuuuccugcacucgcagcuguucuucacgucaucuuuauggacucugugaugcccuuagauuuaacaucagcuacuuacggcuuaaucccaggccuuucccacuacaggcauugagucuccacgggugauuucuaccccuugauucaguuaguauguuuggaaguggcuggauuugcuuguaccagucucuucucuuucucaaaccuguagcucuaguucacaccuaaggcgucuauauuagauugcuuaauagggauuuaggacaaacacagguccaaaacuuucuaguuagccauuuaaaaguuacauguuaacuuuuuccuuaauuucuuauguuuaacuccuguaucuuucauguccuauaaauuacaacuccuaauguucuuaggaauccauguacuuuucuuauuuuuaaaaauucaaauguaugugugcgugugggugagcacauaccuuggagcauguguggaggucagagaacacuuugcagucaucauuccucuuucuacucugaggauuggggucauucucacauggccaggcuucacccucagagccaccugcggccuggccccuucucuucguuuguauucccugugacuuacagaaugcugcugucacagccugugauguuuuccacuugucuacacuugcuuccuaaccuacuuucuccaguauagccagagucacuguggucuuaaagaaaugaaaacagggcagagggaagagaaagaaguucaauuaaagggaggaggggacuggauggcuccaaauucuugcaguggagucagguucaguucucaguaccaucugcagcuccaggucuagguuaccuccuuuucuggccucuguaggcaccaggcaagaucaugguguacacacacacacacacacacacacacacacacacacacacugaggcgaaacacuccuauacauaaaauaaaaugugggguuuccuuuuuuuuuuuuuuuuuuuugagucuucuuaaaugaagagguggugcacaccuuuaauaccuuaaucucagcucuugggaggcagaggcagcagcagcagaucucugugaguuugaggccagccuggucuacacagugcguuacaggacaggcuauacagaaaaccuugcccuuaaaaaaaaaaguacucaagauaguguuucaaguagauuuuacauugucuuuuucugcuguaaauguuaaauuauuuuuuggugagguagacauauucucauguguagauccagcguucuccuaguagauggcaguaucgccccagcaaacacugagagccugacccuggagugaggcugcuuuguggucaucuugucuugauaggucuucagucguugauuuuguuuucaagggcauuaguaauaacauuuucauuauguuccauuuuauguuugguguuagugauuugcguucuuucuuugagacagugucauuguguggcccucuuggaugacuuggaacucacuguguagaccaggcuagccacaaacucacagagauccugccuacuucugucuuuugagugcagagauggaaacucugccauaccaugcuuggccugagcugaguucuugccaagagucccagaauaaacaucuuuuaaaaguuaacacuguuguaauuuaucuuuuagccucgauuugugaguaauuucuaucuucccuauuauuuuauucuuuccuuagcacgagaagcccugccaacaugggacaagcagauccagucacuuuguuuccaaguaaacaaccuccuggagaaaauuagucagacggccccggaguggacagcacaagccauggaagcgcagauggcccagugagcccucagcgcugugcgcacugcaucuuugccacuucgugcagauugauucacugccccucaaagcauuugcaucaugaccuuagacaucucagccuccuuugcuggaucccacuugaagaagaugcuagagcaagaagugcaucguuuaaacauaauagcucccgugagaucugggucuguguauugaacuaacucagacgcuuugaaaacuuguucuuuaaguggaagugaaagaccugaaguuugggauuugugaucacuuuguagucauguaaaacuuaagugcuuugugccucuccacaugugguuacucuaauaaacggagcggugagccaaauaaaggcaguacuugguuuuuaauuagugagguguucuauuccuuuucuuugaauuuagaaaaguuaauuucuguaucuuaugcuacaaauacaagacuaaguuggagcuuucugagccccagagcuaagggcauaaggugacgcuggggcuugcacagccagagaggcucaucacuuagcaggagaccaacaaggacgcuuucacaggugccaauuccaaugugaccaguagagagugugcagaaaagacuuuaaaaaggguauagaugacuucuuagccccagcaauuacagagcuuuaaagagacccacccacuuaaaacaugagguugaaagucagugucuugcuuagauccuucagaaagaugaagucacaagaugaacggcccccacaucuggacagugggcagaaugcaggguuguaguucaucagcuaggagguggugaugcugcuggaaucagcacuugcuuagcaacuacaacagaacugaccuuccugcugaccaagaaagcugggcauauccuauucugucaaauguuucucugguucauuacuuugccacucaguuuacacgugggugcuuucuucuacaaacuaacuuuaccuuuggaauuuaauguuuguacuaaggguuugucuguguuccagccagagggauuacaggugcuaagggcugagccacaccuagaaacagguuuuuuucaguaaacaguacagucucaggguucacucugugaucaaauauccugccacaaaguacagcccuuuuuuucuggaaauaugccggaggacaguaguuaauuuugaaauaauacccaaauuauuuuccauaagacagucuugacuuuuaagggaaauuacuuugccugggcuuugccugaccuagagaauggguauauaauucuagccuuuuuuuaaaccaguuuucugcacgccuaggagcaaaugacauacuucugaaguucaaagcccagggauucaggcuaaauaagaagcagacauaaggggccagcaagauggcucagcugguaaacgcugcaugcuggccucauuccaaccccuaaaacccagacaaaagaugauggugugugucucuagcccaaacaccacugugaugagauacguggugagaaacggggagaacuggccugaaucucaagccagcuggccuggagugugcaguguggcaaaccaagggagacccugcuacaaaacaggguggaagccaaggagcaacucaaaaccuuguauuccagggcuggagaggugggucagcaguuagagcauuggcugcucuuccagagguuuuggguucaauuccaagcaccucccugguagguaguucauaaccauuuguuaguccaguuucagggcauccgucccccuuuucuggccuuugaaggcaccagugaggccuagauaugcaauguaggcaaaccacacguccacguaaaacaaaagauaaacacuuugggaaaaguuuuaaagcuugucuucugacuuccacauguacacagugaguggcacauguguggcccuauucacauacacaccacacauaguuaaaaaaaaaaagaaaccaaacauuauaauguuauagagugcuucccaaauauuaccauaaugucagggauccauugaauuuugacugagagugcagacccaaagaagggacucccccucagaacagcuaggaggaaacugcagccucuucugucacagcuacagggaacaacggccuaguuccuacuuggguaagcaugaaaccuccuaccacaaaccuaaggaacagcagccugcuacaucaugcugacuuccagccaaaauaucccaaacucggggcuugguagugcacgccuuuaaucccagcacucaggaggaagaggcaggcggauuuauuucugaguuugaggccagccuggucuacaaagugaguuccaggacagccagggcuauacagaaaaacccugucucaaaaaacaaaaaacaaaacaaaaaaagaguugccuuggucauggugucucuuuacagcaguaaaaccuuaacuaagacaccccaaaagauaagacaaccauuguaagagagcugucaggcaucagaacaagacuaauauacgagaggguaauuaucagaccaggaauugaaaacagucgugacuaacaugcuaagggcucuaauagaaaaagaauagauagauauauaaacagaagguugaaacucaagauugaagugcaagaaauaagcaccugagagcauccacuugggaggcagaggcaggaucucugugaguuugaggucagccuggacuaugagugaguuccaggacaccugggguuguuacacagagaaacccuauauugaaacaccagcaucaaucaaucaaucaaucagucuuaguuaggguuuccauugcugugaacagauaccaugaccaagacaacacuuauaaaggacaacauuuaauugaggcuggcuucuagauucagagguuuaguccauuaucaucauggugggagcauggcaguguccaggcaggcauagggcugggagagccgagaguuccacaccuugauccaaaggcagccaggaagaggcucuccuguacuggguggggcuucaaaaccaacucccacagugauguaccuaucccaacaaggccacaccuccuaauuguaccacuucccauggguaccaccacaaaauaaguucaaaacaaaacaacauuagacuggugaugcuaagagaagaaauaacccaaagcuguagauagggaaguugucaauaguaaaaacuucccauacuuaagugugaagugacaaaguggaaccagaggauauguaagagcucucauaccagaaauaucaaaagaaacucuucaggauuuuucucugcgcagccuuagauguccuugaacaggaccaggcuggccuggaacuugaucuguccaccaggcugccuuggaauucagagguccuccugccucugccuccugauggcugggacuaaagucauacaccaccacugccuagcuuccuuugucuuuuaaaagaagacuuagccuggugguguuggccuuuaaucccagcacuugggaggcagaggcaggcggauuuuggaguucgaggccagccuggucuacagagugaguuccaggacagccagggcuauacagagaaacccugucucgaaaaaacccaaaaaaacaaaagaagacuuauuuuuuuuguguaugaauguuuugccugcguguauguauguauguauguauguauguaugcauguguguauguguguuaugcauguauguuuaugcauguauguauauaugcaugcauguguauguauguaugcauguguuauuuuaugcauguguuauguauguauguguguauguauguauguaugcaugcauguguauguauguguguauguuuuaggcaguuuggguguugggguccucugugggaucuggaaggcagcaaaggcugugaauggauaaccuuugauauagaggaggagagugaagccccacagggcacccuccuucacgagcugcaaaggcagggccagagucuaucauugcucucuaugacaugcaggugccuagauuuuuuuaucucacugaaguuuaacaauaaaucucuuaaguaggaggauuuaccuuccucccugacccuaacaaaugaagaggacucaaaagcauugaaugacuauuggaaauucucaaauacaauucaggauagguaggauaaaaaguguuuuuaaaucgccuuacacauuuauccaucgauauuuaaccaaaaccaagucauugacuuugacaaggagagcuuuauuacuacuguugcaggaauuguaugccuuuccagugagcagucacuccucucaggaaaguaaggagggagccccuuacucgcucaaggcugacuuuggcuaacauacagagcuggccuaauagagaacggugaaaucuuuuuccuuuuauguacuuuagguuuaugaaauuuauauacauggucauccuuaaaucucuuuuguguccuaacacagguuaugauuugagcagcuuaaguaggaacaggagaaugcaaaucuggucgccuggaaggaugggggauuuacauagcaaaggcguugguuacuagaauuauuucucucugaaguaugccagcguugguuguucuuugcaaauagcuguuacccggauccagcuugcccaccuggcaggauuggucuccugauaggagcacaggggacucaauggcagcuagaaccuacugauggcuguccccuugagcugccuguuagaagcagguucuuuggagauggggcuaauguuugauaaguccugaugacugaauguuuauguucuugcaucacaaauuuugcuuaucucuagugggccugguuagcuuacugguuaucucugagguauguggugguguugcacccuuagcuaaauucuacuuccugugaguuaaugucuccuacgaaaaucuauuggcaaauccuuuuauaacaucaauauuauacucugaguuucuucuacaucacuaccuuauauuuaagaggauaaaaaaauaccacaaaccucgcaagcauucuggaagccgggccugggaugcccacugcacagucugcugggucugugcacaugcaggcaggggaugcccacugcacagucugcuggaucagugcacaugcaggcaggggaugcccacugcacagucugcugggucugugcacaugcaggcaggggaugcccacugcacagucugcugggucugugcacaugcaggcaggggaugcccacugcacagucugcuggaucagugcacaugcaggcaggggaugcccacugcacagucugcugggucugugcacaugcaggcaggggaugccccugcacagucugcugggucugugcacaugcaggcaggggaugcccacugcacagucugcugggucagugcacaugcaggcaggggaugcccacugcacagucugcuggaucggugcacaugcaggcaggggaugcccacugcacagucugcugggucugugcacaugcaggcaggggaugcccacugcacagucugcugggucugugcacaugcaggcaggggaugcccacugcacagucugcuugaucagugcacaugcaggccuggcauuugcacugcacagucugcugggucugugcacaugcaggcaggggaugaccacugcacagucugcugggucugugcacaugcaggcaggggaugcccacugcacagucugcuggaucagugcacaugcaggcaggggaugcccacugcacagucugcugggucugugcacaugcaggcaggggaugcccacugcacagucugcuugaucagugcacaugcaggccuggcauuugcacugcacagucugcugggucugugcacaugcaggcaggggaugaccacugcacagucugcugggucugugcacaugcaggcaggggaugcccacugcacagucugcuagaucagugcacaugcaggcaggggaugcccacugcacagucugcugggucagugcacaugcaggccugggauuugcacuucauagucugcugggucagugcacauguugauaagcaacagggaagggcugaaaacguccacugucucagaauacuucguuaucgguagcuuguagccccacaucaucccaccucaggcuucauggaucaaagugccgaauugcuguugcugaaagucuaccauccugacccugaaccaugggaggaaaguugagacugcaccuuuaagauuaauuggugacacaagcauuugaaugauggccaagaugcguaaaccauggagggcuaaaggcguggcuuguggggguuggggguuggcagcgaguacgaggcccuaauguuaauccuuagcaccacacacaaaacaaaacagucuucuuagcaaaaucuuuuauuugguuucuaccuaaaauguaagguaaaaaaauuauaggcuccaauauuugaugauaugggagcaagaagaaaccaagucaaagagcaauauccauuuaaaauaaaucaaaaagcccaacuagaaagauuucaccguucucuaauuaaauggauccaucccaucucaguugccaaagauuugaaaaaucucaggcugaaggagugugugcugaguugagcuucuucagccagagcucuugccugugagggaagcacaaaacaguuucugaaugucucaaucuacucuuuuauuauuaauaacauuaauuugcagaaucguuuuagaaacaccgagaaguuacacagaucauacggaguuccuggacacccugagcccuguuccccuguugguuagcauccgguguucccguggcagauuuaucacagcugacagccagcaucggcacguuauuaaccagaggggacuugauucagaguccccucagcuuuuccgagcucgcaccugauagugaggcagacuucucuuagagaaaguaacaacugagcagcucucugacagguaauugccaccugacuccaccuuuuuggcuuccucucacagucacugaugaaugacaaaugaaugacaaacuucucuagaacccaagccccacugcuuuucaagaaacugccgucccuacagacccgaucuuccucuggcacucuguguaaaggcaugcagaaacugaguucuauuuagggguaucuucugagcacaaagcuguaaggaccaggaacugauuuaucuuuguucacagcaacaccuagcugaucuuucuuuaugcaguauuugguacguaaaacaucauuugccaaacaaaugaacagcauuguacgcaucuuucaagaauuacuugugagaugcugaagagagagcucagcuguuaauagcauuuguucucgcagggaaacuggguuuuguucccaguaccauggagaggcucacaaccaaagaggaccuggcacacaugugguagacacacacacgcacacacaggcaagauauucacauacggggcuggugagaugguucagugguuaagagcacugacugcucuucggaagguccugaguucaaaucccagcaaccacaucauggcucacaaccaucuguaacaagguaugacucccucuucuggugugucugaagacagcuacaguguacuuacauauaauaaauaauaaauaaaucuuuaaaaaaauauucacauacauuaaauaaaucuuuuuuuuuuuuaaacgggaggguuaggggcuugggagacagcucaggguuaugagcacuugcugugcuuucagagagcagaguuguccccaggacccacaucagguggcucacaagugccaguaaggccagcuccgggaaaucuaacgcccuuuucugggcucuguggguaucugcauacauguguaauacauguuacaaauauuacagaacauaucauuccugcuuuuuaacauuagauaucuuaaauuucucaccucaaaaccaucaucauagcaagaacuguguuuuugccuucuuuuuguauuuguuugucuuuucaguuuuuaaagcucuucucucucucucucucucucucucucucucucucucucucuguguguguguguguguguguguguguguguguguaagaagucucuguguguacaugcaggaauguuuacaccuauacauugagaucuucccucagucacuucuccauuuuuuaaaaaagauuauauauauauauauaucaccauugcugucuucagacacaccagaagagggcaucagaucccauuacagaugguugugagccaccaugugguugcugggaauugaacucaggaccucuggaagagcuauuggugcccuuaaccgcugagccauuucuccagcccuccacuuuuuuuuuuuuagacuggcuccaacuaaccugaagcuuguucuuuugucuagccuugcuagucagcgggccccagagauucaauuguuucagcccugugugucgggauuauaaaguguuggacaccacacacacacacacacacacaccccacacacauacacguucacacucaaacucauacccacaugcacacaugcgugcacacgggcacacacacagucacacauacucucacaaacucauaaacucacacaccugcacacuuucacacaugcaugcauacaggugugaacacacauauuggacacacacauugguucugggacuccaaacucagguccuucugcuuaaacagcaaguaauuuacacagugaaccaccccccuccaucauuuaagcuuugagacagaacuucuuauguagcccugaguagacuggaacuuauuuuguagacaacacuggguuugagggcaacccuucuucugucucccggguuuggggguuacaggaugcaccaccaagcccagcuucaacuugucuuguguacucuguagcuuauauaagugguaaguugcuucauucauagaccaaaaugauucugguaaguuuguaaaaugucaccauuauucaauaaauguggcuuaaacgaagaaaaaaaaaucacaaccaauuauauuacauuauuauaaugagauggcacgggagacuuaagaaacugucacuucugaaguguuauuccaaacaaugaauaacuuccccagccccuaauucuguggcccaagccccacacuaacucaccauccagcuccuuagaaagcguucauggcucuccuccuguuaaugucucucuugaguuggcacacagagcaaacaggacagaagagugugaccauguagucaucacaaauagaucccuguggaagacacgggagacacaugaauggaagccagcacugcuuguggguuuuuggggcauuuuaaggagagccaaaagcaccgauucuuuggauucuguuuauuacuuuuuacgguuuauuuuuuuauuucguguguguguguguguguguguguguguguguguguguguguguguguguucgagugcgccugugcacagagaugggggugggggaggaggaccugcaggagucaguucucucccuccacccucuggguccuggggauugaacuugggucguccgcuuuggccggaagugcuuuucuaucugcugagccaucucauuugcccuggauucaguuuagauaccuuuaggaaaacguuagcugacuuucucccauguaacacuugcuucuucauucuaggacuuuauaauucugagaauauaagugucaaucaaacuaccaaguccgagaguacaagacggagacuuagaacgucagaucucacagcccggacgcuauuuggcucaaaacaauuacaccaggaugaaaagcacugggcacgugauguggcgagcaguuugggaagagauuuagggaaguggcaaagaacuuggggucaaaguacuccuaaaaaccaauuuagaaaguaaaaguuuggcaggaaauguaaccacacucgcuuuaagauacugacugugacacauuuauacacauaaagccuggacaaggaauuaggcaaaggaacacagaggcauggggugggaaccaggaagguaagggcacuaaagccgggcucgcgcucgguggaguuuguagguaaagcccacgcggagaagcgaauguccaagaacauccaaagcaaagggaauaaaaauugcucuaggcaaaggaagucagggaaugacagucuauaaaaugagaucauuuaaagaacuauuugcuugaggccugcaguuuucauccauuaaaaaagaaauccacacuaggaaacagggaaguaaggcaauuugggauaaacacagaagguuagaauucccauccucgaaggagaaaagucaagcaagagucgcagaacucacaacaggaagcagccaugggcggagagguggggacguuacacuagauaaaccccaaguuaagcaucagggaacagggaaaucgggcagagagccaaaccugcccuagggcaguuguccugggacgcuagggcagaagguccaaucccagagccucccaaugugggccucagggcuccaggagacgcacaggagaaaaggguggguauugucgcaggucuuaagacugggugcacacacuccaagauacuaacaaauaucccuccgagacuaucaaucuacaaaccaucagcauuuacagaaauguguuccuguaagucacaaggacagaagcauagccgaagaagaugcucacaaguuauuguuuauuaccaaccaggcaguggacuugguaacuaaaggguucaauuuucacuuuuuacuucauacguuucuauuuuaaguuuguuaguuuuuuuuaaauuagauagauauuuacuuugcaauuaaaagauaccgauuaaauuucucaagugaaaaaacaauuucagugaaauuaaaauagauuccuggaaaaugcugcaugcuuuuuugcuuucugugauggucaaguuuaugucuuaccuugucuaggccauagauggacauagaugugugguucaacaucauucuagaaguuuguugaagauguauuugacauaaaaauuaauguuuaagucuguagacuugggauacaauagaucacuuuacauaacauagauggaccucucucuuccaguuagugaaagaccuuuuuauugggaccugagacucagugagucuggccagggggccacagagauccaccuguccccaccuccccagugcugggauugaccucagguccuuaggcuugcagagcaaggauucaccaacugagcucucuccagcuuuauccucuggccugucccuccugacgccccuucuuucugacagggucaugcuauguaccucaggcuggugucaaccucuuaaucuuccugccucaacuuccaagcccuaaaaucucagggguguguguguguguuaucacccucagcuagcugaagaccuugauagaaaaaaaaauggauuucucuugaauaggaaaaaagucugcuuguaaauugcccguggacuugaaugccaauucauccacaaauaucuauccagcucgacagccuacuccccaaguuuaugacuuauggguuuccaucauggcuuuaaaaucaccaacgggucucucucuuucucucuguuuuucuuuuucuauuaauuaauuaaauauauuugaacucuaucugcaccuguuaggccagaagagggcaucagaucccauuacagaugauugugagccaccaugugguuucugggaauugaauucaggaccucuggaagagcaaccuuaacucuuaagugcugagccaucucuccagccccagacauucauuuuucuuuaucucugucucucuuucuauagucacacacagagggaagcaaauguauguauguguguauauagucauauauauauauauauauauauauauauauauauauauauauauauauauauauauauaugaauguguauauauaggaauauguguacacacacacacacacacacacacacacacacucaucuacgcacccuguaauucugauuaaaagacuaccccauuucauagaguguuauaauguuaagcgcauggacagacaguuuggauuggauauuccccucucuguuauuagagcacaucuuugggucaaagacucuaccucuuacacauuuugaagucuucauugguaaaacauggcagaccuucccccacaagacacaagcauugguggcggguuuaguuaccuaaugcguacacauugcaaacacgaguuacuuccuuaauagaacguugaggaacagaaaggaagaauguauuacugcuguguccacugaauuuaggguuguagcuccuuacaaaauucuggccaaucaaacucagagcuuggauauugucaaauggcagccacucggacaacagcuacgguaaauacaguugccagcuagaaugauaccaaagguaagagacucacaggaaugccguaucggguucgguagagaguccucauggccaccguuguuccacacagacaacacucauucaugucagcugccacuugacauccaagacaagugaaacaaaaggucccacagaggccuggaaacaugaaaacagggguacauguuacuuuagucuguccccauuggcuacaccaagaugaggccuuucuccucucugcugcaagucuggcuucguuguuuggguggggcuucauuaugaccccaccccaucauuucaagagggaccguacaggaaaagaccuagcccuuuuccaguaguacgacucauguauaaauuacugcaaucuauucauaaaacccuugguacuaacaauguccccaaccgaaauccaguugcaggauacaauaggaaagauuaggagauaggaaagauaggagaaccagccuaggaugcccugggucacuucagaguggugccugcaaggcucuaacugggaaauacuacuugagcugaaugguggagcaugcuuagaaauguuuuuaacaacuaaagggggaauaaggccucuuugagguaauuugucucauccauucacuguggccaaggugcuggguggaagaggggugugugugugugugcguguugauuauaaacuaggaguauuuauguaugcaucaaggccaggaagagccaccaaguauuuuguaagagauuaauuugcucagaucugcauuaagaaaaucugucauaggggcuggagagauggcucagagguuaagagcacugacugcucuucuagaggucccgaguucaaaucccagcaaccacaugguggcucacagccauuuguaauggggucuggugcccucuucuggugugucugaagacagcuacagccuacucauacauuaaauaaauaaauaauacauaaauauuaagaaagaaaaucugccauaaaccaaguggugguaugugccuuuaauaccaguacccgggaggcagaggcaggugguauugaauuugaggccagccuggucuacagaaagaguucuaggacagccugggcuacacagagaaacccgccuccaacaaacaaacaaacaaacaaacaaaugacagagagagagucagagacagagacagagagacacagagagagagacagagagaaaauaaaggaaggaaggaaggaaggaaggaaggaaggaaggaaggaaggaaggaaggaaggaaggaaggacagauggaaggaaauuugcccccaaacaaugaaggcugcauuagaacucaccccaucaccccacacgaacuuuuaaacauuacauuuuauuuaaugugugcagacacaugacagggucagaggauaauuuucagggguugguccuuuccuuccaccauguggguccuggggaacagggccacagucacuuuccccacugagccaucuuggcagcccuacaguaaaacucacauauccaaguaaggguacauucagauaaucaaguagcuacuuggggcuggaggaguaaaaguuagucuuuagccacuuugacgucgcaaucaugucgugggacucguuagucaaugagcccccauuaccuagugaagcauuggaaagcugugggcaaacucgacuggaauuccaugccuuugcuuucuaugcaguuauuggcuuccuucgguuccaaguuccaucccacuucgaguuaaagcuuguguacucccauccugaccauucugaggaguuuugcuucaaagcaaaccucuccuuccugaauugcugaggacaauugcugauucccuuugccgcccaccucgaugucuuccacguucacucagagagaucuuauugcagacagggcaacuuuuguuuuuuggauaguuugauuguuuguuuguuuguuuguuuugagacaggguuucucuguauagccccggcuguccuggaacucacucugu

SEQ ID NO: 2553 - RNA, 2267 nt, Mus musculus
cagcaguggcgguggcguggaagccaugaccgccacuaaacacugcaccugaacuggcugaggugguagcuguuaaagucugaaagaaaauauaacuguaagcaggucacagaaauacagggcgaacaaauaguaaagcgacaggauaaagcggaggugugaguccaucugucgucaccgcaacaaaauacccgaggaaauguggaaaaccuugugcugucuccugcuucagaggcaccagcccuaggucacgcucagccugggccuguggugagauccaccucacagcagaaguuuguguugcucucucacacuaacgguuugagaauuugaucccuucugcuaccuagaagcugguugccccugaggucccuccuuccucuagcauaccacuccucagaauguccagagaugacgcugcaaggacccgucugugacgaacuagggcacugaggagagcguucuccagguuccuuccucuuccugcguugccauuguuaccgugugacauuccaggguaggagagguguguuccugggggaugggugggagggugcgcgugugcauauguguguguguguacauguguauaaauacuacugcaauccuuggucagggcccugacacuggguauuccaacauauuggguccagccacucaccuccaaacccagagaaaguaggugugaaaaccaggaaaggacauuuagucaguaaaaccacagcaggaaggaagggcagcugcuccugucagugcuguucagcggggcagucaagagcccccgaauuauccaggcaaggaaaauuauccaggaaucagaggaaacacaugccauuggucagucuugguuacacucuggucuggcugauccuugucuagggauuaguaaaagcacaguaaggaaguugcaguugccuggacacacugucaacucuuguacaagguguuugucuauccaccuagaauucuaggugacugaaggggaaaauguuucagaacaagagagucacaguauauggccacgucugcuucugcccucugcaaugcaccaggcaccuacaggcccaagugagugcaggcgcuuuuagccacagcagacucuagaucuugcuuccaaaaggagagacaggugaagggaagauggaugguaguuuuggagugucugugguuuucaagugacaggcuagcuauguagcccagacuagcuacaaucucaugauccuccugcuucagccuccugagugcugggauggcaggcaacaguguggguguuguuuguuguuguuguuuaagauuuauuuauuuaguuaauguauauaaguacucuaucuucauguacaccugcaugccagaagagggcaucagauuauauuuauagaugguugugagccaccaugugguugcuugaaauugaacugagguccucuggaaaagcagccacugaucuuagccucuuagccaugucuccagcccaaugguguucuuucuauuaggaaggaaaugcacgcaaauagcgacccuuugaauuuuguagcauugcuucaggacuaacagaaaaugcuuuguaauucugaagaaauuucaccuccccuuucucaucucaucucccaaaggacaccgagagucaggagagacaacagcacacuccgcccauuucaauaaagagaaaagcaaucucgagaaagcaaacgaccccugccaacccucgguuggaaucucaggacucugacugcguaugcucuacccaguggaaacguucgccacaugggcuggggagaugacuggcuugggugaagcacuugcuacacagcccaaggaccugaaaucagaaccccagaacccuuagaaagacuggcguggcucccagcacccuacaggaaagugggaagcagcgacaagaacauuucuuggcaaacugggaaggaggaggaguccccaacuggaacaaggugagggccgacacccaagguuguucuccacccuccacccaugugcuguggcaugcacuagucucuacucacacccacaaacauaggucaucaaacacaggcucgcaguguggcggguggggagagggagagagagguggguuuuuuuaguuugguuugguuugguuugguuugguuugguuugguuugguuuuuuaaagaacuugagaaccuauggggcuuaauguuugaagaaaccacugaaauaaagugcaaagaaaagccauacuagaugaagagaaaggggacaacauuugaaauguaaauaaagaaaauaua

SEQ ID NO: 2554 - RNA, 9671 nt, Mus musculus
aaaagggaagguggagagagagaagaaggagaaaauggaagagggagaggaugcagaggaggaggaagaagaagaaaagcggaacagaagcacaaggccuggagaaaccacaaguccuaaggggucucauagauguggaagaugguaguguagcgguagaucugcccaaucuaggcgcacagcauguauucauauugaguuguauuuucauugcuggggcauauuuggguuggagauuuaaugaaacaaaauggugcccaauguauugauuugaauucaacuaaccugagauaaaaguucagaacuagauagggaauauuauucacugacuccaaguagagagagcagugauaauugccugcugcaaacagguagaagucuguggcuccggguagagagcacaacaaauagaugguauaaauguggcuccugguagagagcacaacagauggaugguauaacggggaugguugcucuaggcagagagcuuaacaauuaaaaacuaucugcuuccuauaggcagauauuaguggaaguuugaauuaauuguuuuaaagaugguauaaagauauauugcucuaauaagucuuacaggagacucauauucugucuaacgugggcuccaugggaauuuuggguuuaaauccugguuuaacaagcugccucuuauaagcagguauaaaggaaaggaaagaggaaaggaaaggggaaauuaggaaaggaaaauagaaguuugaaucaaguguggaugguauaauaaagucugcaggagacucauucugucuaacgugggcuccacaggaauuuuggguuaauauccugacaugacaaauuagaaaggccuaaauaggcaaacaugugugcgauuuugaguauuguggugguuguuccucugggaacaggaaccagguuuuccugguuaccggcugaaggauaugcugauuuggggaaaagguuuugucuuuguguuuuuggaaaaggugacuaagguauuuacaccuuccagaguucuauggaucagacuugauagagggagacccccugagaacuagauuccagagaaucaaacaaaaagguuaucuugauacuaaaauuuuguuuugagauuuauauauuacagaauauaaagcuugguagauuucauugucagacaugcugaacugaccugccugaacuccugcugucuugguuuuuuucauccauauccagucagggcacagacaucagagauuaauaaaaucauugguguggccuucuuaagaccaacuccuccauuuuccuacccuucccucucccuucaaaauaucucaacgcccauauucagcuugaaguaguuaugaagagucaucaucccaguucccuaggcuuuggggcugggggugguuauuauaaguugucuuugauacuaaacauuuuauuauuuuauuuuucuguuuuuuuuugagacaggguuucucuauauagcccuggcuauccuggaacucacucuguagaccaggcuggccucgaacucugaaauccgccugccucugccucccaagugcugggauuaaagguguacgucacugugcccggcugauacuaaaaauuuaaaguacaaggcuuggaaccaguccuucuauugcuguuguuauaaacagaucugagauguuuaagccugugaguuaagggccaaauaggaaguucauggcucugaguuuauugcuagggaguuuucaguuauuuuaaucagaaauggcugagaguagguaacagagaacagucuagauuacgucacauagauaguugguuuuuaaaaaugucagaaguccacagaacgugauguuuaauguuauucacuuguuguugagacuagucugcuccugacaguuuucccugucuuggauucaaagaggaaacugagcaucugugaguuacuccaguuguggcaaaacagccacuaggcaagaauugccucauuucaucuacagacauaauacuguccaaagaaaggacauaauuacagauuaggacagguugauucugccaagacaggguaggcuagucuuuaauauuccuguuucucuaagucugucagaugacccuggccaguaggcugaagacugauguccaacguguugaaguaagggacuguccaagugaccagcugucgcuauaaauuggcuauguuuuggaaguuguguuaggcuuccuauauauuuucaguuaaaaucagucguucuuggauuucugaugggguugaaaaacuacauagucucuuggccaacccaggcuuuuuccuuugagaggaugguuuucagauggcauucaaucuaaagccaagacauaggugcagaacuauagucuuuuaaguaaggauagacaacaaagguucuuuuuaauuaagaaagacgauggucuggguguuaggucucuuguacuuuauaaauuacaaaauaguaauauuuauguucaauuauaucugagauaaaaaagucuuuuaauuggacagaaagggggaaauguuguggauaucccuggggcuaauuaauuuauauuugauguuaauuccguucuccugugaguggcugaacgagucagcacucaggugauuuccaguaaaccugcuucccaccuuaauuuguaaaauaaaggagagcugaugauugggcagauaaagggaagguggaguggaaggugggggagaagaggaggaggaggaggaggaggaggaggaagaaaaacagagcagacgcacauguccuggagaaacugcaaguucuaagggucucauagauguggaagaugguaguguagcggcagaucugcccaaucuaggugcacagcauguauucauauuaacugaguuguuuucauugccggggcauauuuggguuggagauuuacugcaacauguguccguguaugugugugugugugcauguagcauauguggaagucggaggacacaacuucugggaguuuguucccaucuuccaucaugugggugccuagauaaaacucaggccaugggguucaucuccagucauuuuuuaaauaagcaguaucuguuaaccucucgcucacugcuggacacccaaggcugacucuacgucuuggugccugugaccaaugcuacaaugaacaaggcuaugcaggauggaugguuuguuuuuuuguuauuuccccauaugcugccugacuucauuuuuuuggccaaauacccaaggauagcugggccgcauggcaguuuugguuuuaguuuccauaugcgcugcacuacuucauaucccuuggcagcaugcaagcgccucuuguccucccucuucuuaggaguguuugcuauugcuggagauagcuagucagacuagggccagacugacucccuguugguuugaucuguauuucccugcugcccacugaugcugaaaacuacuuuauguacguauugauuaucuaugagguaccagacuaccuagccaacauuuaaccuaaauugcuuagcuucuguuguguuuuuaguuguuuuauucuggaugggagcccugccuaucuagaugaaaggccaugaacggugaggacuagcgguggguggccaccacuucccuuucuguagacggugcucagcccagcccuguucugaaagaaccuuuuagucugaggcgaucucaggugucguguuuugcuuuuccuccuuuggaauaugaucuagaaaacuaccuaaauuggguuguuggguuuuuuuguuuuuuugguuuuaaaagaaaagguuucucgggguagcccugacuguccuugaacucagagaucucccugucucugccucccaagugcugggaucaaaggagugcaccaccauugccaggcuuaagccaauaucuuaaagugucucuccuaugcuuuccuuugguacagucagagcgaggucuugaugcauuugaguuuacuuccuugcaggguaauagagaucaaguguuaaucucggaugugguuacccggguuuccagacccaguguugaaaaggccguguuguucccuucgauauuuugaacuacucaucggcgaggugcagugcacaggcuuacccgagccucugcacacugcccacugccugucucuaccugcgccaggaugcugcagcugucguagcuuuugacuucuuuguucccacauuaauuuuagaacugcuuugcaaaguucugugaagaaugucacugguguuuugaagggggaccgcaaugccucuguagcuuacuuaguccugggagugcaggcaucuuaacaauauuaacucuucucauuugugcccgagagaggcauucugaccuguuucuguccucuuccgcuucauucucaggugcgugugcacacgugggaagcacauuccccaagcugucuccucggccagccuggacuccccaggaugucugcuccaaguacgaauguguaggugagcaucauuuuauggugacugcugucaucugcucugggacacuugcgauggucaccuuggagcuaugcuuugggggcagugucgccucacauuggaguuuccuucucuucauguuuacgcugagaucugcacaucccauggagcuacacugguucucaguaucagccugacacaaaagucaccuuggaaaagucucaacugaacggcugccuccauccaguugacuggugagcaaccgagugcuuaagagggucgcugggcugguuaugggggauuuugugcaaaggcucaggagugaggcaguucucagcagcggagggcaggaaggcugugggccagguuccacuuccugcauagcuuuccucugggccaccacugcgcagucacugcucccaacaaccuuuacucauauaugagaacaauggaugacucaaggauuuaccuauacuuaauauuuggaaaacacucccaagagcagcuacguggcagugcugagcuccaccugcagcuacagggucagagcacacugccacguaacaggaccuccugccccaaccucacacaagucccaaucaucagaaaggccuuccuucuaauucauccugcaguccacuccagaauaaauaguaauuaccacccccugaaccuuucuccagcuauccuucucuauacuugaugucauucuguccuugcaucagcucucaaggaaagcugucuuuauccaucuuuuagccacagagaacaagcucagagggcuucagucccuuaccugaggugacaaugaacauuuggucagagucaguggaaaggccaccuccucaccagaaaccauacauugcuuaugaaaccccagaaccugcuuuagaagaugauuguacaggaguuuucugugaagcguuuagacagaggcacugcgggugugccagaauguggaucucuucugugugugccaggcaagaaggcaccaggcgaggaggccugcuguguaaucagggaauggcaagcucaugugcuuccugggucaagagagacuccugccuuacauacagcccaaugcagacuccaaagaguuuaaaaaguaaaacuugcagacuuuaaaagaaaauuaaguuuccugacaccaaaauccuaauacaugugcacacacacacauaucgaaaauauaguaagugcaaccauaccgauuagaaccuuucuacuagacagcacaaaugcaaaauuaaauacaagccacagacuugcaggaaauaugugcacaaugcagggaaagaucagaguccaggguacagagagaacucaaggagagagacugcaaagggggagaaaaaaaggcaagagacaaaccuacaaggaaaauggggaguuucccaagagcaucugaaaagaucccaguggccccagcauugagguuaaaccaacuaggcacauuuccuuagccauuagacuggcaaaagggaaacagcucgcuuggcaguaccacgaaggacugagggcuuggaaggcucuaaggcaccugcgguagcacaacugcucuaagagucacaagacacgggcaagauccagaguuaagucugugccccaugggauguucuacucugucuccaggagaggaaaucuggcacuuaggccagaacauacuguagccuuauuuauauuauuuguaaaagggaaagaagacaccaagaguccuuaggagcgagcguaagggacauacauuccuaaacuguccggaacaugguuaaaucaaauauacuauaauuguuauuugugaauggauuuaaaacaaugggaauacaacuuuacaggaaagggcaaacagugcgcaguguaaagcugagaaacacugugugcugagggguguacagacuuacagacaauucaggugcaaucagggaagguggggagggaaggcaggcuugugugcaggguggccacacacacauauccugugugccucuagaacaguucuggcggaugcacgugcauguuguugggcuggcagccacugcuggugacuguuucugugcucucucucagagagggagaguucaugauugcagaaaagggaagagcagaagggacaaugggucuacacaaacucccaccccacggaggacacagccuugcaaaccagcacccgugcagaacacagcacacccaggaaacucacuucugacagaagagcugcccacaguuccugcaauggugccuccgcucugugagggagaagcguacggagcaucccgagcagcugucgccgccuucauccuucacccaguggucagcggcagaacggccaggcuggucacucacagaccagcugaacacucggccucgacugucacccacgaggauccugcugugaucccugugcaaaacaugagaaagccucugguccagggcucgggguguucagaaggagccccauucccuccaaggauguuaaaggagaaaaaauuaaaacugaaccugaauuuuuccccccauuucaauuuccuuuggcucaauacugugugaagugcaccgauaacaccuugguuuauuuguugagaauuaaaaucuacacaguggcaaguuucagcccaaaaguaccagaccagcuaugauaacaugugccucaaggacccgguuaaaacaugggucccuagccaugccaaaugacccagaaagggagaugggcuggaaaaagccuggcucuuacuuggauacacccaacgcggugaccucggcugggugcguguuguccuuucgaucaaaggcugugugcauagucaguuugcuucugaauaccagcugccgcucccaccgguacccugaaacagagacguguaagacccagacaaaccaaaccuagggaguuacaugaaucaaggaagauuugggacugugguuucuuuuuuauaacaugccuagccugaucuaugggagaacugcagaagaccucggucuuuggcucaggcacagaguugaucaaggcuagaccaaggguagaucaagagaccuggaccccaaacgcauggccugucugucacagggcucacaggcagggagggggacaccagaacucaaguuaccggguuucaaucugcuguaacugcgcgcuucgaugggguuggggugcgggugggcgagggggcccugcagaugugcucuggucuggcccucagaguaguucacaaauaugaagccaucuuucucaucuagacugagcuggucggaccagcgccuggagucgucggagccgcugucgguacaccauguggcgguggcccugcaggaggcugcccgcggccuguggcuggugcugcugggcuggcuggacguguccuugggguccuggcugacacugggcucuucuguuucagaaucacugcugucgucaucuugggcuugcugcccuggguaaggcauuggggacacgagagacgggagacugacucaucagucacucacacuugucccuguuccucuguccaguagaugggaggcacacucacaaccaagcauagguagcaagauuguacacagcaagaaugcggagcauaguccuuagaaucccauguccuagacgaucacaacugagaaaauccuuagguggcauuugauccuucacaguaaaaucgaaaccacacucucccuggcagucuggcuccucagguguucuccccucacaguagguccgcagcacugcaagcagugacucuauuugaacuugucuucccaaagcgugugcgcacugguguuaccugucuuugccgacaccucacagucuaaaaucuuacccaacuccuucaacucaaagcaccgccucccucucccaaacgcccaccaugccucuugguauccuguguucuucucugcacucuuuacacuggcagaggggagaacaaacaugaaccuuguccaugcacauuccagaguguguguguguguguguguguguguguguguguguguguguguguguguguguaugaacaugcacaugcauguguguggugcuggggaacaaacaugagccucguucaugcacugaguagccacgugacuucuaagacagugacuuguguaaguuuugaugcugaaucuucccacugucauuucacgcuccccacaguucccuaccaccuucaaacaucucucaaaggagggauccccagggaaaagugugagcaaguggaaccgaaagcugccaagggacagcuuugaucugcaaugaggcaggcugcccuucagucucaucuccaguacacaguccuucuccguggacuuugcccuuuugcaaaauggccacaguaugcaugcacgcggaagauggcacucgcugucucaacgcucugaguccugcccuccucccaccccacuaaucucaucugcuuuagucauucacuauauagaaaggugacucauuucaggggacuccaucauccaaugccuuggauaaagcaggugaccaacaguuacgcucuuccuaccaacacuucagacaaccucuucugaagcuacaauugcgccuguggggauuuacaucaaacacagugcaagcauuaaaacgugcugccuauggauuucucuuucuggcacagaaagcaggcacucggaguuuaccgagaggagcugugcccuucugagaaugcgccuuucuaugcaggagcuccuuauguuauucagcaagcugaaaacugauucuuuccggcaagucacuagugccaggccagggagggucaccaacacagggcaggacgcugcugccucuauggugcuguccccagucauucuguagggaagacaccuggcucugcuuuaacuggaaauuuaaagugcuucagaaauagcagauaacggucuucaguuggaauuaauggcccacgugagcaggaucggguggggugaguacugauguuuggccuguaagcaauuuaagagccuggcagucuccugucuccaucccacaaugcaucucaugagcugggaacagcagcucuagaauugaggugaggggcugccugacucacccaacccugcaccccacagaacugagucgcaggcccuugaaccguggggaaagcacuccuguauucagcuugcacagcucagagggugggcuuuggugaccuggagugaagcuggcacacaugcccacaggguggcggcgacagugcuaugugugcagccuugccuguuucagcugcucggucggagcuuuuccauguugaucuaauaaauacaugaaaugacu

SEQ ID NO: 2555 - RNA, 3021 nt, Mus musculus
ugauauacccuugaacuuuauugcaaugguuuuuuuuccaacagaaagacauuuauaaucaaugugcugaugacauacauuucauaaauuuucuucucccaauuauaauuacaaaaaaaauucgaaaccucauucauauuuaguugaagaucuuccuucugaaaggcacccuggucuuaguguugacucaacugauuuucuuacccuaauguagccaugcauccaguagcucuucuuccugccacacucccaggcugaagagaauuuugugguacauuuguguaagggcagauuggaggaacgguaccuaaagaauacacaucaaagggccaaggaggaaggagcaguaagaaggaaaaggaagcaggcacaccccucccccacccagcgaccuggcaguaaugauuuauuuaaaacuguauuauagagcgcuauagcacagccuauuuggcuuuaaaggaauucuauagauggcacagacugaguuaaaacaguugaauggccaguaucuuuacagguuacuuugugagccuuagaggcaaagcaucggauuucuguucccccuuagaugaucugguuauaaaaguagguuuuuuuaaaagggguuguucugaccuacucuuucagaauugaguaacauuuacauuuuuauucuguagccugccccuggucucuucccuucccugacugucucccuggccuccaacucuggacaauucuucuauccuccugagggaccccccaaccucauccaacagcagccccacccagcacaggccuuacaggcauggcucuccacaccuggggaaaggugcuuuguccugccagcgggugccugggaacagcaggaacaggggcccccacacggaacagcugcugaaucuuguagcaaacaguggaguaaaucgguacaacuggauccaauuccaaacacaaacuggcuuaaaaaaaggaaacagcaaguccaaauuacuucggcuuuuuuuuuuuuuuuuucuuuuuuagaggaaauccuaaaacugcuguagauugcaguguugggaaaacaagcucguguuuccaguuucuguaccacuacuuccccacucugagcuguucaacucaaggaguucaagcauucaugcugacucaguuuuguccccaccgucagaacagaaguaugacccaaacgguacgcugggcggacuaggaacagagacaagcugauguccgcuuggcuguuucaaguuuaccaauccauacucauuuagugcaaacauuguguuggucaggucuauggagguacaaagaaugaccuuuccagaaagggcaaaccuaaaaucucagcagaaggucucaaggucacugacccaggacaacccuggagacuggaaacuccuggguccugauccgcaccggaggagguggggguucgaggccgcguagugaaagagcuagcgugggcaguucuuuuguacuccagcuggaguaaaaugaacgcaggcucgcguguuuucaucgcuggugacagcauccagcaaugggaguagggcucaggggcgcgcagcggugcuuucucagcagggucccccgagaagccggaggagggggugagcgcugcgccagaggacccgggagcccggaggcgagggcagggggcgcggggcgcggggcgcggacugggcugcgcgccuguccagggugccggcaagcaggagccgcggcgagggaaggaaguaggaaagaggaaggaaaggcgggaggggccggccgcgcggcugcaguuucugcggccggccugguaggaggagcgggaggagcgggaggaggaucccgagccguccgucagcgggcgcgggagguggggagagcgggaggaggaggaggauuaaagauggccaccagcagcugcgggagacggccaccagcccucacuuuccgggauguuccccgcggcccggcccggccuugauggagaggagcagcccgugcagugccgaggcugaggcggcggcggggacccggcgagggagaagacgcggcggagcagggacccaggcgggagaagggagcggcggcggcgucgcugcccuggcugccuagcacggcugccgccccggccccgcagcucgcggacugcagcgggcgcucggccccggcccggccuggggggacucccgggccccacgccugggcccgcgcguccgcggugagugcugccugcccgcucgccggcucgcccgcggcgcgcuuuguuccugcggggcggaggcgcuguccgcgcggggacaggccgcggcccagccgcucccccacccgcguccuccuccgggccuggagagggcgccgucggcggcuggucccaggcggccggcggaggggcgugcgggggccucggggauggggaggcgggggcaaggcgaccgcagguccgggagggcgggggcguaacccggcggcgcccgggguaggugggggucaugccgguccccucgggaggacccucccggugcccauucccggaccccccagcccccacccgcgcgcgcccgggcgcagcggagcgcggccuccaucccucgggcgccgucuccagggccgcgggccucuccuggcucaucccucuacgcucugagcugcaaacccuucccuguggaagggaccugggaugcuucuguccugcaucggggaugugguggcaucaccgacauucgcgguuauggcgggguugaaaaggcagcggugaccuuuccgaccagagcccucuggaccauggucgcaucggaggugcugcguuccauugauuuuuugacucuugaaucggagagacagaugaugaguucuuccuuuguagaaauaauaggauagaaucagaucaagcagauguuuaccgaaugcauggauuuucaguaccucaccaauggcuaaguguuuuuucugugggaaaaauggugcuuaugcauacgaaaaacuauuuuuguucacuaauagcuauggguuggucaguaccaagugguuauuauggugucugaaaacccaaca

SEQ ID NO: 2556 - RNA, 857 nt, Mus musculus
ggaggauacugacuaagucugaggggaaggaggaggaagaaaauuagcggcaggaagaguuuauagcccugucuauaagaaagcuuaaauauagcuaccagugcuuugaaaggaacgguuuauguccaaacaauauuuuccagacgagcucuguacuuucuugccaacagaguuaacuuuaaagugaaggcaguagacaguuaaacgagucgacucugggaccagcuguguguagagaagaccaauuacuuauaagguacuguuuuuccucauugaaaucuugagggucugcuuguuucggguacaaguguucugugggcauuugaucuuccuuuuuccuucuacuuuaucuccuuucuucgaggaaauggcaaucuugaaaauagacuggguuuuagccguacguuuugugacuguugauuguugaagcugccagaauuguuuuguuuucuggaaccgaaugaucuuugucaguuuauccgaaagcauucuucagccuuguccagccuggccauguaugaucuucgacuuuuauuguauauguuguagagguggcauaauaugcugacuuccuuaacugagggggagggacuaacaacuucaacuauagaaugcauccagagccccuccccgaagaagaggaggagguggcaugucuggacaauacucuuacuucacucagacugggaucuuagaagauuuaaucuguaaaacagacuuuucuaaauuagggaucuaccacuaguuugcaccucuacuuaacugguaauuuuaacucuaacuucucuuuacugccauuucuuuuugcaaauuauagcaagucuguuaauucacuuagaguaauucugcuccuuugc

SEQ ID NO: 2557 - RNA, 857 nt, Mus musculus
gcaaaggagcagaauuacucuaagugaauuaacagacuugcuauaauuugcaaaaagaaauggcaguaaagagaaguuagaguuaaaauuaccaguuaaguagaggugcaaacuagugguagaucccuaauuuagaaaagucuguuuuacagauuaaaucuucuaagaucccagucugagugaaguaagaguauuguccagacaugccaccuccuccucuucuucggggaggggcucuggaugcauucuauaguugaaguuguuagucccucccccucaguuaaggaagucagcauauuaugccaccucuacaacauauacaauaaaagucgaagaucauacauggccaggcuggacaaggcugaagaaugcuuucggauaaacugacaaagaucauucgguuccagaaaacaaaacaauucuggcagcuucaacaaucaacagucacaaaacguacggcuaaaacccagucuauuuucaagauugccauuuccucgaagaaaggagauaaaguagaaggaaaaaggaagaucaaaugcccacagaacacuuguacccgaaacaagcagacccucaagauuucaaugaggaaaaacaguaccuuauaaguaauuggucuucucuacacacagcuggucccagagucgacucguuuaacugucuacugccuucacuuuaaaguuaacucuguuggcaagaaaguacagagcucgucuggaaaauauuguuuggacauaaaccguuccuuucaaagcacugguagcuauauuuaagcuuucuuauagacagggcuauaaacucuuccugccgcuaauuuucuuccuccuccuuccccucagacuuagucaguauccucc

SEQ ID NO: 2558 - RNA, 2398 nt, Mus musculus
uaugcugauacuuacaaauauuuauuaauugaaaguauacuucaucaucuuguauguuuucaguccaggaaugcuaagagccuaguccuuguuguuguuuaacacacucagaaacuuuaggaacucuucugugccagccaacugaaacacacgcaugcauuguccaauuccugucuuuccaaauucaaaaucaucaccaucuaggccugagugagcacacccgaaagccagagcuggcacaaggacagugggcgccugcguggggugagagaggcaggaggagaggaaggacugcacagccucagccucucagaucaagcucacugccucccagugcuccuaagagagcgagcccucuccagcagcgaagauaauccacuguguaucccccacggauagcaaaugcagcauucuuuauaaagacaaaaucuggcucugcagcccaggcuacucucaacacuugugacuucucugcuucaguccccuagguaagacaccaacucggaccgacagcuaagccuuauuccuaggcugcucuuucauacuaacaaacgcgcucugaccacugcccucuccuagacaccacccaucacauuuuuuuguucucugcauaaccaagugucuuccauacuuuauggccccucaacaauguaacaagaaguguucaaauguuccagucuuuggaacauuuagcuuuaauguucucuugauaguuucaucauccuaacuacacguucuugccuaggaugugagagucccggaugccuuacagguaucuucccaucauaucacaaggcacagaauuaaacuagguagagaagagacgauggaauauccugaggcucuuccuaugaacuuauuggugaauucacaagccuacugagcuauccaaauauacuagucuuuggaauucuuccagucuuaaaagucuauuuacuaaguagucaacaauugcucauucaauucauucuuuucauuucuuuaaguaugucuauucuaucgucuguuccacugggcacucugagcucucccucucacgugagggaugaacagagcagagacacgauucuuguccuggaggagccgauauaccacuccuucccaaaaaaacaggacaaagagugcucacuggcacuucccagacaugggcacaacccuggaucaaccauaaaacccccaaaacaaggagaaggaaggaggaagagauggagacacgacaggaagugggagaaggcagaggcacccgauaugcaucagggguauccuaagcaacacacacacacaaaggcuggcacucgugagcaaacaaaagcuagaguuaacaaauuccaggagaaacguucaguuccaaggaauucugagcuggaauucuaaauugaggcgcugccuuuggagcguggagaauugucacgaggacaugagggaaggaaucucuagaaagguaguuggguggugaagggggcuaugggcgcacaaacugauugacggucucucguuaucugagugugaagcaucguccauagaucgacuuuugcauuugaauucucgguccccagcuaagaguccuguggaggaggcuguggguguauuggcuggcugugagaagcaagcucccauagcaacagaaucaucccagcggccaugccuccccggccaugaaauuauacuccuuggauccagaacuaagucuguccucccuugagauucuucuaucaguaaucugucacagcagcuagagaggaaaacuuugugacugcagaugaauauccagcccagguccucuguucuuucccuucagggccauucgaccucaugaccaggagauggcgcucuaaacacgggaacggguuuugcuuaguuuggauuaaaaacaaaaacaaaaacaaaaaaacuuuuguuucauggagacuuuugaaagcuguaguuuucuuucuuuacuucauucuucuccuucccgacuuaaacccuuccauucauauuuuguccucagauggucaaaguucaguuguugacggcaggcagaaguaaccuggagccuggggggagggggggagggguugucgguuuguugauuuguuuguccguuuguuuucuuccuuuaaggacuucuuaccacaugcccuacuuuacacugauuuuaggcaagucuccuguuuaauauuuccacugcugugaggagacaucaugaucaagucaacucuuauaaauuaggcaaacauuuaauugggacuggcuuacagguucaaagguuuaguccauuaucaucgugguagggagcauggcagcauccaggcagacauggugcuagagaaguagcugagaguucugcaucuugauucaaaagcaacccagagaggcuggcauccuccggcaacaaggagagagcucucuuacauau

SEQ ID NO: 2559 - RNA, 163251 nt, Mus musculus
ugagccuccgggcguuccgggcggccgaugcccgaagcuggcgagcugggagcuggcagagccuggagcauucggccagcagccugcacgcacaguggugcggacuguacucuccgguccccgcagcucuagagcggaacccgugucccugcaucucaacaggucaagggaggugagaaggacgcccuugccgggacuggagaaccaaaggagcuggaagguaagccgagcccugcgugucccgggcugggggccugggggcucaccaggucccgcgugccgcagucgcgaacuucuccgcagccgggcugccccgcacgcuaacucaagcgccggucuugcuacuuuccugaugggaaccuuuggggcaaaugggagcagaagaccggugcgccgccccugucugcgauuccgcugcagguagcuuccagaacccaggggacagggaccuaagaggucgcucguccucccucguucccuugagccucgaguccugcgggaaaaugucccguuguuggagucugguuccugaguugcguaacacacgcgucccagaaguuucucgaggaguacagccagguucuuuccuccuccgcuuccgacccuccgcccccccaccccccagcaucuggcaggagacuggugauaccuaccuauccccucuaacuagauggacaagaggcguggggcgguggucggcguccucaaggcaggggaaaguuggaggcacuucugagaacugcugucugggauggagggagacagcguuuuaagacuaaggauuggccgguuucucagcauucuccccucccccgcccccucucauauacuuuucuccaaugucaggucuucucggucagggaguuaagaggggggacaacggauugagggguacugcgaaucauacgcuuccuguguggaaccuuacuuccacgaacgaagcccuguggggccugccagcgucuugcgguuugaguuucuccaccaauacuguuaugcaaaucguccuaagacccuuggcuuuggagguuggggcugcguccgaaucuuccgagaaccagacagagcuggcgcaaagcccuggcugccggcgguuccauuugccuugcuguguacucuuuugaaggguagggugggauaauuuuaauccuguuggugcgccaugggggguaugaccagccucggaggaacuuggcacauugaaaaccuucagugcggaaccuugagccgggaugcaggcgcagcgcugucugggacaguugcaaagugagaauucugcaauggaggcacugaaagaaugcuaggagccagaggucuagggcuaugcgcaggauucagggcaagauugugcagaauguacggaaaguggggggugggcggcaucccucucucagaccuaggcggggucaggcucgaggucuuauuugggggcuugcaaaguaaaaagauacaaguucuucccugaggcuuacaaauaccuagauauggccccgagugaguguucgcuuccucucuaauguauuccauagcucgccuuucaucuuuacuggaaaggauuccuugaguggguauucuagaaauagauucacaugagauuaaaaauucuuaauggcucaccugcuucguuuaaaggugacuucuuggcugugugugcauaaaggaacagggagauuggagagcuaacuaccccgggagagaagaggagagaaggcuaauuaaagcuagggaaacucauuugaacuccggcuuguuugaggagagcuggaaccuagcagggcuuugagaugaagaaggucaggaugagacuuugaaggagaggcgggguuuuauuagcaggaaugaucguuuuuauuuuugaaauaucacaaguuugguggugcuggggaugugggaccugcagauucgaucuugggaguaucuuuaccaucuuucuagaagcugggcuguuguguguuggcguuaauaugucuuaugcauucagcuuagagacugcauuucuauagggccuuuggcuuccuucauuuuugucaaucuucaaccuugcaaaaggauuguuuugaugaaucauguugucuucgguuagguugcaaaguuagacaauauagcaaaauaagguuccggcuauuuuaaauacugcuuuacacaguaugcagaucaagcccccacccccacccccauccccugaagucaguguuccguuaugggguaaucaaacaguaucagaaccugcuguuucuucuguuuccuacuugcuuuaacugaauuuuguaaauagcgggcugagcuaacaggcgguagagacagggguaggauguucguucgguucuucauucucugccuccuuuucagccuucuggggggguuuuguuuguuuguuuguuuuugauuuuuuuguuuguuuguuuguuuugguuuuuucgaguuuuuuuuuguuugguuucucuguauagcccuggcuguccuggaacucacuuuguagaccaggcuggccucgaacucagaaauccgccugccucugccucccaagugcugggauuaaaguggugacgcaugccuuuaaucccagccuucugguuuucauauuuuugauuuuucaaagaaucucacuauguagcuccggcagucuuugcuacccuccugccucagccucugcugggauuacaagcuugugccacuacacccaguuaguguucuuagcuuagcuguagaagacauucaguuaagauauauacacauacauauguggaucugggcagacggcugaucuuccagaugaccaaugacaugguggcccacaauuguaauuccaguuucaagggauccaacacacacacacacacacacacacacacagagucaagcagaaaaaacaccaauguacauaaaauaaaaauaaguaaauaaugaaaugguaaaaacauacauaugcgaugcauuuuuguuagacaccaauuuguuuuguuuuguuuuucccuacaggguuucucuguguagcccuggccauccuggaacuuccucuguagaccaggcuagccuccaacucucagagagcugccggacaugagccaugcuaacuggcucuucuguuauaugcagacaagucuucuuguguuaaagaguuuguuuuuauuuuguguauauaaauguuuaucugcaaguguguuaguguaccaugugugugugguacgcacagaaaucaaaaguuagugucagagccccuaaaacuggaguaaagcugaaagaccccuccgucccccccagugugggugcugggaacugaacuucgguccuguaagaacagcuagugcucuuaacuauugagccaucucuccagccccauuguggaauucaaaaaccucccugccucaacuucuaaauugcugggauuacgguccuacacugccacauugccaguuaaaaucgaucuuuugaaaaaaacgaaaaacaaaaacuuguguuguuuuuuuuuuuuugauuuuuuaaaaaauucauuuacauuaguguucugccuccuuguauguccaugugagggugucagaucccccggaacuggaauuauagacaguuauguacugacauuuggaugcugggauuugaaccuggguccuuuggaagagcagccagugcucuuaagugcugagccaucucuucagccuguuuuuauuuauuuauuuauuuguuauuauuauuuuauuuuauuuuauuuuauugguuuuucgagacaggguuucucuguauugcccuggcuguccuggaacucacuuuguagaccaggcuggccuugaacucagaaauccuccugccucugccuccugagaacugggaucaaaggcgugugccaccacgccuggcuuauuuuuauuauuuuugaaagauaaguggaaagacuuccuugcuuaccucuugcaucaaauuugcauaauuucucauggaguuuguuggaugugaaagugcaaguccugaaauaguccuauauuuucacuuuuuaaaagccaaagcuggggcuggagagccggcucagugguuccuggguuugguuccuaguggccucagagcucuagaugacacccccaucuggccuccaugggcaccuccaacacaaaagguuguuguuguuguuguuguuuaagacaggguuccuuuguguaacagcccuggcuguccuauaacucuauuuguagaccaggcuagccaagaauucacagauuugccugccucugccuccugugugugccaccaucccaggcuccagauaaauuaacauuuaaaaagcaaaguuaaauaccuggugugguggugguggugacacacaucuuuaaucuuagcaaaaucgggaggcaaaauugggcaguucucugaguucagggccagccuggucuacagagccagcugcaggacagucagggcuacacaaaaaaaacaaauaaaagacaaaauuaauuuauauuugcgugggauggcauaccucgaagacaucacucuuaaggcugcagaaguguguuagcugcugcuuuaguuguuuuggcuuugagacaagaucuucuucuucuucuucuucuucuucuucuucuucuucaucuucuucaucuuccuccuccuccuccuccuccuccuccuccuccuccuccuccuccuccuccuccaagcgggagcugccaugugguuguuggggauuaaacuccauaccucuaaaaagaacagccagugcucuuaaccacugagccaucucgacagcccuaagaacaggaucuuacuguguaacccuggcuggcccggaauggcuuuuuguuuuauuaaugacuaucugugugugcauauaugugguauauaugcauguauagaugugagugugagcaccugcauguguucauauacaggccagaagaggauaucaaguguccuauucuacuacucccugccuuauucccuggaggccagggucuaccccugacucuggagcuaggcuggcgucugacaggcucgagcagcccuuuugucuguaucccucacagggcugggaucacagcaccgcugaguccacgcuuggcuuuucuugaguucgagggauuugaaaguuggucuucauccuuguucauuaauccaccuuacccacuaagccaucuccacccccauccucacucccauuuuuuaagaucggguuucguguagcuggccacaaacucuguacguaggcgaggaugacauuggauuucugauuaucagccuuuaaccccaaguacagcccugggcuaccaugucuggcaagugaaccauggaccuggugcaugcuagguaagaacucuaucacaaagcugagcugugccugcagcccucugcagcaccccacagccccugcagcccuccccgcagcccucugcagccccccgaccccccugcagccccugcagcccucccuguagucccugaagcccucccggcaacccuccccaacccucugcagccccugcagccccuaccccccauccccucaacucauuguguuuacguuguaucauugcagaauugacuauggccaggguugcuaauaggagcuccucuuucucaggcuucaggacagcucuccuuuaguaguauucuccagggaagaaagucagcugauguucugaaauuaacuggcccauuuuaaauaugacuaaguguuuuuuuuuuuuuuuugauagagugacuuuuuccuacugaaagagcuuugugacaagcagagccugaagggagcuaacauuaugaaauaccuuguucacuccugauacuucuugaauagaaagcaucuucugugugccagacagugaucuaagcaugacauugggguaaaacccugauccuccaagaacaaucagguacacucccagggagcaugucugugcuuacuucccgugaccuaccgcgcacaccuaauuguagcucucaguugaguucguuuuccccuuuaaagucaggaaauugggcugaaguugaauaacucuccucugacucaaagccuggugcacuuucuagcaugguacacucuguuggcuauguugauaugugguuuccuguuuuucaagaauuacagcuugacuuaaaauauaaauaguauuucuccuuggcuaaguaauucucaucacaacuaugguguaagcauuuucuucuagcaucccagauauauauuuauauguccacaauauauacuaugcacauggaaaacauuaagucaacccauuuaacagacaaguuguauugaucuguaccgaggaucuuagcuagaccaguaguacagauuuguaacuccagauguucagaaaacagagacaggaggaucacaaguucaaagguaagagcuggagagaugguuuagugguuaugagcacugacugaucucacaaaugacccagguucaauuacuagcucccacgugguugcuuacaaugcaguuucaggggauccaaaacccuuuucuggccuccgaggacauggcaaggacaccugcacagacacacgcaugcaaagcaaauacacacauaaaauaaaaacuaauuggaucucaaaaaaagagagacaaguuuaaggguagccuuaccaaguuacuuguuaagacuuuuauuauuauuauuauuauuauuuauuauuauacugcuaggcauugugguacagaucuuuaaucucaggacuugagagccauaggcagaugaguccuugugaguucaaagccagccuggacuauauagugagauccugucuuaugaaaaccacacaaauaauaaaucaaacaaaaagggcugaguauauaguauuguaaaagaugaggccacuuuccuggaguuguggaguagagacaggcuuccugccuaccuacuuaucaaguaagagaccuagucucgaaaacaagguggaugacuccugagggaccacucccaaagguauccucuggccucugcaccuuacaaacugccuuuuuuuuuuuuuuucuuuuguuuuuuugagacaggguuucucuguguagcccuggcuguucuggaacucacuccauagaccaggcuggccucgaacucagaaauccgcccgccucugccucccaagugcugggauuaaaggcgugcaccaccacugcccgacuauaaacugccuucuuuaauuuagaaaaaaacccuuucgagaauuuauggaagcuguauuuguggguuucaagaauucaugccuuguaaaguccuccuccccauaccauugccuacagccugggagauaaguuggguguguguguguugaugcagucauuuagguguuacauacuucagagccacagauguccccauuagugccacagucacuguuucuggucugucugcgaaugcuggugcagaauuugcauuuguaaccaggagcuguugcugcuucuauuucuggaacaagguucagcaccacugcuuauagcaacggcuuaacaccaggguucugcccuggaugugcaggcugaugcgucuuuaaugugucuccugccacuucucagacucugggcaaagcaauucgcuucuggucaaggaaugugaggauguuauauuauccuacuuacaagcuaacaaauuaacccgccuggagaccucugggugacagcagagugauuuugucauuuguaaugguaguugcuagagugacaguauucucuuuucuuacucuuguuuccuaagugccaauuggcaaaagacacugcagucucagggagcaagcuguguuccaggagggaauccagagcucaaggaacccccucuuuuauaauuggcuguacagcugcucuguacuccaggggagauacugucuugaucacacuguauaauaaacauguuccccuuugcuggagaaguagacgcuagcugcauuucccaaggcuguuccauacauacauucuugagaguaaccuguauccuguaucguagacacuuggcaccucugcuugucugugucacagaccugagaauugucucuaaaauaagagaagggacacaauagcacuuucuuuacuacuugaggagguuaaaccacuaaaucugugggaacuuggaacagaaaauuauaaauacuacuauuaauaaguaugugguauuuuuacucuugcagggaaauguuguggugacugucacauuuuauucauuuguucugugcauauauguauguguguggauacaugccugcugcaauauuuaugaggaggucagaggacaacuuaguguguuuuauaaaaagauagagaaaccagagauauguuugguggauguguagucaggugugggggaagagggugccucugggggcccaugcugaggcaucccuuccccugagggaccagccguacaguauagaauaagaguuuaauuagggcauggggaggggaguugagaccguaguaaagagagaaagagagagagagagagaagaugagaggaugagaggagagaccagaccagaccagaucagaccagaccagaccagccaugagcauauggagagagaggggaggggaaauggggagagaggguaaagagcuacacagcaagagcaagaaaggaagagagggaggagggcagggcauggcaacacaagccuuuaaucccagcacuuggcagaggcagaggcagguggauuucugaguuuggggccagccuggucuacagagugaguuuucaggacauuuccaggacagccaaggcuacacagagaaacccugucucgaaaaaccacaaaggggguaagcaggcccuuuuauagugagucaggcacagcugacgauugccaggucacugaggggcagagccuagacuaaaugccaacaugccaacacaacuuguaggaguugguucacuccuuccgaaaugugguucaaagucaggugcgugguggcgcacgccuuuaauccuagcacuugggaggcagaggcaggaggauuucugaguucgaggccagccuggucuacaaagugaguuccaggacagccagagcuauacagagaaacccugucuugaaaaacaaacaaacaaacaaacaaacaaaagccaaaaacaaacaaacauacauacaaaaaagucagguugcuaggcauagugaccauuguuuuuuuacccacugagcucucucucuggcccucuuuccuuuuuaacaguaaaucauaagcacagggucuggagcagugacucuucaggcaagagcacuuacuguucuuugggaugagcuauuucuguucuugggacccacacaguggcuuacaaccaucuguaacuucaguucugggggaucuggcgcccucuuuugaccccugaggcuauugcaugcacacagacagcaaaaacacugauacacaccgauugugaauucaaaugcucucccgaaaguaaguucacaugcuugaacauuuggucccacuuuguacuucugcaggaacuaugucacuaggugcuggcauuucaagucccuucucucugcuuucugcucaagauuggagaugugaggucucagcugucccugcugccaugccugugacugacucuucccugcuauggugaauucuuauuuucuuuaaguuuccuugaucaugauguuuuaucacagcagaagaaaagaaacuaauacauaaaauauuucaaaauauagguguauauauucaccucucucuagagauagggucuugcuguguagacuggccuugaacucaggaucuggagcaucacuacacccagcugagaaucuucuuccaaauuggauucaguuucaacugcugcuugcaccgaugaguagcaccaggcuacucauucuagcaccaggcuggaagggugugggucgccuccugccacacaagggacuuaauuaaggagaguacaaaagugauuccccaagaauagaagaauucaucaucugggagaucguauaacuucaaauaauccaaccuggaaaaaccccucacagguguccuagguacuuggguuuuaguucauuccaacuuagccaaauugacagggagaucagccaucacacuugaacugugggaguuguugcuuucacugguucccuggggguaucugaggugugaaauuucuuuuccccaauggugacacacgccuuuaaccccagcucucaggcugcaaaggcagguggagcuuuuugaguuugaggccagccugguugugauggcuagucccuguuggcaacuugacuauauuuggaguaaacuauagcacagauuuggagcacaccugugauccagagccugaggcuggaagacacacgccuuuaaucuagauccugagacacaccuucaaucuggggcacgcuuucugcuggaggccuacuuaaggacgguggaaaggggaaguguucauucuuugcugcuugcacuuaccgccagcaccucugcuggaaaccguuucuucaggauucuagcucauacaaaagaccagcugaaauauccagccucgugggacuucccagucacagcugcccauuguuggguuaguuggacuauagccuguaaguaauuccuauaaauuccauauauauguguguguguguaucauaguucuguuccucuagagagcacuaguucugacuagcacacuagucuacagagugaguuccuggccagccagugcuacacagagcaacccugucucgaaaaaacaaacuaacaaaacgagaacaccuagguaaggaacagugauguuguucaaaauguuuuaauugggucuacauuuuuuuuuccccaagacagucucacuauagcucuagcuguccugaacccacuaugcagaccaagcuggcuuugaacucacagagaucugccugccucugccucccuccggaguacugggauuaaauguguguacaguuuauaccuuuguauugagccacguuccuuucaguuugggguuguacaugucugcuugacuaugcuacacuggcaaauucccuucccaucucagaggcuugaccaaauggaagcuuuacuuuauacuuugugugcuguacugagcagggcuggagggaaacuugauacacauugggaaacuccagcuacugggcagucucauuuuuuucuuucuuucauuuuucaguaguucuuugaggauuagguacaauguguucugaacauaauuaccuugccuuccacuccucccagaauuaccugccuuuccuacaaaucaaacccauguauucuuagauguguggccuaccacaaggacagucucacuagggacaacacuccucaacacucucucucucucucucucucucucucucucucucucucugaaacuaucaauaaccaauagcucuucagcuaggugggacucugugccuaccuuuucucuccucagcuguggggacucagcccaauuucucucuccucagcuggggggcgggguaucucuguuucccacuuucuuucuccaugcugagauguugucugaccugagcuugcacaggccuugugcuugcuaucccaagcacggugagcucacauaugcaacugcugugcccagaauaguucccuuauaguuauccacugucccuggagcugcaucugacugaggugagcuaagaaauaaaaauacacuuuaauauaaauuagucucagauacugguguauacuaaaaaaaaguuaaaagaaguucuauccuguuacuuuucugccuaagacccauuguuguguuuuauaaaaagauagagaagauauuugagagaggugugguguggggggagggggugccucugagugcccaugcugaggcaugccuuuccccuuugaggugccaguccuguggcugguauaguauagaauagaguuuauucagggcguggggacgggaguugagggaguaggagagagagagagagagagagagagagaagagagagagagagucagagacacacagagagagagagggagacagagagagagacagagguagagagaaguagaggcuggucaugaguguguggcaagaagaggggggaggggaaugggggagagagagagggagcaagagcuagagagagaggaggggaggaggggggcauacagccccuuuuauagugagucaggcacaccugacuguugccagguaacuguagggcagagccuagaauaaaugccaaccaacacccauucccauuuauucuuguugccauggacccuacuuuuguauggaacuacacuuguccugccugggauguugggccaucacuuuucucugccaguucauguccugaaucaccugccucucuugaagcuagaaggagacuauucucuuuuucuuuucuuuuuuuuuuucuuuguuuucuuuucuuucuuucuuucuuuuuuuuuuguuuuuguuuuauuguuuuuuugagacaggguuucucuguauagcucuggcuguccuggaacucacucuguagaccaggcuggccuugaagccagaaauccaccugccucugccucccaaaugcugggauuaaagucgugcgccaccacgccuggcuuuauuauuauuauuauuauuauuauuauauguaaguacacugaaguugucuucggacacuccagaagagggcauccaaucuaauuacagaugguugugggccaccaugugguugcugggauuugaacucaggaccucuggaagaacagucagugcucuuaacugcugagccaucucuccagcccccgagacuguuuucuaguguagauuguugauagucuagacuuggggaagaauuuuccauuccugacaaaaggaggacauuuugggugacccauccacacgcccuucucccacacucuuccucuuugcuuugacuaugaguuagaugucuggcucuagugucgggcuuuuuguaugucaagaugacaagcauugaugagagcagaguuccugaugccauaaccaaguagcugaaagucuccuggcuuugcuguggaagaaacauugggccgagcaguuguuacuugauauccagcacauugcuaauucuuagagcuaucccagaauagagcuggggcuuuggagaguugcugagagcauauugcaacaaugaguuuugguggggagguggugcuuccuaagaauguguccuucagcugagcgccacaauggcagaggggacuugggugugugcuuguaucugcaugcggcuagugccagaacugcugaagcauggccucuggcuggaaguugacuggaaacaaauuguucucuaguauugguuuccuggcuuguggguccaugcggugcuggaggauggagaagugauagucaucaagucagugggggguggagugugucucagguaggguucuacugcuaugaagagagaccaaggaagagggcgucagaucucauuacaggugguugugaccauguuguugcugggauucgcacucaggaccuucugaagaucagccagugcucuuacccaccgagucaucuggccgccagucccuauuuauuuauauuuuuauguauaugaguacaauuauagcugucuucagaugcuagaagagggcaucagaucccauuacaaauguugugagucaccaugugguugcugggaccacuggaagagcagucagugcucuuaaccccugagccccagggugaggaucuuaaagccuaugcccagagugacaccacauacuccaacagggccacaccuccgaauagugccacucccuggcccaagcauaugcaaaccaucacagaguggaauccuggaagauggugguaggaagcugugggggaggaugugugacucaugagucaccccaaagugcugcuuacuaucaaggacagcuacuccugggaaguguggggaggaaaaggagaaguagagaugaguagaaacugacugguucaagcacccucuagcucuuguagacccugucauauuugccuuuggaaacuaggucaugaucaugcaauuuaaggccugaauaauucgcucugaccauucaaaagugggaccuucuggguaugaccaaaccaagauaaugccaccuaggaagugcuuccugugagcuaaccuuugugcuaaaacuuuuccauuuuuuaugauaauaaugaugacaaugaugaugauguaaugaaauuaaucccagaacucugaaggcagaagcagguaaaucucugaguuccaggccagccuggucuacagagcuggacagccacugcuauacaacgaaacccuguuucaaaaauccaaaacgguucucccucuugcucuuccuccuccguaucaugcuuauccuccuuaucuugcucuucuuccuccauaucgccaucaucuggaagcuagagaaaugggucagugauuaagaagacugguugcagagaggacucggguucaguucccagcaccacauacaugguggcuuacaacugucuauaaauucaguuccuagguaucugguaaucucuucuggcuugcacagguguuagggaugcaaauacuguacaaauauacaccaggcaaagaauuuagacacguaaaauaaaacagauuuuuauuuuuuuuuugguuuuucgagacaggguuucucuguguagcccuggcuguccuggaacucacucuguagaccaggguagccucgaacucagaaauccgccugccucugccucccgagugcugggaucaaaggcgugcgccaccacgcccggcaaaacaaauaaaucuuaaguaauuuaaaggauugaaaaaucaguagauccacagaagaauauaauaaaauauuuguuauaauauuuguaaaauuaauuauuuuuaauacagacguugggaucccagagucacccgcaaaccacacaaauucugaucucagugagacugggaugguuuugugaaagcacucccuaagacugaucaauccaggucuguugcccagaauuugggggcagagucuaugaccuugaacaucuuucucugccaucuuauaaagguuaaaaccacaaaaaccauagagugaggucaacacagauacagaaagugcugcccgguggucugccauuuaaacauaacaguucauauugaccucuaauuugauggguccuauggaaagcuuuguggaauuucguaagauuagcaagccucauauagaacauaacagaauaugugaucagcaugaccuugcucugagucaaguuacuuuucuguguuaaugacucgcaggcauauuacaacaacaauaugaaauugcugauagucauggaacaaaaugucuacagcuaggccaggggaggugaggggcagaccucaacauaaauauguuuuggaaauuaauacggugacaguauuucuuuauccuaacuaguucccaauaagaacacagaacaagauuuucaagcugcaccucaauauuugggcagucaaauggucuaucuuaaccccuaagcuaaucuugccaccucccagccaugaugccaaauaauucuugcaauuaggguuucuaucauccagcugaacucuucaaaagccucccucccucccucccucccucccucccucccucccucccucccucccuuccuuccuuccuuccuuccuuccuuccuuccuuuucauggccaaucuccuuuucauccaucucuugccuccuuucacuggcuggugcaaguccuguccuauucuuucuucuaccuagccauugauggucagcauuuauugacaaaucagagaguaagaauuguuuaugcaaauuugagacaggagauucuugacauaaguauuacaaagcugugcucagauuaaaacaagauaugagugcagagaaaucagcauuuggauaacaaugacaaccuuuacacagugcacucaggaaaauacgccuauaggauuuaacaugaaaagggaauaucccuguccauaccuccagugcaaccacuuggcuuaugcuaguccaaacuguguaugugguuauguauaaaaauacagacaagaaccuuuaaaacaaacaaacaaacaaacaaacaaacaaacacacaaacacccagauuggccuaucuacugacuggcaggcacauuacuucucagaaugacuuaccacaauugacuuugcucaaucugucauauguggcaaguuguuaccacucuuauuagaaaucauaucuaccuuucuguauacauguaaauauauaaauauauuuaugggggcuggacagauaacucaauaguuaagagcacugacuggagagcaggguguggggggcaguauaagggacuuuugggauagcauuugaauuguaaaugaagaaaauaucuaguaaaaaaauuguuuaaaaaaaaaagcacugacugcucuuucagagguccugaguucaauucccagcaaccacaugguggcucacagccaucuguaaugggaucugaugcccccuuaaggugugucugaagaaaaggagcgaugguguacucacauacauuaaauaaauaacaaauauacauguauauaugaacaugcauaguacauauaugcaucacauacauacacacagauauggaaugguucaagauacuguaccuaggcaaggccuuuaauauaccaggcaaguguuccucugcugagcugcuacaucccagaccccccuaugaccacagauaaacacacacacacacacacacacaggauuuuuuuguuuguuuguuugguuuuuggguuuguuuguuugauugguugguugguuggguugguugguuuuccccuuuggggguguguaugaauggguccuguaucccuggcugaucucagacucaugaaccuugaacucuuccuacuucagccucccaagugguuacugucaugugcaccacacccagccucaugugacuguguuaggccugcugagugguaugguuacuggcaagugcaccacgcccagcuucacgugacuauguuuggggguggaggauuggccagaguguaacuauguaggugacuguauucuaaggaaugguuuccuuuacaaagcaauuucuuaaaaaagagaugcuagccccgagggcuggagauauggcuuagugguuaagagcacuagcugcucuuccagaggaccuggguuuaguucccagcauccacaugucugcucacacccgucugcaacuccaguuccaggagaucuaauuccuucuucuggauaccagucaugcaggcaaugccugcagacauacaagcaggcaaaacacccauacauauacauaaaauaaaaauaaauaaaaucuagucacuggguguagugguaaacuccuuucauucuacucaagaggcagauagagcucugugauuucagggccagccuggucuacauaaugaguuccaggacagccaaagcuacauagcgagacccugucucaacaaaacaaacaaucaaaaaauuuaaaacauuuaaagacaauuuuuuuuagagagauacuaacuuuuuuuuugcugugauuagaauaauuuucugauuauaccgggcccuuuaucucagcuuacaucugauaaaguagauaugcacuagcugugcaaaccacguagggucguauuaaacagaucuuguggacagaaucuggucuacucugggggauuaaacccugcaauccuguggugcggucauuccagucuuaccucugugguuucggaaggccugugugcucagcuaaguugggguaugaacugcacaggcuguggucuccuucccucccuacgcaccuuguuggcuguuccucagcuguccagcuagcuuguaggaucaucuugaauugguggucagggcuugcuucucucaugaguccuccaauguuacauucucuaaucaaccucuaugagcuuucaguaucccaccucaguuccucucagacagucucugccccaccuuugguuuucucuacaguagcuuuugggguagaauaucuguuuugcuuguuagcauuuugucugacauuaguacuggcaguguugugugcuuugaccucugguguuucuucacuggcuuaggagcugggaaucuuaucaguuuuguuuguuguuauugugauaagacacuuuaaccaaagcaacuuaagagagaaaggauuuauuugauggaucauaauucggagguuucaguccuaaaguucagacaggaauuugaaacagcuggucauauuaccuccauaaucaagagcaaagaacaauaaauuaauguaugcaugccaguguacaguucauuuuucuccacuuauccaguucagcauuuuuuaaaagauuuauuuauuauauuuaugugaguacacuguagcugucuucagacacaccagaagagggcauugaauugcauuacagauaguugugagccaccauguggcugcugggaauugaacucaggaccucuggaagagcaggcagagcuguucaucacugagccaucucuccagcccaguucagcauucuuuacuuagggaauggugcuacccagagugggcagguauucucacugcaguuaaagcacaaucaagagaguccuuacaccuucucuucucuucucuucucuucucuucucuucucuucucuucucuucucuucucuucucuuuucucucucuucucuuuuccccuccuguccccuccccuaucucuucucuucucuucucuucucuucucaugcaagcccuuucuuucucucuuucuccaccucuuuccccauggcaacuuuccuggccuccuuccuuggugccaguaaacucacccaccugagagcagcaucccaaaaagccugucuuuaauacauucuuuuagaaccuuaguccucacagacaggaccacagaucuugacagucccucaccgagauucccuacccauaugauucuagauuguguuauuaauaagguagacaccuuugcugugcaaacaguuuggacuucuuuaucacagagucacggaugggaguuccauuguagacucuucagaugccucuacagaaguauucucaggaauaaugucaacacaauucugacauugcacacagauaaucuucuaugugcaagagugagagcagggagggaggggacagaaaguaaacuguuagcaauaugggaagagagaaaaagagaaaagggacgcgaaaucagaggaggaugaaaacagauauggaguuggagauuguagaacuugccuaaggccacuguaacuggcuggaggacugacucuaaaagaaauuugacccugaaaaccuuacagcugcugggguaugagugaaagguaauguaccaucugcugcauuguagccuuugggaggagagauaacaguaacaaauaaugucuaccagcauggaaacauuguaguuaagugguuuaaauuauuugaagagggacaucaaaggccuuaucagcaccgccaguauugcccagugggucagcuucagaagaaauuguaacaguuaaaaguaauuacagguggcaauugaaaaugauuacagauuucauguaguguugccauuuguaucaaauagugauaaauuauuaagguaauuuggcaaccuaccuugucuuuacuaaugcuugaagaaaaaacagaaacagacaagagugaagcaaguuagcguaagugcagccaauuuacaaauagacaggagggaaaggaaacagcugcugauauuuacucaaaguuauuccuagacacagauaguaccaaggccgccugcagacugcagaacaaauguguuuucuuaaaauucagucccauuuucagagaauaaaccaagaauuuuauuuuaagccaguguaugacacaugacuguaauugcaacuuguaggagguagaggcaggaagaucaggcaaucucuguuguagagugauuuuugagagccuguuuaaaauugaagaaaagggaggaagagaagaaggaggagaauuccaguugggcuuaauuguuuguuuuuugagacagggacuuguuauauagcuuagcccagccuugaaugaacucuuauggaauuauaagcaugugccucgacaccuagccaaccuacauuuuaaaaaauugaauuuauguuuaauaauuacaggcauugugacccuuuuccccaacaccagcaggcauggcacaggggcuggggcauaugucccccuacugguuuucugcaaagcauuacagucuuacaugagaaucagcuguucucuugcacacucaguauguuuucccuucuccucuuaguccuuucaaggaugcuagcacaaccugugaccuugggcugauagcuucaaaccuagugucucauuugcaagaugagauauuaguguauacuucagaaagguuauuuuacuguuuacaugaaacauuucucaaaggcuuaacauagugcucagcacaaaguugacacucagaacaugguauucccuucccuccuucccauaauaaaccuauguauguuuuuuuuuuccuucuaaaaugcuuuaaguagcagccucaaaguccauaguaauguuuggcuucucucucucucucucucucuuuucucucucucuaguauagaauagaguuuauucaguguauggggaggggaguuaagaggguagcagaggcagagaaggagagaguaaagaaaugggggccuggccauggccacaugggggggggcagggaaagggaguaagggggcuagaggcaacagagaggcuagaguguaauagaguaagagagcaauguuuggauucugaaauaugcuauuuuguucauucaacuuggaaguuagugacgaacaauuuucuuucuuucuuucuaaaauaguuuuucucucugagaaugucauauuacauuuugagcaucccccaacuccuucuagauccauccccaucucccuacccccaacuucauguucuuuuuuuuguugauaucccaugaacuucaguuugugcugccccgugcuacuaugugugggaccaauccacuggagucugguccacccacccugaaaaaccuacuguccccauuugaaagcugccggagcaucucaguuagggguagggcucauuggcuaccccaugcugcagugcggauuggcuugaucccacccaggccuuuugcaggcaucucagcugcugggcugauaaguagucccuucaacucugaaagacuuuguuucaguccucuuuguuucaguccucccuggccucuggcucuuauaaccuuaguguucccucuucugagauguucucugagccuuggguggugguggugguguaauauuguaauacagauggcccuuuugugugcuaguacucuacuaacacuuuuucucugcacucgacccucgugacuuucuggguuaacugccauccauugcacaaagaaacuucccugaugaggucugagagcugcacuaucuaugaguagagagauacaacuuuagauacuauguccagaauaguguguaacagagauaauauguaacuuagauacugcguaacagaauaauaguggguuuacuggcugagguuuacaucuuuaaucccagcacuugagagacagaagcuggcagaugucugguaaguucuagaccagccuaaucgacauagugaauuccagacuaucuacggcugcauaauaagacccuguuucaaacaaacauaguagcagaucugccagugcaaccugugagcccccaaccauggaucuugggucagauuuacaaguaccaaguguguguucccuccuauagagugaccuaaaaucuauucagaacccaguaggcuacagcauauuugccuacuguugugccugugagcauuuuuucccauuacaggucaguguugaggucacaggguuuguaagugaauuuguccauugauuuuuuuuuucucucccagcagcucguucuaggaaaacuauccaguaggagaaagcuuccuggucaguaccuguaacaaacgugucuuuagcaauggggucuuaccaggaaguccuggugggcaaccaagagcaauggcaguaggcuguauuauuuuggggggaguagucucauggauaccucugaccaacaacaauuuaggggggaguuaucccacacuuggcacugagucaaauuacauuccauauaaauacucggaaguuuauagaagaguagauuucuguguaucuuuuuuuuuuuuuuuuuuuuuuuuuuuuuuuuuugguuuuuugagacaggguuucucuguguagcccuggcuguccuggaacucacucuguagaccaggcuggccuugaacucagaaauccgccugccucugccuccagagugcuaguauuaaaggcgugcgccaccacgcccggcucugugugucuuuuaaacacccuuaauaauuaguuaccccucccccaacacccuccgcucuaucuuuccaucucucucccaacugaaacccccugccauuaucccccucccccuucaugccucucgugcuuuacucuuucucucucucccuuaacaccuuucucuuccuuucaaccaauggucucugucuaauauucugugcuuugaggccucuccuuacuggacacacaaauguaagauuugauucucagagcuauguacgagugagaucguguggcauuuguccuuucugggucuccauuauuucgucaguauaauguucgggaagcugccacauugauuuccacaguggcugcaccaaucuguacucccaacagugcauggggcuucccugcaucccaccaacaucucuugccuuucguuucuuuaaucuuagccacucugacugaguuaacgugacaucucaaaaaaguuuuaacuuucauuucccugaugacuaaggauggugagcauuacuucuuauuuucuuauuucuuagccguuuuguauuugcaaggaagcauuuccuaauucaacugugagcucucaguguugccuccuuggugguggcaagcuggguguagggcgcccuuguguuugcucaugagcucacauuugacauugcuguuuuucuuccagaugagcaccuuccacugaccagcagcaauggcuuuuaaggacagcagcagcagcagguaaguguggaguccacgauucaaaagaauuucacauuuaaaaugacauuuaacuuuacaaucugauauucuaauaaguuccagcugccaugguggcaccugccuauaacuucagcgcucuagagucguaagccagcuuggaucccacagaaagauuagccagggcuccauagcaagacccugguuugaaaagccaagcaaguaagcuggauauuguagcauacaccuuuuagucccaggguuugggaggcagaagcaggcagaucuccugcuguugguggggugugaugguacacaccuuuaauucaugagcugggggagggggcuuaucagaaguucagugucaaacaggagcauacagagggagggaaaagugggacuauuagcuagaucaucgaauucuguauccaggauacuggccugaguauccauuacugguuuuaggaaacacaugcacuaagacugugccuaaagguugucuuugugugugccuccaugaagggaaccucugauacuuaccucuuuuuuuuuuuuuuuuuuuuuuuacuuucuagcugcaguuuauucaaguauaucaaucuccuucuuuuuuuuuuuccauuuuuuauuagguauuuagcucauuuacauuuccaaugcuauaccaaaagucccccauagccacccacccccagauacuaccucuuauucucccucaucucuccuacucgguguaugcaguguagaaguugccuuuuuuuguacaaagugacaaguguuaauuguguagagugcucuauacuaacuauugaugcagucuugaagaauaccuccaugugggauuuucaguaauauggauaaguuaauuaaaguagcuauucaaaaacacauuaaaaaaaaaaaagugacccggugugguggugcacgccuuuaaucccagcacucgggaagcagaggcaggcggauuucugaguucgaggccagccuggucuacagagugaguuccaggacagccagggcuauacagagaaacccugucuugaaaaaccaaaaaaaaaaaaaaaaaaaaaagugacucauaccacucaguaaauuaguauuuauugaguaagaagaaauggaaccugggaacucaggacaagucuguccuuccugcuuccuccccucuauggacuucaguguugugaucugaggguccuguugugaaucuugguacauucuccucuccuacuacagggacaacaugggaccuucuaagaccgaguauaaaacugccuucauuugucuuuaaguuuguucauacuuuuggcuacacauaaguucuugcauaaaugccuuguccuuuauagauugguuuugacuguacuuccaaaggccuuuccuacuccaggccuguauucuuagcugacauuuaaaugacuucggguuuuuuuuuuuuuuuuaaugagaauuuguaagcugguggcacucgugguugaucugcucuacauaugggcuuugguuggcucuucacagcauuucaagaagauuaucugcagauauuucauguagcaauccagauuuucaguuuuugagaauuuuaaguuuuaggaacccuggaauguuaugcugcagagccgcucacgugaauggaaugcauguaauucagcacacauauucucuuucuaaaagauuuguguguguguguguguguacauguucucucucucucucaaguacaggugcucuuagaggccagaaguauuggauucucauagggcuguaguuuccagcuguugugaaguguugugaacugugugugugugguggggauagguuccggucuacuucaagggcagucuguguacuuaaccacuaagcaaucucuccaaccauaccuugucuuuaagaaagaguuucaccaggcagugguggugcgugucuuuaaucccagcacucaggaggcagaggcaggugguggauuugaguucuaggccagccuggucuacagagugaguuccaggacagucagagcuauacagagaaacccuaucuugaaaaaaaaaaaaagcaacaacaacaaaaaaaaagcaaaacgaaaagaaaauuccggugcauguuuguaauucuaccacccaggagacuaagacuagaagagccagaguuuggggucagccuggucuacaugagaccucaguguuucaaauaaaaugaaauaaaagaugauucagaaauguccucuugcagaagauccaaauuuggcucccaacauuuacuuuggguaacuuaaaacuguguguaagccacacuaccugaaaucugaugcccacuuacuucuggcuucugaguauaucaguacuaaaauaccccauauaagcaaauauauauauauuuuuauauauguauauguaauuucaaauagccaggcacagacaggggcucacaucuuuaauucuagcagcugggagagagagguaagcagaucucugcguuugaggccagucugguggucuaucuagacaguuuaaggccagccagauuaaaccugccuaaaaauaaguaaauaaauagguaaguaaauaguaaaucuaagcugggcggugguggugcaccaccaccagcacuuaggaggcagaggcaggcagauuucugaguucuaggcaagccuggucuacagagugaguuccaggacagccagggcuacccagagaaacccuaucucgaaaaaaaacaaaacaaaacaaaacaaaaaaauaguaaaucuaucuuuuucuuguuuuagaagcagagucucucuaaggagguuaaaagccacuaugccuagcuaaguauuuuuuucuuuaagauuaaagguggguggaggugguagcacacacguuuaugauugucauucagaaaacagaggcagggaugucucugugaguuugaagccagcauggucuacagagcuacuucuagaacagccagggcucuggagauguuguuuuuuuucuuuuuugagacagggauguauuuuaaacauacauguuuuucuuuucuuuuuuuugcauauuuuuuaaaaauuuuauauuucauacauguuuuucuuaucacauucggguguguguguguguguguguguguguguguguguguguguacaggggcauauacaugccacagaauauguggagagaucagaggacaguuugcaggcauggauucugcccuucuacuguguugguuccagggaugggacucaugggacucaagauugcuggguuugguggcuuaccuuacccacuguucuuaccuaccagguccccaaguucccuuuagagcagaggguuuuacuauugaggcgacccuuuaauacaguuccucauguuguagugaucccucuccaaccuuaagguuauuuuuguugcuacuuuauaaccuuaauucugcuacuguuaagaauaguaaugcaaauagcuguguuuucucauggcuuuaaacaucccuguugagaaucacuucuuuagaugcuguugcuccuugauaaggacaaauggaugugugaaugaauagcuagcucaaauucaagccacguuuucaaucaucucaccuuuaauuugugcaguuuuacuuggaguuugauugcuuuuuuaacccccuuacagaagcagaacuauuuuuuuuuuuucauuuugauucucacccuuauuuaucagucgcuacaacuucucauuuccuucugugaaucuuaaagguaaagucaagguuuuccuacugugugcuaaacuaucuucuaggugugacacugggaccagaugaaguugagaggcauucaggaaauauuugcuuuagagcugaggaacguaaauuuuauuuuagaguauccuaccagauuguuggucugauuuaaucuucugccuugauacuuuguucugcugauacguguuucaguguuuggggaacccagagggcuuguaauuuguuaucucugauccggucaguggugucuuccuccugcagaaaaccgcaacacuguagcuucuccuaauugagaagcuacgagguguggagcagauuaacaccuauuauucagacagauuuucucggggggccuguaaaccagcagcugaaguguuacuaaagugcuuauaaagagauuaauggcccuugaccaugccuucccccacccucacccccaccucccgcccccgaaauagugauuggcuugggcauuuuaaugaauccacaccuggaaaaauggagugggagcguguagacaaauccaggguuuuccaagugaaguagcuucuggccucacuugcaagcucuugcugcuuugggcacaggacauggcuuuccacuguuuaagaaacacauugcuaauuggcagguuuuggucauugucccuggaacuuuaaaugaguuaguccaguuggaugagcuugagaagguuuaguuuaggguuuaucucagacaggagggaaucuuuuuuuuuuuuuuuuuuaauuguuuauugaaggauuaguuaaucugagggugggaaguagggauuaaauuguagaaacagagguagugagucauuucccaguaagaucauaugaccugucaucacagucaugacaggaacugugggcaggaccuauagccagcuggugugguggccucuccugagacaguuaugaaggcagacugauuguuagagccucgauaaacucggcucaggaaaaucaugugcugugccugcagcaucuuaaacccugacucucacaccaaccuccacucaggcaaccuucauucuccuucgagggagggcuuugguuagcagucagacccuagacagaagggggagccucugugguaacugccacagcucacuuccuaccuacaaacaaacuaggugcacaccagucgguagcccuagcuggagguguuuacagguuuggugguaguagcacacaccuuuaaucccagcacugggaggcagagggcaaaacccggucuacugagcgaguuccaggacagccaggguuacccagagaaaccuugucuugaaaaaccaagaaagaaagaaagaaagaaagaaagaaagaaagaaagaaagaaaggaauaaauuguuccauaauauuuacacaucuguaacaaacauaagguauaauuuucacccauuuuaagaauacacauuaauacuuuaagcccaaauuuauuuuuuaaacauuuucuuaguuuugugcauauuuuuauauuauuaugugcaugccuggugcucauggaggccaaaagagugcuuugaacucccucccugacaggccgagagcuaaaccagggccccgaaagaguggccagugcucuuaacugcugaacuguuuccccaacuccaugacagcccacuuuuaggaacucucaucacuaauaaccaagguuacauuuuauuuuauuuuuuuguaguuaauccuaguaucuccaucccuaccuaucaauccuauuaagcauuugucaugauacuuucaccuguucugagcaguucauacaaauguacauguguguugcagcuugcauuuguuucauucauuuuuuuuuuuuauugccagagaauaagccacugacuguauccuuuucuuacuguucacacucaggcuguuucuucccacugugaguugugugcuuguguuuuuauuuggguggaggguggguguuuaggagauguauuugugaggcagccaugucugcagucaucuaccgauuauucuaagcacaagagucuuagagccuaaggugguuucacauuuauuugcauguggcuuccaaccuucccccuccccccaccagccuuccaucauagcuguaggaaugcugacaaccgaaagcugaugauacaaucuugucccugcuuuccaugaagugcacacuguccgggccauccccucggcuuagauaugaaugaacacacugcucguguuuggagucuguuggaugcugaggcagggagaauccuuucuguccgaacagcucagcugugauaccacuuacccugugagacuggcugggagcuuccuucagaauucagggaccaucgcuucucggccuuuuggcuaagaucaagugaagaauucagggaccagaguuggaauucaguuccauuugcccugauuuucacaaguuugggguaucauuucaaaucaccacuuuuuuuuuucccucgucauuguauuccugaaaacagcaaugacugagugugugacuaaggccacaguugcuagacuagucuaggccacuagacugcugggcucugaaguaguuugagcuugcaauaagagaaguagcacaaguccuguaugcuuucguuucugcucugagcaauuuguccuaaccccuuugccaaaugaaggcauuucccagucaacagugcagaaagauacuguuuuguugucauagaaaagacagggguggaggcuugggggacugacugaagagaccgcucagcgguuaagagcauugacugcugcucuuccagaagccucaaguucaauucccagcagucacauggugacucacaaccaucugcaaaaugggaucccaugcucucuucuggugugucugaagacagcuacaguguacuccuauaaauaaaauaaauagcuguuaagaaauaauuaaaguaagacuuauaggaggcugauaaaguggcucagcgaacaaaggugccuugaacucaagccucaggauccaggaacuagacggguggauggagggaacugacugugaccccaggcuguugccacacacacaguugggcagacugcaaacaaacaaacaaacaaauguaauaacaacaaauguaacuuuuuuuguuuguuuguuuuguuuuguuuuguuuuguuuuucgagacaggguuucucuguguagcccuggcuguccuggaacucacuuuguagaccaggcugaccucgaacucaaaaaucugccuccgccucccaaacucugggauuaaaggcgugcgccaccacgccuggcacaacaaauguaaaagauccacuggccuuggguucuauucugagcgcacacacacacacacacacacacacacacuuaaauaaacacuggacuugguguggugugggggucuguuguggucuggcacaugccuuuaaucccagcacucaggagagagaaacaggcugaucucugaguuccaggccagucugguggucuaaauagagaaauaccuggucagccaaaacaacacagggagacucugucucaaaauaaauaaaagauaaagaaauugguacaagaaagacagcauauauguauuaagucaggguguuaauuauuuuaguaaaccaaaccuaccuuacaacggcaaccaaaagaggaagcaauugaagcuacuugauuuuucuuuucuguguuuuuugagacaagguuucacuuuguaacuuuggccagccuggaacugacuauguggaucaagcugucauggaacucagaauuuccccugacucccauauacugggauuaaagguguguacuaccacgccuggcccucagaagcacuugaaaugcuuuaaacuugcuugcaucuugacuuaagcaagugaaguggcugaaguucacacaggcacuaggucugugucagcuccugcuuugaagcccuucucuagaacacggauccugauuauuguggggugagggcguugucugcucggggacuucuaugucagguauguuccucauugaguaucuguuugcuucuuugugggggccuugacuuccagucugaacagaggugauuaucaggugggcgcugccagccagggucgggauuugguuggcguccucuagaacaggguaaucuuacuuggggaguuuggagggaugccacaaaucacccugcauauacacagggcagcucccagucccagcuucuggcucccuuuacauguucaugccccaaggcuaagauuuucaugccuguuuccugaauggacguuaaaagccgagugagagucaagaugaaaauaguugcuucaaacugucaguuguccuugcaguauuuuuuucuuuguuuugauggugcugguguuggaccccagggucuuaagcauccuacucagaccuucacgacugaaccccacucucaacuggguauacuuuuagaaguguauauuugcccacuggaucguccaguggguaaaggugccugcugcuugcuggccuggguuuguuuaccagaacucauauaagugagagaacuuguuccuauaagccgccgaccucugguuuccauguguguaguagugugcgcaagcaugcacacacaaaagguaaacauuucaaagcauauauuuaauuauguuauuaauuuuugaggcauggucuugcuagaaguccagacuggcaucaagcucgcucuccugccuccaucuccugaacacugggauugcgcuugugcaccagggugacugccuaaagaucuacaaucagauuuuuuuguuuuuguuuuuguuuuuuggaacagggucucacgcugcagccccaauuagccuugaauuccauuuguauaucagguuguucuugaacucacuaagauagcuaccuuuggaauuaaaggugugugcuaccaaccccugauuucuaaaaaaaauggugugcucuaauuuaaaacguuuacuuuuuaaaaauccuguugggcgugguauagaaugccuuuaauuccaguguuuaugagucagaggguagaggaucuuugaguuuaagaccagcuugggguauuaugauucuaggacugcuuggacaacugagagacccugucucaaaaacaaaugaucaaugaaaguccuccugcugggugcuuuccuuucuguuguauccgagcugacuucuuaucuacuuuagaauucuuuaaacauuuaaaauuccuuaaaagaaaguuacacagguaagguuggugaaagggguuuuggguaccuugugauauccacgagggagcauaaugcauucuuuacgccuuaccuuguagaaucacugucuugcccuaaggggggaauacuugaaggaccuguaagguuagacccccggggcuuucugggaaagcauaaaaaccagagaaaguuguuccagauggguugcugguagcaagagguuuuccccucugggugggguuggggaaagggccauucuaggcagaccaaacuggaaugcacugggguaugcuggagacuucucccccagagagaucuuaaagagacuucucccacaacuucgauaaauaauuggaggcagaagcaaugaauuuuuuuucugacaguuggcucuuacugggggcugggcuuuguuugcaagugaaaggguuucaaucggagucguugaaaucacaauggggcccgacccuuccacaucaaaguguaaaagaaucccuugggcugauaaaugcgggcugcuccacucuuacuaguaaacaaagcuguuggauggccuuuaggauuuuguuguguuuuuuaauuaaaagaaaacgggguuuccuaguggugaaagcugccugcuccugaagguuggcuguucuuccuggaagaacaaccuuuguuaaaguuguuggcagacugcaguuaccuacggaugcacacugguucucaacuccugggaagauguccccugcacaggguggcccugcagggguccuuuuuguccuuaguaagacuaagccgagugggauuucugaguccugcuguccuuggaagauugagagcuaagaucauuucucuccccaccuaaccccaacaccagaagauacacucacaugcaaggcacagagcugagcucuaaagaaaacugucacuauguaaaaagugauccaaaggcagcuguaaaguguucacucaaagacaguagaugguguuuugauguaguuacaggacuuuguaugcggucaaaaccuuuagcuuguagcugaaaauauaguuaguauuuggaaccauuuacugugcacaaagcaacagcaccaaggucacauuuuaugcuacuaacugggcccugaaggcuagggauaacucucuguaaaguacacugucccuccuuaggcuccuccagccuagcccugcaggacucaaagcuggaggucagaacaugucuuuugugacugcacagcgcugagcgcggggcuagcccagcacugaucucuugagaacuuuaaggcuuucuucgauuugcaaauacuugguaauagaccucuaucugugucuauuagcuggaagauuggggaagggaaaagaggucacagcugggcuggcaggggaaaacacaguccagcugaagugugcucaacuauauucaagcccuccucauccaccugagaggaagaguggguaacaccagcuaguuagauaugcaugucauuagcuaugcacacccaguaguguuuagagcauuagugccacaggauaaaacaacuuuucuuuguaacaggcuucggcuaaaacugaggacaagugcuguaccaccgaccacugucuugagccacuaauauuuacucgagaacuacuaauauuuaaugggcacagccaggcucugugcuauauuucuuaaacaucccucccuucuaccaucccccaccccccauguuucuuucuuccucuuuuuugcaggguuucauucuagcucugacugaccccggggagauaauauuuucauuucaaucuuacaacuccuaauagauuuacaauuuugaaaacaguaaacgaacaaauuagcugauuaaucuguggcagacagucaaacuaccuuucuaauuuuuauugauagauuuugaaaaaggaucucacucuagcccuagaacucaccagcaauccuccugccucagucuuccaagugcugggauuagaggcaugaaccacccaccaugccugguuuaaggucuguuguuauugggccccugagaccucaacucaagcccaacuacacauuagcuauuuaggaacuaggaacaggagagagggaaacacuaugugcccuggcuugccucggagagauuugugcuggaucuuucuggagccagcugucuuuucugacacuguuaacuagauagcagguuguuccuaagggauccacuuagcagggcuaccacaguuagagguaccuuucuugcugaaggcacaaagcugauuacacgggagggagcucaggcggcuagccauaugucgggaaaagauuuguuaguauaaaauauaagggaggagguggcucuucugccuagacucucccagagcuguacagcuacacacacacacacacacacacacacacacagagagagagagagagagagagagagagagagaguuucacacucaugaggugguguuuccuagaguuauugggucugugcagccccacacaggugccaggugguggccuugcagcucaaucagugucccaacgguuacgcuuugcagcugcuucucuuuaagacugucaacauccggcagagacuuauuuaacucugguggccucuugaugccugagauagaaaaucuccuuaagaauggaguacuggggcuggugagauggcucaguggguaagagcacccgacugcucuuccaaaggucuggaguucaaaucccagcaaccacaugguggcucacaaccacccguaaugaguucugaugcccucuucuggugugucugaagacagcuacaguguacuuacauauaauaaauaaauaaauaauaaaucuuuaaaaaaaaaaaaaaaaaaaaaaaagaauggaguacugacuuccgagugggaacuaguguuucagaggcaagggugcagaacagggcaaaaaauuacauuuaaaauuuuucccccacugggcugugguggugcuagccuggucuacaaagugaguuccaguacagccagggcuacacagagaaauccugucuugaaauuccucccccgagaugugaaaagcuggcagcauuauccccucuaaauuguuccuuuauuuguacaguaaaaauaggguuaaauguauguguguguguguggggggggggggcuuuaaaucccagcagauugaggccaaccaggucugcauaguaaguuccaggacauccagagcuuagccuuucccauggcccagguuugccuuguuauccccacugaaaaguuccuuuuguacuucagcaaaauguauggagagagguaagauccauaaggcaggcuggagcgauggcucagcgguuaagagcacggacugcucuuccaaaguuccucaguucaaauccuagcaaccacacgguggcucacaaccauccauaaugagaucugacgcccucuucuggugugucugaagacagcuacaguguacuuacauauaauaauaauaaaggaauuuguaaaaaaaaaaacccaaaagauccuuuaaggcccaacccauaaaacuaagagugauuaguuuauuauauuuuuuccuuuuguggauaggguuccauguguccuauacuaaccuaacucaccaagguugcugaagcuagucuugaacuccugaccugcuguggugccccucccaggugcugauguuaaaggcaugugaggcucugcaccugacugugcaguacuaggcaagcgauguaccagcugagcuaggcugcccucuuugcccugcaguccuuuuaucccucugcauguagguuagcagugacucccugcucucucuccacccucccuuuuccuugucaggaggacaucauuaaacuagggcaguucugagccacaucacacccaugauucacuuugaguaauauagagguccuagggucccuggaccucagucuccucuuuugugaagacuuauccuccaccagcucuguugccuagcgauacaacucacacaagcccauguaaaggcuucugccuucaagucccaugccuuagcacacgcugucucuuucaucccugcuagcccuucugcucuuucaucuguaaucacuaucaggaaauuguagggcuuuuuaggaauauaaaggagggacaccccguugcacaacuggccagccaucaggguaggcuucuuggagguagguuuagaauugauguugggggcuggagagacggcacauugacugagaggaugugcaagucuugaaaagaaugagaacugauuucccagcacagaaguaccagcucucagaagauccaaugucucugggcuccauggcaccuauaugucuguaagcaaacucacccccaccugcaaauauauacugggaagaagaguucucuguauguagcgcggcuucauagauuaaguuggccucaaacagacagagaucugccugccccugcuuccuaaauucugggguuaaaggccuagcaacaugcaucauaucuuaaguuuuuuuuuuuuuuuuuuuuuuuuuccggggugggcggcaauauuuaggaguccaaaaaaaaaaaaaaaaaaaaaaaaaaaaaaaaaaaagugguaacuugaagugguaguaguaguggugguggucuagguaaagaaacuauauuuauauuccauaaauuauuuuauagaaauaagaaaagggaagaaagguggagacaacagcaucuucaccccugcacccucaaccucucccugucgucccccccccaccuccacaccccccacccccgacuguaaagacccuucuaaggaccagagugaggcucacuggagccugaucucuggagcaucuuuaggaaguggccaagugagcugugcagggcaugugguguuauaaguagcagaaagacaagcuuuggagaaauuuacuugugucugugguuugauccaauuuuauucuacuuuuggguuuucgagacaggguuucucuguauagcccuggcuguccuggaacucacuguauagaccaggcuggccucaaaagauccaucugccucugcuucccaagaggauaguuaaggcccaugagaggguuagacauaaccggauggguucugcaugguuuucaagagaguggaggaggauuugucagugaauugaauguaaaacagauguuaagagcaacccauuuuuagucucucagcuuugccaccuggagaucaggaugaggcaacagaaaacaggucugugucccuuccaaauaccaaggagugagacuacagcuguguguaaugggggugggaggacaacucugucuacuugguuuuucucuuuucuuuacuuggugggauccagguauuagacugaggcuugcacccaggugccuggagccacagcuacacucuuugaguagccucuguuggaaaugccuuucagagcugaacuauucguuuugucuggaguucauugcuggucagugcuucagauacauauuauucuauagaaaauggaucucucaugugcuaagguuuccaaagacaguaagaagaugggacugcacagaaagaggaaagaguaacaacccaguggcaacuuacuaacgaguaacuuaggagcuccaggguuuuagcugagugaagugcagggucuggauguggcucaguccggagggcuuucccuacaaggaacaaagacaguuaagaacaucaacucugugucucuaaggcagugaacgguucucgaccugugggucaugacccuuucacagggauugccuaucagcuguccugcauaucagauaguuacauuacauuucauaauagcaaaaucacacuuaugaaguaguaaugaaauaauguuaugguugagggucaccacaugaggagcuguguuaaagggucccagcaugaggaaggcuggggaccacagcuuugaggacuagcagucuaccuagguaugguacacaguaaaugaauaaauaauuuaaaaaugaaggaaaauugaauucugcugucaggaauaguuauguuuucuuucuuuccuuuuccuuuucuuucuuuauuuaauguacaugaguacacuguagcugucuuuaaacacaccagaagagggcaucggauuccauuacaggugcuugugagccaccaugugguugcugggaauugaacugaggaugucuggaagagcagucacugcuuuuaaccucugagccaucucuccagcccucccuuuauuguuguugcuaauuuuuuuuucuuguuuacucauuuauagacaggaucccauguagcccaggauggucccaaacuuugccaaaguugaccuuuaauuccuauuccccuuugcuucuuccuuccaagugcucagauuacagguguccaccgugcaacccccccccuuuauuuuuuaaaaugccuggauuuagaagaugucaagauauaaaugggcauuccuucauaguacguuguagaauuuuuauagucauccuuacugagauaugguguuuucuuuacacucaguuccuaugacgggcaaggaucuuaggaacagaacuuuggugaccuuucagagggcuuuauacugagggaggugggaaugaacuacucuuguuaaaacaagcuggccagugggugguagguaagcuaccgggagagauuuaugagcaacauccuguucuggaaucauugcuggggacagcagagggggagcaacugcuacauuaaucaggaaggcagcucuggaauggaugucggccacuggagaaucugagguugauccccccuggugguugguagucuguguaccacauggcugaggacacacuuuggguccagcucuugaguccacacagguguuggugcugguuagguggguccauuucccuaaggagaaaacagagcugaguaagauaaagacagaugcuacuguggccagagccagaguauagucuuauaauugcuuccagaauuguaaagaaaaagagaggugagccauuugggagggaggaggaggagaucauguguguugugcugggucugauaugggaccauggucaccugcuuuguuccucccauaguuugcaguaucucugacucagccauagcgugugugugaaaccuaacaucuugaugggagggugaagucuuggccuaagucauccuuccuucagugaaagacagaucaguccuucagcagaagaguggauucugggaacauggcucagcaguugagaacacucgcugcucuuucagaaucaagaguucgguucccagagcccacaccaggucauaacugccuggaacaccaacuccaaaaggaugcaccaucuccggccuccauagacugcacucacgcaggcaaacagucaugcauacauggguucuuuuccuuuaaaaggggcuaugguuagaauguagcuggguuagcagagugccugucucaaaugcacacagcccugaguuucauuccuaacauuguauaaacuggguguggugguucuccuggggugguagcaggagccacaggccauucucugcuaguucugggcuggccugggauuccugggguucuuauagguaaauauuuaagaucacacccugugcuugaaagucuacaaauugaaaaugaaaggauccuauuuuuuaccagaaacaagauaauuuuuauccaccaggugugaugaugcacccuuuuaaacacugcauccaggaggcagaggcagggggaaucuaugaaaauaaguuucaggauagccagggcuacacugggaaauuuuaucuugaaaaacaagcaaaacaaauauuauuucauucuagauaaacguguggguuugggaguagagucauucaaguuguucaauauaauaaccccucccccauuuauauauucaaagucaauaauuguauguuuuuaagcuguggcuagagauuugcuucauagguaaauuuaugaugcuacucaacuaaauauuauuacacuggguuccauuuccagugccaagugcacaucuauacaucaacaugugcgcacacauucacagauguuauuuaauaaaugucaaaggcuaagugguuauucuucuacucccuuuagaaaaugggaauguuauucaguuacuguauugucacugauaaaaccccaaaggagaagcuuguuucagcucuugaucgcagagguuucaccgcauggugguuugacccuuaugacagucaugguugguucauuauguacacauaggagacuuacucaccccauguuggcuggaaauccaacagagggggugagggagaggcagauggagacuugauccaauauccccuuuaagggcacacccagggaccuucccaacuuuaggucccauuucguaaaagugcuaccaccucucaguagcucugcaggugggguagagugucacaugggcaaggaagcagcaaacugugagacuagagaucgcauugaggaagggaccccaggucccugggcccaggguugguagggcaucgagggucuguaggagaauuguuaacaggacauggaggccacuagauugauuccagagaggcaacaugucugagcaugccuuggcugucuuaggccguggggaaacccccuuucaguguaugggagucauacuucccucugacuuuacagagaaaacagaaguagaagaaggaaaccauuccaggguuggggcugguucuguguucccggaggucacucuuguguuuuguaaaagggugggaaagagcaccuuagcagccuggccaagguguucuaaggaaugaccaccaugcuggaagcuuauugggggaguggaaggggaguuggaaaacaggcagaaccagagaaauguaaggggguggguacagagaaggacagaaagagagagagagaagaaaagaacaucuggaaauaugugggaacaaagagagagagagagagagagagagagagagagagagagagagagacagacauagauuuagaagaacagucuucuuuuaugccuaacuuguggcuagaaccugguagucagagaggcaagccguugcuagguaacuaaugagcagagucuagaggaauugccaacauuccuccauuuuuguuuaauuaaaaaugaaauaggggcuggagagauggcucaacaguuaagaagaaaacugaucuugggggcuggagagauggcucagugguuaagagcaccgacugcucuuccaaagguccggaguucaaaucccagcaaccacaugguggcucacaaucauccauaaugagaucugacacccacuucuggugcaucugaagacaacuacaguguacuuagauauaauaauaaauaaaucuuaaaaaaaaaaaaaagaaagaaagaaaaccgaucuuucagaggucuugaguucaauucccagcaaccacauuggugguucacaaccaucuguaaugggaucugaugcccucuucaggcacacagcuguacauucaggccgggcacucauauacauaaaauaaacuacaaaggggugauugguggggcaggaauggagugugcucuuuaauuguuuccugcugauuuuggggcaacaguugucuuagggaaaccuaagaaaauuggaauguugguuaaauccuggaagagaguuggcuguuucauugcuguccagggucugugggaccaucuacagcuaggaaagugcuggcccacuagacucuucugggagaguagucuggaucgcuucuggguugcuucuuuggagcuguccuggauauagauuuuugacuuaucggagacagaaaauaaaguuaagcgggcuugggagaaaacuuauaucuuagguauauauuuguaacccuuaggcucauguucuugaugguugggggaggggaguccaaaaaccagggaauuggugggagaagggaaaucccauccucuggaauaggcaacagauggggaauuuaggguguugauugacggguacuuaucuggaugaaguccauuugaccuaggggagguaggucggagaggguuuccugaggcucacaagaggugaauuuguuaacuuuauggauaguuuuuaaggugaacucagggaagacaaaagccuuuccuggagcagaaagggcaagaggagcuuugcaccucuauccagaacacugaguguacguaaacuuagcacagugagaaacaguuuuaagucuaucuuuaaaaggcaaccaaaggaaacaaaaucuugaucuugugacugugguagauaguugauuguaaacuguguuggaagcccagaguagguccugguggauuguggguggggauuugcagaaaggcuuuguggucaccugaccugaguuccugccuaagggagagaagcagaugaugaucuggaagaagagucuggaacauauucuucuacugcaugaauaaucugguacaccccgucucacagaucagggaaagcaaguagugggcucagccggugaggcuggaaacaaaguugcaagcuggaaacagguaaccaguggcccauacuggguccagggaguuaaaaaaaacaaaaacaaaaacaaaacaaaacaccaagauaaaugcacauagauuucuaagaauuagucugagagaaaguacaacuacaucuuccuuccauuacuaacugcaaguaagcguaaaggcaugcuuguggcugauugguuucaguauaacauaaauaaaauguauuuuauuaagauguaccguuuggggcugaagcccuguauucaaugcccaguaaugccuacagacuggguguggugucaugccuuauaauucgagcacucuugaguuaaaggcaagagaaccaaaagcucaagaccaacuugaauauguaguaaaucugaggcuagccugggcaauuaaaaauaaaacaauauuucuuuguuuguuuugagaccucaguucguagcucugguagccuuccaauucaugaacucagagaccuaccuaccuuugccucccuaauacugggauuaacagugugcacuccacccagaaauacuguuucuuuuugaaguggucacuagacuggauaaccaagcauuaacuugcuaacagcuggccuugugcuugcggaguagcugagguugguguuacaggcauuucucgccaugccugguuugcaaguuuaaauuuagauuauaucuccuggucauugccuagcuugggcaaggcuagucucuagagaaaaaggaaguuuaaaaaaaugaaggaaugugggagaaaaccgagagauaagagcaccugcuuggccaugcaugggagggcucagaguauaaggcucuugaccuuggucacaggucuuguaggagugccauuggaagcuuugaagaagggagggugucgaguccugaggaguuaacuuuggcaggcucugggugcaguggauuagcccuggugaagcuggaggugggagaccgguuaggucagguccagugcccaucacaccuggcugcccuggcucgggugggaggaguuuggaaaguguggcuuccaggugguggacuauagggauaaccugcagaacugcuugauacuuuguguugaguuucaccuuggcuuccuccuucaaucucaauucccccaccaccuuaauuccuguacucuuuacugcagugacacaauguaugcagauggugcuguuguugaaaacuuuacaugaguauagccagagggaaaaaacccuuuccucauuucuggaugcagauugacuuguauugagaaugggaacaucuaaggagcacagggcuuguagguuuucuuugggacccuccauuuuagagaguugaggcuuuccucaucaauguaugggccaauuaacauugaucgccugcugugccaggagaagcuaaaaagauaaaaccugauugccaaggcagaagauguuacucagugcaggaauagcuccucugaaacauagugacccaggggagagaaguggaaauuccaggccaacauaagguagaggccaggcuggagggcacucuggcuauaaaauaccugucacaaaaacaagcaaccagacuacaugcgcucucucucucucucucucucucucucucucucucucccucucacucucccccucucacucucccaggcugucauucaaacuccuggcaauccaugggcacauaagaaggggaaggaagccucucacauagagucgcuugaauucucuugguagaauuggauucugccacaccuaacaguuaacugugucucauugcauagagagaauauuuuuuuaaaaagauauuucaaaugagaguguuaaauagcagucaaauauguauaaguugcugcugaguuuaaccuuacucccuuccccaagcugcaagccuuuaacuaucuggaaaaucuuaaaccagauuguggacauuguuuacagccaaaaucuugucuuaacucccuugucaccuaguacuguaaggauucuuucugucguugugacucaggauuuuaucuuaucagccuguuuuccuaucuaguguaucucagaaaccacccuaggauuucauuuaccaaaaaaagaaaaggguaaaaguccuuagaaacacugaaaccucagcagggcguggccgugucugucuguagugccaggacuagaaaggacagaggcaggcagauggaacucuuugaguauuugaguauauaauucuuuuuuuuuuuuuuuuuuuuuuuuuuuaaagacaggauuuuucuguguagcccaggcuggccuuaaauuuagguccaucugccuccggauuaauugcuugcacccuugccugacuguugaucuuuauauugaguuucugcugcuauccagagccaaaaaaaaaaaaaaaaaaaaaagguggcuucuuuagcugucccguuaauggaaagaguuuggugacagagaugcagaagcauggcuuuagaacuguguucccagaacccgagaguucaauguauuagucagugcagugcagaacccagaaccaaauaaauccauggcuggcuggugucguagccuguggcaagcgcuugccuaauaggcggaugagguuaggauuguuuuguuuucccagugacucugggcuucaagauucuuaucugugaccccgggacagagauagcaccacgauccucagaucagugcucugacgcgguuagaacuucggcuaccaugcagcgacuucccaagauaugcagcgccugucuccacauccugcugaaaugaaccugggccuccagcaacaacugccaugguagauaugaaggagccucagggcuucuugguuuuagagggaccgagagcgcacauguuagggugcugaggacuggaacugaguuucuguguguccucuggccucacccucucuuuugccuccugccuaauuacccguucccucacccgaguucccacagccgguccaacuccguggcguuuucccacuguauuuuacggcaugugcuucuuguucaagaccgaggcccuugggguguuacgggcugacugcguuagucaucuucacaucucacugccaaaagaaugccgagugcuggcacauucugggcacuugauaaauguuuguugaauuuauuugaaagguuugccagggaguugcccuaacuuauaauucaggagaaagguccuucugagggagaagucugggccuguugcuaugggagguguucucacccuuucaugcaacaaguauuuauugggugccuacugcgcauuggcguugugggggaugcuggagaugagucaagccugcacucugcccuggguuguguuggcgcugauagucuaaugaugggugugcuggagguugcugauaggggugaugagaagcgggcugaagugguuuccuuguauuggaguuuuguuuggacguguaauuacuuugaucaaagaaucuuggaguuguuuuguuuuguuuuguuuuuuccaccaccacggcucauuucucagguuuccuuuuuauaucauggcagagccugucugcucaguugcacagggcugacugacgaguacagcuaagcuugucuguuggauucuaauccugaguggucccaguuccaucugcgugaggugcaugcccuuugguuuagacaaaauauuuucaugaguucuaguacaauuuuuuggggauuuacuucagagucaguguugggcauugcauuuggucagaggugccuaguuacaugccucucuauuacagcuguuuucaaucuuuuggucaauuugucucuggguuuuuuuuuuuucucuccaccccccuccugcccccauaauucccuggcacuuucaaaugccccuacccaccccauuuaacuggaaaaagccagcucauucuauuugacuguaauguuuugcccagaugaguucuaaaaaccaggaaacuuucccuuuuuuagcuaaggguuguucuccaggcagguuugccucaggcccucucaacucuguucagggacugcugaacuguuccacucuggaaucuuacgcugcucugccccgggccaguguuggucaaguccugguacaccaaagcccucaguaaauaugcaucgauuagacgggcugauaagcaugaaguguguggccagcaggagugucuccaaacuaccccaaguuucuaaggaggauaguuaauagugauuugugaaauuuuuauucggaaaguucuaaaauauucuaccugucagaguuauuguuuuauuuuauuuuuguuuuuuuuuuucaagacagguuuuguuuuuguuuguuuguuuguuuguuuguuuguuuuucccuguauaauagcccuaguuguucuagacuugcuuuguagaccaggcugaccucaaagaucucucugccucagcuucccaaguuuaauuucuucucaauuuaacugcuggaauuaaaggcgcaugugaccacacaccagcuaccugucaguuauugaagugucaauuuaauauggaaaauuucauuaauaagacaugguauagaaaucucacuuauccaggcuugcgcacuccuggaguuugacaacauauauuguugcuaagacuagaggggaaggggcuguauaggugaugggaacacagaauaccaucuagcucagcgacagugaaaucgcuucugguguugguucuguuucuuugcauuuucauugagauaaaugcacuguucugugcugauauguugacugcugggucagucacucaugacaaauggcugauuaaaugccccagcccuuaaacaaaaucucuaguaauaagagaggccaggcagugguggugcucgccuuuaaucccaggacuugggaggcagaggcaggcagauuucugaguccgaggccagccuggucuacagagugaguuccaggacagccagggcuacaaagagagaauauggauuauagggaagcuugauugagaccuauuaaccccauuuuaaagggauccugaacacagcagcuacauuugaaaacuaacuggacaguuuguacugugaauggaaauucauuaagaaauggguauuuuuaaagagacuuuuuuuuuuuuaaauguauaugagcacacuguugcugucuucagacacaccagaaaagggcaucagaucccauuacagacguuugugagccaccaugugguugcugggaauugaacucaagacuucuggaugagcagucaguuuucuuauccacugagccaccucuccagucccuaaguuaauaguuuauaauuuaauuaaucaacauuaaaauauuuuugggugaggugauaguacuuugcuugucuccacuuuugccuacuuaaaacuaaaaaaauaaugguccccugaauucccucauauaaaauaagcaagagggcucugugcuuucuaguucauucugcccuguuucuccaguuaccuaauugguagucccucuugcuuuucucccuggacucuccuguuaggacacugugcaggcucccacacugcuuguaggcucccauuaagcuguguguuuguagcauagagacacuguguucuguuccuagcauaugcuggcucugacauaggaccuugaguugggaguugacccaggacucgacagccuagugucuggagcugacagugacucagacuugagugaagcccuaguucuucuguagguacugauuuagcaccuccugaaggcugcacagcuugugcaaggcagcuagacaccuacaggggggauaaauccaaagaucaaaagcuuuuugaggcagaagaaaagucagggcuggggggaguccucucuggaaggcugcacacuggagcucuuuuuguuuuuuuuccagacaggcuuucucuguguagcccuggcuauccuggaacucacuuuguagaccagacuggccucaaacucagaaguccgccugccucugccuuccaagugcugggauuaaaggugugcaucaccacugcccggccacacuggaccuuuugaacccugaggucuccccaagagcagauuccgauuggccauuagcagguuucauccaugagcguuggacacuggagaaaaguaaucucuugccaagcaugucuuggguaacauguuacagcugucaugaaaguuuaucaggaaaaaaaauagggcuuaagucuuuuggauaagcagggugagacugcccaaaaacuucuccaaaaacuugcuuaaaacucccagaauaaaggcauagagaauuggaaaggcuccccuguuuaagacagggacccacaugucccagaguaaaacugguguagcugaccuuuaagccgauucuccugcuucuacugcccaagugcugggauuacaagcauucaacaagcccaccugguuucuccccugggauuagguacaacuguuggaaaugguuacuguaucccuggcucucugcagcugugcagcuguuuagcaggcagauguggagugauauugaaauuguugaguagcccaggggugcuacaacuucccaauguugcaacucuuuuauacaguuccuuguguuguaaggaccuccaaccauaacauuauuuuacuugcuacuucauaccugcaguuuuucuauugucauggaucauaauguuuucugauggucuugggugacuuccguaaaaggaucauuuaacucagagggguugugauccacagguuaagaacugcugguggccuauucaaauccuaacuauaucuguaaugugacuuguggcuaugcucccugaaacaucugguaaagagacuaguauagggucuuaauuuacuuuaaauagcuuuuuacauccuuaucuuuggucauuggaaaauaguaggcauuuugauucuaggcacugaaauucuucuaaacccaaauguuuccagaccaaaccaacucaaaaguaauuucauuuugguguaauguuccaaaacauagcuagauggcagaaaauuguuucuaaagaucugggacuauuuccucaaugaaagagccuccccugcgugugugugugugugugugugugugugugugugugucuuucugucugacucugugugugucuaucuucuuucuccugugucuguguaugucuguguguuuuguuuuuuuuuucaguuucauauaggcuagggugaucuugaacuccugaaucuccagcuuuucauuuuccuaggacuuggauuuaugaaugcaccauucugcccugcuaacaagagcuuuaacguuuuugugugacuuuuugggucccaugugcauauaugaugugugugugugugugugugugugugucugucugucugucugugugugggauuguguguaugcacacaugaucaugagugcuacaauauagagugagaucacagucugcccucuacugcauggguuccuggaucuaacucggguaggguugucaccuugaccuacugaacuggccuaacaacagcuucccaagagaggcuguggagucucaugguucugaggcuggacccugcugucaggaccuuaucucagucagguccuuaccagauggugacugugagaaagcuggucaucucaccaggcuccuguuccuuaucuguguaccgcaaggguggccacacugagugggugaagguuugugguagggauuaauuauuaguaaagcacuuagaacagguggcuuaagcuuaaaauucuuacauaucaucccuaacacaucacuugcuguugaucucagacuuuggucuaaagacaccaagggcucacccucaugucuagaagaagugggccuuuaggugaauuuucaggugacagccccauaaguuacgcauuuuccagcaugaagcuugcccuagcuuugggguguccuuuccuuguaggacauuaacaaguuuguuaucaacagggagaaguuuccagcugugagcucaccuugaccaaauucuagauggauuagcaagggacauaccuuccauuaagggaaccucaaagccucuauugcuaaagcuuccuuucuccucucccuccuucacuuugugugcuggggaaguaauucaaacgugcugaguauugccaauacuacucagauucccacccaagcccuaggaucuccuuaaauaggccuuauguguuuguguuuuccuauauguauggguacccaaagaggucagaauaagguaguuaugcgccauuguggaaauggaacucaggucuuguauuagucaggguuuucuagagucacagaacuuacggaugguuucuauauauuaagggaauuuguuguuaugacuuccagucugcaguacagcaauagacugcuguggacgggaaguccaagaaccuaguaguugcucagucccaugaggcugggugucucagcuggucuucuguaucagcuggaauccugaagaguagguuccagcagaggugcuggcaguaagugcaagcaggagagaagaaagaaucuuccuucuuccaagguccuuagguugguuuccaggagaaggcgaggcccagguuaaagguguguaccacugugccuggaucugggacuugcuuugucucaugcugaccuugagcucagagaucucucuucugggauuaaagguguguacuaccuugcaagggccuaaacuuuucauggccacuaugccucaagaucuggaucacaaaugagcccuccaauucuggauuguaguucauuccagauauagucaagcugacaacaggaauagccacuacaggucaucugcaagagcagcaacacccuuacccaagucaacugauggugaaaaucuuuuuuuuuuuuuuagauuuauuuuuuuuuuuuuuuuuuuuuuuuuuuugguuuuucgagacaggguuucucuguguagcuuuggcuguccuggaacucacuuuguagaccaggcuggccucgaacucagaaauccgccugccucugccucccaagugcugggauuaaaggcgugcgccaccacgcccggcuuuagauuuauuuuuuuuauaugaguacauuguaguugucuucagacacaccagaagaaggcaucagaucccauuagagaugguugugagccaccaugugauugcugggaauugaacucaggaccccuggaagagcagccagugccauuucuccagccugugaaaaucuuuaauugguuauuuaacuuucuauuccuuauauccacucuauuuuaaagacauuuggcauuuaacuagaagguggagcuccauauaaucuccccaguacuugggacuuagaagcaauucaagucuuccuugguacacagagaugccaggaguugauggaaucccauuugugugugagaggccagaucuuagcauaguucagaagcaaugaagugcugagaauauaugcaugccccuuccuccaaggcaaaacauccccaagagacuuggaaauauuuccuaccuuucaauucuuaaacccacaccccugucuuguuuuccugcaucuucaggaacauuuucuaguaguuuggaacuaggaaacuaagaaagaaaugacugucuuagccugacuggaauaauuacuuugauuaguguuucucugucucugaacucuguuucucucucucucugucucucugucucucugucucucugucucucugucucucugucucucugucucucucucucucucucucucucucucagacaggauauccugcuauagcccaaacugaucuucaacucuccauuccccugccucaaccuccugaguuccugguagucacuuacuuuugagaauuuacagaauguccccugcuuuccaacaugacacuucccagguugcaauggcccugggaacuaccugggaauugugagaaaaugcgugcucucaucuugcagacucaagagggagggagccuacgacuauauggaaaaccagcagccaguguuugggggaugccaagggcgugguggcuucuuuucaguggagauugacacuuuaaaagucauacugacucauacauagcuccuacacucagacgguuauugaccuggguguggcuacggaguggaaggcuggcaggugauucucaccugcugcggaccacagcauggcuaggaaacaugugccaucagaauggggauaugaaagcuaggaacaaugacagugucauggcuaagaacacacacuuccucuugcacaggacccaguuuugcuccuaccaccuacacaggccagcucacaaccauguauaauuucagcugcagcuucagggaauccgugaccauucuuuggccuucaagggcacugagcuucuguacacaaacuugagugugcacguacacacaggauucagauuuacaaaaaaaaaaagugaugcugugucuuuuuuuaaaaguuuugucauuuuguguguuuuuccuucuccauuggaccggaguccaguuuuuguucuguuuuguuuuuuuaagaauuauuuauuuuauagauaggaucaccacugucgcugucuucagacacaucagaagaggggcaucaaagcccauuacaggugguugugagccaccaugcgcuuccugggauuugaacucaggaugucuggaagagcagugcucuuaaaugcugagccaucucuccagccuggaucugaguauugaaggcauuucuuuuuuuuuuuuaaauuuuauuuuaauuagguauuuucuuuauuuacauuuccaaugcuaucccaaaagucccccauacccucccccccaaggcauuucuuuauuaagcauucacuuauauugaaacaguugguguauguuucuugcuucucacucuaauccaugacacugccagucagaguugucugcugguguguacucacagugacagcacacaucacaucagcucccaaaagacccaaagcacaguucuucacagcucuccaugcacaggcuguggugguguccaugguuccugcugcaauguugggaagaguccucacuagcuguugugucagucagaguccuugggugguuuaagcugugucaaagucauucuggaggcaucaccugaagcuuccauggggagcaggaccucaaacugucugaaaucauggcugaguucugcccacuuuccacucucuggaguaucauuugucuuuccaccccagggagcagacuuuccccuuaucaugaacugauguuuguguggguugggagccuguggcagauaggggugugugaagggugagccugucggcuggcuucuacaaagagcuaagugugauguuaguggagucaacagcuguagaagagaauggacccaacugaaguauaucuguggguagaggaaaugcuuuauggcuaaguacaacagguagaaacauggaaaugggaaggggguauccagggcuauagggcuguggcucagugguguaguaccugcugagaugugggauucaguccuaagcacccuaugaacuaauguguaaacaaacacacccuacacaucaacucugauuuaguuucuguugcaaugauccuguuggugaugaaguacucugauuaaaaacaucuuaagggagaaagggcuccuucuggcucaagguucaggggguacaguccaucaugacauagaaaucaagacagcaaaagcaugaagcaacuggccacaccacauccacaaccaggaaacagugcucuuucucaaauccaguagucagggaauggugccgcccauaguggacggucuucucaccccaguacagucauggucaccccaauagcugcucacagaggcccauacuccagaugauuccagauucugucaaauggguacuuaaacauuacuccucaaagaccccccacacacacacccacccacccugugcuuucuuuguccuaagaggugucuaaggguuggugggagcgauugacauuugaggguucaaagucucuuggaccauuaagggacaaagugaaagcauggugugguaugggcuauccagaccaucuaaggcccuguugagccuaagacccauccuggcacugaugggugucucugcugccucuggcccuuccccuucugcauuccgccuuuguaguuucaucuucugugaucugccuacuugcucuuguugcgguugucuucuuucugcuaugcaaaaacacagggagccugaucuucuuuggggguuuaguguugacugugacaguuaaggaaaaaaaaaaacauaugaccugguaaugucuaguuuugugguauucaaauuggucaugaucugcuaaugaggaacaccucuugagcucugcaucuuucagagaggaaguuauggaagaccuuuccuagucuccuuuugguugagaucuuguggguuuccucuguggggaaacugcucuuugcaaaccaaagacccagcuacaguagggugaucugugcaugccgaaguguccucuccugcccugggaccuguuuggaggagcuaccaaggauggcuuuguagagagcuuuuucugaguugcuugcucagucacuagcauguccaaggcauaguuagacuccagaugaggagucuauugauucuggauccaaggugugugagaggcaaggaugguaaggccagaggaauugcccacaacaaauagagcuuugucauaagaguccacagagaguauuucacaauggggcucuggcaccacggcaaagagacuuccuugugccuaaguagagagaggcuagaugauagcuguuugguuuauuuguuuuugauuuaacucuguguagcccucccuauuggccucaaacucagagauuugcuugccucugucuccccaaggcugggauuuaagggcgugcaccaaagagcucuagaugauagcuauuaaagaaggggaaagaguuuuguuuuguuuuguuucacuaaaaugccuggcucugguaccagggcaggguaaguaagagguugauccaaaaauaucaaacugcccagaaggagaaguaggugaagcugaacuggcugaaacccagugcucaugaccuguguggucgugaacuguucuguccuuggcuugggaagucuuucagacuggccucuuguuucuuggacaucuuccuucuguuuuggucucaccuacuuucucuguggacuuucaugacaaagcuccauuuuauuuauuuauuuauuuuugguggcaaucucucuggcuuuaccgcccucucugcuuacaugcauauccaggacccgagacucugaauaagagaguagaugagagagucaacaauuacaacuauauuacuauuguguaucugccacagugcucucuggaguuucucucuuaccacuuucuguuacucagguagcuacacuuaacagcaccagugccuauacucucugagguaucuccaggaaggauuuauagaaagaucccaggcaguuauuaccuacugcuaggguugugguaucuucaauguacucaaacucagccaauagaagucuuuauuagcccaccagcgagcaucuucacugagcguucgggauuccacuguagcacugagccuuucucagagugggcuuuuaaaaugcacaaugacuauauccuagguugacauacuuaaguuaacaagacugccuagucagaaguggaacuacagaaccaacccaaaagcaacauuaauacuuccccagaucuaugggcucugauggacuaggucuuuauuuuuuucuuggccagggaugcugucugccugcugaguuuuauagccugaaggguagguacuuccauggagucaguugugcuaagaaccuguuguuagcacuaccacauuucaaacagggcccuuauaccucuuuaagggauggaaagacaggcagcugauagacucccuugcauuaucaaggccuuagaaaaaggaagaacagaggaacucccaguacagugcauaugugauauguguugauugucagcagagaaaauuaaugggagaaaaaaaaaaaugaacucaaaaucuggagugccccaauguugauuucuauuucuuuuucuuuuucuuuuucuuuuucuuuuuucuuuucuuuuuuuuuuuuuuuuguuuuaguuuagugguuuuuuugucuguuuuguuuuguuuuguuuuguuuuguuuuguuuuguuuuuucccgagacaggguuucucuguuuagcucuggcuguccuggaacucacucuguagaccaggcuggccucgaacucagaaauacaccugccucuuucucccgagugcugggauuaaaggcgugagccaccacguccggcuaguuuguuuguuuguuuuuuuuuuuuuuuuuuuuuuuuugagacaggguuucucuguguagcacaggcuguccuggaacucacauuguagaccaggcuggccucgaacucagaaauccgccugccucugccucccaagugcugggacuaaaggugugugccaccacugcucagcucgauuucuuaaguuuuaaagcaugcuaauagaaucuuacaaacauugaggaugccacugagggguuaugugggauacccuuuguaauccucggauauauaaauacuuugauuguauguaguaagacacaggucucacuauguaucccuggcuggccuugaauggacagagaucugacugucuuugucuccugaguucuggaauuaaaggugaccuuccauguguagugguacaggccuguuuucucugaagcugaggcaggaagacugaggucagagucaauauagaccacacacacuuggagaacuuguuuaaaaacugaauguaggcuggguaugacagugugugccuuuaaucccagcacuuugcuagcuaggcugaagcugguggaucucugugaggcuagccagagcuacauaauagauagaaucugucuaaaaacaaagcaaaccagaacacacccacaaauaaguauuaagaaaaaaaaaaaacuuguauguuguugauuuaauggggaaaugauacuuugagcuaagaguuaguucucacauggaagaacagagguguugggggagggucaaacuagaagguuuuaggagugcagaaauggaagauaagaauuagugaagcagaaagaacagcugaaaaggguugaguuuuguuugauugaguuccucuuaaaaaguguugcaaaguuuaaagucuuccuucccaaaccagugaaaucacauuugcuaucacaggagcugugagcagcuggcucucccuccuuuccuguucuccugaaugccucuugggcaaggagggagggcuggcaagggcugugcuacccaaguguguuuaaugaggagcccugcuuggauacuugcugagcucugggguugggacccacccacccucuggagagaacagucccuuggaaguggcccuguccuuaauccuggcaaugcagcguuuaagaucgauuugggauggauuagaggauugcuuuucuuuauccacaggagauggcgagcggaaaugagagugagcaaguaguguuuguaacaaagaaggcacuugggguugggaggagagggcauuuggaaauuagagaccuggaaauagauuuccuuaaaucccacuuugccuucacacguacugagacggagcaaccacggugaaggggagguguguggagcaaugguuguuucucaucugcggcucagaccuucagggagaguguguauguauguauauauauauauauauauauauauauacauauauauauauauauauauauacauauauauauauauauauaucccuaagaauuuuagagugaauaaggcaaccugcuuaaaaaauaauauauguaauguuaugaugggcguggugguauaggccagagucccaguuucagaggcaaaaagauugaugcaagcucuaggccauccugggcuacaaagcauguguuuggaauguuuuaaauauucaucuaaaaguuuaucaaacaguggagugucuccuggaugguucuaauuuccaugucauucucucuucuccucuucccuucuccucccaucuuuccucuuaucucucugcucuguucuucucuugcuucucucucuucuugcuucuugggacaggcucuuauaaccuagguccuuccaacugguuauguugucuagcauggcauuaaacugcugauccuccugucucagcaaauaaugacuuaucuaguguccauuuugggcaaacuccauugaguuggugauuauauuuaagguacauguagcuggggcacagcuugagagcuugccugacacacacaagcugggggcuugaacacgauuacaucaucuacugagugcuguuggcauuacaugcaugugagaguuacuuuuaaagcucauuaauuuaaagagcuaaugaaaaggccuugcuggcauccaggagguacaaugacuacccgcucaccuuguaaaaucugcccucucugcuuaccugagcacccuggccccgugggaguaauguagaaauggaaaguugcucuucuguugugugggugauuugugcuguguuguuccacaguaguuuucuaucguuaagagaacauauccuggauaauaaggcaacucuacaucuaaaccuuauaaugaaucaauuauuaauuaggauagagucuuguauguaguuuuuggcuggcuuggaacuugccacauagaccaggugagccucaaagugauccacuugccucugccugugcacuggaacuaaagaugugucucauuugugcagcuggaccuuagcagucuugaacuuaggugcuuccgagaugaacagagccucauccaaguaugacuuccuuugucugagaaaccaaggauugugugugcucacagcuacuccagucugcuuuuguuuacuuuuauugcugaacuagaccuuggguccuguacguggagauuuuaggcuccuggacuuccuucuaguaugauuggaucuauugcuagaucuuuccauuuuagaauauucugauuuauauuacaagcuacucagaauccaggaacccagcccuggcuguccuggaacucacucuguagaccaggcuggccucaaacucagaaauccgccugccucugccucccaagugcugggaugaaagcaccacccccggcaauccugggacucuuauaaugucuaauucgaauccuauuccaucuucauggguagauauuugcuguauuuuucucauuuuauauuuaauugucucagcaauuaucuguugagagaugagugcaguuauuuauuuauuuaacgccgggcuagauuuuuuuuuuuuuuuuuuuuuaaagauuuauuuauuuauuuauuauauguaaguacacuguagcugucuucagaugcaccagaagagggcauuagaucucauuacagaugguugugagccaccaugugguugcugggauuugaacuucggaccuucggaagagcagucgggugcucuuacccacugagccaucucuccagcccccuagauuuuuuuuuuuuaagauuuauuuauuuuauaugaguacguugguguugccuucagacacaccagaagagggcaucagaucccauuacggaugguugugagccaccaugugguugcuggaaauugaacucaggaccucuggaagagcagucagugcucuuaacuccugagcuaucucuccagcccccugaauuuuuauuuacuuauuugcauguguauggguguucugugucuauguauaucuauaugccacaugugugccugauuccugaaaacagaagaaggcuucugaucccuugggacuggaguuaaagacagcuaagggaacauggaugcuacuuaauguggaaccuagaaagugacucugggaccucuggaagagcagaugagcccucucuccagcccucaggcauguuuuuguagcaucacauauugucauuuggaacccauugcuccuuaagucaagcagugaguccuucccucucaccuuggucugacaguaugggaaacugucucaccuguagcaagcuuccccuauagcucugaagguaaaaccuuaucuuugcaauaaacacugaaaguuguuuuccuagaagagagacuugccagaugcccaagucagaagcgugcgaauuguuaucucuaggagacauggucuaugaaaaaccagcuaguuucugguugguuucucucuccagucacuucacacucaucuucaggacuggugcugugcuugugagcuuagaacagaacagugcuuucugugcacuucccguuugucacaaggaggaggagggagggaggagagacagagagacugacauagagacagagggaaaaaccccgcauuucagagucaaaauucaaaggacuaguuaguucaucaagggcauuccuaaaguacacgaguucuccaaacuacuacuguaggugguggagaaagcagugucuggcaacuugucucacuugccaccacagccuucauuccugcgaaggcgucagucguucuccaccaucagagcuaaagccaggggagugaaagacaagcuuugucuuguguucuuauguaaguaguucugaccucugagagggacuaccggaaucuggaaacuugcgguauuuagaaacugggcaaucaguuacaugagcaauauaauguggugagucccgggucgaacccggagcgcaccaagaaaguguccuuccagcagcaggcugguccuccgggaugccccuguuaagucuucucccugccuuucugcccaucguuguuuucagccgcuucccaggcaaagccuggugucuuuccugugucugaguugacgcaauuuucgauugugcuuucgagcguuuacguugguuugcaucaugguuuuuguuugcggggggugggguggggugggguggaggggaagcaauucuuuuaauuuauuaggggacuucccugaauggcugucuucuguguaaucgcauguugccucgaagagggaagucguauaaacacuuguuucugggcacuuucaaaacugaaagcaaaguugaagaaggguugcuagccgaucccugauguuuccgauggcaagccccgcagcagcggccagaagcagcgaaggcagugauccgaugcucccacucccagcacauccccacggcagcaggacccugaggucccagcccgagcgcggggaucucuguagcgcgcguuugaacacagccgaauugggggcagcggcggcggcggaggugcgcgcugcccuuaaaaggaggcgggccguaccaccgcggcgccugcgggggggucccggcgagcucgggcaccucgaggggagcccagcgccgcgcacaucgcccccgaagugcgggcgaacugggagccgggaccccgcagcgggcggugcggacgcaccccuuggucucuggugacccgacagugccccggggcggcgggcaucgccgcucccugggcuccagggaggugcggcucgcccggcugcccccggugcccggauguccgucaggcucggcgcgagccgaggcuccggggggcggaggcggugcugaggacacagagcugaggacgcggcugccgagagcgcagagucugcggggcaguaucgccgacggcugcggccgacgcugagagcggcgcgggcgagagagccugcggggcgagcgcgcagauggauuugggacgccaggcagugugagccgagccauggcagcccauuccaggugaggcuugcgcagggggcgucugggacccgggaguggccgcggagcccggggcaagggcggcgcgggugggagugccggggggggggggcggggaccgcaggaagccagcggcuggaucacugcuaucucaucccugagugucggguagaaaagugugugaaccgagugcaaagggaccgcccggaaaguuaagguuaaagauuccgcuucuggcccgaagaacuguuauuuucggaaagugaaguugguuucucuccugccggagccuggauuuucacugaggugccugugcacaauccuccggcucuacucguugcugguuuggcgucuuccaaagaaauuuggaagcgcacuuaauggaaacgaggauucucccacgagagagugguggagccuggugaguaauauaguuuuuuuuuuuuuuuuuuuuuuuuuuuuuuuuuuuuccugcuagaauguacgauuccacauaaaacggcacagucagagugaaucugcugaguaggcaaaggccggaaugcgcuggguuggugaaggggagccuggcuaaugacccgcaguugcugucaggggagugcccuguacugcaaggaccgagucuugccuucucccggguuugaagguuuugaaaggagccuuaaaacuuggccguacaccggugcccaagauugaggcuguugggugucaucgcgcuucggucucuacagcuguugguuacggaaaacaggacccgucgaaccuuuucaaaacuuaugccagaaggcagugugauugcacaaguuuacaauuauggaaauguucuuuagccuuaauacuugauuuaggauagugauuugguaacauaucuggacgcugagcugagguaauuuuaguaauuuuaggucuaaagaucauggagaacaguagauuuguaaacguuagagacugaguagauagaacuugaauuuuucuaagagauaaaacuuccuagaaggaacuucucuaaacagaaaaccuucuaagugugucuuacuuuaaaaacaaguuuaauccucucaacuuggcuuaguugugucuucaucuuauugaguguuggaaggaagggguuccuaacgggacagaggaguaggggaacagaaguugcaccucaaacuucugcuaaaucuuaacuaaaaagcaaccguuagcuuuuagcacaaacagaaccuguagauuuucauauuacagugacugcagaugucuucaaucucuaacguuucccauuugcuugaaauuaaggaacuguuugucguucauggcuaguaauuaaaauauguuauagcuggauaugguugcccaugccuuuaaucccagcacuugccuuuaaucccagcacucagaaggcagaggcaggaggaucucugaguucuggggaaagccuugcucaccuuuuaaucccagcauucagaaggcagaggcagggcgaucucugugaguucuggggaaagccuggucuacaaggagaguuccaggacagccagagcuguuguuuguuacacagagaaacagucucaacaccaccaaaccaaacuauuauguccuuaccuugucaaugguguauuuuaguagauacucuucuagaucauuuguuuccuuuguauuacauaauuuacuugugaaaguauccuuauguaucacgcugccucaggaucccuuggcauacagcccgagauuaagguaccucuuauaaaauaguuaaagcugccagagcauggggauuugaaccuugguucuauuguuccaauuccuugacucuuaaacuaacgucgaacguaaaaugaaauaaaagauaaacuggguccuguguaugccagacacagcaguaggcugcuguaauuggauuaccucuuggucaccuaagcagacaagcaagugcuugauuauuugcccuugguaguuaaggaaacugaggccuagccgggucacacagguuucgugcucaaggucacacaggugcaaccugccugaccccagauggaccccuguagucucuacaguguagcacuuccugcuucuuguugccucugcugugccagcugcagaacuucagaggaagagcccgaaagugauugcagcuaaguuugcucuggugcagcauguuuaaucuaagucaucagcguggcugcucagcucagcagcaaagacccugcugugcuuuccuggcuggcucacaagcucuggcacuagaaacaaaaccacacggccaucacgguugccuuccugguguuuucuuagcccuagugcugaguaucuacccuguugcaaucaucccuucaauuuugccuugaguguaguccaagcacucaggagaaacugaagcauucuuugugauauaaaacuauuggcacgugucuuauggaggacagauugguuugcucuugugacaguucauuugaauggucaggcucauuggacuuagagauucagagcucacuguuuuaaccauagcgguuaagagcacuuccugcucuuaaagaggaccagaguucuguucccagugccuacaugcagcucacaaccaccuguaacuccaguuccaggagauccagugaccauucuggucuccaucgacaucaggcaggcaggcaggcaggauacauacauaugggcgaaaaugcacacagucaaaagaaaaaaacaaggaagaaagaaagaaaagaaaagaaaagaaaaaccaccagcaaaccuacccccaaguacuuugauugugcauaggccuacuuguaggugggagcuuaggugggaucuugccuugcugagguggaacagguccugacuuaaagcugaugugaaugagcuaggcuccauucgauucucagugugacucaggcagggcaaggugaugcuacuucccauaucaguugugaaugagcuacuaaguguuuauggucucaguagcugcuuuaaaauuaagauuauguagcccuccuucuuuucccaaaucgugaaaguagucguuuugcuuugguggugguggugguggugcugcugcugcugcuccuccuccuccucuuccuccuucucccccucccccuucuuccuuugauccucggacacaauauguagaacaagcuggccucaaacucacaguuccaccugccucuuuagaggucaauggcauguggcaccuugcuuggcaaggauagauuucuuuguaauggaagacauuuauuaacuacuacuugaaaacaaacaaacaaacaaacaugauuuauuuaggaucugaguugggaguuaguuacagcaggcuaugugcuguacuagcccagccuaggcuucucuggagccugcaaucacaacacacccugaucacacuuccuugagagaaacugguagaagcuugauguccucaacaugaaacaguuacagauuuucgggagucucauugguguggagguugguccuucugcaacuauuaaauaguaaauuuggugucuggacuauguccuauguagagugcuugcaguaugaugagcaguguggauugcuagaauaaaaagaagacccgugucugacuuucagcuuucccaguucuuccauuaaaaccauccuuggagucuaggguggaaucuguaucaaucuucuuaucuuaauuaguucuaaaacgugccgaguguugggcuugaggagagacccagucaucccaaccaaugggaauuagaggcagaagauagcugcagguuuaagaccagcaagggaaaggacaaacaggggaagggugucuggguggccucaggaguggaacuuucuuugcaucugucuggugguuaaaaagauccacagaagugucugcaacagugcaaaaggagaguaggucuggccagcucucguucacaguuuuccuuuggaauuugacaaaagucguguuaauaaagcccuggagucaaagaaguaaagccagguuguucccaagacgcacgugaaacuggauuuuagugguucuucuauucuagcgagggaaacuguuccuguugaaugaagugugguccuuaaacugguacaaaaccaguuuggccccgacuugugccuccaccacccacuggggagcugcugguuaccuggcagaaaacccacaaugcaaagcagcuuccauuaaagagaagaauuauugggaaaguguaguuucaggaagagauuuggagagaagaaggaugugugcccuacuugaccccuugacuggucccccacgcucccccauggugccuuuaaacagggacuggagacaaaggagucacagacaggaacuacucuguaguucauccugggagcccagugagcuuccugacucacagucuagcucuuuccaagaugaagacagcagcagccaugagucauuuauuuauuuuuuuauuuuuuucugaaagucagcugucuuacaggacguuguuuggcaacauuaauggaaauggucuccuaagagaucuaggugguuccgugcaggcaugaguuguuccgugguuggucucagaccuguggucuugagaaugagauuucaugaaugaugcugagcaguguuuaaagucucaagugucugcagggagagaagcuagucuccaucguagcuaugagcugaaagaacauuuuuuucuagccgggcucugucauuucugucuuauuccaguugauacauccccgagaaggcguagaaagggacuaaauggcugcuuagcucuaaagucuaauagaacccaacugccuuugcaagcauauauauauauauauauuuuuuuuuuuuccgauucucaggcuucuccaauucauuuguuaaccaggacucacaaauaaguacacuucaccccagaaugugaaauguccuggaaauccacuuugaucccugaggaaaaggacuuucagacauuucagacauuucuuggcucagacugucuagagcuggggcauugcuacuuuacugcucucuguauaucuuauguuuaucugcuuuucugugccccggaguaagugggagucaagccuugccucagaugucauucaguuuacggcagacaucacaaugcaugguaucccuugccuggcaugguggcacacgccuuugaucgcaggacucuggaggcagaggcaggcagaucucuugcguuccaggacagugcgggcuacuuugugaggugaaaaauaaguaauguuugauguuuagcuuuagacucaguagaaaaauaauuuauaacuuugugugcgaaauccuugugcuccagauaggaagauuaacuuuaauccugugcugguuucugaguguccacagacgugaguguccaggccccuccugugcaaugcuuuccucucuccaaucucugcugagaguuaaagcuuaacccaauggcauuagcugguggacaccagauccagaaagccuugcuuuucgcuaaaggccucuuuucuuguguugguuuauuagccguguuuuuaauuuaaccggcuuaaaugccugcaggagucucagggcaggaauuugauguuagauuuaaaguauuaagaggaaaaucccaguagugacauuaucuuguccaaaggagcagaaguaaacaaagggagaaauacuuuuauugaccguuaacuuguguuuauuuuggaauuaggcuuuaucuuuuaaaaggacacucacaguuugaccgcaauuaccaagaacugucuuuccucuucuguggcggguaggaugguucuggagugcuuuuggcugugugguacuucaacagggguuuggggggacuugacuuucaguguagcuugcuucuggcaaggaauaauuuagggguacuugggcccuccuccuggguugaacaccagaaucaccaaggugcuugucacccauuugguuucccuuccccccagagcugcugauuggucagguccugggcggaggugggguggaacccugcugucccugaugccuggggcccauauaucagcuuugugaacugguuaacgacuggaagaagcuacgcaaauacaaugugguuacauuuuuuauugaagacguuacucguguauacacuuucucuccugggcccgaacugagcuuagcagagaguguagaggagaccccgcaguccagaaucagcauacuugcucacugagaaguuaaagccgguugugcugcuguuuacgaucugugugugagcaggcaaggacggcaguugguugugccuccugccgcacuuggcagcgagugcuccuucccaaggaccuugauguuuagucgcuccuuuacucugcucugcuggcucccuuccuaugccacuaagccacuuucucacacaaccccucccccaacagcuccccaggugcuguuguucuccuucugucuccaaagaguuacacacagcuggggcuugcuggugacucggaaccagcucugaaccugaagugaaagcuguuuguguuuguugagcagaaagcacgggcuuggcguccugcuguugaacacgggagaugcccaguaaggaucuugacgugggaucguuacugggaaguuaguguuaaaccgaccgcacagagcacuuccuguagcccauguucaggaagcucuggaggaggugcucuugaguuucccguucuuggagcgcccuuuuagggaagcauuccagcagaagugcaugaaaugugaagcacacuucaagggugcuguguggugucauuaaauuuugaaucggugcacacguuuuuguggccuggacagaccacagucaccacgugacauucaucuccgaugcugugucuggaucuuuuggugaaguugcaccucuccccuccccugcuugcucacuuuaaauguaggagguguaugugaugcacuguggaggucaguguauagaaaaccgcugugaaguuaaccugccaguucccauagaacuaggaaaacuguuuacguuuucauucuuuagcgaauucagaaauuucugguuaacaggguucuuuuuaauugguaguauuggguuaccaaaacauaauauucuaauuuuguuuccuuuuuuuuuuuuuauucuggaaggaaaauuucauaucacugggagacuaugcuuaauuuuaaauaguuuuuaagacuuuuaaaaaacugauauguuaacucaagugccaacuucaucuuguuuucaagugacuuugaggagcuguuugccucuuucuuucauagccugugucuuccauugaccuucuagacacagaccaugucuccuuaacuccauuuaaaaaaacucugugcccugcacucuggaggccagaagcagguggaucucugugaguucaaggccagccugguuuacagagcaagauguuauacagagaaauccugucuugaaaaaucuaaaacaacaaacaaaaacuguaaauaaaacaaaaucauguaaguugccagcgugcguggguuuuguuccucgauuccauggcaaggacuuugauucuagaaaugccucgguuacucucagccaccacgaaggccugaaguuauuaagcaauagucgacaggcucauuugucuugaguuuaauuuguaguuuuuaaaagaaugccuggaacuuuucgugucaugucuucugagguccccaugucccuugaugcuguugaaaugguugcgucccauauucucauggcccccagccagcuagauaagagcuaugcuccuguucuggguuuuccugguggguaacucagugaucaggcagcugcacucauagccgacuuacugaucauuagugacugaucacucagcucuguuuccuaggucacaccgaacuguaugguuguucuagccugguaagaaaacaaauaacuuuacugagagacacagcacuuuccacaaagucuacucauuuaaaucucacaguucauuguuuuuugacaccucugguuuuuuauuuuuuuaauuuuugaaagacuuauuuauuauuauaugucuucagacaucccagaagaggacauuagaacucuuuaugggugguugugagccaccaugacguugcugggaauugaacucaggacaucuggaagagcagucagugcucuuaaccacugagccauuucuccaacccauuauuauuuuuugaaaaacaaguuuuaaaguuacauuuauguacaaauaaccaagcagcguacauuuaacugacucuaguggugaguucuuuggccacugccuuuuccaguugggcaagcgagucagauuuugaacccaggauguugccccacugguggccgcagaucucaucuuaucugcccuuuuaacugacccagaggacuuccaccaucuuaagccuuugucuucugaguuagcugugugguacaugucuucugugggccagccuggccuucucauuggugaugcaguagggaauccuauauugugacacagggcaggaagcaagacccccuccagcuugaucaaguccccaucaccugugaugaccacaagucaguccuuguucuccaucaagguagugaccauauugaccccugcuugaaggacagacggucuuguaguggaggugaccacuuugccaacaguuuucuuaucagcauaggccggcaggcagccuuugcugcucucugcggucuucucuggcauguauuaguggucagacuuaaguagcuaggugcuguuugacggugcagggccugggagaacuuggauaauggaaggaggaggcacuuggagccacuuacagaggauagauagugccuugccacugcagcuggaugccuuggggccguuucacaaagccucugagguuccuuuaggguuggaugucuuguacaacacugaaguucucaaacugaacauugaccaguuuuuuuggcuuccuguuucuucacagcaggguugggggcuggggccaccuucuucccuuggcuugguuucuuuaucuuguuccacugaaggagagaguggguucccaaagauuuuaaagucguacuuccuaucccauucccaaggaucucuaugucauuuacaguucaucuuaguuccguaucccugcaaccguuaccuuacuuucugucugugcaaaacugccuuuucuggucauuuuacauacacggguucaugaauguaauguugugguuucuuggguccaguuucuucacucagauaguuuuugagguucuauuaugggcuguguaguucugucgaccuuaccaccaaauagcaguuucuguguggguaaacaggcuguuugcaguguuuugcucaguuaggaauaugguuauaauaacauuucuuugaggacauguuuuacuuuuuucuuaguuauguguuuagggguggaguuuauggcuucugugauaguuucaugcuuguuuuuagauuuuguguguguguguguguacguacaccauaguguuuaggcagcaaucagaggguggcuuagcgauuugguucuucgcuucuuccucuauguguagucuagagcuggaacucauagugccaggauugcuuugcaucuucauccugugaaucauuguaauaagcauaugcuuaccuuuucuuuuaaaaaacaaucuuuuugagaaaauacuaagauggcguuccaauuauuuguccauucuagccuaagucuaagagaucagauuuuaguaacuuuugggaaguuauuugccaucuuuauagcuguggggguggagaaaggaaaagcucugagaugucacugagucuugguugguuguuaggcagugcauccuggcgcuguuggugggcaccgcuagucccggcacucuggaggugagacaggcagucccucaaggcuacagagaaaaacaaaaaaacaagaaaaaaaccaaaaauguauuauucuuaauuuauaugacuuaacaccacagcaaccauuuuguauagaaaauucuuuuuguuuguuuguuuauuuguuuguuugguuuugguuuuuugagacaggguuucucuguauagcccuggcuguccuggaacucacuuuguagaccaggcuggccucgaacucagaaauccgauugccucugccucccgagugcugggauuaaaggcgugcaccaaccccccagcccuccccccccccccguuuuguuuuguuuuguuuuuuggagacauggucuuuguaugguccugacucuccuggaacuugcuauuguagaccaagauccaccaaccucuaccucgcaacacauuggccaccaugccugcuuuguaauucuuuuuuuuuuaaauaaaugauuuaauuuuaucucuacgagaguuugccuucauguagguauguccaccuuguggaugugauggccccugggacuggaguuacaauugugagcugccaugugcuggcaauagaaccuguguucucuacaggaucuuaaccucagagccaucucuccagacccucuuccuuguacgucuuagauuguuuguuugagggcuaggguuugaccuaagguuuccuacauacugaauaugcguucuagcauugaacaguuuaucucacaaguuuaacaacaccuggugcaggaacauuguuuucuucuuuuauugcuauuauauuuaucauuauuuuaauuagauggggcaaguaauggcuuuauuuugcuuaauugauugauguaugcaugcaaacacacuaauaaauuuugaaaaguuugaugagggcuuuuugguuuuucaagacagaguuucucuguguagcucuggcuguccuggaacucacucuguagaccaggcuggccucgaacucagaaaucugccugccucugccuccgagugcugggauuaaaggcgugcgcuaccacugccuggcgaugagggcauuuuuuuuuuuuuuuuaucauuugggagccaucaaauaagggaugugauaagaucuagaagacuuggcuuagugacagcaggaagugaucaagguuagauagucagaggucagucaggcuggccaguuaguagaaaguuuaaggcuacccuccugcccaucuggaggacugucgugggaccuggggugaaagguagccucccucugcgaacaggucgccaugagguuacagguuauaauuuuauguuaccuaaucaaagcacacaaaggagcuucgagggagaugggccaugaggagcagaguguuagacucccccucaguguuucagaaagaagcagguacauguugcaaguagcuuuuccucugcuucugugacuuccugaaaggaugcaauccuaagaaacuguagcagggacugugagcuccgccccucuggcuguggggaguggcugcagaagccuguucaucucccugugcgucugccccgcagucacauuuuggugaccuuuuguuguguagucuaugacuuuuuaaaauuagcacuuccugagcauauaacaauaauguguuuccauuaucuuuaaauagcagaauuagaaacauuguauaacaugccuuuuuaagggaaauauguuuaugagaaaacaggaagucuuaucuguuguuuugaaguggucugagagcugacuuaaauggcucagaccacuaauggguuuucuacucuccuuggauccugaguucuccgauaucgacaagauggcuuuuaaaaaaaccucuuuuacauguuuuguauguacuaugugugugugcagugcuuacagaagccacaagagggcacuggaucccugaaauaggagauacugacuguggugagcaccaugugggagcugggaaucaaacuggaguccuggaagaacagucaguguuuucaauugcuaagccaucaaucuagcccuuugaugaauguuucugguguguagauaccaguaccaggccuuccuucccuuuaaacuugccauccuccugucucucaaccuucugugugcugaggcuaaugauaauguguuauuauccugguuugugucuuccaagugaccugguggauaguguuguuaucuuugagguuguguuuuucaugugugcuuuaucuugguuuacaggcugagggacaguuccacaaaccaacauucugcaccucucuccaaaguacccauucuuucugucugacagacaguaucaaauucugaacagugguugucugacaguauaacaggaugagcauuugucauuaguguuagucuuugcugagaauucuuugaguugaaauuaaaaaaaaaaaucguucauuuuauguguucuccgcauuuuggcugcagacacauguaguguguauacccgauacccaggaugauaaggacagggcaccagaucucuaguuacagaugguuguggguuguuguaugggugcuaggaauggaaaccugguccccugcaugagcaacaggugcaauuaacagcugagccccuaguuggagaauucucgugagcuuugcugugcaucuucccagaugaccuugagugcccugucaggaaacuuguggucuuuuaauaggaugcuuuccuugcaaauuuggaaagccucauccuguuuuccagaacauuacagcuuaagucaggguugccaugacccuuguagcuuuucaugagacggaaaaggugauucccagcgguuccugaaucacucugcaggcaccauccgucuguaguggaggggagguccuguuugccucaguuucccccagagaguaguagaaaugugccuuggcucuugccauuggcaaagguugcgcuaacagucugaccaaaugucacuggugauuuaaauaugacuuuaggcagaagagcagaucaucuuguggcucugaguaucaucucccuuuacuccagccuuucuucucugucucuuuuucuccugacagggucucccucagaauugcuugcuguuuucaacuaggcugacugccugcaauccugucucccccuccucccuuccugugcugggguuauaggcacucacagcggggccuggcauuuuucuaugggugcuggggauuugaacucagaucccuguguucuuccucacugagccgccucuccagccugaagaaaaaaaaaaaagaucuuagggguaauuugucauggugaauuuugacacuuugaaaggcaggacuuggaugaagucucucgauggcagauaggacgugaacuagagaaauagagcuguaauuccaccucuuucuaaaggccgagcacacuggguggguagacacgugugugaguguauguaugugugaaggaauguguguguguguuggcuggaacuuccagaaaaaacucuuugaaauaagaaggaaaugcaauucugaugguuucuuugagguuucuuuagaggaacuaaaguagaaggugaaaaaauagagcuuaaaagcaggagagauuuuuccuuccuuccuucccccccccccccccccaucaggcuggccucagaacucagaaauccgccugccucugccucccaaguccuguagaggaaggaauucaugguuuucagacacagaaugggacaggguaacaugggaagugaggucaggcucuguucuagaguguuuguuucccaggggagcuaugugcagacacaaagccaugcauagugacccuugaaaucacgaggccaaggcuagccugggguacacagcagcauccuccaaacccaagcuagagcaaacauuuaaaggcuuuuagguaagggcugcagucugcaugcugaucacagacacacaacacaacacaaccacacacggccaacacucauuuugcaaguugugggcugcuguuuuucuuuccuuguauagagucacuguaaaucugguggauacacuugggcuuccagacggcuucguucuaguaaaaccugaaaugaauugcaagcugggucugcugugagagcaucauacaagagagacuucauacaaguccugccuuucaaagugucacuugguugcaccucaacugugguagauucagucagccucagacaguuauccuggugguuuauguaaaacuuucaaacacuuagaaaaguugagugaauuccacaagauaaaguccuguugcauacagauuaugacagcgugcuuuuacagugaauuaauaaugucuuggucauaguagcauacaaugaauauacuucauuuuuuauuauuguucgagucauguaugccauauaccuuuuuccuaaauaucuuggcauauaaaucauuaacugaaguugagucauauaguuuucuuuuccuuccuaaaauauucaaagaggcacaaagcucaaaaugugcgggaguguacugacaggacaaagaacuguuuucagcaucuuuuuugguaugugggugagagggugauuuaaacauggaguaacccuguauauacccgcuguucuguuuuuuaaagcaauaaagugauugaggcguggauugagguagauuaaacuugggaggcagaggcuggcagaucuuugaguuggggcguugccaaaagaacauaguccuugucucaaauaucaguguacaacaaaauaaguauaaacaacgugaguggcuuuauauguucuucauaaugggccccacccgucuaucauuuauccauccauccaucauccauccacccacccacccacucagccuccuacccauccaucuacgcaucccccauccauuuggucauugguugaagauccuguguguggauucugaggucacauguucuuuaccugacuucuuucuaacugggaauucucaugcauuuuuauuuggucacugguauuuuucaaucuagagaaacauucagcauguaguggaauuuacaaagaauauauuuguuuuuguguguaugagugcuuuggcugcauguaugucuggacaccaugugccucacuggagccugagggaaccagaagggcgucaaguuccaugugucuguggcacuuggaauccucuggaagaacagccagugcucucagccacugaaccguucaguuccccaacccuacguuacuggguuuuuuuugacugccuuaggauuuagugaacauaguucuaacacuuauuucccaugacucacaacuaaaacuccugugcuagagguauagaaaacaugagaguaucacuccaaacuccauuauuauuauuguuguugcugugguuaucauuuuucuuuuuggaguaacucuucuccagagaagucacugacaauagagcuccuaucuaauacucagaacagcaaauacacaugaaauguuccuucaagaauggauuaauugcugggccucuuagcacuugugguaggaggauugagaguuugaggcugcggggaccagcgacaagaguguggcucagugguggaucuguugcccagacugugcaaagcauuggguucagagcuugguaaagaaaaacaagaauuuuugcaauaaaagggaggaugacugagcuaugugcauauuauugccaggguuguguuaccgaagccguggcaggcaggcaagcagagccccaucgaaggagaggagggaccgguggaugccaucauucggcauagguugggccuuugauuucugagcucagggcuuuuuuucagagccuucccuuugggccaugaugagauaacugugggagugacuaggugucuuuccaggauaucugggaauggaucucuagauaaccaggggccccacgcugaaguugggcaaguuguaauuugucgggcagguuaucugacagcucuuagccaucucuucuggguagaauguuccauaacuacuuauccgguucucacaacuucacugugagggagcaguugaauuucugacucucagggcugagaggaagcaggggucuccccagggcugacgaggguagugcugaugcugacacugagggauggaaggagguuuaaagaggaagaaggagauggcauggcgugagcauuagaagcccgcucuacaucuguuagguuuaauucugugacuuugguuaucugugacucugaacacugccccuuaugguuuuucaaaucuagugguacugucccaccagacaguuuuggaacaagauuucugaccagacagcaggcaguugucuugauucuucauaugcuccagaaaccgcuguuguuugcuggagcccugagucugaaggauuugaggauucccugggcccugccgguuucagucacagaucugcuuuccuaggcucuccgccucuuccuccugccccguucaauuauuucaccuuaucauagaggauuuuaguaaauucauuguccuacuuaaggcucagccagagccagucacugggguggcuuuauauucauguguccucuugcuuccucuguugagaguuaacagguaaacacaggguggggaaagcuguguccugccauaacguggugagagacgccugaggccagccuggcaucuuucccagcacacagcccugccuugcuuaucuuuggggauaaggggggcagaggaagacauuuaggugagauagccaauaagcugggagauuuauggccuuuucccuucaugucaggaaaguggauaaugagaaguuaaugcuacuacaagacagaauauuccagagaaaauuauuuccaaagcaguauguacuuuuuaaaaaugaaaagucuuaaagugaacuuaaaaaaaaaaaaagagcuggagagguguucagcauuuuacuggcacaggcugcucuuccauaggggucuuucuucauucucagcacacaugaagacuaagucuaguuccaggagagcugacacccucuccuggccugugcgggcauugcauguucauggugcacauacauacauacauacauacguuaguccaaauacacauacacaaaaaauacguacaucuuuaaaaucauuugaaggagggcacuguagcaggguuugcaagcaagccuuuguauaaugcugucuguuccugagaggagcucugagccuuucauauagccccaggugccuguuuagcauuggagaaaagggccuuuagagcacucauugguaacacguugucaucugaggccccuguuaacuuucuuuuuaauucugacuuccaccuguccgcaugguuccuucccagcacaguucucuguaugugcagucacuuuaggucauugcuuguggcuggagaagauuguaggcccuuguugcuggguugcugcucugggauauaauuagggcguccuugcagacuggguguuuguaagaaacugucauccccacaaauuaucagggcuucuuucaaucccugagaaaugcgaguuggggguugggaugagauagguacaaacagucccgagugacugaucacuccucacggggcuugcugcaggggucacggggucccuucccugccugaagacuaaugcucaucuuucaagacccaguucagaugucugcacacugcacuaaguuauuugggcuccucgggacuucuucugagguccuuccuccucauucugcaacauuguaacuaaccuccugaacagcacuuuuucuccuaggacuacaucucuuccuuugugugucucgguaggguguagaaucuuauuuccuuaggucuggcacauaaaaaagucuguauuuccuggaaauaaguggauuuucuguuggucucccugaggcuuaaguguuaaaagcacaggaaacuauagaccaacuuauuuaugggcuugaauaaguuuaagugauaugaauaauauucaagaugccuuuguauuggaagacaaguauuuuauaguugccuaaaaugaauuaguuuugcaucuuugcuuuuucuuaauuuaugacagaucugugcgcuucugcuuuuugagggaggugagaugugacuguuaacacccucuccaggguuuaggcucuuaagaauccuuaagugugccucuucuaguucugagcuuucagauaguaguuucucagugacaaagguaggaugcuuugucgagauuaauaaauacccauugugcauaugcaagugaacagcccacugcuuguacuuggggaaggaugauauauucugcauguaaauguugauguuugggcuaaaguccagcccaaggaaucccagcaagcuguguaaagcucacagcaccacauagcagagguuaaaugaagggagacugcuccaggaaaacaguaacucacuguuuagcuuuaaggagaugccaauuacagcggguggugggaggugaucgggguuaggaugaaaaugagaauauuuagaaacauguaaucguugcuguggccauaggaagcaccagugcaugcuuccagcuuucuccuggaagaguguugcucuuccuccuacuuggacugagaagaaauagacuggcucugcuauuuacaacagugaacuuucugugagaacaaguguggcgugggcaauuagauuuccaaagggggaggagguaaauacagucaggaugcccaggguccuguaaaaugucuuuauggacaauuaguucucaaauuuagauuuuuaaagggagagguaaauacagucaggaugcagaggaaaagaaaugccgaagguuccuauaaaacaucuuuauggacaauuaguucuuguuuguuuucugcuuuguauaauaugcaaauaagaugagcgcccugugcuuugucacuguguuugcccagagucugauuuaaagcaaggcaaagcaaagcaaagcaaaacaaaaccaacagcaacaaaggaaaacuuaaaaguuucucuuuuuaguguguuuguaccuacccacagcagucuguuuaacucugaaaauucaguugacccuggucucugcuggaagagcuuguguuguugagggggacggaggaccccaguuuucugccccugacugaauuuuuuugaguacaaugggagcccugucacuuuuuguugcugcuguugcugcugcugcugcucagucagcaauggaaagcuguuuuggugggucucugcaagcugauaaugauacuguguuccuucacguuuuauccuuggggacgcagagaaacaaauuguagcucaaccguuuccaugccaccccauuguucccccacuguuaucgauacacagacccugcuuuuccuuucauuuuccaagagccagucuuuccuguugcuuccugcugcuggguagcaaagccucagggcugagccuuugucccagcugaggcugugcuaguaagcuggcuucacuucacacagucuccuuauuggacgagaugcaauggguuuucuggaaugugugcuggaaguucauuuuuugggagggacucuuccuuuggauugccaauuccuguguguucagugcugauguacaggagggacugccuucugcuugcuguuaauguuuguaguuaucuggaacuaacuaucaagugauaguuuuaaaaauacuuaggcuuggcaguaucccagaggcaaucagagcucugugaguucaaggccagccugguguauauaaggaguucaaggccaggauggacuguaucaagugaccgugucucaaaaacaaaacaaaacaaaaccaaaaaauacccccgcuuaauguuuagcauguuuaauuuuucuuauggacuauagagcuauuuuuaaaacaacaauaacacuaacuugcuucugaaugaugucuugugaggaaaaauguucaucuggucacccagucacuaucuaguucagaguugaaugauuuugaaucauuugaaugaauuugggaauacauuuguuuguuuguuuguuuguuuguuuucuuuuuuccuguuugguacuugaauaucagccgaugcauuaaacaguacaagaaugguuuacuacugccuguuuuaucaaaauuaugucgugaaagugcaucuuuucaaaauagauguguuguguucauggaagcgaacucauuuucaaccaagcacagagcagguuuguggcaguuugcccuccccggugucuggguagccuagggaguuagagcuggauugagaauuacaggauccccgaguagauaaggugaccguggauaaguuaucuuuggauaguaacugaaagagaugaagcauggugcagagcuagagagccucuugugaggugagccacaugcaguucuagaccgugagauagcagugagaaagaagagagacagccccaggcccaggcccaggcccaguguccauuuagcccuaaacauaacauucaucugucuuucuaucaguuugcuguccguccauccauccaucuaucuauccaucauguauaguguguaggucuacacaugccacaugccacagcaccaaauggaggucugaggagaggucacagggaucucuccuccaaccgacaugugacuucccaggguccucaugucugacaaguguccuuuugugcagaucacucucucuaccccagcauaacacauaaacauuauccccagucuguugauuuaaaaauaaguauauauuugcuaucauaucuuacccaaacaucuuuucccccuuccccucucuguccagcacaguuuuaugaugaauucacgguugugguaaaguaagcugcuaacuuccucccaguguucccugagcacauggaguuaguuacucagcggcucuccuggagccucugggaagggaugaugucagcauccuugaggcuuugagucauuucaugggcagaacgaucugcuggcaagauccauuuuagguaucagacagugaaucacgguuugucaucuuccagagcggcagaauucuacagaauucuuaguggcugacgggugucugcauauaaucacuucagucagaucugaugggguaaguggcacuugggugagcacagugcuaggaauggcucccucaggagggaucuguguccuccaagagcuucuaggauaagaagacaacccuaggcacgucuagagucugucuagauuagauagcuguccacacaacgggaauguagccugauaaugacaauggagagagcuuagacuugagcucuccugccuccuggcucuugagcacugcuuggagaggugacgugaggauccgggagacugggugcucagauucucacaggaggucauguuugcugccaccgcccucccucugcagcugcaaacccuguaggaggcuugggccugggugggugggugugggggugaugaauaagaucagauuuaggaguuuaaaagaucugggaggcagcucuucggagguggagagcccaggagagcagcugguuggcucuacaccccagugccgaaguacauacaguaccucacuugcauaucggguucagcguuccagcguuauuaacuugcuucuccagagaugaaaagcgaugaacuaaaugcaguaaguguuuaaaaauaauagacccaaaggucgcgugccuacauucuucugucuuagcugugaccacaggccagacucuuuuuucagcucaugacuguaaggaggccaaguuuagccagccucauugucuucuaggccugugauacugugcccuucaugcgcaauugaguagugcggagaaugauauagucacguggcgccaggguucugguuguuccugggaagccaacggugcuguccaccccuaagugaaugaacaaugucauuuugauggagaaagggaguguuaggagggcaggggcagauuuuccuuccuuccuuucuuccuuccuuccuuccuuccuuccuuccuuccuuccuucuuuuuguuguuauugagauaggguuucacugugugucccuugcuguccuggaacuccuuagacaaggcuggccucuggaacucagagauccaccugccucugauggaaucaaaggcaugugccaagaccgcuuaguucaagauggcagguuuuuaaucuucaagggaggggguguucuuuguaaugucucuaaaguuugcagcagguagagaaauauuauggggcaacccaucacagagacagaauuuucuguaacuuuucaguuccauuaaucuguucacauuucacauaacaauaaaaagcauuuuauuaaccucuagcuacagauugccaagccugugaggcgagaaguuaccuccuuucacugguguggcuucugcaauuguucuuauuugcaugguagucuuccuuguguguguguguguguguguguguguguccacgcgcgcgugugcgugauuuauuuaucuuccucuauguguaugggugcaugucaggugccuacagaggucagaagaaggcacugaguagcuuccuagaacugaagugucagauguugugaacugccauguaggugcugggaacuaaaccuuggucuucugcguugggcauucucaauugcugagccaucucucuagcccuaauauacauacauacauacauauuacaaguuauauguuauauauuauauauuaauuaugugucuggguguuuugccugcauguaucccugugcaccuugugugugcccagugucaagggaagcaaagguauuccuuggaacuagaguuacagccuguuaaugcagugcuuuuaauugcuuggccauugcuccagcccuguucucuaucccaucccccuuuauugauauguguggaaggcuuugucugcuguguauuggaacaccuagccuuucuucuaucugugucucucguuucugcuggguagugcaucaccauaagccagcuuaacaaaaaggcgggugauuaggcuucucuaccuguagauuaauaagaucuucccucuaaauauaucugcauguauuccaaggagaaacggucagugugucauaaaacaccagcccuggcacuuggacuuuggaucguguuuuucucuguuuuacugcaggcugugagcuuuugcuucuucauacacagggaucuagaauuacaguuuggggcugaucuacuguuuagagcuuugcaaaauaaugaucacaauauuucuuuacuccauuuuguuuugcccugugugugugugugugugugugugugugugagagagagagagagagagagagagagagagagagagacuccgcuaaaauaguauaugaauaucuuuuuugugaagcaaauguuccaacaaaacuguuuuugaaccugagucucuugguaguccugguuccucuagagcuugcuccgcagaccaggcuagccuggccucacagagaucugccugccuuugccucccaagugaagauauugaagcugugcacuaccaugccaggcacagagcugaauauacacagaaugcuccaggaaccacauugucacucaaccacgucacccuagucuccugggaaaccuaacagaguguaaaguguguuagaaccuauguagaaguaugugccagguucuucugcaaggugaauuaacaugguguuuccuuagagccgguaucagucuaaaacuuguaacaugcaucucagguaugcaaacugccucagaauggaaaaagagacuuuaugaugcguaacaagaauuuaaauuucuuuaucgaguguaguuacucucagaggagagugaguggccaggagguucccugagcaguguuuucaaggcugauuuaaauugugugaaggugggugugggguccuaacacagaugaucagccccaggaauacagcugauagaaucauuguugucuucuggaggggcccccgauugcuuuuuuaagugucaguuugaguguuugggggaccaaguccccccccccccccccccccgauucagcuuguuguuuguaguguguuuuagguuaagggagcaguauuaagaauggaaguuuuagcugagugauuuuuauuaugagaaagccucuugcacauucuuuucauacacauggaacuggggggggggaguagucucuuguguuuggaaacauuuauuuuugucuccaaaacacggagcuguccucuguaagcaacauugggagagauacaguuuaauggcaaacuaauguaauuuuaaaaugcagugacaguuuuuccuaaagccaauguguuaaaaaaaaaaaaaagaaaaagaaagaaagaaagaaagaaaaaguucccaagcuuuuggaauggaaacaaaggacagaagacaaauguaagccaggcagaaccguuuccagugcucuaaagucacgugacagaagccgccgaucccguuccuucacuucuauccacuugugacacagggacccuauuucguaaggcaagguggcuggaagccgugagucuuauaaguuguuuuguauggucagggcaggacggcaaagagcuaaaucagugagucagaacccaguggguugauuucuuucuccuucucuggcuacaaggagagacgcgugaaagaagauacuccucccccguacucuccaaaggagaguuaaaacuuugagcauuaauucuagagggagcuggugacaucuuugagagaaaggcauacacggagugagcagucaggggugauaaauggguagucagcuguucacaggcagccccgugggcccuggguugccaugggagcaugaauggcauucagcauuccugauugacuaaccuaguuuagugacaaggcuugugagcucugagcucuggccuggcagaaggcucuucagguggaccuuaccacagcacgcugcaccaugucuccagcccagcuugggccuuuguguggcuugaggccuuccucaucucucccccccuccccccagccucuuugacuccuucccucauuagugguaaggaagaagaagagaggacccccgcccccaugccuacagaguuggguuuucucaguacuuuaacuccucggugacacauuccaucccccaaggagaagccuuugaguaaaugcacccugacaggcccagcauggggcugacuuaaucaccguacucugaagaggugaggaauuggagcugaauuuuucagcauuuucaccaccucucugaaagucagcacacccuguguguuuuagguuuccagagguucguucggauuuuuuuuuuuuuuuaaauuuuuacccguuuuguguggggaguucugucagugagagugucggcuggcuuguguuuauucugcaaugcaguguucugugcguuggagcauaagugcucucucucucaaggguccuggcagcgccugacuuacacuugucuucugcccuuguuucugucccuagcacccaauagcuuggaaacuuuucacauauugguuuuaugaaaaaugucgacacguuaaacuguaucuguccagauguugauuaaauaaacucagggcagcucaagguucugaagacucaauuuugucuuuauuuguuucccuccacccccacccugccccaaaacauucuaugucccccuuucucaaccaugagucugugaucaucaauaccaaggcaaaaguagccuccuugcccuuuacagucagcaggagcaagggucaugaacuuugccuguauucuggaggcaggggggacuuguagauauccuuguagauauccuuguguucuguugacucuccaggaugcagagcauccugaugccagacugugguugcugaguguuaucccugucuguggaugucuuuaguguaugagacaugacuugugagugcagagguuacugugggaucagugacccccaaguguguaaaaucuaacaaggaucuaaagaaggauuguaugcagcucaguguuuagaaaacggaagagcaagcgccuguugaggccccucucaaggagcuuccuguaagggcuuuguggaaucagccgaaccagucaugcguucugugguuccgagauuguucugcugguagggauaauaccuggguugccgugcaccuccucgaaacgaaggaauuaagagugauuaacagcuagcacaccuuagucaucacugcccuguguaacucagcccagcgacugggagcguaaggcugcaucacuaaccaagcuuggauuuccagggcuuugugagacagucagucagucauugagccucuuuuuuuuuuuuuuuuuuuuuuuucccaaauuggaaaaugggucuuuaaagaaauucuacuuugucaggucugauugaaaacgagagagagaaagagagagagagagagagagagagagagagagagagagagagauugagaccgugcgaaagaaccagugaggcacucaggacagugcugacugaggaacaugguggccgggacagcugguccucuguaaggucauuacccuguuuccauggggcccuccugggcucuguaaucugccuugacaaggccuuugcccuacucuuaaacacccaggaggguguguuaauucagagugccguugccccccagcaaggcguuuuggauaucagugugguguuacccugaguguucaagagugugaaaaucuguugcuucucccaggggagguaguugccuuuaauuaaagcuguaguuaacuuguaauuauuuagcaguaauuacagagugagaaucaauaagaccuuugcuggcuucaggcuugggggggggauccccucauuucgaaguucauccaggcucuugacauggcuuagcagguaaggugauucaaaccagaguuugauucccagagaccagaucacacaugaugcccccauaucauagugugcgcucguggaacggucaggcucugcaaagcucugccccgcaugugugcuguaacugugugccccccccacaaugugcacaucugagugccugucuuuuccuaucuugcccagugcuuggauuaaagcagcccgcuccaucuacccugcagauggugccacugcuuugcuuugacauuuaccuugcucuagauuucaaaaggacuaagaaacaauuucuggguugugguggugguggggauguauugccuagggccuucucagcaagaacacuucagcuacuacagauuuguagugagugaacuuggagccugcccgguggguguaguugacaaaugccuguaaguacacagaaccaaaaggcaccugggaauugguugcuuagcccucugcugugguaaaagagaccacagacaauagaugagucucccagucuagaccaggacucaccagacagcaacagccacaggugucucuuccagcgacagucaguuacaguuacuggaaguuuguaagacugucccaguauuacauguauuugccaauaaaaguucaguaugaauuucuuauuacuuuuaauguauuuuaggaccagguuucucaguguagcugcccuggaauucagagaucuccuuaucccugccuccuaagugcugggauuaaaggcgugcaccaccauaccugguccucugauuaauuauccaguuccuaauuuaauacaguuuuuuuuccugugggaggcucucuaguuugagucuuaucugccugggcuuucgugguuacuucuggaguccuucucauuagugcaggcugaaaagccuuaggagaguguagacuccugacuggugcugaucuggccuuagggauacugggaccuuacacaggauuacuuugcuuaaaagauacuugagugugcaauugauguggaaauuaaaggaucaaacagccuguugguugcagggcuaccacucacagcccuggcuuuacuacucaaaggucuccucuuucugagucaggcaggggcuguucacagugggacugagcucuggauuuugggauggagagguguggagacagguucucauugugcagcccugacuagccuaugccugcagccuuccguuuugucuuucacacucuuggcaucagcaaggucuaguuguuguuguuuuuucuuugcuuuuuuuuuuuuuuuuuuuuuuuuuuuuuuuuugucuugugugcuuuuaagauacggucuguauguguagcccuggcuguccuggaacucugugucagagcacucaggccucaaacucacaaaggucaaggcuagaguguuuaaaaacaauggggagggguguucuuagcagauccccagaaguagaucugugaaguacccccaccccauguauguauaauuucuuuauuuccauuuucacuguagaucacagcggagggucuguagggagcagguuagguuacaggccuguaaccugugcaggccuggcuggggcugaaagcggcuuuuuucuggaacuagucucugguuugccuaucaauuuuaacuaguuugacaccacagccaacgauguaggauacaucauuguaaauuggauugugugguacuccugguauauagaacugacuucuagaauuggauuguucauccuuuauucgugaaaugugaaauaaguaaaaaaccaacuuuccaaguuuuuaugcuaagguauccugaguggggaaugaacuaagugguguuuuggguguuuggugaccuuuuggcuuuugucuguagacgaggauugucuugaacacauggccaucuuccuguuucugccucaguugcuggaucccuggugucaaccucuggcccagugugauuugcauuucccacccacuuuuccucucccuuuuuuauuuuggaaagugugugugugugcaugugugagcucccaugugugugucugugcaagcacacacacauacacauacacacaugcauguacucgugcccgcccaauaggccagaaaagguguuagauuuggagcuagacuugcaggugugagcugugagcugccggacaauaugcccugggcugggaacucaggcccuaugcaagagcagcaugcacccucgcugcugauuccagugcaccuucuguaauuacaccccugccgguacuucuucccggccacuucuugcuuccucccacacucguguuuguguguguacaaccaaacuuggauacugaugaccuuuuuuucuuuuguggccuuggaaaaaagcuuguacaaugaagauagaaaccugcuucgaaucagagagaaggaaagacgcaaccaagaagcucaccaggagaaggaggcauuucccgagaaggcuccccuguuuccagagccuuacaagguacuuauagugugugugagagaagacggucuggccuguuaaaauauuaaacccggugauaaaaucauuccaugcaacugaguucagucaggggucacgagugagaaaauaacuuauuccagagguuguuuuugaaaacaaaaucugaaaacucuuugaacacuguuagucagaauuaccaaaguguguggcuuucuuuuguaauguuagccuucgguaauguguguccauggccugcccucagcaggggaaguggguuaacauugcguuccauauuaaguugaggggguuuuuccucacugacguuacauaauaacuuauuaauuauucaaauaauguaaauauaaucauaucaacuuauuauugcucugcuuagauuuguugccgagucugcugucucuguuuuuuuagacugcaaaaggcgaugagcuaucaagucggauccagaccaugcugggugacuaugaggagaugaaggaguuccugagcagcaagucccacccccaccgccuggauggcucugaagacaggcccgggaagcccagauaucccuuaggucaugacagggggaacggggcugcauccagcucccuccgcacacaugucuaccaccagccuauccacacuucugcucccggaucacguccugucgguaacauuagccacaguccaaagauggcacagccaaggauggagccaagucuccacaccaaaaucuaugauggcccacgucugacucaagaccaccucagucagggacauuguuccagaaagugugaccgaagagcugaaggagacucugcucccgagaggaagcucucgcccuugaucuccucuuugccauccccggugcccccucuaucaccuguacauuccaggcugcagggaaccagcaaggcucacagcaguggcguuagcaguaaaagcugcuguguggccaagucuuccaaggacuugguggcgaaggcccaagauaaagagacuccucaugacgguuugguggcaguuaccagccuuggaucagccccuccucagccaccuugccagacauuuccacccccuccucuccccucaaaaagugcugcaaugcagcagaagcccacggcauauguccgucccauggacggucaggaucaggcucccagugagucccccgagcugaagcugccacuggaggacuauggucagcaaagcuuugagaaaccagaccuuaaagugccugccaaagccaagcucaccagacuaaggaugcccucucagucgguggagguaagugggauuucgugaggguuuuuuucucuuuuccuuuuuaauguauauuguguguaugccugcccauccuguguaugcauggccagaagagggcguuuauccucuaaaacuagacuuacacauuguuguaacuguguagaugcuaagaauuaagcccaacuccucuggaaaaucagccagcucucaaggcucuuuguuuuuucaagacaggguuucucucuguagccuuggcuguccuggaccucucacucuguauaccaggcuaaccuugaacucaccugccucugccuccugagugcugggauuaaaggcguguaccacuauuagccagcuucccuaaucuugacauuuagagaaauuacuaccaauuucaaauuuuagugauaguuugugaaccccaauucuucccccacacacaaggcuaucauuaauugucacaggaguagaagaguuuuucucuugaucuaaagaaguaugcauauaaacagacugagcaggaauuugcacacacacauacccacagugauuaaaaagauuggcaguacucacauauguacacaugugcauucuugagcacacauacaacacuuuggagggguuacuaguucauuggaagugauguuuguuggggggcgggguccucucaccuuauuguuaaguguagacaguaauuauccugaacccucccaccucggacuuccaguuagccaggccugaauuuagacuauaaauuuaauuuaauuuagaagugaaucuaaugcuuacuuaucucuguagagggaguuucuguuugcauagacauucuaauuugcucaaaggucaccaaguuacaguuuuauguaaugucuggaaaauaacauuuuaucuuauuggugucuguaugggaugggauaugugcaugccugugugcauguaugugugcauaugcauguggggaguaggggugcaaugagagaugguguguaggggugcaagucccuaccuguauugcgugugagaaagccugagguugacaccccaggccuuccuuaauccuguccaccccauguaucaaggggcagcggaucacugagccccguccucaccaucccgcuaagcugccucuagagcauuuggaucaccagggagcagcuagcuuagccccccccccccccccccaggauccaggcucugcuucuaugagcacuaaugcugcuaaccuaucuuuccaaaucccuucuuguaacacuucccuuccuggagaggaagccaggcaccaugggcucccaccuccagucccagcagaggcaggucgaucucugaaugugaggucagucuggucuacagaguuucaggccagccagggcuacgcagagacuccuguugacuuuucuuuuuuauaagaagagacuuugggccccuagcucgaagauccaaguauccccucaggaccagaaagagaagccugauccuuuuaggcacuguccgcuuugguuauuuauuauuuauuuauuuuugugugugguuuuuuuuuuuuuguuuuuguuuugucuuuuugguuuuuuuuuuuuugaaacaggguuucucuguguagcccuggcuguccuggaacucacucuguagaccagguggccucgaacucagaaauccgccugucucugccucccaaguucugggauuaaaggcgugcaacaccaccgccuggccgcuuugguuuuugaaucaacacguuggcuucauuacucaguucucaaacaaugagugcauuugagaauagcuagcauuugcuuguggucugagggagagccaaucagaagauagaacugacccacggaggcagagcuugcuggaccugugauuucagcugguggagauuucugcacacuucguucugcaccgugcagaacaaagcaggguucuuaucucaggcuuguuuuaaccccacuucagacucuuccuuuuacuaauguuuuuacguucaucagggucacuggcuggaguugguucucuucuucuuccaccguguggaauggaaaucggcuugguuugucagucuugguagcagucuccucuacccacugguccaacucauuggcccuuaaccaccuucuuaagacugaguuuaaaucugaagucuaaccagucccacugacuacacaucuaaacacuugcucaagucaggucaugaaaacuuccugggucuucauagauagguaaagugaccacacaauacaguuaaaauuguucaaggucacacagagguuccagagauuauucaacauaagccuguuuuauuagugaguauuguucucuuguaaauuccccagggaucagguaaugaauuucagcaguccgcucuguuccugccugcucauuucccggccgcucuaccacagucucccggagccagugcuggucuccacaacucagccucucaccgugucuuacuuuuaauuuucuucuccuaaaaucuguagucuguaaauuacuuucacugguacccaaagugcuuuaauauuguacuuuugaaagaaagagcagagcccuggguaugaugguucacaccuuugaucucggcggggagacagggaaaagacagagaggcagagaggccugcagaucugugagccaggacuaccuaguaagacaaggcuuucuaaucuagaagcaacauaauaaaggugcuguacucaguggugggaacucuggaugaggcuauacaugagucuggauucccacaccgaggaccccaggacaccuguccagaaggauccuuuugugucuguaggcuucucagaacaacaggauggaggugucaagacuuccggugugggaucugugaggugcauugaauuagcacacacaaagugucgggagcccccaccacugagcucacaugccagaggaugauguuauccuacuuaggacagguguuguuguuguuguuucagaguaacuaccuauuccauuuucugugccauguugcaaaagaauucacuguauacaggcucuuggauucauccauugucucuuuuuggguuuucagugcacacuggucaaaaagcugaaauauagaauauacagcuaugaauccuucugucacuaaaguaauuguuccuggcaggaaagcgcuuuuaagugagaagaauguccagacuaaguaauagaaaaguuauucucucccaaagcucacaaguucacaggcaggaaaagaauguuggggaugacugaaggaacugaaaguguagcaggaugcuggaaagcaacaaacagcacuugaacagcacuucuaaagggcugccacaaggguuggccuuagcuggauagaauacuuuaaauacagagucucuucacaaccuccgaacacaccaguacaccucaguauauauaccaguacauacuagaacacgcaagaacacacaaguaugcacuaguauauauuagaacacacuagcacacucuaacacucucuagcacacacuaguacucucuagcacacucuaguacacacgagaacacacuaguacacacuacaacacauguauacacuagaauacacuaguacacacuacaacacauguauacacuagaauacacuaguacacacuauaacacaccagagcacacuaggacacacuguaaacauguauugaagaaucauacuuucucauaaauaaaugcaauugguacauguuagucagacauuuuuuuaaguauuuaagguuuuacugacucgugaauacugauauacugcagguucuuuugaaugaccacagaauauccugugcguguggauaauuaggggaaccacgggcuugaggcagcauagccaucccagagugcuuuuucuuguucucacauuuagucccaaucuccaaauccuugaccacugugaguucuuagaauucuguuaauuauaaauuagaauucagaaguaaaaagguaauuuaucugaaggagagagcuagagauaugaccucuaauuacuuaaauaccaaggcccccuagauuaaaacauuaaacucaaaauccuucagccgaagggauuaaggagcuuagacugaguuugacaaauuaccaugggguuaaagggggaagugcaggcugaaaguaggccaugcucacucagauagcagaugaacuucaggagaaaaagccugguuuguuuguaguccgaacccugugggggaggggaggauuguacucggucagucuaaugauuucgacagcuaaaaauaucaaaaucaguguaaaaauagcuaguuauagaggucucguggagucugggcaaacagcagacuuaaaugggauuuuuuuggggggggugguggcgagggucacaaacuuauguaucucuuggcaaccaggagauagaaaugcaacuucaaaaccaaguuugcaaugagaugccagaagaauucugcuuaaaauaucuucuaaguauugauuguccugcccaaagagucuaaacccaaaccaugaauucagccaucgcaucuggcuuucucuguuccugucaacuaaaugccacacacaacagaaacagcacagggaagaguuaaaaaguuugggagagcagccaggcaggggagacucccaugcagggcgagccacugcucuagggaccagggugugagguggugugugugugugugugugugugugugugugugugugugugaagugugagcacagcuagaaggaacaggaauuucuuauucugguaccaaauguacucuggcaguuuugagaaggaacagagagugaaaaacaacaauuccagcuaacaccacccagcagacacuccaggcucaggguuaagcucucucuccucuugggcuacugcaggcagcucuguucuuugcacaaccucauuuccagcaauuuuugaguuuuaaaaaaaaauuuuuuuuucuucuauaauuuccuaauguucugucaaagcuuaaaauguguuucagaaccuugcccagcuccaaaaccuucaagucuaagacuggcuuugcaccaaagcagggccuuagccgggacuggaaggucucauuuucuaccugagcuuagaaaucuccagcuuguaaauacuggccuuuaaaacaaagccccagaaaacacaccauccaacaaagcagcucucggcccagggcugucuuaacagcuucugcucaaaaugucugugggucauuugucacuauuuuuaagcuucuauauuuagaugugcagguccauccgggacuucgccagccuaucccgagagcgagggcacucauuucugguucuucaccgaacauaguuugcaagucuuuacccaacacccauaaucuaaagagagguacucccugauucugauuucugacuccugauuuuaaauucugacucaugugggucacccugagcccuccaucugccuggcccuccucacuggcacaaccacacaacgacagugccaggcaguuggcacagcagcugccgcuggcaucagggcucuggcaaggaucagaggaaacugucacauuacagugacacugaccaaagaaggcaaguuuacauauagucagcuguuaacagcagagcuucugugcccugauucuacaaucacaugcccgccccugaggagaugugccggggcugccuggcucaauguccugugucucaaauacuugugcaguggcagagacucgaagguacgggagaaaucuccgcucuccuauccacuuuccucccccuucucccaaagaacucacaaguugaagggaaagacccaacucccuaaaguuaccuucuagccacaccccucggauaaauguauaaauauaagaaaaagaagaagguagaauuuggagugguaauuuguaaugcuggggcagaaaggcugaaguagacuuuaggaagcucagcccaaugagaucaaagauaccaugaauccuaguuagggcuuucccaagagauaggacccuucccaauuuuuacuuuuuauuuuaaauauuuuagugcuugggguugaaccuaggggccuaguugaacacacuaggccacaggaucugcucccaguuugauguuucuuuuuuuuguuuguuuuuguuuuuguuguuuugagauaggauuuuuuuuuucugugcagacucagcugaccuggagcucacucuguuggccaaccuggccuagaacucagaucuuccugccucugccuccugaguccuggcacucaguuugaauguuuuauuuuaauguguaugcuugcaugugugcuuggugcccuugaaggccagaagagggugucaggucuccugcaacuggaguuagagacauuuguaaacuuccucuggaagagcagcuggugcccuuagcuacugauccaguucuccagucccucccucccauuugauugaaaauaauuaaaaagcccagagaaagagaccauuugcuuuggcauugcccuaggagcuaguucucagugaauguauguuacacaaguauaguuccuguaaccccugcauagggcauggggaucuccaguuaagaguccaggacugccgaaguuucaggaucccugagucguccccccccccccccccaauucccuuaguauggcaaacucuccugaagaauaacauccaauuggcuuggcagcuucaccaagauauuuacuuggugaguaaauaucucaccuuacaagcaaucagaaauauuuacuuugcucauuuguccugccucccccucccccaccuccccuuacagccaccuguggcaugaaucagcccgaucccauuauauauguugcagaccgagucccuuaggaguuuaagaaguccagccccaugucgccaaguauacugucaugucacaaagauuguggaguggugaccuuuugugccuuuugugcgacuuaaguuuaccgcuccccgauuuucucugcagccgggccagccuguuggcaccugcgguaaugcaauuagggccguugaugaagggaugauuaaaacucaauucaggcucugagugaguacuaucuauaugcacagggcuaagcuucucccuuucagagcugcaagccaugcaggugagaucucuguucucaccuaguuaccuccaccuacguggucaauuugcuuuucuccuguggucucacagaaggugcgagauguuucucucuugcaccccccccacccccccacccccacccccacccccacccaagcccaugcuccaucuggcugcuugaagcuccacccuucugcuagcacccugcucagacuacuggacugcacuuaggucuuucagccucugagcguaguaagccauuuauuccuguccggcaucacuacuuucuugcucccuccauagcugaugcugugucgugggaaguagacagacacugugccuggguuuccucucagccucuugggccucuguuauuuggauugugccaccagaugacccaggaaagcacgccaagucaugucaugcuugaagucucugaacaugggacacaccauguaaccuccuuggcggcuggcuggcuuuuaccugccucuguagacaggcuccaucucuguuggaaguguguuuuccuguuucuucccagggcuccaacuucaccugaugauguuuaucgaggaggugucagcugcuagaaguagagaacgaccuggacgacauuuucuggccuuaaacauuuaaagcuucgugacgcuuccucucugugucucuccuggggcuuuugucgaaggcugugugguuaucucagaucuauuucagagucucucuccuuguacccaucccagacauuggcaauggucucuugcuuucuucuugggugccaggaucaccuucucucugugaccagcuuguuuggcagcuuaguccccugaguauuaccugcugacccgccauggcaagccuugcaucuuucucccccucacuguucuaucugaacuugagaucuguugcuuuuguuuuuguuuuucgagacaggguuucucuguguagccuuggguguucuggaacucacucuauagacccggcuggccucaaacucagaaauucgccugccucugccucccaagugcugggauuaaagacaugagccaccacugcccagcuacaccuaagaucuuuauggcugaccuugaaccuguuuucugcugccugcuuuugugugagcuuaguuuucaccccuucccugagguuuccuuuguuuggucuuauuauuuuggccagucuggccugaaacacaugggcucaggucucuauagggacccaggaaauccugccucuggugcucaccucuggccccaucuuuaccguuugccuucuuuguagugauacaggugguuugucuugagaaagccacacccugccagaccuuugcuuuccucucagagccucuccuguccucagugguaguguuccuguggugcugcccauaacccccacccccaccccccagccccacagagcuggcuucuccccgagcuuacuguccuaguaacuccucucccgaccuuaugcuaugucucuuuccccuuccuccacaaggcaagcauuuagaggucagaaguguuuaguuuguguuugcacacaagugggcacccggugaaaacugcaguuucugccacauugugcucaccaucaagauuuccuaaccuaaugugcuuuugaucuggaaucagaaugauaaucccccuaauguguuccaccugccgaaggggcgaucgcaugaugugaaauauucucuauuuaggacauuugucuggggacaugucacuaaacucauuuuagaaaugaguuugaaaaauggauuuauuaauguuagaguguuguacauuuagguucucccuguguuucuuuuuucucuuguauguauaucuagugugugcaguuuucaugaaguccagaaggaagauguucaauccucugggauuagaguuuucaggcuguugugagccaccuccguguggaugcuggcaauugaaccuggguccuggcaugaguagccggugcuagcaacugcugagccauagcuauagccccauaauuaaaaaaaaaaaaauccauacauuuucaacauucgucuuuaagucuuuuaaaggcuuucuacaugugaggguuuuugugugaugaugauugcauacauauauagagaaauaggguuucucuaccuagcagcggcuguccuggaacucaguacauaggacagacugacucagacucacagagaucacuugcuucugucuccuaagugcugggauuaaaggccugugccaucaugcccagcuuuuuuuguuuguuuuaauggcaugucaugaaaucguuaauguagacgaggauucagucuuaaguguuuuguauggaauagaucccuuuuccugggaauaagccaagcauaccguguggaacauuugcucaucuccuccagccacaaagguaucauuaguugguauccuaguaacgugggaauuguugacccugaacauggucuucuguggccugggcuucauuuucugguaagacuaccuaucuccauuauguccauucaaguugcaguugcuaaggggacacacugguguguuguucugaaccuuguugggacagguaugguacaugucaccuguagcucccagacuccucccacauaggcccugcagugacugcacuaugauuugguucauguuucuggugaucugucaggugguaugugccaaccuaccgaagucauacagaccauggcagagaccaaaguaauaauucgguaagauugcuuuauacucuguacccccgaccaagggcuuuucauacuuuggacaaauacuuugaggaaugugcuauauaaaaauugugucuguagugaguuaauaagagauucuucaacgugaauauaucuaucuucuauucucuuuccauauugccccucuguaagaaaaggagugauuagagccaacuguuggagauacagccccauuaaggagcacucucugcaacagcguacuuaauugcuaacaucuaaaaaguaguauucuccacauugaaaucuuaauuuucacuaaacauuggaaacauugaauucccaacaaaacaguaauugauuuuuuaaaaaaaugauuuauuuuauauaugugaguacacuguagcugucuuuaagacacaccagaaaagggcauccaaucacguugcagaugguugugagccaccaugugauugcugggaauugaacucagggccucuggaagagcagucggugcucuuaacugcugagccaucucuccagcccaaguaauugacucuuuaucuucuggaaaacgccaaacagcagauggcucaggugcagcagcagggacugcaguggucuuagaggcuguggcugguugaggcuguggcuguggcuauggcuguggcuguggcuguggcugagguugaggcugaggcugagggguuuaauggaaguaaagccaaagacaaggaguuggauuucugucaucagacuggcccaccugcucaagacauaaaugucacgcucucccugcccaugaaggaacuggagauuauuaacuuuguucugggcucaucccuaaaggacaggguucuaaaacucaugccacugcagaagcagacuugggcuagaacacagguucaugguuuuugucccuauugaggaccugagguccugucugucuuggugguggccacugucgucugucuaacuauccucuuagccgagcuuuccaucaucccuauguguguggaaacacuacuggggcaacaagauugucaagcccuacaccguuccaugcauggugacaggccgcugugguucuguguuggugccaagugaggugaggauccaucuugugaaaacugugucaaguucaugucuggcugugccagcaggcuuguccugaagcucauugguugaguggggcucaaaggagauuggagaaggcggccucaacauauucagcaauaaagacaacccaagggguguguguguguagggggguaggcuaucuuacuacaggagagcaaagcuauagaugauuugcaaaacaggguguuuagccuguguuuuauuucuuuugcuuauaauauuaguuccuuuuuuauuaauuggcauugauaauggcuuuuguccuaaagcagccauccucaacuugagucaugacuuuugggguugagguuugcaaaucagauauuuacaauaugauucauuauaguagcgcaauuacaguuacacaguaccaacaaaauaauucugucagaaaccucagaauagagccuacucuuuaggacagugguucucagccuaccuaauaaugcuacccuuugauauaguaccucauggugugaugaccuccaaccauaaaauuauuuuguugguaacacuacagcaguuggguacgaacauacaucccaguguuugcucuguagugucuuugcccuguagaccauaugaggcacaacgcugcuuucccugauagcuucaaacuguauaaucucagccguugagacuaaggugggagagugguugugagucugugugugauacagagugaaaacuggucccaacaacaggcaggaggggccccuugcuguccgcugccuccugcccaucccugcccuggaaugccuugccagaagccccuuucccuuuuccuuuuucuugugcaacuuauggcuugagggauguuuuuaguuacucccagccccaacuuuuaggguuuaucagcacucgccugguggacagcacccacccugcuuccuuccuccucauccccaagagcacaggauccccacccuccaaacuuauaacauuccuuccuccgcacaaguuaauucagaguagcauguugagacacagaugucuacagagaugguggcugcaugaaugagaggcugccauguggguggagggaaagggaggaaaggggggugucagggaagugccacagggccacauggcucuaauccccccauuugagaggcagacacaguagacuucugugaguuugaggacgucagagaugaauauaucuaguuccaggcuggcucaggguaccuagugggacaagacucugcccccccccccccccaaaggcccauguuucauuaaggaugacuucuguucaugcugcuucaugcagugagcuuaacugauacacggucccugauagagucagugcuggaggcuugcauggcuaucagaaucuugcucaucagcccuaguguagguaggcagaacuuacacuguaaagaugaucuugacaucugagauuuccaagacucuuccaguuugaagaaucggcucauguuuuuccuacagaagauagugaggagcauagcuugcugacuguucuaucugcauccagcagguaucaggugaggguccuaaugagaaggagauccuagcguguugaauucauguauguguuuuaagugacauggcauguugucaaggaccuuuugagugcagggaauaugaccucagcuucuaguucuccugugucucuguggcuugagagcacauggcuacucuacccuuuauagccagaacuugguuucaacagaguuguuuugaaaacacuugcucauaauauaucagaauugguuggcucaaggugaagaggaaauuguaaccugauuuguuaaaaacuaggaacaaaaauguucaugugccaacagugugaaugugcagagcacuguucaauuccgagcaggcuuuaaaaguuauaugaagaauuaggauauuucaucuacauuuuauuuuugucuuaugcaugugguaucagcacugugaggaacuuguguauaaugguaaccuaagcaaaugcuaagguaccugauagaugaaguaccaaauacugagaugacaggauuaucuugaaaucuauaauaguagguuaauuuuuuuucuauuuguguucgugaaguuugagaggugucuagcugaguaguaaaaacacuugcuuaccauucagaaggccuuagcuuuuuccaguucagaagggagaagagagagaggagaggagggaaggagauugcuacuggguuuuuaucucacuggugacuccugcguugcacauaaugccacaggacugaauuuauucuaaaugaaguuguuacccagaugagguuuccauuucugacacauccucagguguaauugugcaggcacacuaguuauuagguggaguuuaauaggaacucccacugguggcuuaaauauuuugcuuaugugccaccagcugccguaaaacuacugaucucucucccguccuugcaagcagaacgaagaguaagccauuuugcacucuuggcuuuuuuucuuugggagcaagggaggaggagcaggugcccaucggggaagcuguacguuuuuaaaacuuugcacauggugcuuugcaugagucgaaauugccaaagggacagauguugccaauuucaaauguacagggggaaggcaaacauugcuaagcaacgcugugcuugagagagcguuuuuuaggagcagagccaggggaguugggccugggagcacuccugcuccuuauggcuccauaccagggaagacacgcaaaguucuucccugucugggcggccauugcagccaccgcaccagggagagcgaccuaguggcauugagcagggcuggcagggcagguguugagacaggaaagcuuuuuuugccauguaggaaggcauuaagacaugcucagggagguaagugccccauugccccacaguaaguauccagcgagaaguucaggugggaaaggccagaaaguagagggagagaguggaguaaggaagaugacggccugaacagaaaggugugucuuucuuaggaaucaaucaguacagccugguuuagucugcugcgugcaugacuguaacaagguaaauaagucuuccagcuacaggcaugcugugccucccucccgggucuuucccuuuguauacaucuguuagguaacagacaguuuuccuuuugugugugugugugugugccacaggagacuugggcgaccucuugagauuuguguggcuguuuguuuggacuuuggagccugccugccuuauaaaauaguaaucguggagcuagagaaugagugcauaaacgaaugcagacuuguuuuuauuguguguuuugaaacauugucucacuauguagcucagguaggccuuggacauucuccugccucugccuccugaguguugggauugcaggauuauaccccaugccugacuauguguacauugguaguauauuuuauggcaauuaaaagcauaaguauaugauaauucccauagcuaaugauuuuuuccuguauccuucaaacacugggccuaaauuaaugaaugauaugagaaaugaagcuauuauuuaaaagccaaaauauaaauugucccuuuaaagauuugguuuuucaauugguauguugaauuagagucuagucuagaaggugugugugugggugaguggcuugggggagggggaaugugugugcugguggcuacaaaacccggaaguauuagaucccccuggagcaggagucgcaggcauuugugagccucuuuauaugggugcuggacuagaacucagguccucugcaauaacaugaauuuuguguuuguuuguuugcuuguuuuguuuuauuuguuauguuuuucgagaaaggguuucucuguguagucuuggcugucccggaacucacugguagaccaggcugaccucaagcucagagacccaucuucuucuuucugccugcuugcuaaaugcuaggauuagaggccugugccaucaccuggcacuuuucuuauuuuuaaauacaguguuccagccauuucauucuaucuacaaaagucugucaagaaacuaucuucauccccaaaccaacacagaggugacuggcagaggucagcuaaaaggcuuaccugcucagcggccaagcugcagucacacaccugcauuguucuaguguguaugagagagcauucuaguuggcaacauggugcuuguuuuauaauaaaucaauuaaagaaguucauucagguugaaaggaccuggagcagggcuuuuaacuguuacucccaguucggccugcagcugcugguguaauuaccaugucaggaaggaaguggguacacccaggacuguguccccaugggcugugugccagguggaauugucaggaaggcugcuguugggucagguauaucugaggggcaguucauuuucgaaaggagguuauuuuuguuucacuguggcuaugguuucuugauuccuucucuggauucugcauugagcacaugcucacgucaugacaucuacuugagcuugguuuuaaacaggccauacaagagcgauaauauauuuuaaauuuaggucuaaauaauuuauaaccaccuaugauauccuucuagccuuuguugauccgguguuggggauugaacccagggacuuguauguguuaagcaggugcaugauaauaaauaaguuauacuuucccaaggugauuuuccuauucuguggaaauuuauuuguuuauuguuaaauauguggaaaucaaagccaucucuuccugccgccuccuguguugguuacagugcccauguccccaugggaguuugaagcuguuugcuuccucguaggaguugugccucuggcugcaggacuugccuugccuuuucuuucuguuccccauuggauugcaguuuuuguuuuugaagauaaucaaugccaagagacacuacaccaagccuggaggagacacugggauuaccugagcaaaccgaggauaaaaccuuccguccuuccugacaaggcguggauuaaauggcuuaucucauuccucugacuucagugucuuuagccucuccacccuggaaagccccacccacccccuuuuguucagaugccuauguagccuccacuuaugcuuaaguauuuuuuuuuaaaggucuaaguacccaugaaacauggaauuagacaugguuuccaaacccugugugccacuuacaaaaugugacagacacagacacguagagaguaggcuuaagucucuguaaacauccugcgauugacagaguaauguaguacuguuguuucagaucagaacuguauguuaauaugaucugugagagacaggaauagcagagagacagaaugugcauguguguguguccacgggcaagaucuagguaucuaggcagugcagagcacacagggacaucauauaccaccaugguuucauacucuuccgugcucauaaucugcacauuggauguuuacacgcaagguaaccccucucacauucacacaucugaaggcauuuuaauaaguagcauuggauuuuggaagaagaaauagaucagauacuaugaaagaaaaaaauagaucaggccauaugaaagaucucucucucuuucucucucucucucucucaucaugguaguguaauaucuagacuuucuuguggugguuuggcuuuuccccuaucauuuagugccuacuuagccaugccaucauucaugguuuauacccacaauggucuucacaaggccucacaugaucuuucaucaagaguccaaaauguuucaaaggcacaccccacugggaauuucagcuccccauacuauguggcuaauggcaauaguucacagucagaaagcuggaaacugggguuagacauguucucuugucuuguuagagcguuuguucaucuggguacucuacuucugagugaacuuuaacacgacuccuuuuuuaaaaguuuuauuuauuucauuuauaugaauacacuguagcugucuucagacacaccagaagagagcaucagaucccauuacagaugguugugagccaccaugcgguugcugggaauugaacucaggaccuguggaagagcagccagugcucuuaauugcugaaccaucucuccagcccuauuaacacaaauucuuaacuguuaugcaagaagguaauugacuagcuggaauacaugugucaacacuaaguccuuucauuuagcuucaaugcaccuugcaaaugcuacccaaaaccuaggaccuccagauccucggagcaaggaaugagaaggcagaauuaagggauagcagcauuuuugcuacuucuucauaucauuggcauauuuguguccagugaauguuuauaacucuacacagagagaauagcuauucauuaauuuguucuuauuuaugaauccagauugcaagaaacagagccccaaguuucagaauuacccauguuucugucuauucuaaguggaauuucuagaguggaauaauuuaguuaauucagauugugauuuuuuaaaaaaauaauuuaucugauuuacagaaaugaacuaucuuaaugacacuaauuaaaacaaguggcuucagucgugugaucaaaugacugccagcgaaacugucuaaugacucuuauugguucuugaaagcuaccuccuguaagagucuguucguuuuaggucccccccacccuuuucaucuuuagugcauuuuugcuuuaguugguuaaagaaggacauuguaguuuguggcuggaaguguauuuuaaacagguagggaugaaggcuucauuucccacaugaaguggagugccggugcacacaggcugugggaauucucucucugugucuagcucguaggaucuuugaagcuccugucucaccaaggugucuacauccuuccuuuacugcugcuugggggagacccuugcaguuuggagcugaaagugguuggauucugggagaggagaaacuuccagagaagagcagcaguguuugucuccuccucuuucagauucucccacaggagaguugcuuagucuuagguuuuuuugggaaguaaauaacagugggugaccugcaggcuccucuuuauuuugucuuacuauguaguuagauggcccaggccucaugggagcugggacugcagacaugagccauaucauauugauaauccuuaaugcuucuuccuccugcaaaccaaaucagagaugucuucuaauuaaguguuaacaucugucccaagcaugccguuggguaccaagaagagguguuuagggacaugaaggaucacuuguggccuuugucccuuccuacaagugaucaggucugcagauguagcucagcaguugaauuugugcuuuaguaugcuucagucccuagugcucaaaaaccggaaggacagccacuaacaacagaaaagggaaacaucacacuauuuagagccaaugagauggcucacggaguagggcccugccacgcccgaaucggauucaauccuagggacccacaucauggaaggaacacgaauuauccccuaacuagauaauacacacuuugauaugcaugcacccauacaugcacaugcguacacaugugcacaaauaaauguaagguuaaaaauaagaaaauacaaaaaaaaaaaaaaacccugucuacuuuuuggaacauguuuagggagagaaaucauguuuaaaaaucuucaguaaaaauguuauuuuuuuauuuuuuguuugcuucauuuuuguuuuguuuuuugagauaggguuucucuguauagcccgguuuauucuggaacuccuucugccucccgaguucugggauuuaaggugugcaccacaagaccauguaaaaauguuuuuaaaaugaugugugugucucugcaccuaaauagugucauuggaggccagagauggggucaugaaccauucaguguaggcagauuuggguauugagagcagugagcaguuuuaacugcuuuuccaucuuucuagccccauuaauaaucuuuaaggggagauuuuaguaguugacugcaacuuacauagcauccuuucaauuaaagaaacuguauaggguguguuagcaauuauuuuuuauuaauugucgcaaacaccucuguguguguguguuuacuguuuuaauuugauguauaagaacucacauacaucuauccagaagccuuaaaacaaaaccucuuaaaguuugagguauggaaguugacauaaagacagucgcccaggggcuauggagcuguaaugccugugccuuuaugugucuuccggcagaagcaggcauacccagguggugcgagccuguucuucgagccaaguuagcuguguaggugauuuacugcuuauucacagaauacaauuaucauuaugugaagcuuuguucagucaggccuuuuggucuccauuucuaaucuuucccagaaguggugauuaugguguccucuuagaauugcaugcauuuuuauguauggcacagacuuuagcaugcacugucuuauuucucccuuaucauugccauuccaggcuuuguguauuucauauauguacguuuaauacuuauuuauaauguguuugguaugugugcuccagcauauaucucuguguguguguguguguguguguguguguguguguguguguguaugaacacguuugagauagagcaagcauugccauggggcaaugucagggaacaaccucuucuuuguuuaaccuaggguuccccacacaccccucuucuguguaugccaggcuagccagcccccaggcuuccagugauuucccugucuuugccccugccucaagagcaguagaaauuacagacacgugugugucacugugucagccuuuguuaacuucuuauugaaggcucggcugagguccuuacucaagaggcaagcuccuagguccccuguucaguacuuaagugcuaagaagagaaagagagguaaaagcugccuuucucucaagcaaagcuuuuccaguuucauuagggagugagaacgggcuacagcucugaugccuaugccuccggccacucugggaaguuggcugcugaucaggaggcggccucucagugcccugcuuuguggugagugggccgugcugagugcugcugaggacagacucuggaagggcagacacagggcagacacagaggaaggguaaccaagggccaggagcuggaagcaggugguggacuuugagacguuuuuaauuucagucuaauguuuauggguucuguuuuguuuguuugguuugguuuugucuucuguuuuuauguucuauguuuguuuguuuauuuuuaagauuuauuuauuuuauauaugugagucagugcucuuaaccgcugagccaucucuccagcccauguuuguuuuaucacuaaauuuaagggcuuaggauuuaaaaguuuaaaaaaaauaaggagauagggaguugaaaucuuuccuguuguucuuuguagaggaaacugauggguuuuuuuuguguauucuuagcuguauuuuaagcauagaagucaacucuaaacacacaaucuagucucugacauuuucuuuuuuuuuuuuuuuuuccuuuuuaaauauuuuuaauuagguauuuuccucauuuacauuuccaaugcuaucccaaaagucccccauacccuaccccccccaccccacccccgcccucuccccuacccacccacucccacuuuuuggcccuggcguuucccuguacuagggcauauaaaguuugcaugaccgaugggccccggccuagucucacaagagacagcuauaucaggguccuuucagcaaaaucuugcugguguaugcaauggugucugcguuuggaggcuguuuaugggauggaucccuggguggggcagucucuagaugauccauccuuucaucucagcuccaaacugugucucuguaacuccuuccauggguguuuuguuccccgacauuuucacuuauguaaaugcugacaaaguaccuuguuuauuuuucuucuguuucauauaguuaggguauuaccucaucaguaauguccuguauauaauguuauauauucucaucggcauaucuggcuuccuuguccuuuaucauaguugcauaauauuuuuuucaugugacccuguaguugcauuagucaguguuuguaguaucccguuguuugcaggcugaccggaaaccuugugaacauguuguuuggaacacaucagugcuauaguucaaaggaugcauguaacuggaauugguagcuugggcuggcuggggagaugggguauaaaaugcuuacuguguaaguaaccaugaaguugagaccaccagaacucauguaaaagcuggauagcacaugccuggaacugcagcuuagggguggaggaagcugaggcaggggcugcuuuuacuagucagccgagucaaacaagaagcaccagguguagugagagacccugucucaaacuauaguggagagccacccacagcagccccuggcuuccauaugcucaugcucacccacacagccuagcuuccuccucucuugcccuccaacccuguuuaugggagccauugccuaagugaugcugggguuuugaacucucuauucuucugccagugaaccuugcaucugucccauagcuuaggucuuguaaguccuuugacuuguucccaauccagucuaaggagaaauggggauagauggauccuguaucccggcauauacuuguuucuauauuguuagcccacguguuuauuucuaauucagacagcuuacagcaccuaacgugcuuucaaaucccucagauuugaaauuuauuuuaauuuuuuuauuauguguauuugugcaucgugugugggcuuggugugccuccucagagaggccagaagagggcuggcuccccuggaacucgacuuagagauaugguaugggcucugggauucccacccagguccucuacaacagcaguaugugcuuuugaucguugagucaugucuccaaccucagaaaaaaaaugagaauucuaaguuugaagaacagaaagaccagcaaauaucauugguggcguuuauguagcagguaguguguggucaggugggcgugggggaggcugcccucugcuuuccuagaacuuguaaccuagaagaagcagaggacauaagccgaugguguauagacaagucuagggcagcucuacagggcacaguacagaugucucugcaggagucaugcuauagcaaguggucucaggaacaccauggcaaagggggagugacaggguguguuuucaccagccccugagcaggaggagggagggggaagugaguuucagguaggcggacaguggacacucaacuuacugagcagcagacagcaauccaggaggcaguguauuugaagaaaaguaucuaugaaaauugguuagaauuucuuuugaaacagucacauuacugaauaauacuuagauaauucauguuggcacugggcauuuccuuacuuuaauucccauggcagcguacuuggcuucacccugcuccugugaggugguuagauuugguaacauucuccuuuaucaccauaaggaaauagucccaaagcugaauuguauccaagaucacagagcaggucccgagcgaagccacccuagagaagcuggggccuggcuuccucuucaguauucagccgcuguggcccccauuuccugguaagccuucacgaaaguagcacuguuguaaaagcucuuuucuguugaaacuugaugccaauuggacuugggcaggagccaccagucucgguggccaggugucucuucuauuccguucuuuugguaguaaaccaaaguccagaaguccuuugcaagggacuccucguuuuggugucaguaccgagugucauuuucaggccaugcucaguguuuugcucuggaacuugugggugaccagcagugagagauggugacgugugaaguccuuaacaaaugguuuuggucaugcuuagaacagaaaccugcucaaauauuggugugucugucucaggcacagacaaucuuugggaagccaguuugacaggaucuugaggcuuggcucagccgauucagagcuuuugugugaccuuggguaacacaccgguuuuagucugcauguuguaaaaaaugccuaccgcggugguugauaggagaaugaaacuggauaccguauuccacucccugagaccuuuuaauugaucuaaaggcuuucggaguggggauguccacuucggggucgauggguggggaaauggaacaacuuucuccacgccaagcuagugaucgauuucauaaucaaugguaucaauuugaggaaauaauaguauguaaauaguuuaaugcagugccaaguauaaccugaguucaagaaguaacugcuguguucucugcuuuguugaguagggcuauuguucuaguguuauuuacggccaugcccguggggaugucacccugcuggaacguuggucucuguauagaaucccaugugaugugaggucagcagugguguccugccuacuccaggaacacagacaccaaguguggaggcaggacugaguucuggaaguuagucagcaagccuucacacacagccuuaggagaccccuguuccucuugaccaauuaucgauuuugcuguuguguuuuauuaucuaguguuccggaaggaauccuuuuauauaaucuuuuuauaagucucagcuucuuagccaggacugauaguucauucuggggcaagaguuccgugaagagccuggcuaugcucagcaggagugacaguagguaaccugagccccacaggggccauguggcuuuuaagagcaagguuagcacacaggucuuuucagcaucuccuuccuuguuggaaguuuccuuucaguggcagaggcaagcucggaggugcugggcugcacuuuauugcucaaggcagccuguccucugacuugcuagagauuuguacucucagaugaaaccuugguagacuugggcugcacugacuuauguagccucuuuuuuguuuuacuuuuauuacuuaggggagaguguugugugugugugugugugugcacaaguacauauguaugguguauguguuugugcacaugaauauguaugguugugugaucauauguauguaugguguacgggugugugcacaugcauauauguauggugugugugugugugugugugugugugugugugugugugcagaaggcacagcacaaauguagaggccagaggaaaacugggacuuaguucucuccuaccauguggcuugugggcacugaucuccucaucaggcuugguaccccuacccaccgagccaccucaccagcccuuucuuuuaaauauagguucagagguagccgggcguacauagauggguugggaagaaaggggaugaacacuaauuaacaccgcagcaguucaugguuuguguggaugggcaugugggcaggagaaggcaccaggaagcaugcucuaccucagaaggagaauaaggggauaugaggauugcuuccagcacuuugugagcaugaagucaccucuaaggaggguacaccuuggaggguggcuucccaccccauucugauuuuagaaagaauuggccaggucuugguugguccucaucagagcugcuuuaccguuuccuuuuacugcugguugcuucucagccauuccccagcuuagucccaggcaggagguggaacuauaguucauagacauuggagucccaggcucuguuguuucauguauauguacuacugauggugacuuuuuuuucuaacaauagaugucagucauuggaaccaguuuaguuuauguccagguggaaacagccuuuuuucuccccuuuuccuuuuucuccuuuuguuucugauacuuaugcuaaacugugacacuaucauuugguccuaugacaucuuuuaguggauuuuggaaacuaaaagccgguuugacaugcagaaugucugaggaaggacuggauagacggcaguggaguaggaauguccuuacccuucucggguuguaccucagaacuuccuggcugugccuuauaaacacaaagcuccaaaaauguccccaagucauuagggugacauuagugaacacauaccgaagugguguuuccauuuugacauggcuguuagauuuguucacagccugguacagaaguuauacucuguuuucuuuugauuguuccuaaguuggaaugacuaggaugauggcuaacaaacccucgguuaugaauuagcaaccaguguuauaggaugggacacucuuuuuuuuuuuuuuuaagauuuauuuauuuauuuuaugcauaugagaauaccaccauugcucucuucagacacaccagaagagggcaucagaccccaucagaugguugugagccaucugaugugauugcuggggauugaauucgggaccucuggaagagcagucagugcucuaaaccacugagccaucucuccagcccaggaugggacacucuucaguuguagcugagcccaggggcaaggcugcuuuguaccagccugcugucugcgggggcaucaccugauguggcacuugcuguguguacaagggcucgcgagugacacagaacagaagcaguagauuugugggcugcauucuggguuccuaaugucggaaaauuuuagauuuaaccuuuuugcuuuucuuugugcuuaaaaguacauagacuauaaaguggaguuuucucagagcugucuaucacagcaagucuagcugccacauuugaugcuuucuauuuaguuagagaucaggucgcucuaucucaucacucuaucucaucacuuccuguguuguccuuuaugcacauaaaggccagagagauggcucagcauuuaugaguucauacuguuccuccagaaaaggagacccaaguuugauucauaaauaacacccuaccaugcagcuuacaacuuaguguguaacuccaacaccggggauugugacauccuccucuggcuucugggaauaccuacacaaaucccacuauauacacccacagagagagagagagagagacagagacagagacagagagacagagagacagagagaaagagacagagacagagagagacagagagagagagaggcagggagagacagagagacacacacagaaagacagacagaaaucuucaaauguagaaaugaguuguagaggacuguauugaagagcuguuuccugccugggcuuggccccuguggguccucuaguacucagacauuguccaugucuaugcucuucaguggauguuacuguaagguagccagcuucauuauuugauuacucuugccuccauuucuguucaucuggugcucucuuagauuuaucaauaccuuucuccccucuccccucauccucuccuucccccuucuuuguugagaugggggccuuacacaagccaggcaagugcuuuacuaccgagcuauguccccaacccucacuuuucucccgggcuaccuucagcgaaguggucacauucagaugggugcgggugagccucuagccuccugcucuuccccaagaugaagucgguguuuccuucuuccacggugcaguuccuagcacucugguaguaaaggguagguccugaagccaaccuacccaggcugauccacaccuguaccuagcacugcaaucaguuccacuggcaagguuuuuaaauuaagcucucucucguuuccuuugcagcagccguacuccaaugaaguccauugcguugaagagauucugaaggugaguuaguuaauaauuccuguuguggguuugaagaugaaguuuacaaacugcaagaauuuggaucacuguuuugugaauuucucaaguucugcuuuuccauaaagacuggggagugugcucauuucccagagaagaaacacccucaaugggcauagcauggacaguaccaggcuuuaaauagccccgugucugugaucuugcuuuuuauacagugaaaccuggugccuguggccucugagaucuugaaacuugaaaucaguggaggaggcauaugcacuugacugcagaagcaggcagaugaucaggcaagcugugguuacucagugagauccugucacacacacacacauacacacacacacacacacacacacacgaaugaauggucauauuuagacuuccacauuggguuguuuuugucugcuugcuuauuugaguugugugaacaccuuguugcugcaaauguaucacuauauacauuaccucccgcauauuaccccacacauuacccgccugcugcuguaaauguauaguuauguucaguaccuauuguaaauguggccacacauauauuacccucccacucugguuuucuugcacuagacaaaacaaaacaaaacaaaaaaaccaacaaaacuaaauuaaucuuaguagauucuucucuugaccugugagcuugcuuuucucaagagaagugaacaaauugucaugugacccuccugaaauucagagcuuaauuuauuauuuguauucaguaauuguaauaaccuggggugggggugcuuuccuguguguuccuuauuuucucuauggcucaugauuugcuccuguuggucuuagugauauucuuguagcuuuuauuguaaaauuugguucuuuugaaguucuggaucuaugaauuuuaaucuccugcucacuguuuuucucuaaaaauuuacuccaaauuuuacuuuaauuccaccuucguugcaaaaauacuaaccaaugcugcugcuugccgccauuaaauaagaaagaauauugguuauauuuuucauuugugauuuuucuuuauuuuaaaaacaaacaaagccgggugugguggcgcacaccuuuaaucccagcacuugggaggcagaggcaggcggauuucugaguucaaggccagccuggucuacagagugaguuccaggacagccagggcuauacagauaaauccugucucgaaaaaccaaaccaaccaaccaaacaaaagcagcauuucagcaaauguuugaacaguacuuguguuauuuuugucuguauucuguauucuucuuucuguaguuagggcuuugcagucacuccugagagacaugcuuugaaccacugaaagcugauguucucgccaauuagcaaggaggguggauuuuuaacuaauuacccugcucaggcuuugguauuaacuuuuacacuucaugauucugaaaauuuccacacaucaucucaaaauccuaaauuacuuauuauagaugaccacuuagcauccucucugaaacagggugugaucuauucuguauuuaccccggagugacugagagagagggugggccuccgugggcauuguguugugggguuugauguguagaagacaaaccauauccuuugcucaggggugauagcauuauaguacugugccauagucaaaacagccacccucccguccuccucacccggugcugugcuggggacgcucagacugaaaugugagcaaagucacauuugggagucagaagugagaaguggaagaagggaucccggacagaagcggcaggggccucuucacagagaaagcccaacucugccuuucuguuucacauucuccagccuuggcucucucaugguggaagcagggcucugagcuagcaggcgaccccugugcucuauaugaggggcugauccagagccuucuggucaagguucccauucuuuugugucaacaaucuugagcuuaccaggagcccaccgaccuuuccuaagagugacguuucuuucggcccuagauggugcuugcuaucgguucucauugguucucuagggccauguuuacuguggaaguaaagaggaaguggugugcucccuggggcucucagccagagcugccuguugaguggcaugguucuaggggcccauggagguguacacgcuggcaucaccugagccugugcuuauaaagggaggcccaucccccgccaauccauucuuggugccuguugccagccuguaggugaucugcuggaugcagucuccugaauaucucuagggccucucagcagguagcagugucuuggaguagagucgcugcaggugacagaacaauagagcugucuaagucggaaggcuccaccccaggugaucucaugcucaguggcagcaaggucaaagccagccuacucaaggcugggggaggcuacagccuccuguggugacggcuuuauguggaguagcauuauugcuugcuuauuugguauucagauaggguucuagguuguuggaugucagugaagaugauagagccauugcuuccgugaggauggggguaggagggguaaaguugccaugugaaugacuggcgagugaacaaaguagagaaccgaggaauagugugggggagaaggccacagguugaucguguuucuagaggaauggcuaguaccauggugguucuugugugugugugugcgugugugugugugugugugugugaugagcaaggagugagagaagacuacagcuguaaggccuagcaguguugggcuaaagagguaccauacaguccaucuuugccgguaggauggcuuggagucaaccguucuuuucuuuguaauggccccaauuccccuaaugucuaagguguuagggaagugagaagguucuuuugacuaccacaguaccgccuagagucugaaaguguugcuauacuucccagcugugggcuuucucaggacguagccuuaggucuuggguaguguuaggaauaauugguaguuaaaagucacaaauuccacaguuguaauaaguuaucaggaaacauuccgacuaagcaaaagagcaggaguucacuggcacacgaucagagugccuggaagucuccauuucaguuaaacauggugcagcugcuaagguuggugcugcuugcucuaacucagcaaacacucaggaggcugaagcaggagaguucuacacaccaugcuuaucucauaguguuugugugcacgugugcaugcgcggaugugcguguuccugauaacacacuuaaucaacaauaccuaauuucccuuuagugcuuaagcaaagcagcauaaacgccacgauugugcugaagagcauauuaauucguaagugcuagaaaccuugccuuuaacucagauauuagggagugauuaaaguuuugcuucuuaagccugcugacggugccgccagggaagggucaaaucuauuagaacccucccgcacggagcaaguggccucaaugacuuguuuguuuaagucaaacaggaaaguucuuccuuugaacuucaauaauucccggaagugcaguggagaagcugcaaggcagaaugugccgagaugguggccuuucuuggcucagccuucccagagcugccugcugcuccagggcccagagcugcaccagccugccggcaccugcuggagcgcuugcgcacugugguguucuugcugggccgcucaguuucuaaucuaauguucuuaagcugcuuuuugucaguuuuuuuguucagcuuccaguguauguagccugguacaaguguugcccacuuuguuagcugaaaacuaauucggauguuccacuuacgucugccuucccuuccuuuuccaaaucucuuucuaggaaaugacccacucguggccaccgccucugacagccauacacacacccaguacagccgagccguccagauuuccuuuccccacaaagguaauuccauaaaucaugacgggcacaauaucugcagcagagggaaguguaggggugugcugcagauacuguauccaccacagugagaagaauacaggguggugcucugguccuugcucucuggaaucuuuggagacugggcuaaaggucacgguuuagcuuuuaugguacuuccuaaggcuuuuagauaauuuauucuccuucucauguuagcaagaaugucuuagaauuguauagggcuuuauaucuucaaaacuucuucgugcaguuucucauuugagggcuuauucucuagauaacaaaccuuguuuaucuuauacuuccuaaaaguuuuuugaagugaacagcuaacgcuaauguugguuuccauaacaaccaaacagacuacuggcacguuuucagugauguauugaaacagccauccuuuucuuuuuggcuuauacuuuaaaaguauuuuucuguuuuguuuuagugggcaugggugugccaccugcaugcaugacuuugugugugcagcacgugugugcuguggccacagaggccagaagagguugauggcucucuugguacugguguauuagaugguugugagcugucacgguggugcugggaaucgaacucugcucuguggaagagccaugaucccucuuaacacugagccaucucuccauucccaguguauacuuuuaaauaaccuuuagcauggauguauccugagcgcaggggucugucuggcucgaugccauauucauauucauaucucuaggaaccuuuuccaugguacuguuuugaggagcucuaccuacaaaccccaaacuuaccucguuuauuccacccuguuuauaacaaugcuuuuaaaccaagaagauccauuaagaacaugcagagaucagauuggucaguguccaucuugucuguucggugugauugaugauuuacuggagaauugggcuguuugggccuugcagaggccuauagaaggcgggcgguuugcuucauguagcaggcgaugaguagacuguucccuucgccaucgcuacauuguuuucuccaaauuugaguuuuaggaaaauaucguuugcuauaaagccuacaugguguugcuguaagccacacagcucuaauggugaacguuucuucuuaggacccucugcacgucaguccugcaacccagagccaaagugagugaccgucugccguuuguguugcuuacagagcaaauccgugcuccuuuguugugguuuguuuuuguuuuuaauaauuguuaaccgauuuggcaaugauacacucaaaacaaaacucagagccacucuguagguacuguaugaaguaagcuguuuucauuaaauucuaaacaaauacaaguuaauauuacauggcacauuuacuuuucuuuuucuuuacaucaugguacauuuuuuuuaaaagauuuauuuauuuguuuuauguauaugaguacacuguugcugucuucagacauaccagaugagggcaucggauuccaguacugaugguugugagacaccauugugguugcugggaauuaaacucagaaccuuuguaagaucacucaguguuccugacuacugagucucuccaucccuuaugucuuguuuuucaagacaggguuucucuggcuguccuagaacucacuuuguagaccgggcuggccucuaacucagauccaccgccucuguuggguuaaauuagugugccaccacaccuagcugacacaugguuagguugacuacaacucuuggaacuguauuuaaggauaaaguauuuagcccaucagugguuuccuauagcaugaaaccugacucacucagcugucugaugcugggagacugggcugacaguucucugguuaauggaaugcuccugugaauaauaauguggccucuguggcuaucagaugagcacaaccuccauugcagaguguagccugcaggccaguuucaucucaacucaacacaggcgagagccacuuuagaagagggagcuuccauugaaaaaauugcccugccaaacuggaccugggggguggguaggggugggggugggggacggacuguagucauuuuuuugacugcuaauugaugugggaggacccagcucacugccagcaugccaccugugggcuggugguccuggugccauaagaaggcacguggagcaagcugugaggagcacggucaguaaggugugcucuucuauggucucugcucugcuccaguuccugccuugagcuccugccuugacuuccuugagugaugugacccuuuucacucuaagcugccuuugaucuuguuguuuuaaucacagccauaaggacacuaacuaagacagcauuccugucuuaguaugauagcaagucaguuuauauuugguuuguuuuuuuguuccuguuguuuuguuucguuguuuuucuguuuuuuuguuuuguuuuguuuuugagacaguguugcucuguguagcucugccuggccuggaacuuguuuuguaugccaggcugaccuugaacucacagagccaccuccuucugucuccugauugcuuggauuaaagcugugugcuaccacugcccagugaauucuuuuuaaaaaacaaaaaacaaacaaaaaaagccaaaaacaacaacaaaaaaccccacugagccuauuguaccaaaacauauguuucggaauaucugagugucuugcuucuuaugucugugcuuacacaacauggcugccuaaagauuuccaguuugcauuggccaggauaccuucccaucagaguccuugugaguuccuggcuccuguagcucuagaugucuaggccacaggacagcaauuugaaaaugugagagcugcugccaccaugaggagagaguggguaacugcaagugcaggaggguuuaagaguugcucacccagcauugguccccugacccugagucccuguguggacacaucaacggccuuuuggguacaucaggacaguccuuggggaugaaucucucuguggcaccccugugccaugucccugaacuuucuguccuggauccaguucugugaaccuggcucucaccccucuuccuccuggccacugcacacccaaccucaccugggacacacccggggcuuaacuucuccaucucuccacaugggcucuucuucuuccugaaggucuuccugcauccacacugcuggcagaaucccacacguucucucugauuuagccauuguaagcuuuccacaauuggccuuuggucauuacugguagacuauggaaucugaggacaguaaauuuacauaauugccccauguacuuaccucagacugcccuagguaguggauguuugugggccuguuucgugucccucggguaccuuugcagaaugggacagaugucuguauacauauuggucucuaccaggcugucuauaaauagcagcugagugaaugaauuauacuaugggagauugacuccaggagggacagaugugggagagaggcuauacaaaacaaacaaggaugaaccugagagucaagccagguaugauuugagaacagaauugucauggagcacccuuaggggccuaaucaauugucaucaagaacagaaacugucccccgcaguuaugagcaggaugggugccaccucaagcucugugcucuggcuaaaaguccguugcugccguuucguuuccaaagaagcauucucuuucaugagaccauaaaugcugccccaagcggcugcaucaagugcagauugguacugcaccuggguaacggggaaaagcugacaagagggaacucagcgagugguugguuguauaaaacuguuuccaugcuguucugacugcaucuuccuccccacagaacaauaugacacgccuucaaaaacccaccccaauccccagcaaggaaccucguaaguaaaaaagggaaaagcaaccuuuguguauuaaaauuugauaauauagcguucaaauuuccccuguaagcccauuauguagacugacccccccucgcucucagcuaaugaguucauaaaagggcuucacuguagagggcagaaaugacccccaguaauggccaguugaagguuuaugcacugucguagaaugugcugaagggguuuucuggaaagaaaggucuugagcuauuauuuaugcauugaccauggaacuccaaaggcuuuggcuuuuaaaauuucaaacuuaaguuacccuagcucuggaaauuaaauuugggggggacuaugggaugagauuuucugccguuuuccagccuauuuauugucaguauccuguucuguuaccugcuguucuuauccaggucaggcaccucuaaauguauucagggauuuuggaacacuuagucuucacguuauagguguuucacucagcauuuugacccaguuuguuucuuuaaaguaaccaauuacuauuuccuuacugcuugccccauaaguaauugcuagggacagagggaggcuagcucuucaggcuuuccccuccgugucugugaugucaccagcacacugacugguuagauggauguugcagaugcucucagaguucagaauccugccccaggaggccagaggagggcguuagaucccuuggaacuggaauuauaggugguugugaaccaccauguaggugcugggacuugaacucuggaaaagaacuguugaacucuugguccucuggaaaagccaccagugauuuuuauaugcugagccaucucccuagccuguuucuucuaauuuuuuuuuuuuuuuuaaagcucaguuuuuguuccuuguuuugggggaagggcauugccagaaagugucagaugaguuggagagauuauuacaugucacugucggagugauucucauuucaacacagaaagaugaacaguagccuaagaguuuugauagaugaauuuucaucuucuggaggauugugaguugcuuguuuuugucuuguugguuuuaaaauauguuuuauuuuugcuugaucagaauguauuuuaaugugcucuugguggaugagggguuuuccuuguugauguccucuauuugaaaaagacaaaacucaccaaacuuauguuacuuuguuuuccccauuucuguuuuguguugucaugcuuucuggcaguuuugagucacuagcuuagacuauggaagagcuacuagggccaaggaccaaucucaugggagucugugauacugccccaggcuaccagacucugucugcacuugucugugaugguuggagauugaggaucaagccuuggucauggaaaaaggucugggccauugcauuguggcauccaggagggcucacuuggaucagcagaguaguggcaucuagggcaggaaguggcugugucugcuugagagugaaggaugaaggguuggccggcuccugcaccccagagcggccugagagggagugggcagaagucacuucucugucuguccaucacacgcagcccugguguccuagcaacaccauagcaaccauggaaaucacagaagcucuauugcaaauguacuuacaccuccugaugggguccucuaaauaaagacuacucauucauuuuugaaacgaguaccuguaaugguugucagggcaagguaaaaucaggacugaggcagucagguggguguagaaagaauguaccagaagugcugcagaggcuggguggauggaugauaaugcgugauucaguagugcuauggggcaguucucaacaguugguauggucucaucacaguugguaugguagguuucuuagugcugguggcuaauuugaucggugacaaccuugagucucacuaauguagcugagcucuuugaguggcagggugguugucuaacauuccuggaacaccagaauuguucauuacaggguuauuuaugcuuugguuugaaagggaagggcaaccuacgucuugcuaucucuagaaguaacuaauucuagagugaggcccuacucccuaccucugggucuguaguaccucuugcuucugucuagucuugggugcaggagcaagcacagugguagccgaauauaugugagugcaugucuucugcucucauuauuuuccagcgaacccugucugcugguaacugauuagcuaugguaucaguacuguuugccuccaaguucaggggaggguauguuuguuuagugacacuuggcuguugguccacuuccuucccaagauguggaucugcaguugccggacaacacagaauguuuccuaagguuaucgugucccgugcaguuccuugccgggagcgcagggcacuuggcagccccucaggagggcugcaggacucaggccuuugacgcuguagagcuuuaguguacaucucagggaugagcggguggaagggugcauacuucauuuauuuagucauugcuucaaccccugcuuugagugaaggaauaagagacagggacuucaggguuaccugggguugagugaguuaaugguagccagggguagucuaauuuuuuuaaggggggguuaaauaacaugcguguucauguugucuauugcuaguguguaaguaccuugguacagagggagagccaggagucguuuaccgugcuaccguuccaaucagcacagcguacucacaugccagcuggaaggcuccggccuucccuggccuucuggcacuuccuuguuuucuguuuuguuccucugcggugcaggggaugaugccuaguucaaugcuccuggaaacuuacaccccaaaucccgacaugucccuuagaaugagcuccagugacacagcucccuguaccuggugaucuaaaucguauuagucuaagaaaauucacuuuucucuccugccauuuuauagaaaguugacuccuguaguuugacgguguuuuacuugugcauucauugacagcucuacccgagaaauguguugcuggcagauagcuaucauuaaaaagagaugccgccccaguacuucagggacacacaccugugcugucuuguauccagugacggauuuuugugguugccaacacugcuuagugugcuacagcuggcuucuuugaaaggggacaccuuguuuucaagugacugagaaccuggggucauguuauauacaaugaccucauuacauagagaaggaaguguuuuaauguguuucuggaagaaaacuagagauuggcagugaggggcaguaaggagcccucccccugcucccuccugcucuaccguugcccuucccucuccauucccuccucccuccccuccucuuccucccucuuccccuccccuucuccccucuuccagccuuuaguggcucaggaucugauuuuuuuuuuuuuuguuuauguuaugaucucuccuuucuuuauaauucguagccucccaggguuucccacaggcaauuguggcccauauuucucugcccuauuuccaaaaggaacccgaagccagaauuaguggguacuguaaagcuaucaucacaggauuggagacaauuuggucugcauuaugagacugggucuccaagaggaaaaugcaccaaugccaggccuugcucaggaggcagaggcaggcaggucucagugaguucaaggcuagccuucucugcauagugagaaucugccuaaagaccagacaagcacacaaagcaacaaaugucugacugcauuauaaacuuggggaauuccagcugugucuuggaguucagcuuccuccacuccccaugcccccaagucauuuggaggauggaauaacguacuguguuuucauaccacguuugaacacguagggugugaacacaugagugcaucaacacaccuaccaccaucaggacuuagcaguuacagauaacuaaaaugguacuaaaaauuaagccagaggugagcuuauuuuaaauaguuuuggggaucuuguuuguugagaauuugggcagagauuucauugaaaaagccauuacuagguaauggcaggaaaguaagacucgugucugugucuucacacuguaauguuggggugacucauggaaacaagccugccagggccugccuguccagaggagcgggaugcagucacacaggcgccagggcugucuguaacgucuaugugcaagcugacuucaccgcugcuggaaauguggucacacuaugugcaguccagaguuuucuggaacauugucucucucccuuuuaacagcauaggucuuugggguuuuguuguuuguuugauuguuuguuuugagaaucauauauaguucaggcuggccuggaacuuuuagccgagguuagccuucugauccucuugcccgugccuccaucccccucccccccccaccuuccgcccaccccagugccaggguuucaggcaugugccaccaugccuguuuuauucuuguuuucauuugucugucugucugucugucugucuaucuacuguguauaugaauggugauaguguggcggcuagaaggcagccagcagaaguuuguuccccugcuuagcaaguaccugcuuuuacccucugaaccauuucacuggccuuugucuaagagcggauuucucucuguggaccagacuggcuuugaacucagauccuccugccucaaccuccugaguaugaauuguaggugugugcuaccauaccuggccuggcuaacuuuuuauuucuuuaucaaagacauuuuacgcacagauuuagaccaugggaaacaaauacuguguaaguggcaccagugucuuacuuaagugauugaugccaucugaccuuuucugauggaauucuuacauuuuaauuuuguagaaagcccucaggccccucuucagcagcccuccuucacagaacgcuguucccacuucaaaacgucuugaguagcuuuuaacccagcagacagguuuuauuauugauucucauccuguacaacuuccagagggggaaaucuguagaacuuucacaguaccugcuauuuccaaaugagcucagaacuucucgugugccuggacuugccuuaggagagcauaucuguagugguuagguguuauucaguagcaagggggacacauaaaugggauuuugauucucugcugugaguggacgcauagugggauuacaggaucauuuguggugcagaaaaguuaaggaagauuaguuuuguacaaaagaacccgguaacuaagagacggugucccuuuauaugguuuuuuugggggguuguuaauacugaauacacuuuaccaacuuugccagacuucccccacccugcagugaguuauaccuugugauuuucuuuuucuccuaagguaauaccuuuuaucucuugcugugucuccuugccaacccaaccuagcagcaaacucguugagugacuuuuuuuuuuuuuuuuuuuuuaauaccauucugauggccaacggccagguuccaugacugagggcuguguuuuuuagucaugguaaaauaggaauuuggucuccacuugguaaacauugagaaagaucuucaacuuauaaguagcuaaaauuuucuguucucucucucucuccuuccuucccuuucucucuccuccucucucccucucucucucccccuccuuuaguuuuguuuuguugguuuugguuuuuugagacaggguuucucugucuggcucugaccucaaacucagcgaucccccugucauccugagagcugggguuaaagacgugagcuaccaugcccaguuucaguuuucauuuuuuaagaaaauguacacaggaagaauauuagcacaugugcugguggaauaacuccuugguggcguugccacaucacauggucauugguaaaaagcccaguuuaguuccauaauuuaucuccuccauggcuuccuccuucagagagcuacaguaagaaucgcugcucaaaauuccugagaagguauuuugagaucuacugaaugaauuuuaauuugcuuccuggaacauaagcaauauacaaauagauuuuuuucuguuuuacuuacaacuuugugugugugugugugugugugugugugugugugugugugugugugugugugguagcuaugcuuguaaaauuggagagaaaugugagagacaguacugggcacccuugauauuugggaucucugaauggaagggugggugcuuagauuugagaaaacaugcgcaguuuagaaacauuuuuaauauuagaauuuguccuaagccagggugccuagaaauguguaguaauauaaauuuugggaaacaagcugacucccccccccccccaccaaaauuaguagugcuaagauugagauauacuuucaacagggccauuugcauuauuagcuaaacuaaugggaacuuugagcauugauuuguauccaagugaccaaaagagaaugauuuuuuggggaggaggucugugacaaauuaauaguguccuuuggacaaaaaugaagagggugucuugaggguuuuugugcuugcuuagcacuguuuaaauaccucacuuccauugggaagcagcauagauaaccgcuuauuuuacuucugucagagacaauggaagaaggugguucagggucauuugcugucuguguauucccuucgucuucguguguguguguguguguguguguguguguguguucguguguguucguguucucccugaauaggagucgagggcagguaaaaaaugccugccagaaguugucugcaggguuccaaacaggugggauguucggcuuuugcauugucaggagcuuggcugaccugauuuuaauguuaagugguaaagcuugaguuucuagaaaauugauuuaagcaagcaaacaaaacaagucuccagcuuaucccugccuccccccagcccccauguucuauaaaguuauucguucuccuaaauucuccacugucugucgcuucuccccagcaugcuggaggacgaccugcagcucagcgacagugaagacagcgacacggagcaagugaguguugaauucaaugcccuaaaugcccgagaccguuccugcugcuguccuaaccuguguuucucuucuuucugggaacuucgcacccuucccgugaauguccaggccacagagaagccuccauccccaccugcaccucccagguacugucugcacacuucucccccaaacuauugccuucccucgcaaacuacaggagaauauaguccuacuaagugccuuguggcuucuugaaaggcacaguguguggucacagcugagaagugccauuuuuguuauuuuaaaacuugacucagcuggugggagguugcuaaccccauucaagaggaagagcguuguuuuggaugccuuugagcugugggguuggagaagugacuugguagagugauugccuuccaagugcaaggacucaaccuucagcaagagacucagguguggcugcacagucugggaguguggagacaauggauuccauggccuggccuaguccaugagagaccuugucucagaaccagagguugguugaagaaaacacuaaauaucagaauaucaacuucuggccuccacaugcauuaccaaguacacauguauguguucacacucaugcucacacacacacacacacacacacacacacacacacacacacacacacacugagccaggugugaugaggcauaccugugauccuugaaccugggagauugaggcaggaagacaaacagaauguuagaggccagaugggguauggagcuuaaauaagcuuuaaacauagucgaccauuggcuuugugugaccagcguuugaaaagucagaggaaggagcccaugcacuugugaaacuaauagaaaagcuugucuucaaaaucaguaacauugaauucuuccaguaauuguucccaguguuucugauugguggguucuuuuggagggggagagauaugggggcaggggucaaaccacugcuuucaccuucaaauggaagagcaaugcucuguguuugggauguagaaacuaauuuuuaaaacuauuuuaugguauuuuccccugguacuagcuauacugauuuaagauagaaaauaccugucucucauagucaaagacacaaucuauuuugcggccuugcaagguugucagugacuuagaaagaaggucaccaggaagaauuugaguguccaggagcgaugacgugguuaaacuaaaggaaaaauuaauuauauagcccacggauuccuauaugcagccugucuauuuauacccaaucuuguuaaaauuucguguggcucacacugacucauaaaauaugacaaacuggucauaggugaaagcugagggaaaggcacaugugacagcagaggccaggaauaagcuagaaucaagaguguucuucacagcugacuccgugcugguggaguccugugcagaggggagguccugggacagugcuugcucuaaaaugacuccagccagugacuuuuauuacauucuuauucaccauuuaauaaggguuuauuuugugacuauuguagguagguuugggaauguugaaagauuucugcuuuagcucacagcauuuagggcaguuuuuaagauugcauaugguuugaaacuauaucuagccucaauccgugugucuucuccuuggauuagaguuaauggccuaccuguaaaaccuggacuugcucauggccugcuagucguaaagaguuguauaauucuaccaggaaccgugacugggugcuuugagcucacccggccaacgaacacccucugucaucaguaacuguuggcugcuguauaguuagguccuauguagagaauacgggggaggguuguacgcuagcuuuucucuuaugcuuucucuuuugaguuaucaucuagaguaaucuucaugagccacauaguaaaaauuuuagcuuuugugggauacuuaagccuccgcuguaacugcuuaccucuacuacugcagcaggaaagcaaccaugaugcccugugagacagcugcaggcagugauaauaaaacuuuauuuaggaaaucgggcaggcugucuaggcccugcuuuugauauuaggcgccuggcauagguauuguuuguaguucaaugcaucuuucaggaggggaauaccaaaaacuccuuccucuccugcuauuacccagugaccacgauucuaacaccuuggccucuguccacuggaugacaagccugcauugaugccuuuacugucugggagcagauagauaggcauaagugauaggggaagaaauccugugugcguaauccucuaacgguacccuccuguugcuuugcagcgcuccgcagacacuucccgagcccguggccucagcacauuccaguaguggggagucagagagcagcgagucagacaguuccucagacucugagagugagagcagcuccagcgacagcgaggaggaggaagagaacgagccccuggagacccgggcucccgagguacugcgcccccuccagaacgcuaugcaagauggcaggaugcugguucgucagagcugcccacugagccguccgcucauuggugcuuucccauggugcacuucgcuguucagcaagugcuuagcgguggagacgcugggcaggccugaccggggccucucucuggcuccacaugcugcucccuaagaguguuugcaaccuuguuuucuuuugaaaagggaaacuuguuuuuaguuaagcagguuaccguaucagugucgaugauagcucuuugaagauucaggauucuguagcugaaaugagagaaacaggagcuagaaacaagucgguucugucuuugaagcacuaaaagccauggaguacauugagagauagcaaagugcacugccgggguuguccugcccuggguagaguagggacagccaagucugucaucacccacacuuuggaaauagcauaaagauaagcaaacagugagacuggaagucccgaggaugacauuucccuguuccagaaacugucugagccgcauggaacucugagcucguggaaagggaaggaagcgcuacuuauuuuuuuuuuaacuggaugaggccauccuucauagagaacacugccucuguauuuaagauuagaauacaaggagaugaagcuuuuuaauuagacagcauuacauuuuucuguguucaacucugugagauggcugugugccucggggagaagggugggguaagggcaucagaaauugaagaaaugugcgcugugccuuuaggugugacggugccugacugggcaguccuuuguuuuuguucuuuugagguuuuuacaguucacagaccugggucagcauuaacugcguuggaggagccuuauuagagcuuaaaaagcaacucuguggcucucucugcugucuuguggcaccggcuguacggaagugaguuuucuggaucugaggagcgaggcugauggacgugccguguagcucagcuuuaugacgcucacuguaugucacaccguuuuuguguggcguguuuucauuuuguuuuuguuauuuuugguacugggacaugaaugcagggcaugcuuagcaugcacucugccacugaacuguguucuuaacccauguuucaucuuuaguaagaaaaacgugcaugcuuguaagaugacucauagaaaauguuccauaaaagaguggagucuagccaggcauugguggcgcacaccccuaaucccaguacuugggagacagaggcagguggauuuucugaguuugaggccagccuggucuacagagugaguuccaggauagccagggcuacauagagaaacccugucucaaaaaaacagaaaaacaaacaaacaaacaaaaccaccaaaaauaagaaaacagaguggaguccagugagauaaaguuuagcacauuugacugaguaauugaaaugcauucauuguuggccuguagcuucuuagggcccuggcucagucccugcugccacugagaacacaaagaaaauagaaaaugauuuagucuuaucuuuauuguaaagaaauauagucuuauugaucaaaaaguaacugguaugaggcucacuguguuagcacagcacaugcuuauacaccuaacccucugcacgcugaggccggggaccagccugggcuaggaguauacccuagccaaaaggcccaaccaaacaaaaguccagcaagguagacuggaacuuccucggugcagaauaacuguccugaucucacccugcuuuuuaaaaucucugcagugaagaaauugugucucugugaggucaggggccucugcugagugaggcucgcucuugggaauaucuugucuuaguuuauuuucauuuucccuuagguauuuaacuaguuuuuguccccuuuagaaugaauaucuccccuuuuaguugaggguugcaugaguuauauaaucaucugcauaguggcuuuauuuuauuuuuaacuaguaaugaaucaguuuauugcuuuugagucaaggucuugcuauguagcucuagacagucagggacuuacucuguagaguagacuggaagggaucugucugccuugagggcugggauuaaaggcauguaccaucaugccuuauuuauugugugugcacgugugugcgagugugugcgugugucacaguugacaacuuuggggcugauugucaccaugggcuucaccaagcucaggucaucaggguugugcaguuuaaguacauauauaucauguaugccuuaauauuuuaggucuuaagccauaauuuguuguaaauccacacacauuugugacucagagguuaggagagcuaagggagcgcccagacacacugggaacacuuccacgcuuucgucccgucccuuccagucuucaguaucuaggcgucaucaccuuugagaggagcaggggaugcauggagaaaaggaagagagaaaugaaaagccaaacuuggauccuaaucugucuagcacugcuguuugaacauuacaaucucauuuaauuaaaucucucccuuuuaaaaaaagauuuuauucauuuuauuugcaugaguagcugucuucagacacaccagaagagggcaucaaaucccaugauaggugauagugagccaccaugugguugcuggggauugagcucaggaccucuggaagagcagucugugcucuuaacuguugagccaucacucuaguccuuaucugaaucucauauucaaacauuuuaacccaaguaauugcuagccuuaagcuuccaugucauuuggauacagaggaagagcugugucuuguuuucucauuguuggguguaugauucggguuugccgugaaagugggccacuggacauucaggagcacaguggagguaaacaugugcuauuucugaaaccaggacauuccuuuagggacuccacacugaauauuucacggugcuacucuguuuuagggauagaguuucaggagugccuuuuccauuggguucacacauugaauccauucuaagcagccugccagugauaggcuggagcuguaaccacaggaguuggccugucccagccuuuccuaaggaauggugggaacgguuugguuccaagggugcucuaccuacaauuuuaucagauggcuuaacuacugugcuaccaaagccuugagucuaagcaggcaauuguguagcaaggaggcaucauccuccccuaugaauuuccacacucuagcaaccaccuugcugucuuagaauauuggauguguguauguauuuucaugugauaaaacgcucugcacaucaugguucuugccuucucccuguccugcugaaauuccaaacagacaccuggaggagaugcucugucuaggaggcuggacaacagagauaucaccaaaggaggaaaccagccccuuuucugucuaaaacaacccuauuuauuggcuucuucucaccauucuuugggguguuacuccauugugaacacaggaagccuaggcuauuuuacuuccuacugaccaaaauguacccacaccauauguuuucuaucaggauugcauauuuuugcagggucggauuauucguugcauuuuacuguggaaaguugucagcuaucuccccuuugaaaacucgaauccagaggcugaggauaaaguuuagugauagagcgcuggcccacaaggcaccagguucuucguuuguuccccagcaaguuaagacacacuuaagaagauucuauuagguccagcuuacuggaccagucuuacccgugaucuaucuaaucgauuuaaaucucauguccacuauuagcucucugguuagcucucuggugcucuguguauaugauuuaacuauucuugccagugauaggcuauagcugugaccacagguauugaccuaucucagccuaucucaguaugggaucuucuaagaaguagaaccaucacucacccagucaacauuggucucuuuccauaugauauauaucucauaagaauauuucagcacuuaggagcauauucugcagaaaaccugacuuggguucucagcacccauaccaggcugcucacaaguacauguaacgccugcucuagccucucacuagguaucugugcucauauccacccccaauauaauugcuauacauuauauaaguguauaaaacccggaauauagaaaacuaaaaugaauaauacaaguuacaaaauaaaauacuaaaaacuuuaaaaaagcaaagaauguccaaguaucuuaugccacagcaugcaccaacuguuggagucacaggauguuugaggaacaccaguugaucuucccuaucaguuaucuggguaacugacugucugcugugggucuucucuuugugcuuagggacaugugcgaccucagaccugauugccuuugguaaaagaugcugugucugucugaaagaauagagggacuagucccugcuaaugugauuucacucugucuuacuguguagguuuuggaagucagaucugucuguguuauauugauaauccugucacauauaaauuacuguuuuuaaguaaauaaagagaaaucaaauguuagaaguggggccuuaucaguugaagaaaaguacuguuuuucuuccucguuuccuuauuauaacuguaccauaauuaaccaucagggcaaaaagacaagccacaaaggccucucagcaguugccaauuacuuauuagugacuaucuaucaggcagaguucucauugcaaagcuguucaagcucauuugaugaagugcugcagaaucugauuuguaaucugaaggagaugacuggaggguaaauucuuaggcucaaaaugaccacuugucuuggggacaguccuguauagacugcuaacauggccacuuguccugggaaugguccugucuaguuaggcugcuaacccaguucaucaaccccgguugguuaauacuuuucuguuucugcuucuagcccgagccuccgacgacaaacaaauggcagcuggacaacugguugaccaaagucaaccaacccucagugccccuggauggccgggggagcacagagucuccacaauggcgccaggaaaguaagggugucgcugagggcagcagugaccagcagcauccugauuccaaagacccucucccaaagagcuccagcaagacucuccggggucccucugaggggccccagccugggaagaggggcuguccgaaaucccccgcucaacaggaacccccaccucggcaaaccgugggcagcaaacaacccaggaaacccgccaagggcuccggccaggcagagccccaggccagcucgcaggcagagagugaaguaggaccccuucccuacggcucaaaggagcagacuuccaaagacagacccaaggugaagacgaaaggcaggccgcgugccgugggcagucgggagccuaagccagaggucccugcgcccacgccucaggcagccgugcccagaccgaagccgccugugcccacccccagugagaagaggaagcacaagagcuccacggcccccuccaaggcgcccucagccccccagccuccgaaggacagugcuggggacaggaacccagaacacucugcucuugucuccuugacucagagccaggguccaucccacagcagcaggggcagcaguggcagcgucaggacuaguggcugccgacaggcugugauugcccaaggggacggcuguaaagacaagcuccuguugccuuugagagacaccaaauugcucucgccgcucagggacuccccaccaccgacaagcuugguggugaagauaacccuagaccuccucacgaggauuccccagccucuggggaaggggagccgccccaggaaagcagaagacaagcagcugucagcagggaagaagcaggacucggagaccaagagcugugacagcuccagcagagugaccaagaagagaaaggugggugcagagacaggugguggcauggucuuugaguuguggaagcuugcucggcugagcugccucuccagggcuccucuuggccugcauccgcuucccguccugcgggcugucacucggucaggguaucuugagucacugaaggcauccucuuucugcacaccccacagcgaggcgcagcauuuuuauguuuuaugcagauaugguuuacucccugggugcuguauuuuauccuggagguuccacaaagcggcgcgauaguguucugagucgucugaagaacugugcacucaugaccacgugcuuugucccuagaacuagcuaaggccucuggggagagguagcgaagugagcugguggggcaagcucggcaugcugaguggccgucacgauguguuuucaaggcaaaccuucaugaugcggcuuucuauuaggcaugaugccaguuuggacagugucgucuuccuuuauucaaagggguugagcucuggauuccuggauuuuuuuuuucuuuuucuccuuugugaugaggaaagacucccgaggguacuacuacuaccugcccagaucuuuucacagagcacaagggccaucucugcuuugcugaccaggagaggauuuagcacucuugaguauaagaaagauaucuuacgaggaagaucauguugaagcccagauaguuuauccaccugguuaaagauauaguggcucuagcaaaccgaaaagggagauuucccccagaaccugguugcuggagacuugaauaucugugacccuaucuacugugcccaggugcuuacugaagaaggggcugucugagcugagagaggacagguuuccgugucaggacucuagcugggggacuaggggugagacaguauaugucuauggagcucuguucuggaucgugccacguagaccaggcugaccccaaacucacagagaucaucugccucugccuccuaguuaaaggccugcaccaccaugcuagaaagauuuuuuuuuaaagcuuuuagaaugagauggaauagugugugugucuguccguccauccgccugccuuucugucugagacaaaacuuuaucggaacuugugguggacaugcuuagggaaaagugucccugcagcuacugccugagcgggaccccuacucgugcuggccagcagccagucuccugucacccccaucugagcugccuuggcuuauuuuauguugucucuggcacuaauccucugcuuuucugccucccacuggaguggaaggaaauacagugugcagugugcuuccuuguugguuagagagucgucagccuucacgggaagggggacguggggggcgucuaggcuagcuccuccgcauucugagaucagagccuguccucuggaagcugagccucuaaggcauggcucaagggaagcauucuguucagagcuuggggaaguuuccucaucuccaccgugcacgugaguucugcaaagugucugguccaagagaaacugaggauaagugccaacuguggugccuguuagccaagcagacugugcccuggccucaugugcucugugcacugcagcagguaccugucagggucuacccggcuccucucagcucuccucgccccaccccaucccaaucuucuccaguuugugggcuucccuaccccagcuucugauuccgauagaaccugccauuugggccaugugcuccaauagaucuugguccccucuccuuuuuucucccccccccccccccccgcccccguccccguccccuccauggcugauucagucugcugaccauguuaaguucgcuacuuccucucccuacucuggacccuuccugaugccucuggcuguacucucccucauaugucuacaacaggaagcuucccuucaaccacaccuuggaguggccauguccucauucuagacacaaagcucuagcaaacagccaagagauccagcuugguagucagccuuuccguggugaagaugggacccauugguuuaaauccuggcuguauuaaaguccuggcaagccugaucacuuuacagucaccuagggacagcgggaggaggacucuggcauuuuuuaaauuccuaggcaguccuaauuccguggggcuggaagcagugaagcgcagccuucccaggucccugcucaggccgagcuggugcuuggguagaggagcuguggaggugugcugugagugugguuagcaucgguuaggcauucauugcuucagguguggcauuaguuagcugcuugacugagacgcuuccagagagcuauggauccaaagcuaguuguuguauauuuaccccucagcagagucauguguucucugaugcgguaggccuugcguauguuacccguuuugugcgucaaugccaugacggccauucaggccucccuggcuccuccgguggggucaccugguuugcaaaccugggaaccuggcucuaggccagagguuuaccaacuuuuuuuuguuuguuuguuuguuugcuuuguuuuuaagauuuauuuauaugaguauacuguagcuguuuccagacacaccagaagacuguaucagaucccuuuacaggugguuaugagucacuacgugguuaaugggaauugaacucaggaccuuuggaagaguagccagugcucuuaaccaucucucuagccccugacuuguuuuuuaacaugggaauauuucuccccaaugccuucaucuucagcgugaaagcuagaaaacgccuuuucaagauguauuuagagacauuuaagaguuuuccaaaacguucacgugagugcaguuuauucaaagccccccacccccacccccagcuucucacuguccuacuaugaaguuuaacaaaaguucucaaaggauucaagucuuugaaggcauuuuagccuuaaauacucaagagaauaucagagauuacacaguaggguggggauggaguucagugucugagcaccucucuagcauuauuaaggcucuggaugcaauccucagccaugcaaaaccaaaagccagccagcaagagagagccgauggugcagacagcugugaugaagaggggacuggguuaggaacaguugaugaggcacaguggagaaacugagguaaauacacaagccgagcagugcuucuuuaaacugcuguguacaagugccagcauccacucccuuuucuuaagauuaugacucuuuagggacacagucggagacuucagcucugugugugcgcgcuuuuguaaaugauccauuccagccauuugacugaagauugcccccuucaaauaaguggcuaucuuuugauauuauuguguuggugucaccaguguagcccaggcuagccugagagccaagauccuucugucucagcuucccaagugcugggauuauagucaugugcacagauaaguagacagucuuccuuauuucaauaaauaacgggaugaagaguucacugaagucuuccucucuaacagaauugguuuauuaaucaagaaaccgucauguuuggugggggaaucaguguauuuauauacuccuucauuuauguagacagaggaagggaagucauuguaugacaggaagaggcguguuuuuuuauuauuauuauuauuagauuauuuuacuuauuuacauuccaaaaguugccccccuucccugaguucuucauaucucuccucgcuccccacaaagguguguuucuuaugcuugucaugguuaguucugccuuugacccauccaguuaacuaacgccuucuagguuucuuuucagcuugguuguuuauugacuggggagcauggcaggugugugugguaguggaggcugccuuaaguccgccaguuccugugugucugccucaacugccaaggaguaaagccgauccacuuuccuguccuguggggcuuucuuccuguccucucaggcagucuucugguggaggugugaagcgugaucuugggcugagaggucauaucuuuucuucuuacugaaccuccuucagagaguugcccugaucuucccauucccccccagcuucacacgcaggcaagcuacguugcuuccugugugagcagagccguagcagucccuccaagccaccgcccuuugcugagacccagaaaggcucaggaaucuuauggcuguucaguaguggggugugugugugugugcauuccucccagucuugugguuuguccugucucucgugucucuauagacacgugucucuggggaagacucuugagaggcacaaaggcagagcucucagaucuguauacugacccuggcgauuacacucaccagggcgguuacaacacucuuccuggcuccaugccuccauugcccaauguggccacccuggugcccaugcacucccguucuccaggaucucagguucuuccucacacccucucgucuccaccacuauagccaagcucccaggaucuuucccaccagucagaaccuguggacccuaagugaaacgcuaccuuucgcuuuccuuugaacuacaggccacccucaugaugagcaagguaggcaccaggccaccgccuacccucauggugggccccgcacccgcauggccccaucucuuccuuuuauggccuugcucuuuugcucuguucuuguagguggcgcagcacuuggcaugucacccaacaggcugagaaaagccagcaguucacugagacuugcuggcagccguuggucuuuccugggugguuggauggggaugcaggcaccacuggaaacucacauuccuuaaaguggguugacuggcagagagauuugcuuuuuccccucuuaaagaacauugcagucaccuaacuuuuguguggcuuccagaccuagaaaaagcuaaagaccccaugccuccuauaaauguggcaggccuuacucaugggguucaaguucaauuacugacccccacuaccgugcacccccacuuuggcccucucuuuagucuagccucucaggguuccugugcagccccgccccaggagugacugccacacagcuuggcugcuguucuuaguuucuguaccacuuggagauuccacugcugcucuggggaagccugggccuuuccacauagacaacauggggggggggcacggugcacagggggcccacacuggagccuuuugcuuacuuaguuuaaugccauccuuuccguuaggcguuauguaccaugcuucuguguucugaagugcccauagaaagcuaaugauuuaggagagagguaaauguuagcauuuccagacgcuggccucgaagcugaugucuccugugugcuggcuccccuugugcuugugauuggcagagacuccagcagcagucagacaaagauggacucuuguuuccccucuggacuugggugucugcacaguuugucuuuggccuucccuguuuuccgugaccugccuggaaaauaccuuccacuuagauauaugcuuuaucguuucauguguaaauuaaucucaguggcauacucgagcaaauucuuauuuucuccagcuguggacuucccacuuugaugaaaugcuugucggggcgucuguguggccuucagguggcacaagaaggugcuaaacagauaagagauuuacugucccuguggcagaguucuguuuuagccuuucauuagacaagagaugugugggcguuaccguuguucugagcagagagccaggcaugucguaaugacaccacaguccugcgcucaccaguaccucucacauccagauuuuucuguuagggacugcugcuggcucaugcucacuguggaauggaacuuggggcauuuuaguuguggcuuuaggccuuuuuuaccucacacacuagauuuugcuauuagauuuaucacuguacauuuucugugucuuccauuaauaaugguuacaguuucaucuaaucuguguguauguguagccagacucagacaaaccucacauguuucaucuuaugaaaaacccagaguuuaaaaugcaagacaagcugggugugguggcacacaccuuuaaaucagcuccugggaggcagaggccggcggauuucugugaguuugagacuagcuuggucuacacagcgaguuccaggacagccuuuguguguguguguguguguguguguguguguguguguguguguguguuauguauaagauaaaguaggagagggauuauaugcacacacacauacauaggugacaauguaggagaagggguauauugguaucaucuauauuauacauauaugaaugacauaggacuauauacauauacauauagcagugacaguaggagagggauacuauggaagaaaagaggaggaaccagcaagcgucaaggguggccaagagaagguaaugaccaaaguauauuaugugcaagcugacagugccguuagaagcccguaacuguguaagggugcucucuccaccuguuucacacgcaguccauacaccugagggcgcaccucuaguggucauuuagguccaguugcugugucugcacuucccucucccuuugucugugugaugguucuaacaugucugugucuaucaccugcaauaacagggugacccagaaaaagagcacaguaacaagagacacaaacuggauaagucgcagacugcgucaucuucaucuucccauacagaaucuuccagaacaaagugaguauccaggcgggaacagccugcgacaguagcgggcuccauuugcacuagaaacagaguguggugcuuacucucggccaugggugugcucauuucuuugguggcaaacugagauuuaucaaaaacauuuucacagagcauuuccuaaacaccuagaauuacuguuuauguacauaaaaucaggguuggggauaacuccaggccuugcacaugcuaagcaagguacccugcauccagcugccucuuaccuucaauucuuuuuuuuuuuuuucauagaagaaaauaagaaucaguuguauagguuaguggcagagcacuuuaggauguagcgauccuagcuuuaaucccuaguuauuuagauggacagacauacagacauagaagaaaagcacuaucagccauuuucuucuucucuuccuccucuuccuccuucuccccuuccucugccuccuccuccucugccucuucguccuccuucuacuuuauuuuauuauauuuuauuuauaggcguauaagaaagacgggcaaaauugauucaaagcccugggguagcuacuggguuuugcuuggacucaggacagcucagguucgaugcucugucuuuagagggacagagguaugcccaaagagaucaguaguguugagguagcauggcuauaaagaauaccugucauucaugcucucuggcuuauucacaaaaucgccucacaagagacucggcaaaacacaaguauaucccaaguacuuuuuuuuugugggggagccugcugucaguuaugucacccugccacgugagggugacaguugagcuuaccuguuuguugggguaagguacggauaggugagcagggaaaaccagugauagaaaaugguuaaaaucuuccagguuggugcaaacccuacaguuugguacuauucaacagcuggauuuaauaaagcuugagaaagucccuaaauccauaauuacaugcuucauggcacugcagucuuuugugccggugaccaccuuguccauuauaaacauacucagaugugaugugucuucagcuuccauuguuguuucacaccagagcgcccagguccuccucagagaacucaagaaaggaaaugcugccuccagcaucggcguccucagucuccucuuccucauccucccagaagccaagcagaccugcacagaagaggccaaggccagacgaagacacguguagccaggaaccccccagaagugccagcagcacaaagagcagcucuacagacccucccgcucccaagcacagaaaaguacaggccaggggcucugaacacaagguaagcaaagccgcuagugggucucucacacaugcuggcaaccuugaguuguuuuuaacuaccacaaaugacgugauagcuacucuuauagaaaauaugggguggcguucuuuguuuuuuucucgaagugaucagagauggaaaaaucacagcagcuuucauagugaguuucuuucagauguugagauguuggcuuaagaguucaguucuuugccucuuuaaucucagauacuucaauuauccaucuuaacaggacagaaaucagccacccuggcuuccaguuacacuggugcgugccgggggcagagagaccacucugcuugugcguuauuuguucuuccucacguagaugccaggccacagagccagguacagccauagcuagggaagugguggccaagcuaagcuagccugugguuuuacuguuacccaccaugcacucuccuggcuuuggaaggcuggcgcugcuagguccguggccucucgagcuaacagcacaaucuguggcuguguuuuauagggaucuucuggggaugcugcgaaugcugcaaauccuuuuccagugccuucuuugccgaaugguaacgcuaaaccagggaagccacaggugaagucugacagguaagcccagugucuaccccaccccccaccucccccuuuccuuuucaccucuucuccugccccagguagucauucuuauuuguaugacccacaccugccuuuucuuccuuguuuugcagacaacaagcugacuuucacaugaaggaggcuaaaaagcugaagugcaaagcagagacaauggucagucucuguucccaugcccuugauuaaacagugguuuccauucugcccucaccauacguaugggaauggggcagcggguagaguaaugucugugggugcucugggauucggcagcagggaggaagacuggggaccuggggaccugggaugggguagacaggaagagggugccugcuguuagccacuuguaagcaggauaaucagaugucuuaugacugaggucugaggcguucuguguucuuuggcuccuauaguucagucugaucguguacagguuugcagacuguaucugaguggaacuucaucagugggaugucgguuuaauguauggguacuuuucucaacccacugaaucaguucuugagaugucccacccugagugcuaugcaaggcgaggcagccuauuugcauuccagagugaucuugugcacagaucugaagggauagcuggccucgggaagagauuguaaggugcaggcacuauaaacauguccaaaaacaguggcugucuucaucugccagccucugggcugcuucugaaagggcauguuuugcuguuaaguaugggcaugguaggauuccauuuucccuuagucuuauuuauuuguuuguuuguuuguuuguauuuaguuuuuauuacacuuauuugggguuggggguugugccauacucauaagaugacucucaggacuugggucucuccuuccuuccaccauguggcucccaagugucagaccaugucaucagacuugguugaagcacuuuuaccugcugggccaucucagucaccuucuucauccuauuuaaagauccuggagguuccccagacagauugucucugguucuuugugacaagcugcccccuuguggccaugggaauuuuggccugugccuuucuaucccagguugcaggcccccuuguuugucagauaaaauggucucuggucgccucccaugccuagugcugugaggggucaaggcacugaaccugcucugugcccuggcugugugugcucagucugcaccaagcaggguugugagcucagccaccucuuucacacuucccaagaugcugugggcucauugugacuguuucagguuggguuaggggagagggggaccuauuuugcacuguaggcagagagcaaaaucuuaccucacuuagacacuguuagcauuugcaguuaauacugcagagagcuucggguugcauccccuuccucucuggugagccaggacccucugcuuuauaccuguuauaccuguugcaucuaauuguaaugacuauucucgggaccugccaguucuggaagugaccuguuuguggucucccuccucugcuucucaugaaagaucuuagcccagguuggccucagacauguggccaugcuccugcucggccucugaguucuggagucacugagugccacuguggcucagcuaccacagagcugucuacuuggcguuccagacagugaggugcacagcuggucauggggauguguuucuucuuuacauuguucucuccuugaggagggaauucuguucccuccuagaaccgagauagcugucuagcugucucaggagacccguuagccuuaaggagguagggauggaguaaguuuauaugucccuucauuucuguacuaagggcaguauucauuuuggaaauuccccgagagaaaugguuuuaaguaaguuugagaaucagagccuuggguuuccguacaggaguuaagagcacuugcugcuccugcagagaaccugggcucggcuccccaacacugcauggcagcucacuuugccugcagcuccgggucuagaggaucuuaugcacuccuuuggccuuugcaggcccagcacauguguggugucgauacauaugcaggcagaacaccacacacgugaaaauaaaauaaaauaaaagaggauuggugcuccaccaucaaagcaagcuauuuaucacccacacagcugaccgaggcauacaaauuucacuccuacucugcuacagauuuucugagcuuacucuuuuagggaaaaccacuaaguuucuucuaaaaacugaaaagcuuuggggccucugaaaugcaggugugcgugcuuguguaagugcauggaugugcauggaacacuccacuuugcuccucuacugggaagaggcaccaaaagcagcgggagggaggacuguuucccugcccuggagcagcagcagcacacagaagcccagagcagcugcagacgaucucugccuuccugguuuccaugcgcauccuugcugcuuucaucccuguugaacacagugaauugaagcauuagcaaaaccuacaagccagccccaguuagccagcugcucccagcgugcggugccugugccacgugcagagaagcgggcugugggccacauuuccgcuuaauugaauugacuguaugccacucagcgagaagaucaagugaccaaauaugugcucaggauuaggcagaccaccgguguccgauuuccacauuuccuugaagggguuuugagagucugucccuguuggccagggcauguuuuuguacaaggugccgaaagagaugaacagucuguugggcuccaaaucauuaagugaccaguuacauauuuuauauaaccucaaccuccacaaagaaacucgugucuguccuguuaaugugcugccucguaggcugcaagggugauugggcugcagcugguagcagcacuauacccugcucgugcuuggcggaguucuaagcguugugauuuucuuuucccugguggauuuuugcuagaagacaaucuuguaggucagugcugacugccauggcuggucaucucauucuauucuuccucacccgucuuucuaaucaggugaagacgguggagaaguuacaggguugaaugggguaagggaccgauggcugcccacagccucaugacgccuguguuccucucccacagguagacaaggcuggaaaagccuucaaguauuuggaagccguccucucuuuuaucgaguguggaauggccucagagucagaaagcucagccaagucggcguacgcuguguacucagaaaccauagaccucauuagguaagugcugagguauucugccaccgggccaaaccugucggucuccccaccugcggcuaaagagggggagcccuacaaagcuaaagagggggcccuuugcccuuucuugccugaggaggcccugggugguugguccacagguuuuucacaguuaaaguguguugcauaugagggagcacaggauaacuggaugcaacugugucgucuuuuuuuuuuuuuuuuuuuuaaauuagguauuuucuacaucuccaaugcuauuccaaaagucucccauacccuccccccccuacuccucuacccacccacucucacuucuuggcccugguguuccccuguacugaggcauauaacugucaaguguccugaagagaacgcugagccucucagggagggugcuuuucccagcuuagguuucauaacgggugucuucuuucuccacugugugccccaggccuuucauuaagggcuuaugaggacaccacacuugagagagcaggccucagggccaggucuucugggcggcaugugguugcucuuaacccuuucccugcuggguugcauaccccuucauacccucuagaagacagcagcagcacagccagcauuacaugcgcugccccccccucccccgaguuuaauguucaaugcacuguuuuaucucccugcagguaugugaugucacuaaaaugcuucucagauaacacgaugccagcacaagagaagauauuugcuguuuuaugguacagacuuuuuucuauuuguuguacuaaagcuuguuuagugcuuuuguauaaaaaaacacuaaaguuuuguuuccuuugacuaaaaaaauauuuuaaaaauaucuuccuuuuuuucccucuuauuuugagccaaguucucucuacauaacucuggcuguccuggaacucauuauguagaccaggcuggccuuguagaggaacauagagaccguccugcuucugucucucaagcacgcagugcuguuauuaaaggcacaugccagcacgcccggcucuaacuuaauuuccuuaaagugaaaauuauggcaggagggaacuuagucugacucauggucacuaggaacugguaccuccugucuuccgauggcccaggagaugcuucggucuuaggguuuaagugauauucuugcauuuguuuuucugccaacguuuccuuuggguggugguguaccuacaguauagugagaugcuuaaggggacuugcucagccagaggggagaacccaguaugcucacaggggaggacugggagaguauaucugucuguccacaaggagcucugccugugaggccacccagacagaaccucugguuucauucacagcuugcguugccagucccuuuugaacauggcgauguuucgauguaagaaagacacagugaugaaguauucucguacucucagugaacacuucaagaguacuuccaaaguggcccaggcaccuucuccaugcacggcaaggcaaguguuaagucuuguuaagucaagucgcucacguccggcuucuguggcgguuuaugugugacuauggauuucccaagaucuguguuguucaucuuuuauguguguuggccccuuaaacuuuaaaccguuagcuacaccgucccucugagaaacagguaaacuaaacuuagguugaugagggugacacaagguaccacgggucccucugaucugcaagugagagcuucccaagauucccagagggcugcauaaaauuggagccaaaauuauaagcccucccuaaacugagaagaagggaacaguaagagauuaacaacaguggcugaggaggggcucuggagcagagcgcuugcugagcccaugugggucucucacauccugagcaacagaauccuuaggcugcuuugagaugaauguuacagugugcauuucuucgcaauccuacccaagugcaguuugcuuugucugagacggaaccucacucuugcccagacuggccuugaacuugugcuugucucagcuccccacuaagcaccgcaccucaggaagucccauuucuucugagcuagccauacuuucagagagcauuaaauauaauauggacccauuucuagcaaucaaaaaggagaggcucccuguggcuucuuaaaaaagaacuuccugaugaaggacaucuaauguaggugaauaugucaucgguccucggauuuagcuagggugauuucuucacaccaacccucacagcugccaggaugcagcgguaaugacucucccaggcagcucccucucuugccuuugauugugaggcagugcauauccugucuuuccaucuucugucacgcgcucauaugacugaacuacuuuuucuccuuugacccacaugaaacacgugagcgugcaggacccaggcuaucagccaagggucagaguagagugagaggccucuggcuccugauucacagccacugcccagucugcugcuggucuguugagucucuuguuuacugauccaguaggaguuuuuaggagccaggcucucuaccuuuguaauguggugacccaggguaagaaagaugaauucguagaaagugagguuugagagguggcucugugguauauccacaggucugagaguccggucugagcaguuuacugcugaccgagaggaggaaaguguaaaccacaaguggauacagcucagugaugccuacugaccaugugugaggccucucuccgccucuccuugcugcugccuuaacaggaauuggagagggaggguggugguuccggaagaugaagacuuagcaaagccucagaacgugccaggaacacagaucaguuggucuucuggcugugucuuugaucuuguaugacugacuuagcagcgauuauuguuuugggaagcacacucugaaauucagacugcaguucuagagacuguagucugugaucugcucauuuacgugauuaaccaagucucucuccauccuugcagaagcacaggcguuccguccccccucuccccaaugccuucuccugccagcuccguggggucccaaucaagugcuggcagcaguauggggagcgucggggugacggccaccgucaguacuccagucuccauccagaacaugaccuccuccuaugucaccaucacaucccauguccuuacggccuuuagccuuugggaacaggccgaggcccucacaaggaagaacaaagguaagugaggggcucugaaggagcacucaguguugugacggucggggguacacucugucccaugaagcaagagccacggagagcuguucuacucucuucacuuccgcuucauaaccugguugcaggucuuccugggucagcuagaggacaaaauaugaagccgaggugugcucugucccuugccucagcacacuggggaugaagcagcuccuauccgaggcacacagcauagcaaauguuaccgaggcacauuaggaggagaaguggggacucccaagauuugagucgggggcagugacugccugguguuuuggccagugcccacuaaauaaagcguacacacaccaggugacugguaaacaccauuaaguuuucuuccugguuggaagcaggcagccugcugcucccacagccucucugccuucuuggagaacuaauuaacaccuuccccucugcucucauggugcacagugcaucaguuggacacuuaaaacauaccagccacuguacuaguccugaguuauggauuuaacuuggaagguuccugacauuuuuauuuuauuauuauuuuuggauauuuuauuuacauuucaaauguuauccccuuucccgguuucccccccacccccuucccagaaaccucuuccuagaaaccuuccauccccucucccccugccuccaugagaguguucauccacccacccacccacccacucuugccucccugcccucaauuccccuacacugaggcgucuaucaagucuucauaggaccaagggccucuccucccauugaugccugacaaggccauccucugcuacauaugcagcuggagccacauguacuccuugguugauggcuuagucccugggagcucugggguggggggucugguugguugcuauuguuguucuuccuaugggguugcaaaccccuucagcucagaagguuccugacuucuagucuaguggggaacucugaagaauuaaguagaacuuaacagaagaguguguuggaugaggcgcacagagugugguggggauaccaucucugacuaucuguguuaucguuuuaauuugaucccgugcacguauuuacucgaguuugaccuggauucuguugcagaauucuucgcucagcucagcacaaaagugcguguguuggcccucaacagcagccugguggaccuggugcacuacacaagacagggccugcagcggcuaaaacagucacccaaaggccccuaacguaggccggaccuacuccugccucggagugucucugcaccauuggaagccaugauccagugcagacaacgacugucagaucggaaugucaguacucaacaagagaagcacccgagagauggccgggaugcuuguccacuuaaacucacaacagcuguguggucaucgcucagcgcuggucaucugagcagaugcugcaagauggccuugccuuugccaaccggaggacaaguacaacggagccccacuggcguaugaauggucuagaaacauuucugguuuuuuucuguuuguuugggcgauaggauaaaaauugcaaaugagaggaaaauuucagcaaacucuugucaucucagaagccauccuaguuugcauccggaaggaauuuuuuuuuuaaauaauaauaauuucuggugaagggcuuuaaagauuuuguuuucuuuucaaguuuuaaagaauacauuguuugauacauucugauggccaucuguggaacacaccuugugaaggacuccauugcacuccccuuacugcagggaaggggcucugaugacagaguacugauauuuacagaauugaaggugacaaccccacuccccagugccuagagugcugcacauugucuagcucuggucucucuggcuguccugagaagaaucccuagucaguccuaugggggaguggcagcauuuggaugcggguucuaucucacagucuuccccacaacccuagaggccuaacacuuccuccugacacacgccaccaaagggacuggcuaagcagcauugaccuugggcgaacacaggagccucauguugacuuugggcuguaggcagaugcaguucaucaucugucugcuggagcuggagucccgggcacugacagugcuguggcuacccuguguaucagugagcgaaagugagaagucuuccuagagagguauuuuucugcuacaaguguuuuauauuuauagcaaaacucagcuuucuauccaggauauccuuggcuauccaggggacauuagcuccuggagaggauguggaguuugggggggggggcaggauuaacuucaacuuuaaaaaacaccccacuaucauacaccuucaguccagaccaucuucuaagguaucgugacuugaugagguugaagaagaucugugaccuucccaggcuacaccccacccacaguagaccagguucacuuagaugggaagugaagaauacacucagaauucacaccugcccguaaacacaggccuuuccuugagacuucaagguuacuacuggaauacucucaaguguuuuuaaaaagccaguucuuuuuaaucccuucuagaaagaaaguagaauuugcacauguucaccauggagguguguuacggcucccccugccucucuuuccugccagccaugcuugucugugugcauuuggagauuaguggagaugggagacccaucuuuccuuagugaugaugucugugguccuugugguaacaucaggacuuucuugguaccuugguuaaaucuacacagggucucuaggugagugcgauaccagguuuuucagggcaaacugucugugauacuccuuggucuucucagccuucucuccugguuugaaugaagccagaaaauggcuaccuuguacauaucugaguauagaccaagacggugauccagcuaagcccuuuucuuuauugauauucugaagccaagccaugucugacugagucgaaguguaugguagguggucccuagcacaguggggcuugugggcucaucaggaucuuuucucccacagcccugcaucccuugcagccuguugguuguaaaauggcuaugauccuugugagagguucuggccuacugaaguuuugccagagcauguguacauccugccagcagaucacugugccccuugccuggacagaaucagccaguguaggaagaacaggcugccucauucuuuaauggguggguuuucuccucaguuuuauuuguaccuugaaaaccaaugcaguuggacaggauccguuugugccaguuuggucuguagcuauugcacugcugguuuucccacaacacugcaccuagagagcaugagccuugucugucuucuucaggggaaaaccccagggcuguucugcgcugcuuauuguaaaaccccgaagacucaaauuuuauaccaucugcacaguucacugugugcuuaaacuuaccagaggcaaauuuuccccugaggugauuauuuugggaggacuauaacauuagccccuuugaauaucugauguucuuaaaaccauggaagagcauccaccuuaugggggggggcagcauuuaaugaaugaaucuuccauuugccacuacaaaggguguguguggcccaucugucugggacacaaaguagaggaacacaauaauguuuucucuuuuggaaaaaauuaaaauuagauacauguaaaaaacccuguuacuaaaacagguugcccuugguuaaggugccuagagggcagaccacauggcaguagggaggagcaggagggcccagcaagugcuugcuaauggucccuuacaaagugacauuuauuuuguagagguucugacaaaugucuauccauucccuggaccaccaccacccagccucaucuguaggaaguuucaaacgggcucuuccccaucuuaauugaaaaugugccuuuacuauguugauguuagggacaggaccuuaaguccuacgauuccuguuugguaacuuauaaaaggacuugugcucuugagcuguggucucugaugcagaagaugagagauucagcuagacguauuugugccuuugcugaccaaacauaaauucugaaguuacgcuguuuguuuugcuguggcuuugaguggguucauggguuuuauauguuuccuuuccugcuuugugaaauucgagaugaguugggcuuaaaaaauauuauauauaucuaagaucuuuccauaccucuuacagauucuuuuucuucuuaaugacuuauuucccccaacacuacgaaaugucuuugaaaauuuaccacuucaucuguuaccuucuucaucaaugguuaguauuuaaaucgccucagaauguuuuaggggcuccugucuaaaacacagaaguguagguuuuucucauugaagaaugagcuauggagaugcgaggaucaauuuugaugccccccucccccugccucuuuccccugguuuuggcucauuuggaacuacugggcaagaggacuuuuccuguggaagggaaguguaaggacagacgggcauguguugggauuuugggauuucugccaggcgauccuccauaugcaguccaguuucccacuuacugagagcagcugucugguagccgugccucuuacugaugcauugacaagcaccgcaucaccacauuucuuugagcgacuguaaaauuuccugguuccuugggggugaaucacacucuguucuguuccgcugugcgucagacaucagcaguuacuguggugggcagagaagugccucuuucccuaccuaagagggagccagaggacaggaaggaagcguagagcucucugcaagccuguauauugcuauauuuguccccauaggacaccggauugaggcuggcggcaggcaagccgggcugcacuguugagcuggggcggggggaggggggcagaggcugaccuaaggaagaugaacucacuuugcuuagauguuuuagcaaugcucaguacaggcaguauuacguuugccuuucauucaggccaugacauguauugcuaagaacacugcacaucucaugauaucgcggguacacuguucguggugggguguguccaugugugucccgaauuuuaauuuuuuucugaaugugaucaugcuuuggaugauaccugagcaggguugccuuuuuuuuuuaauuuauuaccauuauauauuauauuauauauuauauauuuucuuucuuaaaauguuagaagucaaaucuugguauuaaaauugcuuuaaaaaggaguauguugucaaggugauaaugagaaucacuggucugccuuuaaugaguuuuucuuuaucauggaauaaugugccagcucugaucagcacagugguuuugugugcaggcuggggaagcagccaggcucccggugaagaugcgcagugcaaauacggggagcaccacagauguaaaaaucagcaucagcaguggaacggcaccccuggggcuucugugaaugggguucaucugccucaugggagacucugaaagggggcagacgugaucugugagaguuuuuuuuaaaagaaacugcaaaagaucuuuccaaagaugaugugccacagaucuuuuguuuuucucuguaacaaggacuaagugcugucuuagaaaagguaauugacuuguucaucuucacaaucuuuccuuuccacaagaucaaacuguagggaaaaaaaaggauauuuaauaaaaauuuagagaaaugauuggaguugagccuguggcuuuuauuuuguucaaaugagaggauucuuguuuguugagccagggucuuucuggagcugaccucacaagagugaaaugugaacugcccuucaaauaugcacuggggcuuucugugaaacucagaguuaaaacacgauucuuuaggauugacuucaaaacugaugggcagacagaccauccauacucuaugggaggaguugaugcuugccuuagaaauaccaggcuugcuuuaguaaccgagcaggcacuggguaaguggcauccgaggaguccgggagcucuaggcuuguccagggcg

SEQ ID NO: 2560 - RNA, 5952 nt, Mus musculus
aggucugagccaccagcagcucacacugaagaagcauccuugcuuggguuugcagucuucugcggcaggcauucucggaggaaaccagccaagguaagccugcaguggcccaugaggcugcaguucuccuggcugaauucugagggugaguccagagaacauucuuucaacagucguauuuguuagucagacucgugcuguucuggucuuuuugaauaagcuggucagguacauugcagguuucccgguauuuucaaagccaguuggauguagaaguuaaaauaaaucuaguugguccucuaaaggagagagagagaucugcuaguaaucucucucucucuuucucucuuucucucccucucucucuuccucucucucccucucucccuccucucucucucccuccucucucuuccucucucucucccuccucucucucucucucccucucucccucucucccucucucuccugucacacacacauuguaaaguucuauguaucuuuggaacaaaugucugcaucauuuuaaaguggcuggaugacuguggagaccaguaaaggaggauccucuauauuaauauaaaccagauacaguuauuuuuagaaaacugucucacuucaaaagagaaccuuccuuaauuucucgcuucugcacuuggcuuuuacaguuuucacuaaggucccugugugauaacacagacucaucaacaugcacagaaaagcuguugccugcucucaguguuuuauuuuuauuauuauuauuauuguuguuguuauuauuauuauuauuaguccaaauagaacaucuuacucaaauucaaagauaucuuuguuucuuucagcuuuguauaauguaaguuaaaaucacauuugaaaugcaaauggaaaaagcaauuuucuuuuaucauucuauuuucucuuuuucuuccuugcagaaaguacucucaugguaguucguugcuuuaauuacucgauuacugugaaacaaaucuugguguggagcucuagagacaucagauagugggggcauaagcucugagacuccagacguaaaguuuggaugaauagaguugugaaauugcccuuuuccuugcuaaggaugagagguggagagguagaaaaggcacacaaauauugacucacugaaauuuucucugagauguagaaagauuccauaaauuauuggugacuugguggugaucuaguggugccaagaguguguuugaaccugacaagacaucaacugugccucauaaaauauguugcaggacuaacuacgaccaugagauuggcagugauuugcuuuugccuguuuggcauugccuccucccucccggugaguacagcugaaucuuagagagaauucuugaaaacaaaugaauuuuagcuuuagcacacucacacgcauuuccuugucacuuuucuguuuuaaaggugaaagugacugauucuggcagcucagaggagaagguaagcaccuccggguugaucauuuaacugaagaauguucgccagcgucgcaaagguugcuaggaacagcaauuuuuuguugccauuuuauucaucuauauaauuagaccugaguauuucaaaguacuuacuauguauuuuagacagagacaguaccaaaucggccauuguuuuuaauaaacagauucucuuauaauuagauuuuuaauauaauaaaagcauguucuagacaauugcuacuuacauaaagcaggucacaggaccuugagugacugguucuuuccugagucagcaugcuuggaaaauccugcaggcugacuuuagaaggucacucagaugucagcuggagcugaucauaugacuaugauauuuacaauaccauccaaguccaucuugaaaagaaaaguccauuugugcuguuuggaucuauuagcugacuuuagaucacauuuuccuaaaugagaaugaaaaccaaaccaguaccuuuacauguuucaacauaagaccagcagcauuggcauaccugugccuccacauagguaagaauaugcugguguaacacagacccugugcuuggacaaaaaggcacacagaguucagguccaaguguagagcgucauugcaguuucauugcucagcgaagacagucagggaagcacuugugcacagaaugugugagcuggugguggggcugccugucuuccaacagucuggagaacaugggugcucaacuacaauaacaagaugggagaauuaacauuuccauacaggaaagagagaccauaacuaguacuuuaaaaugucacaagagaaauauuuuuaaauacaaggaugcauuuuaaaaagaaguaacaguauaagucaucaaaugggauuuaggauguagccgaaaagcucaaaagucaguuuucuagaauuucagcgauguaggagcagaagaaaauauuuaaaaagccuuuaagaauauacuccuaaagauaagcacucguuguucauguuaagguuauggcuuacagagcucuguguuucuuuuuuuaauaauagcaaaugcauacuuuuuuuuuuuuuuuugaaauagcuuuacagccugcacccagauccuauagccacauggcuggugccugacccaucucagaagcagaaucuccuugcgccacagguauuguguuuuaauuucucaaaacugaacagcugggcuggauugauggcagagcuguucuuacagaggacccagguucaguucccagaaccuagauaucaguucacauucuucuuuaacuccauuccaggggucuguuguaguccucugaucuccuuggggcucggcagauacauggaacacuacuacgcaugcaagcaaaacaguuacacacaaaaauuaaaguaaacaaacaauaaaugaacaaaacccuaaacugcuaaugagcagcuacuaaucaagccacacaggcuagguagccggagcuucuugcuuagaagugagugucuagaggaccaauggauaguuugcauccauuguagccuuuguaucuauuguaucaucuggcaggcugaaacaugacaccugcauuaggaugaaaaggguaacuuuagaauuaagcaacugaucauguauguuguguacugauaugugaccuuccuuuuuucagaaugcuguguccucugaagaaaaggaugacuuuaagcaagaaguaaguucucacauucacugagaccuauuuuuagagacaccgaggaagccaccacaucauuuucuucagauugucagucccuuagaaaguauccaaguaaaucuccauucaaaaacuugcuuagaggggcucuguguucauucaucaccaaaauacacaggcucuucagagaaguuuaguguuacagaaagugccuacucgugccugcuauuugaaacuuuaagccucuuguaaaauaugaaaauacgaaaagaaguuuacaguauuuuaacuaauauuugaugacuauaucaucaaugcuuagccaagccaagauacuuuaaaguguucauguugauaauauuaaagauuauuuaauaaguguucuuucccuauuugcugacuaaauaaauaaaaauuucccucaagauuaaauuuaacauagagacaauuuaugauaagaaaaacuagaucaaaagaaccauaacuuuuguagauuuguagauuaauagauuuuaaucucuaguucacuguauggauuuuggcuacaguuuguacacccauguauaacagagccauuucuuaacuaccuuugacaacagggaggcaauuauagauuuugaucuuuauauuaauauacagaugaucugaugucuuagggaacuauguuucagauuaaagaaacucaaucuagcaauuuuuugaauuuaguaaauuaauaauguauacuauuuacaaggaaauauguguuaucaauaugaauguuuuacuuuuaaguuugacuugaaaauaucuaagaaagugauauuuuauuuaaaagacaaaaaaagugccucagaauguuauuucauuuguuuguguguuaaaaagcaaacaagaggcccauuucauuagcuuaaaaccauagaauguaauguaaacacaaagacuuugaaauucaauuaaaauguuucaacgaagcuauuguagucuaaaacccaagcgcuaauuuacugagccaacuugcuuugugauuuagacucuuccaagcaauuccaaugaaagccaugaccacauggacgacgaugaugacgaugaugaugacgauggagaccaugcagagagcgaggauucuguggacucggaugaaucugacgaaucucaccauucggaugagucugaugagaccgucacugcuaguacacaagcagacacuuucacuccaaucgucccuacagucgauguccccaacggccgaggugauagcuuggcuuauggacugaggucaaagucuaggaguuuccagguuucugaugaacagguaaaugaugaacagacauguugaagggcuauggcuugaucucacuucuaggaaaccagagucugcagauucacucacucuucaucaagcacuguacauuuauaugaaaucuacuguaugaccuuugaauacagagcuuuuuuuuuuuaaugguccuguuuaaaagugugugugaugucuuuuuaauuuuaccuaucgcacacaaugucaucuuuccauauucaaagucuuagcaauauuuaagagcaauuuauguuauuaaauagcuacuuuggaaaauagcaauuauauguuaaaaauaauggccauauauagaaaacagucauauauaauggaagcuaaguggguaagaggaauuguaaagucacuguuacaaugaacuuaguccggcuuagacuuagccuuggcguuacuguucaguuuaacuuuaacgcucaaugccuuuucaucagagauagaaccuuauagguuuuaacacacacaaagaugauaucccuauuaaaccagaaaugauugauaugaagcugacuggugaaauauaaaguacacacuaauauuauuuuucuucagucaaaauuuuaaaaauauucaguacaguuugaccuaaaaguuagagaucaaagcauuaugaugcucuuguuccugucuguuuauauaauucuucaauuuguucuugauucaguauccugaugccacagaugaggaccucaccucucacaugaagagcggugagucuaaggagucccucgaugucaucccuguugcccagcuucugagcaugcccucugaucaggacaacaacggaaagggcagccaugagucaagucagcuggaugaaccaagucuggaaacacacagacuugagcauuccaaagagagccaggagagugccgaucagucggaugugaucgauagucaagcaaguuccaaagccagccuggaacaucagagccacaaguuucacagccacaaggacaagcuaguccuagacccuaagaguaaggaagaugauagguaucugaaauuccgaauuucucaugaauuagagaguucaucuucugaggucaacuaaagaagaggcaaaaacacaguuccuuacuuugcauuuaguaaaaacaagaaaaaguguuagugaggguuaagcaggaauacuaacugcucauuucucaguucaguggauauauguauguagagaaagagagguaauauuuugggcucuuagcuuagucuguuguuucaugcaaacaccguuguaaccaaaagcuucugcacuuugcuucuguucuuccuguacaagaaaugcaaacggccacugcauuuuaaugauuguuauucuuuuaugaauaaaauguauguagaaacaagcaaauuuacugaaacaagcagaauuaaaagagaaacuguaacagucuauaucacuauacccuuuuaguuuuauaauuagcauauauuuuguugugauuauuuuuuuuguuggugugaauaaaucuuguaacgaauguaaggagu

SEQ ID NO: 2561 - RNA, 5952 nt, Mus musculus
acuccuuacauucguuacaagauuuauucacaccaacaaaaaaaauaaucacaacaaaauauaugcuaauuauaaaacuaaaaggguauagugauauagacuguuacaguuucucuuuuaauucugcuuguuucaguaaauuugcuuguuucuacauacauuuuauucauaaaagaauaacaaucauuaaaaugcaguggccguuugcauuucuuguacaggaagaacagaagcaaagugcagaagcuuuugguuacaacgguguuugcaugaaacaacagacuaagcuaagagcccaaaauauuaccucucuuucucuacauacauauauccacugaacugagaaaugagcaguuaguauuccugcuuaacccucacuaacacuuuuucuuguuuuuacuaaaugcaaaguaaggaacuguguuuuugccucuucuuuaguugaccucagaagaugaacucucuaauucaugagaaauucggaauuucagauaccuaucaucuuccuuacucuuagggucuaggacuagcuuguccuuguggcugugaaacuuguggcucugauguuccaggcuggcuuuggaacuugcuugacuaucgaucacauccgacugaucggcacucuccuggcucucuuuggaaugcucaagucuguguguuuccagacuugguucauccagcugacuugacucauggcugcccuuuccguuguuguccugaucagagggcaugcucagaagcugggcaacagggaugacaucgagggacuccuuagacucaccgcucuucaugugagaggugagguccucaucuguggcaucaggauacugaaucaagaacaaauugaagaauuauauaaacagacaggaacaagagcaucauaaugcuuugaucucuaacuuuuaggucaaacuguacugaauauuuuuaaaauuuugacugaagaaaaauaauauuaguguguacuuuauauuucaccagucagcuucauaucaaucauuucugguuuaauagggauaucaucuuuguguguguuaaaaccuauaagguucuaucucugaugaaaaggcauugagcguuaaaguuaaacugaacaguaacgccaaggcuaagucuaagccggacuaaguucauuguaacagugacuuuacaauuccucuuacccacuuagcuuccauuauauaugacuguuuucuauauauggccauuauuuuuaacauauaauugcuauuuuccaaaguagcuauuuaauaacauaaauugcucuuaaauauugcuaagacuuugaauauggaaagaugacauugugugcgauagguaaaauuaaaaagacaucacacacacuuuuaaacaggaccauuaaaaaaaaaaagcucuguauucaaaggucauacaguagauuucauauaaauguacagugcuugaugaagagugagugaaucugcagacucugguuuccuagaagugagaucaagccauagcccuucaacaugucuguucaucauuuaccuguucaucagaaaccuggaaacuccuagacuuugaccucaguccauaagccaagcuaucaccucggccguuggggacaucgacuguagggacgauuggagugaaagugucugcuuguguacuagcagugacggucucaucagacucauccgaauggugagauucgucagauucauccgaguccacagaauccucgcucucugcauggucuccaucgucaucaucaucgucaucaucgucguccauguggucauggcuuucauuggaauugcuuggaagagucuaaaucacaaagcaaguuggcucaguaaauuagcgcuuggguuuuagacuacaauagcuucguugaaacauuuuaauugaauuucaaagucuuuguguuuacauuacauucuaugguuuuaagcuaaugaaaugggccucuuguuugcuuuuuaacacacaaacaaaugaaauaacauucugaggcacuuuuuuugucuuuuaaauaaaauaucacuuucuuagauauuuucaagucaaacuuaaaaguaaaacauucauauugauaacacauauuuccuuguaaauaguauacauuauuaauuuacuaaauucaaaaaauugcuagauugaguuucuuuaaucugaaacauaguucccuaagacaucagaucaucuguauauuaauauaaagaucaaaaucuauaauugccucccuguugucaaagguaguuaagaaauggcucuguuauacauggguguacaaacuguagccaaaauccauacagugaacuagagauuaaaaucuauuaaucuacaaaucuacaaaaguuaugguucuuuugaucuaguuuuucuuaucauaaauugucucuauguuaaauuuaaucuugagggaaauuuuuauuuauuuagucagcaaauagggaaagaacacuuauuaaauaaucuuuaauauuaucaacaugaacacuuuaaaguaucuuggcuuggcuaagcauugaugauauagucaucaaauauuaguuaaaauacuguaaacuucuuuucguauuuucauauuuuacaagaggcuuaaaguuucaaauagcaggcacgaguaggcacuuucuguaacacuaaacuucucugaagagccuguguauuuuggugaugaaugaacacagagccccucuaagcaaguuuuugaauggagauuuacuuggauacuuucuaagggacugacaaucugaagaaaaugaugugguggcuuccucggugucucuaaaaauaggucucagugaaugugagaacuuacuucuugcuuaaagucauccuuuucuucagaggacacagcauucugaaaaaaggaaggucacauaucaguacacaacauacaugaucaguugcuuaauucuaaaguuacccuuuucauccuaaugcaggugucauguuucagccugccagaugauacaauagauacaaaggcuacaauggaugcaaacuauccauugguccucuagacacucacuucuaagcaagaagcuccggcuaccuagccuguguggcuugauuaguagcugcucauuagcaguuuaggguuuuguucauuuauuguuuguuuacuuuaauuuuuguguguaacuguuuugcuugcaugcguaguaguguuccauguaucugccgagccccaaggagaucagaggacuacaacagaccccuggaauggaguuaaagaagaaugugaacugauaucuagguucugggaacugaaccuggguccucuguaagaacagcucugccaucaauccagcccagcuguucaguuuugagaaauuaaaacacaauaccuguggcgcaaggagauucugcuucugagaugggucaggcaccagccauguggcuauaggaucugggugcaggcuguaaagcuauuucaaaaaaaaaaaaaaaaguaugcauuugcuauuauuaaaaaaagaaacacagagcucuguaagccauaaccuuaacaugaacaacgagugcuuaucuuuaggaguauauucuuaaaggcuuuuuaaauauuuucuucugcuccuacaucgcugaaauucuagaaaacugacuuuugagcuuuucggcuacauccuaaaucccauuugaugacuuauacuguuacuucuuuuuaaaaugcauccuuguauuuaaaaauauuucucuugugacauuuuaaaguacuaguuauggucucucuuuccuguauggaaauguuaauucucccaucuuguuauuguaguugagcacccauguucuccagacuguuggaagacaggcagccccaccaccagcucacacauucugugcacaagugcuucccugacugucuucgcugagcaaugaaacugcaaugacgcucuacacuuggaccugaacucugugugccuuuuuguccaagcacagggucuguguuacaccagcauauucuuaccuauguggaggcacagguaugccaaugcugcuggucuuauguugaaacauguaaagguacugguuugguuuucauucucauuuaggaaaaugugaucuaaagucagcuaauagauccaaacagcacaaauggacuuuucuuuucaagauggacuuggaugguauuguaaauaucauagucauaugaucagcuccagcugacaucugagugaccuucuaaagucagccugcaggauuuuccaagcaugcugacucaggaaagaaccagucacucaagguccugugaccugcuuuauguaaguagcaauugucuagaacaugcuuuuauuauauuaaaaaucuaauuauaagagaaucuguuuauuaaaaacaauggccgauuugguacugucucugucuaaaauacauaguaaguacuuugaaauacucaggucuaauuauauagaugaauaaaauggcaacaaaaaauugcuguuccuagcaaccuuugcgacgcuggcgaacauucuucaguuaaaugaucaacccggaggugcuuaccuucuccucugagcugccagaaucagucacuuucaccuuuaaaacagaaaagugacaaggaaaugcgugugagugugcuaaagcuaaaauucauuuguuuucaagaauucucucuaagauucagcuguacucaccgggagggaggaggcaaugccaaacaggcaaaagcaaaucacugccaaucucauggucguaguuaguccugcaacauauuuuaugaggcacaguugaugucuugucagguucaaacacacucuuggcaccacuagaucaccaccaagucaccaauaauuuauggaaucuuucuacaucucagagaaaauuucagugagucaauauuugugugccuuuucuaccucuccaccucucauccuuagcaaggaaaagggcaauuucacaacucuauucauccaaacuuuacgucuggagucucagagcuuaugcccccacuaucugaugucucuagagcuccacaccaagauuuguuucacaguaaucgaguaauuaaagcaacgaacuaccaugagaguacuuucugcaaggaagaaaaagagaaaauagaaugauaaaagaaaauugcuuuuuccauuugcauuucaaaugugauuuuaacuuacauuauacaaagcugaaagaaacaaagauaucuuugaauuugaguaagauguucuauuuggacuaauaauaauaauaauaacaacaacaauaauaauaauaauaaaaauaaaacacugagagcaggcaacagcuuuucugugcauguugaugagucuguguuaucacacagggaccuuagugaaaacuguaaaagccaagugcagaagcgagaaauuaaggaagguucucuuuugaagugagacaguuuucuaaaaauaacuguaucugguuuauauuaauauagaggauccuccuuuacuggucuccacagucauccagccacuuuaaaaugaugcagacauuuguuccaaagauacauagaacuuuacaaugugugugugacaggagagagagggagagagggagagagggagagagagagagaggagggagagagagaggaagagagaggagggagagagagaggagggagagagggagagagaggaagagagagagggagagaaagagagaaagagagagagagauuacuagcagaucucucucucuccuuuagaggaccaacuagauuuauuuuaacuucuacauccaacuggcuuugaaaauaccgggaaaccugcaauguaccugaccagcuuauucaaaaagaccagaacagcacgagucugacuaacaaauacgacuguugaaagaauguucucuggacucacccucagaauucagccaggagaacugcagccucaugggccacugcaggcuuaccuuggcugguuuccuccgagaaugccugccgcagaagacugcaaacccaagcaaggaugcuucuucagugugagcugcugguggcucagaccu

SEQ ID NO: 2562 - RNA, 47357 nt, Mus musculus
cuagaauuccauagauucuuuaauguaccaacauggcugaccccuuauugcaaacaguggagacauggagaauauggguggguggguaggagggaaaugggggagggauaccacccauaggcucccaauccaguccuauccccaaggcuaaacagagagagaccaguuuaguauuagaauggcagaagagauauggaagugacagaaaucauuugcucugcuguggaaugacaauguuugcaguuagaguaaaaagcauuagagaaccccuugaggacagaaaugacaagaagacccccgcgggacuugacgaggagguggaugaggacauccuaugagaagcgucagaagugagggcagagaugcacagaucuuggccaggaauuuaacuuuuaaaagagaugggaaaaccauggaaaaucgaauuuggaguaggcuuugccugacccaacugcugucuuaaguuggcugugccagcuggggcguagcgaggauggagaucuagaccuaacgccugaggcaggauucuguuacucaagggcuggccaggagcggaaaugagguaaugguggaggcaucagaaaguuccaaaauccaacccuuggaugccucuagaugucuggagaguggagacaggaaaucauccaguaaacacagaaucaaggagcugagggucaccaaaugcaagccuugccgccuuggugauuucuuucugguuuuuaaacgaaggguggauuucuuugccuucccugagaauucaguucaagcuggauuucacuaguucuuucuaucccaacaaaagaucuccaucuuuacccuccuccuugcaccuuugcaaacccagggggaguauggacagagucuaagcacuaucuuaaggucaugcaggcauggacacacccaggagccccuuucccgacgagcuggcugaccaagcaagcuaccccguaggaaugugggcaccgauggggacccuggcucuacuuggaucccuggccgcuggggccuuuucgacgcgccuaaguccaguccaggcgaggccagggcccgggaggcgggccgagggggcgggcggaggcggggagcagcaggccgacuccgggaagaaaagaacauggcuccugcggcagagggcggcggcacucccgggcgcgcugggcgccagugagcgccaugguuaacuccagacgcgugcagccgcagccgcccggggacgcgggacgcucgcccgcgccgcgagcguccggacccgggcgccugguggcgggaggcgccggccuagcuguccccggcggccucggggagcagcggggccuggagaucgagauggagcgcauccggcaggcggccgcucgggaucccccggccggagccucggccucgccgucuccuccgcuuucguccugcuccaggcaagcguggagccgcgacaacccgggcuuugaggcagaggaggaugacgacgacgacgagguggaaggagaagaaggagggauggugguagagauggauguggaguggcgcccgggcagucggaggucggccuccuccucggccgugagcucggugggcgcccgcggccgagggcucgggagcuaccgcggcgcggcucaccugagcgggaggcggcgccggcuagaggaccagggcgcgcagugucccagccccgcgggcggcggggacccgcugcaucgccaccucccgcuggagggccagccaccccgaguggccugggcagagaggcuggugcgagggcugcgagguaagauccggacucuuggcguccagugcacgcuugacaacugccugcgcgcgggcucgaaccccuguccuacaaggguggcugucugcugcggcuccaccucgcauccucugcguucccgccuccuuccagagcgccuucccuaacuccucuaauucggcgcgauuuccgguacccaucaccgaauuuuacugcguucuuguuggugcaaauucauuggacgccucccuuccucccuuccucucuccuuaagaugcuagcacauuuuggaaaacaaaagcaagccguuaauaccugggcuuuuggaggacgaaaagugaauauucuaguacaacugacaauaguuggaacuuuaugcuugcuaaaugucacaaaugaggaacaaguuuauuccagagcccaagcuuuuccuuugguggcgaugugucaugucccuucagccauucuaguagggaccuacaauguuauccaaguuuugagacaaaugccuuuaaacaggucauugucugaagguuugguugagagagagguuguugacagaaauguguagaaacacauuuuugaucauuuccaauucuagacauuucuuaaacaguugcaaacaaaauuauuauaccucgcccguguccccccccccccccccccguguguguguguguguguguguguguguguguguguguguguguguuuaaagacuggaagcaagguccuuugccauuccaacaagaugauugcuuuuccagaugguuaaugugucagcauuccaacgagcacgcaacucuccacacggcaagaaaggacacggauuuuccaauagcuaguuaaucucguguucuuaaagguuugcagccggagguauccaaguagaagaguuucacuaacucucccccaccuaguuauuuuaaccucuagcuuuaagaguuccagcccaggauuuguuguuauuuuccccugcaacagaaacuauccaggcagugugaguuaggcaggucaggccuccauccaaauccugguccuacuacuguuugaccuugagguuauuauuuaacugcucugaucuuuuaauuuuuaguuuuuuguuuuuguuuuguuuagaaaagaaauaacuaguacauagcccucgauguguugaaagaauuaaaugagaagacaucuagaacgggcagcgaaucuuugcugugcuaugcuuugagaguaucacaaaugaugaaagaauaucugcuuuuacacgugcagacuaguuaaugugacucagggcauuguggaaaaccaaaacauccuuuugaggugacuguaaucaauagacuaggaaagcacuaaguuuuuuauuuuuuuugaugucuagagcagcauaaaacagauuguuauuuuaaacuacguaggaggugcuuuuaaaaguauucacugaggugacugaagugacaugcagguuucuuauaagcuaauacauauggaaaguuacaugaucaguuggaauauuugguuauauagauaacuuugaacucaauaaugggagacaaugagauaaaauguauacuuuuauauugggaacuauauguauguauauguguguguuuauuucuuuuaaagaagaauuuuguaaacucacaauaagacagacuuuauuagugggugcucuguagagguucugggagaguagggugcaggagaggcauggaagcuauaauucccuucucagggucuugaccucugcaucucugcauauauaaccuaaguaguaucuaauaaacucuuguguguaauaauaauaauaugauggcacaccugucacagauguauuucacaaggaagcagacuuggggaguuauuaauuauuuuaaaauuuaacccuuuaauuucuguuacaaaaauguaguuggcauucuuguggcuuauuaaauaaguauuaaauguuuagcacaugcuaugaagauaguguacugcuagaagcucuaaagcaaaauaagcuacgguggcauaucacuauuuuacaaaggacagagcccagagauguaaaaucacuaauaauaaaugacauaugaauuuuuuuccuggcuugugggauaacaucauggaaacccuaugauccugugaauaaucaccaaggaucagaacagaaagugacuuuugcgauauccacagguaguggggacuguuaagggggaugacugaaaucuccaguggucaacugcuucccugucaacucauucaggcucuuggaaccucagcuucucaauuauaaaaugaaagcauuggauuagucucugaugcccuuucugcccccacccggguagcagacaggcagcaaaggcagcaaaggauguucccccguucuauaaacuuacccuuucagcagugaguagucaggguugaggaacugcuucugggauacacaguaucuaacuggggaauuaaaauguaucucuauauauuaaguugaaggcuucuccacugcagagcauucugaaugaccuggacucagcaacuuggugucuaggacagguuucagagguaaauauggcgggcaggcagguaugguguguagccaccagugaauuggcaccgaaagccugggccagaggaaucaaagggcaacugaaugauuugaugacagcgccccagacaucaucuuggaaguuacacucaccacuuggacuccugcugcauuggcaaauuguuaauacacauaacaaauaugauauaaauacacaugacaaaugauacaauguagccauagguccacaguuaacaaucucugucacauagugcuagggcucaaaugaauaagagggcuacucuuauuuuuccuaaaaugaucagagcuuggcacugcauguacgguuugauaaguggccaucauuauuuucucucacauauaacuugcauuucuccugccuuuccuuuugaugucuacagaggaguguauucaguuauuacaaaggcuaucgaggaugauaaaagucugaacuuggccauuccaaacaguaccacgccaaagugcuacucccgauccuccauucuuacuugcagcucauaagcauccgugugcagggacugauuaauuuggccuauuuugaaucuuuggacccauucuuacuccaucaccaguauaguguuauccuaaaugugagguuuuucaagagggaguagaggaacuuuugccccuuaagggguauguagaaguaucugaauguaugaguguguuuuuauaaccccaggagggagcaggguuacaccugccaaauaccagcuagaagggaagaauuguacuaauuucuuaaagugccuggggcagccucguccuccacuacagcaggucaucccagccagcguugacagcaauauagaguuugagaaaccuugcccuaaucucuuaggugacaaggaauugcucacugugcucagcacucuggaagccuuauuauggucauaguuuguuuuauucuuagggugcccccuauauuagaagcuauccucucucucucucucucucucucucucucucucucucucucucucucuccuucuuucuuucuuuggccuuuucucaccucacauuuggcuacuggaauuuucuuuugggcuagggagauagcaaguuccuaaguuugguccucacaacccauauuuaaagagcugacugugugaugaccugugcuugcagccccaacaccagggaggcgaagacagagcucgaugucuaccucacuugacaaguuccaggccagugagagggacccugaaaaccaagguggacaguaacuguggaagcucccgagguuguuguucucuugcuucugugugugucuaaugucucuguagcuuuaauccacgcuuccuucccuaaccucuuucuuuuucuuuucgcacuucccugcccuuacucucuagaccaugugaguugugauaaauuugcucuaguaacacaacucaugcagccaauaaaccuguuuggcaucaccuuuaugacaaguccugggaauggccagauggguaauacaaugucccacauuucaggcugcucaccuucuaacaggugaaauagcuguacaaaaguaauuacagugagggucuuaggugugggaggaacucagggaagagguaagcuaucucuaccugaggaggucagugagcuccguuucgaagagggaggggauucuggcaaagaacaaggaguggugacaaggcuaagcagacuuugagugcugcauuggggagcuggcacacuuuccugcugguauuuggaguauagagacagaugaaagacagaaaucauuaguguuacagaaccaggcuugguguggugguaucugacuguauucccagcacucaggaggcagaggcaggagaaucauuccaaguucaaggucagacugagcuacacaguaagauccugucucaaaacaugaaacacaauaauuacagaaucaacuccaugggaagaaggauaagcguagggccagcuuugagacagacaucaaacuguuugcucaaguaggaagaacuuucuagagaaagaaaaagaaaagccuucaccuggggcaugugaaucagagcacaugcaauggugcaccuuaacucacuccugccugucaacucaugaacacuggaaguagucuacaacaggaccaugaugcagaggggccagucccugucuccuaagauagaccucuacauacacccagugggggaagacuaaagauugugaauauuaauuucuaggagguaggaaggguaauuuagaaaaaguaaaucuauaacaguuuauagaaauacgaagaagaggguguuucucauuuccucuuagggacuugaauuaaauugccauaauuuauuacaaauuuggcuugggaaaaaaaaucugacaucguuuuugucuguuucuauuuaaaggucugagaauaccuuuuguaugaaauuaugucuauuccuuagugcacggcugucuguaaaccacuggaaagaaaucacugaccacggagcaggaaagaugcuaaagagauuagcagucuccacauguacacuguaggcuggccuccagaagaacauuauccuauuuucccaaagauaaugugggcuuguuccugaggcuaauccugagccugauccguggcugcugcuccauuaucccaugucguaauuuuccaugucaucuaaauuuauuaaaauuccuuaguaugacaguuucaaugaguaaacauuccgcaugcugcauuucugccacgugaguaauucccugacaaguaccagaccuuggcaguggcgggcugaccgaaaacuguguucagcuuucagaguggugaaacccgugauguguaacaccuugguguccuugaacuuagaugcugacuuaaaaaaacaaaacaccaaggaaauugugauaucuaaauuuaauagaguggagcucuuauauuguuauaaggccccaaaagcauaucaacauuaccgaagagcucauuuucucgaugggaaagaccuuaugcuguuccauuucucucccuguggcuuguucauggcucaaguguggucugcauuagguuaacaaaggggguaaaugaacgccagagguaacaugugggagccagauucuugucuguuaauagcgaaccuacucgaacuggaaggacugagaggcugguguuuugcggaagauauuaagguccucccagggagucagcaaugugacuuuaccacaccgcucccuaacccggguuuggacagccgccauauugccugcuggccgagucucuccagcaagcucucugaggguuacaucaucuuuacuucaccagcccaacacguuccaucugcuaaaacagaaagcauggcggcugauggcgguuuuuccccaaaauaaaaacagagaagcugcaggagcuguuccuguuaauuuuaagacguauuaauugcuuugaaaagccuauugagcuuaagcaggccaagcguagucaguugccauggcguuucuuauacgacagagaugagcgagugcagagcaaccuuucugccgcuguguuagaagcucaauagauauuuccacauuggaaugaugcaacaacucggggugugcaccguggcuaccugugguugcccaggagucacaccaccuacuuagcuaggcuuagugggaggugccagguguguccuuuaucaagcaagaauuaugugaggcgcacaauugcuaaaucuuuuaaauugccuuccuuucccauccucccaagcguuuaaagauauuugcuagugguccugggaguuaggaaaaugauggcgcacaacguaugguaaauaaaagaugcuccugcuaagucacgccugagucacacacaguuugcguacauacauauucuuaugugcccauauuacacucgaaaacgcguuuacugucaauaucgacuuuccuuuugccacuugugaaauuucuuuucuuuuuacucuuuucuuuuuuucuuuucuuuuuuuucagagacaggguuucucuguguagcccuggcuguccuggaauucacucuguagaccaggcuggccucgaacucagaauuccgccugccucugccucccaagugcugggauuaaaggcgugcgccaccgcgcccggcucacuugugaaauuucuuaggagagaugaccuuguuuuguuuuuccguuauguucaaggucucuggggaacaagacucauggaagagagcaacgccaaccgagagaaguaccugaaaaguguguuacgggagcuggucacuuaccucuuuuuccucguagucuugugcaucugugaguacacgcccugccccucucguggcaaugucagucacgggugaaaaguucgugagcaccaggaggggccaggcagcaguuuuccucucaguguggggacggucucugcucaccgguucauuaucggcugugaucuacuguacagugagaugcgccgagcagccugccauacacacagaucccagccaagggguuuggaggcuagauccuguaacagcaaauauuccgcuuccauccguguguaaccgcucacacugcuugugucagcuucugucuugcaaaggccccuuuuggaugcugacaguuuacaucauucagcgugugauuuggaagaaacuaggcuuuaagggaaagccgucugauccgaguuuucuuccaucucgcuuacuuugguguguuagugcauucucugcugagugaggggagggaagccauagauagcacagaaccagucucuggaagcuuuugcaaguccagaaaagucacaggcaaaucaucuauccugagcuaaagcaugcugaagcaaggguuuuaaaaauauuuuuuagcgugugugugugugugugugugugugugugugugugugugcacgugcgugcucgugcauaugagcaaccaugccccuguggagggcagcuuuguaaagucauuucucuuucugcuuuuacacagguuccaauuugaacucaaguggucaggcuugcuugguaaaggccaucuuccuggcccugaagcacagauuuuuuuguugugucuucucugaggccucuuauagagacauggaagccaguuuggucaccuccauggccaggcucuuccuaaccucuccuaaggagaaaggcaacucuuccgguguacacugagagagucuuaacaauugaccccuauauagaaagaguccauccuuuuugagagaaucagaacuuaaucaguaguuuaauaauguuuuucagccgggugugguggugcacgccuuuaaucccagcacucgggaggcagaagcagacagauuucugaguuugaggccagccuggucuacaaagugaguuccaggucagccagggcuacacagagaaacccugucuugauacccccccacaaauguuuuucagugggagaguggagagcuggcuuggcaguuaagagcccuggcugugcuuccagaggaucuggguuugauucucacacccacagggucacucacaaccaagugcaacucuaguuccagggauccaacacccuuuucuggucucagugugcaucggacacacacaugaggcacagguguacaugcaggcaaauguguacacauacauuaaaaaaaaaaaaacccaaaacaaaaacugguguuauuucuguaacuggucaucuuggauuuauaagggcugaaagcuuuuuugcagaaauuuaaauuuuuuacugaauuauuaaaaauaaaauaaauguugaaugcaaaaaacuaagaaaccauuuaaauuucuuaauguguaguuguuaggaguuaagaucucagaggccacauacccuuuguaucuucuuguuauuuaugugugcacauaugugugaaggugugugcaccuguguauguaggugugugcauguguguguaggugcauaugcauguguguguaggaguaugcaccuauguguguaaguaugugugcguauguguguaggaacuugugcaccuauguguguaggagugugcagguguguguaggugugugcacuuguguguagguuuguucacaugaguguauaggcacuugugcaccuguauguguagauguguccauguguguguacgugcgugugcacccauggguagguaugcgugugcacauguauggagcugugugugcacaugaguguguaggugcauaucuuccucaguuacagcccccuuaguuuuuaagacaggacgucuaacuaacuaacagcuugccagguaccuuggcuggccagcaaaccccucagauaugaacuugggucccucucagcccucuguuuacauccuuugagacuuugccugcuaacuagaaacuuaaauacaaaaugaaggauuuuuuuguaagcuaaaaauauuaugugaaaaaagucauuguuuuggguuuuuucuuaccaauuuucugucacuuguauugggccuucccuugugugcaucuucaucuguuuuccuuauuuauaugcccuagaauaagcagguagauuaauaaaaaaaaguaaaaaugaaaauauucucaaguguaauucacaugagagaagucccaaaugagauucacauuauuacuuucuguuuuaagaaccuaucauuuauuuaugaugcuugggagaugugccaaauuauuaaauauuuaauuuaauaccuacuaugaagauaguagccuuacugcagcuauaagacauaauaaucucagguaacaaagcauaacauucaaacagaggcgaucuagaaauuuaaaauaaguaaccacaaacaagcuuuaaaaugacauuuauuuguuuuucuuuuuccuuugaaaaaagaaagcuuuauucaggaaacaacuuuuaugaggcauaacuuaggauccaucugcaugggcaucuguuucauuugugucuuaggguuuuacugcugugagcagauaccaugaucaaggcaacuuuuuuuuuaguuagguauuuucuucauuuacauuucaaaugcuaucccaaaagucccccguuacccccccacacacuccccuacccacccacucccacuucuuggcccuggcauuccccuguacuggggcauauaaaguuugcaagaccaaggggucucucuuuccaaugauggccggcuaggccaucuucugcuacauaugcagcuagagacacgagcucuggggguacugguuaguucauauuguuguuccaccuauaggguugcagaccccuuuagcuccuuggguacuuucucuagcuccucuauugggggcccuguguuccauccaauagcugacugugagcauccacuucuguguuugccaggcaccggcauagccucacaagagacagcuauaucaggguccuuuuagcaaaauuugcugguguaugcaauggugucaguguuugcaggcugauauaugggauggauccccggguguggcagucucuagaugguccauccuuucgucucagcuccaaacuuugucucuguaacuccuuccauggguguuuuguucccaauucuaagcaggggcaaaguguccacguuuuggucuucauucuucuugaguuucauguguuuugcaaauuguaucuuguaucuuggguauucuaaguuucugggcuaauauccacuuaucagugaguacauaucaugugaguucuuuugugauuugguuaccucaggaugauacccuccagauccauccauuugccuaggaauuucauaaauucauucuuuuuaauaaccgaguaguacuccauuguguaaauauaccacauuuucuguauccauuccucuguugaguggcaucuggguucuuuccagcuucuggcuauuauaaauaaggcugcuaugaacauaguggagcauguguccuucuuaccaguuggaacaucuucuggauauauucaaagcaacucuuauaagaacaacauuuaauugggacuggcuuacagguucaaagguucaguccauugucaucaaggugggagcauggcagcauccaggcaggcauggugcaggaggagcugagaguucuacgucuucaucugaaggcugcuagcaauacuggcuuccaggcagcugggauggcagucuuaaaauggcauuaaagcccaugcccacaguggcacaccuaguccaacaaagccauacuuccuaauagugccacucccugguacaagcauauacagagcaucacaauuuguuuucuaacauacagaguucuaacacgguuaauccagcuugagcacauuucugucaucucaggauuuguuucucuuucuggcugcagcuggccuuuguccuugauccccucccuucccuuugguucucagcucuuccaucgcugcauucugcugucuuggcacuuugccgugccuuuugacuaauaccugccucucuccccagcccuuggcagcccaccauucuacuacuaugagcucagcauauuacauuccuucccuuuaugccauuuuaaaagacaugcuuucuaacacagaaacgcuaagauguaaugugcauauugcauugaaguucaggcagcaagaggugagauauuucagacuuucuuguucugagcuguuggagcacggaacacugagguuggcuuuguuccuagcacaggaguggcgcuuaaauaucaaaccacacugguuuuaacauuaacauguccauuagaauaugucagcauuuucaaacaccacauaugcaaacaugcuucuaaugccaaggaagcccagaguuugacaaauuauccagacuaagcaucagaauugccaagagaauuuaacaaaaaaaaaaaguugauaguuuuucuagaucaucugagucagagcuucuuccaucugaagaaaagcaaguuuucagguggacuuuaugggaaugaggccaaagaacuaaacuggcgaccaagagcuuccgaaaccuaacugaacacuugcauuuucuuguuuuagaaagucugugggguuuuuuuuucuuucuuucuuaucuuucacuauaaccaugagacuuuuuuuuucuaucaauagguacaauuuuuuuguuuguuuuugguuuguuuuuguuuuuuuuuucgagucaggguuucucuguauagcccuggcuguccuggagcucacucuguagaccaggcuggccucaaacucagaaauucaccagccucugcuucccgagugcugggauuaaagacgugagucaccacgcccggcuaauagguacaauuuuuacauugaguuagguucuauuuuuuugaggaaacccugacaggaccuuggcugcagacauggcggucccugaacaagucagagggagcacaccagugagcagcguccucuauagucucggcuucacuucaugucuucaagcuccugcccuagguucccucugugauggagugaaaacuaaaacaugaaauacguccuuuccccagguugcuuugucaucauggaaacauggcaauagaaagcgacugaaaggaguguaacucuuauguuuccacucgaguucacacugcgcaaauaucuuccuucacacacaucucucgacauuggcuccagagaaagcuugcagcauuguugagcucauuuucaaaggucaagcucaggagggucacuagcuguucaagauccuggggcaccuucacccucuguugugagcccagagguagcuggucugaauggagcuggcggagcugcucgcccaggcugucugagguugagcugccgcugacauauccucacaccguugcugcugugggcauauguagaaaugucacucccaaauaacuggcucagucuuauccugacacaguucacaaacaguucaugguggcccaucauugucagcacuagaaguaucauuuucugguguccaguagggggcgcaacacaguagaauuucacuucacguuaagugaagccgagaaagcuacuacugaucuugagaauuuuaacaaaagccaggucugaagaacaauaagaagacaagaagggacccuggugucuauaccgugcuuaaaagucucuacuuuuaaccuaucaacaaauaauuuccaagagcaaccaucuuauagguaaaacacaagaaaauguuccaaauuaaccagcaacccccaaguacgauucuaguuucacaguaauugaaaauaaucaaccgagucauuauucgacucuaaggauucuuccauccucacucugugucaccucuguccccuguauugacaggauucccaggcaucgaugcucagggcauuacagcugcauccuucccucuguggggguggagggagggggagagguguccgggcagaacacucgcugaggaccugcaaguuccucguuuggagggaaaggucacuucuuuacacucaugcccuggaauuauuuaguguacucucuccgcaugguugcacaaauuaugaauuuauguaaaugucuugcuuaugugauugcuuaagaugaacgcucaaauacauguugggucaccacugcccauguuccuucuuuaacaaucuuaguuugauguugcuugaaaacagaagaguaagagagacaaacugaccaaugguuugagcagagcuaguuuaagacacgguguaauuacggaaucaagaaaucaucaucuguguucaucgcugcagacaaaagaugaaaaagaaacaaaugccuucucuugaagcuucauguuucaagcaaauuauauuauguacagcguauuacacccguggucaucagaauuccagcagaacacaguaucugcuaaaugcugaaaguuuuaauucucaaaacuuaucauuacauacgauguguacacagaagcagccaugccaugguguagauauggaggucaaagggcaaccuuugggaaucaguuuucucuucucuucuuuacacggguuucaggaaucagacucagguuggcaggaguuguugcgcgcgcucaacuggccaggaagaacgacgcugcuacaggauccuucugcacacguuuauucaguccuguuucuucuuucucuauauuucccuuguuuauaucucccuuguuuauaucucccuuguuuauauaucucccuuguuuauauaucgccuuguuuuuauaucucccuuguuuuuauaucucccuuguuuuuauaucucucccgaacccugggccucucacuccuuuuauacucucucucauccacgaaccgcaggccacgccaccucaccaggcacgcagcuucagcuaaucagggcagcaggggcaaaucuccaccaaauuggauucaccuguauccugguacaccugugcagcacucaagauguuuguggcuuauaugaggaagucaggugcaagucauaugacuuagcugcagucccuggcgccuuugggacugccgccacacccgcuccccacaauucccccuuuuuucuuuuuuggcagagagaaugucuguagauagccccucgcagccaugccccuuacccguccuugggugacaaacagcauugguuugaucccugucuuagguuggugacaugcccagggagucuuaucacugacuaccucucaaucaugccaagccacuccuggggagauuguguuuugcuuguggcaggugcaucaaaaggccaggauguuacuuaaccuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuccugggggaagggaacuaggacacugaaccuucaugcaaucagacgugccuuccacaggaugccaacagcaagcuauccucugugcagugcuuagccucgcaccccacggcauaacgcagcauaauuucuuuuagagcagcaaaccgaaucugaggagauugucccgccuccucugcagcaaaagccuaugcuaccauggcgaaagugcgggccgcacacugcaccuaacacaugugccaaacacaaaacacacacacacuauaacaagcauacaucccagggcucucauccccgcucaucuucccuggagcaagggauagauggccagcggggcuaucucuuuaaggggaauucagggaucaaaaagcguggaaaaauuugaacgucaugucgagcugguaucggcuucuggaacaccgaaaggaucucucaucucggcuccauuguuugugcuugugggaauauccaccacauccacaggggcaacuggaucaggagccucauucuugcagcgucucaccaaucucuccggcacccaaagagguuccaucugguccuguggaaacacacaaacagacccucucgcccacgucaacaccugaucuacucgauccccaggggggauggacacaauaccucguggugaugagaccuuaaccucaaucaccuguguguccaucuggggagucaauaugagagucaaguuuucacuaacuuccccucuguuaggcaaugauuuccacgcccuuauaggaaucugauucaccugcucaaacaccugcacuggauauccugucuguuguugugcaaaucuaccuugaucaagcagcauaucucuaucccaugcaaauucagcuugaucagugaaaauaggacaucccagcaaggagaaucuauccucuuuccagaccuccggacagaaggucugcccauagauggcugacgaggaggcauagggagggggagcaaaagcuaauucgccuuccuccuccgccucagcucuuuuauuuuguccuuucuguccaccugauaacacugugucuccuuucuuuuuccuuuuucuuuuuaagcacuucucuuccucugacauacuuucuuguugcucuguaaggauuuucugaccugucuugacugccucuacacacaguuucaaacaguaacagaguccauauaucagaacaaacaagaccaaaacuaucagaccuacccacaaagggucaauagaagaaaaaagcauaacuacacagcgaggaucuauugaucacuacacugagguuaucauaguuccuuaacuuguccccaaacugggaaccuuaacgugucccaaacugggaaccuuucguuaccuugugccugcuuccuggcaacuuuaugcuugccucuauuuuauccgagguccuucccaaacuccuggguuacuuugugccuacuuccuggcaacuuuaugcucaccucuauuuuauccgagguccuucccaaacuccuggggucgcaaguuucacucaccgugaacuuacccugccggcaaccacugacugcugaaaguucugaacucggugggggagucgguuccccguacgggccaccaauugucacgcccgcucucgaccagcaagaacgacgcgaccaccaguccuucuaacagcaguuuauucagucuucaucuuucuucuuucucuucaucaguaccguuccccagcugaagaguucugaauccaugccagauccuucucaacagucuguuuuacgggaaccuuuauuaaccgcuucuuccccguuaugcaguucugaauccucccuguagcagggggucuucgcucuugccugaagauguuucuuuucccggguuucagcaccacuuguugcgucugcucucucaacuggccaggaagaacgacgcugcuacaggauccuucugcacacguuuauucaguccuguuucuucuuucucuauauuucccuuguuuauaucucccuuguuuauaucucccuuguuuauauaucucccuuguuuauauaucgccuuguuuuuauaucucccuuguuuuuauaucucccuuguuuuuauaucucucccgaacccugggccucucacuccuuuuauacucucucucauccacgaaccgcaggccacgccaccucaccaggcacgcagcuucagcuaaucagggcagcaggggcaaaucuccaccaaauuggauucaccuguauccugguacaccugugcagcacucaagauguuuguggcuuauaugaggaagucaggugcaagucauaugacuuagcugcagucccuggcgccuuugggacugccgccacacccgcuccccacaaggaguaauaagugauauauaccuuuuccauugagccaccuugcuacacauuucuuacauuaacagagauagaucaccuacaauauuggugggagaagggagggaaagagcugaccuuaugugacauuaccuacaaugucugccuaccaggaagggucccuucguggaggcugugagcuauguagcuaugugagcucguccccucuugaugcucacuugauacuuugugucuuccagugaccuacggcaugaugagcuccaauguguacuacuacacucggacacugucacagcuauucauagacaccccagugucgaaaacagagaaaaccaacuuuaaaacucuuucuuccauggaggacuucuggaagguauucagccaugacuagaaguacacccuugucucugugaauuacugacuugguauaguaaauucaacccauaaguaucuucaggagaugugaguuaugugaaguuauuuagaguuccuguccccuucaguauucauggagaacgcugaaagugcuuuccgcagagaugaacguuuuacaccuuuuauuuaauuccuauaaugaucuuaucuagugcauacugaugccguggaccccuguuuguaaacaaugcaggugagauucaggguguguguggucacauggcuagaaaagaccuggagaugagagagagagagagagagagagagagagagagagagagagagagagauagauacaugguagcugcuucuugguagcuuacuguucucucaaucauccauaagucuguaaaugaugacugagaauuucccuaugauccaagucccaaguagaaguuugggugucauacacugcucuauuuuuugugauuugugucuuuguuggcaguggcauguccuucuccccuucccagcuccacgaacuaccuaauaagacaugaacacauuauuucaaaggucugcuacuguaaaauucagcccagccucuucuccaauucuaagcucugacuugcagacugugggcaaugacuaacauugagaccgugauaagccagugcuaaaauggcaggucgauuucaguuacuuugaauaaagcaccguaaauccucuagaguagcuaacuaucacaccuuacugagcugaucccaugauguggugcucagaaucuaggaaggcuggagaggaaaugaaaaaggaaguuauuguuucucccagagaaauaaucuacagcauucuuacuaaaaccccgaaggcagagcccuugauuccagacaggaaaugcugagccacugcaucuuuugauaugugaugcuugucauuagaacccacagugguccaacccugaccuuccccuaccucuguauggcaggucccuguggauacccugguaauacauggagagguuguuacaucuguucucccuagaagaagagccuuuuguacaaacaugaagcaucucacauguaccauuccaugucaguaaaugcagagaggaggggcggggccgguggacugacucuacauguagcaaaauaauacagguagaaaaaagauccaguacaaaaggcaauuaauuggccuuauauauauauauuuuuauauaacacacccaucucaguugauagucccagcacagaaaucagauauauuuuuauauuuuuauauaauauauauuuuauauuuuauauauauauuuuuuuuuaaaaauauauauuuuuauaaaacacacccaucucaguugauagucccagcacagaaaucagauuauauugauacugugucaggugcuaaccacacaaaggaugaauuuuccaaaugugggaaccagcuuaaggaacccuacacaagucaaauaacucagcaaauaacaguaagauacaaacccaagucuuucugacaacauagacucccucaguacuucugcuugcucuuaugauccggguagaagccagccagccugaguuuggaaacuauccaaaaucuuuccuugcaguucaccgaaggcuccuuccuggaugggcuguacuggaaggcacagaccagcaaccacacgcaagcugacaaccgaagcuuuaucuucuaugagaaccugcugcuaggagugccgcgucuacgccaacuccgagucagaaacggauccugcuccaucccucaggaccugcgagaugaaauuaaagagugcuaugacgucuacuccgucagcagugaggacagagcuccauuuggaccgcggaauggaacugcgugcguaucugugacguaugccagugcuuaucugugacguaugcccagcgcaugcguuucacuuuucauucaucuguucucagacaacugaaugguaggcucugugacauaugcccggugcguaucugugacguauguguguguaucugugaugaaugugugggugaguaugugugacguuugcccagugccuggaguucacuuuucauuuauucauucucagacaacuuuaccaaaaagaugccuccagcggacuugggucaaguugauguuuguuccuuguuuucucuaacguauuuaccuuuuuguuucuguugccuguuuucaaaaugacugaguuguucaccauacagcccaagaaaaagccucuagaaguuuuauuauucaguauuauuuuuauaggacaaauaagauuauccuauaaauugucuuaguaguucuuacaaauauuuuuguuugggguguaauuguuuaaauuucagauuuaggggugcugaagagaugguucagugguuaagagcacuugcuguucucacagaagacacuggcuugggucccaaaacccuaucaugugacucacaaccaccuauaacuccagugccaggaugcccucuuuggcccugugguacccauaugcauguggcacacgugaacucugacacacaugcacaccuuauucauaaauacaucucauuuacccuucccaaacacuucuaagucaggugucaucuccuaucauaggaaacaaggggagacgugugaguaacugaguggauaaucccucuuggcuuacaguuucauugcagcuuuuguggaauguagacauugcaucagucaccagacagggcucgguggggugggguaggugguagcauaggcucuagcguggguuccagacucaagcucaagcacacugggcacaaaucaaacuuacugagccucagggcccuuguucccaaacugugacccaugacugugaggauucacuaagaaaaucaacuugacguacucuuccaagcacaccauuuuauccuggcaggcaccagucaucuuccugguccuggccagccuuucacaaccuuuaccuguuguuuuuacuuuucauuagguggauguacacaagugagaaggagcugaaugggagcagucacugggggaucauugcgucguacaguggagcggguuacuaccuggaucuguccagaaccagggaggagacagcagcccagcuugcuggccucaggaggaacuucuggcuggaccggggcacgcgggcagcuuuuauagacuucucgguguauaacgcaaacauuaaccuguucuguguggucagguguguaucacgggcucuccgcccugcuaucucugggugguuaucugcacaucuauuucuggagaugggcuuggaaaacuagcccaugcaggugacugaaggagggaccaagaaucaaggcugagaccagggaagugugggagcugcaggccuggggaggaagagauuuggaggagggauauaagagccugucaccuuaggacuuggaaagaaccuuagcucuggucaugcuuggccgguuccuagacccgucaggugacaguuuguuuauuguuaaucauugucuuguugacgaaugguaguccucugucaccaaguucucuggcuaucaaaccuuggcgcucucacccugagugucuccacuucuguggguagaacuuggaaaagucgcaccagguuugccccauagacugugaugucgcugccagggccaguguuggaaacugugggcaaagauucugcuguccugucucaugcauucagcacugugcucugggacauaugggcaucacugacuauuucagucuguuugguuaugucggaaaucuaaacaaaagcacucgaaaagccugcauucaacaaugaaaagcaaaagaaauaaacuguguguauuuuaaacaguuaguacaguuuaaaagacuugagcaagguaagaguuagucaguguucacccuagauaccacaacagcaacaagcaagaccacucacauacauucccucaggcaguaaggacacauuaguauuuugugauaauuuucacacuaaaaccaagugggucucauuagaaacuagugagaguuuauuguaacugccauuaagcuuuccauaaugaucccaauggugauuagaagaggauuccaauaggcaggugucuuagucaggguccauauuccugcacaaacaucauggccaagaagcaagcuggggaggaaaggauuuauucagcuuacacuuccacucugcuguucaucaccaaaggaaaucaggacaggaacucacccaggguaggaacuuggaggcaggagcugaugcagaggccacggagcgauguuacauacuggauugcuuccucugacuugcucagcuugcuuucuuauagaacccaggaccaccaacccagggauggcaccacccacaauaggcccuccccaacuugaucacuaauugagaaaaugccuuacagcuggaucucauggaggcauuuccucaagggaggcuccuuucucugugauaacucugacacacaaaaccagccaguacaacaggcaacucugacagucuagaaaauguuuaauugcaggaugucuccaguguuuuguuuguuugcuuuucuauauucucccuagaauucaaagauggcacugucagggcaauugcuucacuucuuucuaagcucccaguugugguuaacaaguggagagccucagugggucagagauacucugacacacaggggccacuugcuuaccucguguuucacgaaggcugaaaacggguccagugcuuuuaguauuguucuggcugccacuggugcuugccaacagauagcaaauuggugaagaggaauucccaucuuccagaguccuggcuuugauucagucauugcuggaucccguaugugacuuagaagcuuggguucuggguuugaccaccgucccacaaugaagaacaucacaauaccagacacacaacugacagcuuuugaaacuacaggguuacugacucucaacuuuaguuauauggaagguuguuuucauuauugaaacacuggacuuucucagugugacaccugcacaguggaauuuggcaagaaaaguccccaguuaaguccccaguuagguuaggaaugcaguaaaaaccagugcuaaaugugugaauauaaaucacagacaguccuguuccagacaguaggugaguauggagugucugagacacccccuugggaagaggaggaacuagcacacugaagaacuaauuagaugccacuuggucacugaaugaaugagcuggucugagggcaggguuagcuacuaaaugcaugcccugcuuucaucuagacccuaugugcuucaguguggcuuacuguaucucuaguuucuucccgugucuagcaaaauggcuuacauuuaauggagggucuacaaagacuaguuuguugaugagcuauuuguuaaauacacacacagacauacaaacacacacauacauacacacagagacagagacacacacacacaacacagauacacagaacacagacacacaaauauagacagacaaaccaacacacauacacacaaacacacacacacagaaacacacaagcauacacagcacauauacacaaacacucacacacauacacacacacacacacacacacacacacacacacacuuaguuuagcaguuugaagaccaggagagucaaaggaagggacagugggugggaggcguccugcaggaucggaggccuagaauccugacuccuaagcacacacuucugugaacacggaacaagggucaggauuccccagcuugugguaacccgagauacugguucucaccucauagugcagggacugaccagacagacuuccuuucuugagucugucuugcauguuaaccuaauuguugucuuugcauuguagguuauuggcggaguucccagcaacggguggcgugguacccucuuggcaguuucagccuguaaaacugauccgcuaugucacagccuuugauuucuuccuggcagccugugagaucaucuuuuguuucuuuaucauuuacuaugugguggaagagauauuggaaauucggauucacagacugagcuauuucaggaguuucuggaauugucuggauguugugauugucgugguagguuggagaaaaacgccaacuucccugcuuucucccucauuuccuuucuguauucuaagagcuugcuaauuaguagucuucgauuucaguguuggagaucuugauaguuccaguagcaaaccuaaaauuuucuuuuauauuaacuuuuguguuauacuuuuucccuucauuuuguaugaaccuacuuguuuauauuuaugauauuuuuauugagcucugacuuagucacacaaauaaguaauuuaauuuacuuuaaguacuuuauucuuguuauuuacuuacuuuauucucaucuuuguuuuuguaacaagauaguaauuaaguaacaaaaauaccaaaauuucuauguuuaguauggcauauaagauuuguaggaugaggggcuggugagauggcucagcagguaagagcaccugacuguucuuccaaagguccugaguucaaaucccagcaaccacaugguggcucacaaccaucccuaacgagaucugacuucuucuucuggugugucugaagacagcuacaguguacuuacauauaauaaauaaauaaaucuuuaaaaaaaaacccaaacaaacaaacaaaaaagauuuguaggaugaaaugugaaaguuucuuuuuuguaguaauacuuuucugccugugaaaauuauuuuauauuuuaagugucaaauuaugacaggaauaaacaaccuaaaauuuuuuguauaauacaggaaaccuccuauaguuuggaacuccuauaucacacaguccagagggaacaaaauuuaaaccauauccauaagucacauccauugcuucuuuucagaguccuaguguaaaaaugaauuuuauaagcuuuuccuucuucaguagcucuucugucuucuugcaucuuuagguucaugacacugugccuaauugucguguguuuaagcacucuuucacauagcuggugccccacaccuugcauguccacguguccugcugucuccaaauucugggaggcucucuggacuccugagagaacugcacucaccaaugagcucugucuccucucagcuucuuccugcuaguauucuuuuccuuguuccaaauucaaaaauuacuuggcauuugugaagcauauaucaaaucuuuaucaaguguuacagaacauguuauucaaguguaaaagaacaaguacuuaagacguggggaggaaccaugagaacauagaccacauggcagcacugguacuagcagcagugauaacaaugguaguaaaauggcuucaacaguagagcccagggugugcgucacaccucuccaagugcuucucacagaagagagcucguuaaauccucaacgcugacucucauuggcucugcccucgccuaacugaggcaugcacauuugcacuucagaaacggcucccacuugaccuaaaagucuccucagaauguguucagugugcaacccaccagaugcuggugccucccacccuuccuguguucuuguaacaucacacacuucauacaagucaagguaacuacuuaaaccacucaguacuaaaguauuacuaauaccaagcaauguuacaaagacaauuaguacuaaggcaacuaaauggcaauuaauuacagauguucuuucaccaaauaauguccauguuaccaaaacucgucagcacuaaacauuuuaaaucuugaaugcugaucagugaauaaguuaacuguguauccuaauuuauugaauggauucaucauuuguggugcauguguagguauaauggguauagcuauagugaccugcauagaauuaaaaagauacaaauuaguagaauucuaguuuuuaacauuugaguauauuucuacuuacuacauaaaacuguaaacaaguguacuacauguuauacaaguacuuuuaaagucuaucaagaaaacuguauauaguauuauaaugcaguaguucauguuuauauuucauaucagacacauuugcuuauuguccguucaaacauuaauaugcuuucuaaccacucagacacauacagauacacacacacacacacacacacacacacacacacacacagaguuagguuuucuccucauacaccgugaacuuuguccacuuugaagauccuggacuagugguugcugguauagaguugaggguggucuucuggucccauagccacaaggguuugccagcaucccuuugaagacuuacuuucugcagcugguaacuuuagauuaaucuuagugcugccacgacucagucaauaucaucccaugucuccuuugaagcauuugcugccuaaagagagggaaggccaucccugcugcaccuccuccgcuaugucagcaaaccucugagagagcgcaaagagggcuucuguuuuauccagcugaaauuuaaguucaccuagagcccagcaucugaaaaaucccuuggcaguuguucccuguguuuuccuguaguuguuuuuuacucuaacaaauacacugaagacuccuucuugugucagcagcuagccauuuguccuagccaguuaaauuuuagaacuacugaaagaaauacuuaaaaagucuaaauuuaaauaauguuuauggcuuagcuucccugguggaaauaagucauuuacgcaacaaaucuacccuaucaggcgccuggcugugcucaaggccuuagagacacggggacacacaggacagcccaaccgucugcccuccuaaagguuguguucugguuuggggaugaaggucuuuuauagauagaagugagaauuacaaagaaaaauucggagugauuuaacaacacacauauccucaaaaacucuccuccuucucauucccuguuuuggaagaagacaaggaaagucaacgugaugcugauuuuugguggugguguuuuggguuuuuuguuuguuuuuuauuuaaaacaucuugacuaaauaaucaauuaucugggauuuggauaaaagauuaucauuggauuugcugacugacucaccccuuuucaaccgagucucaguacaagauaauuuagagccuccaaaagagaaaggagaauuugagcuucagcaggaggguguucaggaagcauaccugcauaaaaaacaagagggucuggcucuucagcuguaauuagcagcugggcagaaggccuuucagucugaaugugagcuuaguuuuguguaaucuccucuguguagucuguguauacagcugcgcacguguacucgguugauuucuguuccuaaggaaauguuggcugccggucguuugcacauuuagagcugauggcugauguuggcucaguaauauggucaguccucuaaucaguagauuaaaaauaggcauuuuaagguagagugucuauuucuuaacugaugugauaaguauaacucuuuuugucuuccaguuaucuguaguagcuauggugauuaacauuuaccgaaugucaaaugcagaggggcugcuacaguuucuugaagaucaaaauucuuuccccaacuuugagcauguggcauacuggcaaauacaguucaacaauauaagugcugucaugguauuuuuggucuggauuaagguaacuuaugucacauucuucauauauagaugcauugaugaugaugaugaugaugaugaugaugaugaugaugauuuacacagaucauuggaagacauagauuugccuuuuuaggcugauugaaauggccagaugagguugcugcauaguuugcagucauguagauggcagcuucugugaaccucccuguuacuauggauggaacaacuugccuuccaaauucuugucagaucugauccugugcauuuuguuuaaaacauaguaaagugucaugucccauggaucugggaccccaggcuacucuagaggucagcauuuaacaagauguggguuagggaaaggaacucagaaaaacauugggcugcaaaagaggggagggggggggagagcgggagugcgcagggggggggggggagaaaagcaggaagcacuuaauaaaaggacugcuuccugggaggccagaggaagccccgccccaccauggcagcaucagaagcucaucugaguggauucuuucccacucauucccugcauagaucccggagcguuucaggacagugaucccgaauucuggagcuacagaaaagcucagucuuugugaugcagcuggcaacucagguucagugguugugcugugcaaacauagccagcuccugguucuguguacaguguacauuuaaaugagguuuaacauaacuaaaacuucacuuccuccaccccaaaagucauguucuaucucuguguugcuaauggcgaccauauuaggaccaucacagcaagcucucaaaagcagcuuucagagaaggcucuuacccagcggcuuauguguggcccccaaaaacauggacccacauuaugcucuuuacauucucagucauuuauugcuuguucaagagaguccaucaccaacaccaaacuuuaucauaaaauaaguaggaguuggaguuaguggagucgcuuagugacagaggccuugucugguugguaucugugagacaauggguucugccccagaucuaaagaaugaaugaguaaauuaaauauaggaguuccaggcuggagagaugguucaccgguuaagagcacugacugcucuuccagagguccugaguucaauuuccagcaaccacaugguggcucacaaccaucuguaaugggaucugaugcccucuucucguguaucugaagacagugacaggguacucauauacauaaauuaauaaauccuaaaaaauagggguuucauuaguaaguaauacugaucauaacaauauagaaauuaaacaguuuguaaaagaccacuaaguaagaguaagagucuagagaguucucucuuaauguguagcauaaguauuguuguuuauuuauugcuuugccucccaaaacacgaccuuuggcuucuuccaggcaggagcuaugccugauccucccgugugcucugcacacagccuucuaccuuggucugcauacauuauacuggcaccuaagcugucagcuagagucuuagcugcuggacuuagauccuuguccaccugcucagugggcuucacaggcaggcucagcuggcuuccagucuggcuggugucuggaggcaaaaauaccaggauuaaagucacugaagauucaaggcaguuuccuguagugaccccuucaucaguauaugaugaagaugcacagaaacuauuuucugacuuuauuuuuugcuaguguucuuccccaauuccauuuuaguuuaguccucuugggggacauuauuacuuauuuaucagucacauuuaauuauguuuaccauauuguaacugugauacaagaugugagcaaaauggaggcagaagcuuugcuuagcucacuauugaggaggguaccuaguguuagguuagaacucaacaaauacuuuacauauugcacucccagcgcuggggacaguaacuaccuagcaugaucuauguacucaacaaauacuuuuggaaugacaagguagauauuccuagacuugaaagaggcacgaaguauaaguaaaucauuucucucuuacucuucuuuacugugaugaguuacacagauccacuuucacugguucacaugcacauuucagaagcacgaagcacccggcacaguauaguaucugucacugcugugccuugccaaacauuuuuuguaaucccaacgggaaaggcuguauucugacucaucaacuuuccauuguauucccuucuuguccuggugaauuugacucuucagggugccucaaacaaauggagucauacaaagcucaaggcuuugcaucuggcuucuuucacuuggcuuucaaaguccccgucauucaaucucauucccucuugugguagaagaauuccauugucuauguggaccacauugugucauccacucauugacuguccuugcccccucuugcagcucuucaaauucaucaauuuuaauaggaccaugagccagcucuccacaaccaugucucgaugugccaaagaccucuucggcuucaccauaauguucuccaucaucuucuuggcauacgcacagcuggcauaccuugucuucggcacccaggucgaugacuucagcacuuuccaagaauguauguaaguaucuguguagugaggaagaaaagauuucucugcacauguaugaaauugcccaguaguaaauuuuuuaaaaaucgucuuaaaaauagguuuaaucugagaugccaucguguucuuuacagcaagauaguccuguuacuguuugacgaacaaauguuaaaaaugcagauucaauuacuucauccacaaacauuuuccuacaaaagaaaacaagccguguugagauguugguccuuuuggggaagcagcauuuaaguagugaaguagaguggggcagccauggggagaacacuaguccaaagaucaagaucuucgccacauccagcccggguggguuuuaaacguccaguugcgggaggaaguacacaugagcagaugcuuagcccuggguucuaccccccagacucuguccucccuaccccugccccucacccccgacaaaaggaagcaauuucccugcauuucauuccuguugaauauuguugccugcaucuuagguuuccacuucuaggagacaaaacauauuucuaauauuguagaagaaacuaaaaucaguucacacaucuuaauuuuucuccaguguucucaaauauaccaaaaccaaaaccaagcuacuauacccugaauuacaguucugugccauucacaaagaagugaccagaugacuggggaaagagaagaucaugauaguggaagucaaugcagcuugguggacagggggccccaguugcuccugcuuauugaugaaagccaggaaaggaagugaugucacugccaacguuuagccacugugaccucauguuaagugacugaggaugccggcccuaugaacccuacuauuuuggccaucuuucaauguaccuuuuuguuaucauugcuauuauuuaaagauguuuuaacuucagaucaagugugacuauuacgaagauucugaguugcuaguuuuuacccagaucaugucuucuugcuauacaaaucaucuaggaauaagauuuacuauuaagcagaaaugguauauauaauaugaagcuguguuaucauucuagaaagcaccaucaauugauaguacaaguaauaagacuuccccaaagaggucagcgguuuuaacucuuggguggcucucuuagacuuccccaacuaugccagcauaugaaucaucuuuaguaagcgcguguccaccgcggacacuguuugccuuuggacuguguucuguuuucuuucccuagcuucacccaguuccgcaucauuuugggugauaucaacuucgcagagaucgaggaagcuaaccgaguuuuggggccacuuuauuuuacuacauuuguguucuuuauguucuucauucuuuugguauguauaauuuuuuuuuacagugaggugauuuaaacuuuauuaucuugagucaccaccaccuucucucuucucucaugcuugaucacccaucacuucaaauuaaccuaugaaaagcagaaaaaaaauguuaauucuagaaaacuguuuuuccauugguuuacaguuuuaagauaguuuauuuuuccuguagucuuuccauuaucuauauacguguaucuaaugacuguaaaaauaguuauaaaauguacaaauuuaucaaguucccaacauggcaguuugccucagugguaacugccaccuccuuccacagcauggugguacuuuuugccuucucagugucuugcugguaugacuaugcauuuuuuucuuuucuuugauaaaauaugaacuaacaaagcaacuuagaaauaggacgucaagaguugugguugggugaauuaucaggugucaagauuaagaugcuauuucaacuuuuucaagguccucaggccugcgcacuaccuacaaaaacccggcauguacuaacuuaaaaguaaaucgaacagucauuaggaauugcucuccaaauauguuuuaaaauaccuuccagucucuugauuuggaacaacuguuaccauuagcuuuaaauuaguaagauuuguuugagucguucuuuuugugacaucuuuauguucuacuuguccauugagcaugugugcagcaaaguuagcuuaacuagggagaaagcauauuucauccaaaugcuauuauccucucagauuuucccuucugaaaguuugagcaucuauuucagucacucggggucacauuuccaaggucuagccaugugucccuguuuuuggcagaugauacucccaaaguauccgguagccacugcugggaugcaaggggcagugugacucugcaaguccauucauucacacccugccuuuuuggccaguacaguggcuggguguuaacuuccaucauuaacugauccuuuucugucauggauuaagggaaaggagggguugucaaggcuuugaugcucucugacuguggguucugcggcaccuggcugucugccaagauuucuaaagcaugaaguucaucccgcagcagacucuucaguugaccuccaccacuugugaggacacacggugaugguuugaaaagcucaaauaggacaggaucacugugcuccacuagccaaagccaucuagcaucgagguuauauagaguccucucguuaagucagacacaagagcaggagaaaauucuccguuuguguguuuaagacugccuuuaaaaaguuauaucugccacugucuaugucuacuuagaaaucucauagaauccacacuuuaauucaugugugguggagcacaggcccaaggauuuauguauacaggagugcacaccugagcguuuguuuauguguaauggaguacacacccaaguguuuacguguaguggagcacacaccugaggguuuauauauaguuuauguuguuuuaauuugugauauccaaucuuaaacaauagucuuccuuaauuuauagagauuuauaauucaccaguaaaaugagagucuuaauuuucauucaugaguuacucguuaaauauuaccaaagccuauauucuuauacagauauuuuacauaauauauaguguagauuauaguguuugugcauuuggugauguguuacacaguagagggagccaugaaaugagggauagggcuuggacuuucucagguuucauggacucauggggauagcaggcauaguugaagauaccucuguuagcugaccacuguuaucagauacagacagcacacagaaagcuaaucugauauacuaacugcagugcucugagaagguguugcaaacagauggaaauauccauugccacuggggaagggaaugucaggcauuuguaaacgacagcagcugugaugaugagcaauuagaaccugucaccuguuaggaccugacugagcacagcaucgauuuucccauuaagggagguccugucaccuuuuucauuuauaaaugcaaaucgagggguuacagaggugguuugcuggguaaagcgcuugcugcucaagucugggagcucaagugugcauucucagaugccauguaaauguggcucaguuaagggcagccagccuauaaucccagggcucaggaaauagaggcaggcagaaucccuugaacaaacuggccagcuaaacuagccaaaugagggaucucuggguuugagugaaagacccuguauugauacauaagguggagguagaagugaguggggaaggcauucugugguugccaagaugagugauacauacacauaucugcaggggugagcaccacacauacauaucugcaggggugaacuccacacauacacaucuucagggaugagcacuacacauaccuaaagggaugagcaccacacauacccaaagggaugagcaccacacauaccugcaggggugagcaccacacauaccugcaggggugagcaccacacauacagaucugcaggggugagugccacacauaccuucaggagugcgcuccaaacauaccuuaaggggugagcaccacacauaccugcaggagugagcaucucacacacacauacaugcaggggugagugccacacauaacugaaggggugagcacaccaggggcccccuacacacacacacacacacacacacacacacacacacacacacacaaagaaaauaaaugcaaaacaaauuuugaaacuaagugggucagacaaucccagcacuucugaggcugugccagguagguuuuugugaguuugagaccaaccugauacacauauagggaaagcacuguuuaaaaagaaagaaagaaagaaagaaagaaagaaagaaagaaagauacuuguauuauacuauaaucucaaaaaauagacauaauuauauuuuuaaaaagucaaaugaggucuugggagguggcuuacuggggaagaaugaucauucuguaugugugagcaccugaguuugaaucuccagcagucaaguaaaaugacaagaauggugguuggcugugucuguauaacacccggcaccugccccgcccugagacaggggugcgggcaaguggauuacuggaucuuguugguuaaccaacuuagccaaugaaugagcuucagguuuagugagcgagccugucucaaggcaauaagagggagacaauagaaaaaucaugcacacaggcacacaugugcacucaccacaacacauauacacaggacagacagcauugugggcaggaccguguuugcuggaggagccucaggacagaagcagacagaaggcugccucauacuccugccucuugucucuaucaagaaagaguuacaaggcagggcaaguaaggaacugugcggaagccuaucacaaagggugagaacucccaggagagucccacauuuuaggcuuuucuuacuggguuuucuauaauucuggaaguugugcuucaaggugacauagauaugagcgagguucagcugacuugacaagcgaucuuucauuuucuuguggugugaggguucggguuggaagaucugaugugacgacugcaguugaaguugcuuuaacauguuggacgcuguugagcccagcuccguauuacaaacaguagacaggcugugcgguuccguugguuuucuucuuuccuucuuggguuuuguuguuugcuugcucuuuccuucaaucaacccaggaccaugcgcccaaaggagguaccgcccacagugggcuggacccucuccaaccaaucgucaaucaagaaauugcccccacagaguugcuacaggcuaaucugauagagccaguuuguuugagguucguucuuuccaagugacucuaguuucuguugagcugacuaaacuaagaugcacgagaugccugccucucuaagugaaacuuccuuccguaugacauaguggugaaaacauagcuuccgagaauaugagcucgaaacuuaauuaguggcuuccuaauuauucagauuggauaaaaaggugaacaaaaagcaugucucgauuauuauguugcuuucaaauauauuugaauuuuauccuuugauuuauaaacagaauauguuccuggcgaucaucaaugauucguacucugaagugaaauccgaucuggcccagcagaaagcagaaauggaacucucagaccuuaucagaaagguaggcuauccccuaauucccauaguuuuaugugcgugugugugucugucuguauauaauuuuuaauauauuuuaaucaguucaccaaaucaacguugauucauugaaauuauuugaaguaaugaguagguugcuuuauuucagaaauaguugaaaugcuuucuuuggugggaagcuuaauaccuaggcuaggccuuaaauucugaggguccuuuuauggucugaauucgauucuagaauaagcuuuuugguucuuacuuacucaguguucuggagcccugcguucacaacacgcuguaagggucucacaucuauuaccaggucuucugucucagucaucugaggcagaaggaaaagagucucucucucucucucucucucacacacacacacacacacacacacacacacaccacuuaccccuagccuucugugacagcuguagaacccgaagaaagagcuucuggaucaaggccacagcuugggggccuaagaaugucguccgcaccuucuccacaagcguguaaucacuguugugagcuggaagggcaggguagggaagugcuuugcucuucucaccgaggcuucauuuagccuaaaggcugaaacugacauagaaauagauaaguagugcaaggaugcaagcugucccccucauugugucaggugggagaguugcuccucuaccucuuccucacucaagccgaagcccccuugucuguaauuuuguuuuagucccuugguagaaccuuggacuucugucaucucggauucggcaccacaauugguaguguuuuacuacuuuguauuguguauauaagcauuucccauagcagaguuuugauauuuauaaaauucagcuauuacgcuauuuuauauaacaucaggucuucaacaacgggguucaaauuuguuuugucauaaaauauugugggcaacagcaccaaguacaaacuccacuguuagcuauguagccugcagauuaccacuuacguaacauguauaucguacucaauggccaggcucugugugacccuucguucuuuugcuguuuggucguucaacucuucuucaguucgucuaccaccaagcacauaguguugcucucuugucuccccugauaauccauguaauuugugcuuuaacgaauaggggagcuggagagguggcucagugguuaugggcacuccugcuuuugcagagccuuuggguuugguucccagaccuucacggaugcucagaacugacuauaauuccagcuuggggauuuugagacccucuuguacccucuaugggcacccacaugcaugugugcuugcacaugcauacguacacauaaauaaaaauaauacuuuaagguagaagagugaaaagcuuuaaauaaaaauaauauauauagauuuuucaagacaggguuucucuguguagcccuggcuguccuggaacuuacucuguagaccaggcugaccucgaacucagaaauccgccugccucugccucccaagugcugggauuaaaggcaugcgccaccacugcucagcucaauaauauuuuuuaaaguagaagaguaaaaagcuuggcugagauaaaaaugggccaguagagauaaacacagagcagagaaacaaggacauaaaggaaauggauugguggaaggaacaccucauugugggaagggagucacagccuccauuugacagauucaggcaaacagcuaaaacaacuuagugaagaucaguguaucccaaaauaaauaaugcacauuaugaugaaaaccauguuggagagagaauuauguuugcaaauaaauaucauguuaacuccagagggguuucucaguuacuguuccauugcuguggagagacagcgugaucaaggaaacguagcagaaaagcauucaauuggggcuugcuuacgguuuccuagagugaguccaugaccaucauugugggaaguguggcagcgggcagcaggcaggcagcagauggcagccauggcacuggagcugagaguuuauauauugucagcgaguagaagagagacugagaacugugugagauuuuguaggucuaucuaccccuagagacaggccaacaaggccauaccuaauagugaguguacuagcuaguuuuguaucaacuugacacagcuggaguugucacagagaauggagcuucaguugaggaaaugccuccaugagauccaacuuguuucuuggucaugauguuuuugcaggaauagaaacccugacuaagacagugagguaauaguccucaccgacuguggaccaaguguuuaaauauaugauacaauggagaccauucccauucgaacagaggaaauauuuuucacuaagaaaugagaaaaagaaaaaaaugucaggaacucaucuuccuguagggagaguaugauaauucaccaacauauagcaaguauguucagcucuuguuuaggcgaggugacagcaucauagaagacaagccauguucagaauucugguuauguuacaaagaaguucaacauuuuccuuuucagagcucuuaaugguuuaaguuucugcgcacucaguaaauauugggcuugguuuucuguuucugugaauguauaauucauaccaggggcauguuuaaaugcuuuaaugagggaauucaaggccauggaacaauuaauuuacccugugauuauucuguucacucugcacaauuucggccugauagcccugcuuaucaugcucagcaaaaugucucugcugugcuccuucagcuaagcaugagaccugcacucacagugacuggcaguuacucuaccacugacgaauugccuuaggcuugccucuaauuucuugaaagugcucagccuuauuucacugucuuuaagaaauguuuuuaccgccgggcagugguagcacaugccuuuaauaccagcacuugggaggcagaggcagguggauuucugaguucgaggccagccuggugaguuccaggacagccagggcuacacagagaaacccugucuugaaaaaaaagaaaaaagaaauguuuuuaccuauaacaaaagcccuuacuauuauacaaaaaauaaacaagccauugcugcugcccuuuccucuguguucuggggagcacacagcuauggagugcauagugggguacauauggaguacagagugggcuacaaagacauauacuuaucucuuuauauuucaaauguaaacauauacauauguaaauaauauggaagagauuccugauuuauugaacauuuucuucagguuuuauaaaaaacugagauuacacuccuugcuuucaccaauacauuuuucuugaauagccaucaucugcuaagcaucaaacuuucaauaguuccacaguaacugaaagacaaaauucaaaaggggaauaaacaaaaccaugucauuuguuuuucuuuucuuucucuuuuuccaauagggcugccaaaaagcacuggucaaacuaaaacugaaaagaaacacuguagaugccaucucagagagucuccggcaaggugguggcaaacugaacuuugaugagcuucggcaagaccugaaagggugagggccaugugcuaauucuuggugaugagaggauguuucagccccaaguacugguaaaaaauguuuuucauucggggaagcagauauuuuccuggaacaugcuauaugucucccuccugcauucugauguuucaguguuagggcuggaccacgugcagaauaaacucacuucaguuuucucaauaccuucaggaagggccauacagaugcagagauugaggccauauucacuaaauaugaccaggauggcgaccaggaacugaccgagcgugagcaucaacagaugagagaugacuuggagaaagagagggugagcaguuuaggggaugacccuauucagcaucucuauauauuaauuaguccuuucuccucuucucucccugacacccucagugcacacauuaguagccuauuuauucaccuggcuuacucauacaaguuauaauguugucaauuaauacaaaauguugucaaguuaugaaauaaaaaaauguaccguccugaugacaagcaccccacuuucugcuugcccaagaccuugguaaacauuuuuuucgaggucuuggucuaucugccccucacuggaagaccccauauucuucaggaggaccuagacuuggaacacagcucuuuaccacguccgaugagcagcagaaguuuccccagaagccuggaugacuccgaggaggaggaugacgaagacaguggccauagcuccaggaggaggggaagcaucuccagugggguuuccuaugaagaguuccaaguguaaguaccaaaguuuuccucagguuugugcugaccgggaucagaaggagaugauucagcuucucuugacguuagacauuuacuucuuuucaugacuaaugucauuucuuucaaauaaguucucuaguaucauucuuuuugaaagugaucuccaugaucagaaguuagggaagcagagaaaauguuacuauccuccacguucccuccagccagaauugucuuaacagaucucagagcccuuguaaccauuuacguguguguugguguguuuucaugucuuacagccuaacacaggcucugucauugaggagaaugcucauccugcugcugcucacuguucuguaggugccugucaguuucucaucuccuguuucuguguugauuuuaugccuguuuacuucuaucugcuuuugaaaguaagguaaccauaucuaauauuguuauucauuugugccguuaauuugagaaaguucugcuuagugugauuugaagcugucaguugcauacguguuuguaacgaguaagucuuuaauagauugggccuccugucaauaugagauuuuuuaaaaaaaauacguuuuugucuaauauaacuggagccacuccguuccuuaccaucgcaguuugcaugauauuaacaccauggcccuuuauuuucaacaucuugcaucuuugauuguaagauaugugucauguaggugagguggcucagugauuagagaugcugaagaccugaaugugagccugagggcucccaugguggaaggagagagcccaguggccauagauuguccuuugaucuccacacacacuccacaacaugugcacacacacaguaaauaacuguaauuaaagacuaagccgugugggcaucauagaguuggaucuccuuuagagauugcugaguuuugauuagauuguuucacucuucacaguuugucauuauugaugccuuugcacuucuaucugcuuucuggggucauuuguacuuaaucuugugagauaaagaaauauuaauccugauuauguuuucucucuuccuuuuguauuuucuguugauauauauguauaucuguguauauguuaugcuguuuuaacuaucauugucuucaaauuugucuucuggauucagguuaccauucaauauaauuuccuucccccaauaaaacuuagcucccacccaccuccuucacugaggaguugucaaauauauuacauuuuuguuacagguccaacaaucuuauuacgugcaagucuuacacagcugcuucuuaacugugaaggaagaaauaagucguuuauguuuauuuuguacucacaugguuaccuuuauugguguucauuuuuaaaagucaucguucugaugaauguaauuaugcuuuuagucugaaguuuuccuuaaggacuuccuauaaaggaugucuccagcagggaauucucuucaguuuccuuuacuugacuauauuuuauuuccuucucauuuccuuuguuguaucugaugagaauguagcucaaugugauucuuugaacauuguagaucaguguuuucuuggugcuuucauuuuuuucuuuucucuuuguauaccuucaccauguauccagaugugccucucugaguuuuaugaguaucuugaauuuguaguauuucuuaacaaaccuguugaaaacauuacuugaagaaauaauugagcauuuuuaaaugccacaaguucuuacuuuucuuuacuggucuuuuuaauaaaugauuuuuaucugucaugugauuguaagaaaauuucuauaccuuuaaaaggauugagguuuuaagaguaguuuugagugggcuggagagauggcucggcaguuaagagcacugacugcucuucccgagguccugaguucaauuuccagcaaccacaugguggcucacaaccaucuguaaugggauccgaugcccucuucuggugugucugaagacagcuacaauguuguacucacauacaugaaauaaaugaauaaaucuuuuuuuaaaaauccuaaaauugugcgguccauaaugaaaaagaggcagagaaggcaguuuaaaaaauaauaauacgaacguaguuuugaacagcuaucccuauacugucaauugagaacugagcguugucuccagggcuugcagccagcgacugaacacugguccagcauauucagcagcucccuucaaccacuaggaucacggagagaggagccuggaagggagaacucaaaucauuaccauuugacauguuuaaggcaguuaaauauuuguauucaaaauggugagaugauaaaacagcacacgacuaacaguuuuauuuauuuaugauuccauuucaugaaagauugugacacaguacaauuuguguuguagagaugagcuauaauuuauuuccaugaguucccacuggguguugagcauagcuacuguccaguguggcaguauuaaaaagcaacucuguguaugugaugacuguguuuguagcacaugaaauuuccucuagaacuuuuccuaaaaacgguacuugugacuaaagguuggacauagauuuuuuuuuuuuuaaagucuuugacacaauuuuauuggcgagaagaauggaggucauugcuccggccuauuacaguuuaucaauaaaucuugugaacacguagagaguguuuugaguuagccuauugguuaagauggaacuauggucaggugugguggcgcacgccuuuaaucccagcacuugggaggcagagacaggaggauuucugaguucaaggucagccuggucuacaaagugaguuccaggacagcuagggcuacacagagaaacccuguuucgaaaaaaaaaaaaaaaaaaaaaaaaaagaagaagaaggaggagcuaugguggcauccccauuggaaaaaccgggugggcugaggagacagagacugugacaggcucugcccacuguuguccccugcagacuggugaggcgcguggaccgcauggagcacuccauuggcagcaucguuuccaagauugaugccgugauugucaagcuggagaucauggagcgggccaagcugaagagacgagagguguuaggacggcugcuggauggcguggcugagguaaacagucaugagcuuaagcugacagguggacaccaaggauggaaauguucacccauggcaauuuuuagcuggaaguauugaagaagaguaaaagcuauuuaaggcuacauagagcuacaaauuauauuuauuaacaauauaauauuaauguacuaaaaguuaugaacauugcuuuuguucccguuuauuuuuagauauuuuuuuuccuucugugagcagaagcauucuuuaguucaguagaccccauaaagguugucaucacugaccaagccaggucugucagugaacagcgucucaaaggagggagggagggaggauugaaaaggaagaaaaacaauuagacaaaauuagagcaugacuccugccaguacugagacugaagcagcuuuauucuuucccagucugcuuuuauaucaucuagguacauccaaaaaacauggucaguucuuagaucaaagacaaaguaaucaagcgaaguaguaaacaaggagaucacacaagacaguaaucuagcagaguaguaagcaaaaggaucacacaagggaauaauuaagacaaguagagagcagagagaucacacaaggggcaaagcaguaaacaaagccccauggccaugguuuuuaacauucuuaucugagccuacuuccuuguucaagcccagugacaaaugccaaauuccuagaagcgacaccaaaaacucucaacacaucacauuuuguaacucuuaaucccgugcuuuucuuccuccauauauagccuuagaucaaauaguaaucagcaggcaugagguuccccuuccucugagagcgcugccauccggguagaagauaccgcugagugaacagucaucccacuggcucagaauuguuaucguuuacuguucccaucugcagucuugaguuacuauagcucauuucaccuaaaauuucuaaccccuucuccguguagaauauauaacguacugcacacacugcccugguuuccauuguuucucuaaaucccuugucaggaugcgcgacugggucgggacagugagauccacagggagcagauggagcgccuggugcgggaagagcuggagcgcugggaaucggaugaugcagcuucgcaaacaggucaugguguaagcacacaagugggacucgguggccagccccaccccagaaacccgcgcccuccuuccucccagucugcagagggccuggaagguggagguggaaauggaagugccaacguccaugccuaauaauccacacguguuuguguguuccugagacaccgagagguggcuguccaguacgacaaugauaaguucgguauuuauauaccccggcugcauuaugaugcuggucuuugugaccaauuguuauaauuuucugcacuuuaauuuauuuuacguaaacuuaaacccgugguucaaggaagguuugucuuacuuuucucaugugagaaaucuagguguaaauauugaguucagaaagaagaaaacuuugaaaguacgcugauuugcugcccugcccgugucuucaggugacaguguuuggaaguuagagagccuucacuagucucugaguucguguggagccaccacagucugcugcauuaguccagugcgagaugcuaaggaaaaacaugacauuucauuccacugagguauaacucggagcuuacugcauaucuuucuucuaaggaaggaguaguauuucagcaaccuuucuggggugcagagaaaggauauguauguagccacugugcuaaaaugugugugaacaguugagauagaugcuaagcgccauaccaguuuguggcacuaagcauaucauuuaauuuuuguguuauuuagcuuuuguuucagauuuggcaaggaaagcucaaaagauaaauuauaagauaaaguguaggauuggagccgggcagugguggugaacgccuuuaaucccaacacuugggaggcagaggcagguggauuucugaguucgaggccagccagggcuacacagagaaacccuguuucgaaaacccaaaaaaauagguaggauuggaaggggccuucaauucuuacuacauuugacuuuucaauuauuuguuagcauagaaauuucucuauuuuucuuuccuaugugucucauuuauaaccaaauuuaauauuaaaaaaacuaauaagacaaacacugaauauuuucacuguguagugaaaguuuuaacucaucaaauauguacaugggaagcaguauuuuaagaaaguuuugaggugcauaaaagcucuguaaaaguagaggucugguuuacguuguaucuugaauauucuuaauaucuagaauauucuuagucauauaucaggauggagucauauaaugcaaauuuaguucauuuuuaugugaggggccuuggguauuguagguuuauauauuugcagaagagauccacuaaaaguugacuaucagcaguaagagagggucucacaaaauuuauaggagaaaucuauaucucaauaucauuuugguuuuugugucugucaaagacagguuuucacuauauacuccuggccggccuggaacuaacuguguaaacuaggcugcccucagacucccagagauccacuggcucucagccucuugagugcugggauuagggccagugugaccacagcaguuguugaauaacuuggcccuuugagagcuaggggucagaagaaacaaagccaagcugguagagaagccagagguagagaacaaguagaagagaauccugggcuuaguaccguauuugaaauucacaagaauucauugacuuccuagaauauaccaaaccucuccaaccucuaacagacugcugaguagacaggccuuuucucgucagcuuccacagaagcgaggcacgccauguuucccugauucugauggcugcacaucaaucauuuucuuuugaauaugcuacacuaauuuuuuuuccuuccuagguauuggauuuugcauugcagggguauuauuguauguauguauuuauguaugcguacuguacuguuacaaagugaacaaacuucaacuugaagugcauuaauuaugugguauccauguguaucgaccaugugccguaugccuauuauggucacuagaacaucuuuuaugaugcuuauuauuacaguguuucucauuuaacuuguaaacuuuuguagaauucuccuuuuuuucccuuuagauauaaguucauauauuuuucuacuuuaguccugugaaguuuaucccuagucaccuuccugguagucuccccucuguuaaggguauaguuaagauuucacauauacaagguucuuuggacaucaacaauuucuuaacuguaauaauguguacauuacuuaauaaagacuugacauaguac

SEQ ID NO: 2563 - RNA, 61643 nt, Mus musculus
gggacggaccaucaucuuauccaucaaucggccucaguacuccaucuucagauuuuuugauagccucaccuuaguggcuucagaaaaaauuauguuuuauggaccugcacaggaugcuuugaaguccuucagaucugcagggauggucaucuauuguuaugagagcuuuuucacucacaggaucugcaaaccagaacaggggaaaucagggaugcagacuuaacuguguguggguuucucaacuuuaaauaccagugguuaaauugguggcaggauuuguguuagguuaacaguacuggcuuguuauucaucuuccuucucuaguccugcaugcaugcuuguuucuuacugaacccuuuguugugcuucccaguuguggugacccucuuacucaacaugcuggcuucaggcccacuuauucaucuuuugaacagcuugggaaaagacuacguacagaugaugauuuucaguuuuccccuaggguacugacucuaagcugcuguggagaugucacucaacucaggagucuguucuaauuucagauucaggccuugcuuguggccuguagagacuauaauauucauaagacuucauauuuuugguaugccugguuuugucagagucagauuguauggugagugcuuuucauaaguucaugcagucagguucaucuuuuagaaauauggauacaguuauggaguagucucugacucuaaauauaggcuuaacacuuugauuuccagcacucuugaaaugugcaauauuuuugaaucuauagacucaaauauaaauuuagguggaauucaaauguuuguuucccaggaagacuacaaauguacacaucaagucuaugcagcagacccucugggucccuggucugcgaggaacgggauuucuuaggcaguugggcaaaggagucggaugaaaugacaauuagucacacacaagagagguguugaaucugaauguaauguuccagucgagcauccgacuuuuauaauacagaauaaauugcagaacaaggcacauugaauuuuuccaggugcaaaaggagugacuucaaaaggaaccagauaaauguauaacacuagagauuagcacagaugcaaggggagugacuacaaagggaauuuguagggaccagauaaauguuuacauuagauauuaacacuuucuaccaugcaagaguuuuacacuuagaguuaauugccucaggguaguuaacucuugacaugccucaagaauaauguagugucacugaccccaaaauucucuaggccucguuaauucuuaucuauaucuggagacuguccauuuucaguauaguauacuaauuugcucuuggcauggaauguagucuguaauacgaauuucuaucucagugagaauauuagacucuauuuucagacacugaauuaauggcuagugcuuaauuagcuacugaauggguuaagcuccuugcugcuaucuggagucuaagaacacugggaaaaggcuuuagcuauguuagaauacaaucuuaaaacgcauuuacuauaagguaaugcuuaauagagugcaugugaaucuauacacuagauuaauguggugaaaauuugaauauaauggguuagggaaagaaaugccauaacucugggaggaaaauuuccauggaacucuuauccucgugaaacagcuuccaggcuuuucgccugacaaaccgauccaaacuggagaguuggcuuucaccagaauauccaggaaguguccacguaaguuauuaaagauauguaaaugauaagccuuagagaugauuaaccggauauuucaauuuguaagccaaggaucaaugcauugauuuuaagccucuacuuaaaucaacagaguucccauaagcuuugaccaaucaugguuacaguuauaaacacuugcuucuaaagcuuuaugugagcuguuucagguaucacggcuagaaaucaaaaauacuugcagucaagauaauuauuguguuuuaaacuuuguuagauuaaacuacucuaaaaauaaaaacagcccaacauccauuuuaaaaugucugagcuucaucugcacguugcacagaguuugagugacaagacuggaaaagcuaucguauuucuaacaaaccuugaaaucuacagcaaaaaggacauaauguucagagaggacaugcaguguuuugucuuccuaggucaguuaagaugcaugacaaugagaccccucugguaaauggucuguuuuagagaggccauggagaguaucgagagaauaaacucuaaccauccuacacuuuacaggaauucaacuguggaccuggggcuauguauggguggugcaauacauaaguuauaauugugugggauuuaugcuggguaccuuauugucaacuugacacaagcuacagucacuucagacuuuguauaggaggagacaggaauucacugucuccuggcugaaugaaguucuuguucuccucugguuccaggucuagaauucauugcuucuguucuuguacaugagugucuacugaguaagcaaaaugcugacaccacguuuaucuccuugaaacaucugcacuugaucuuagccaaaaggccgagaagcgauaccuugaaacaucugugucauuaggaagccgggguuuucuucuacaggaguagcaauacuugauccauacuuuuccccuuuguagagagcagcauuauagauuuagaaaugaauggcauuguugugucuacauaguuggaucacaguguugcucugagaaccugccaagcuuauuaggacaucuuccaauaugcuguugaguagauguugcagcuauccacaauuggauuguuuuuuaaauuaaguaaaguaccagauucaagacaauugauggauuguaauaauguauaauaaaauuguaaucauaugaggacuaguaucaauuaaauaagaagaaauguuuaaugauauguuuuaacuauauguuuguaaauggaagcaacaguaaauauccugaauuaacuuugacauuaccuuugaguguguugucucacacucguaugauguguuuuaacuauauguuuguaaauggaagcaacaguaaauauccugaauuaacuuugacauuaccuuugaguguguugucuuagagaugugcuggugaagaauucuuggagacacaggguuuccaucucucaucauggggcuccaacucuuaucaugggguuuguaagagaaucaccugucuuuagcuuguauaaugauuauccucuuaacaauuaauuauguacaauugcuaccucuucagaaaaggauucauuguuaaauuaccauuuuugaggguuucauauuuaaauuucuauuuuguauaaauugucuugauaagaaacagaaaccaucuucuuuuucucuauuucuuaaauuuguauuuuuuuguacuguaaauucagcaaauaaaccugcaacugauauguacaauggugggaauuguugaaaaauuauuuaaagaguuguaauuccacaguaucuuuugagcauuuauauucauacucgcauaugcuuucuugguaccaauagcauggguggagggaauuaagggagcuuacagcaguguuuagagaccuugcacugucuuucuugucugcuccaaaagucuguguccuugacacucugucaccucagguccaacccccaauggcagguaaggucagcagggaguuccacuggacaggaaacaaugguagugucuuuggauaugucuuuugaaauggccuuuaguuguuuguuuucuccuuucgauuguuccuuccuccuuuaaugaugguuuuacugcugugaacaguuaccaugucaaagauaacucuuacaaggacaacauuuaauuggagcuugauuacaaauucagagguucacuccauuagcaucaaagcuggugcauggcaggagccuaggcuggcauggugcaagaggagcugggaauucuacaucuuguuacaaagacugucaggagaauacuggcuucaagguaucuaggacaaggaucuuaaagcccuguuauucauggaacagaaaaacuucaugucauucucauauaauacagagcuucacaaugggagggcagcaagaaauuaacagaagcccugaaauacauuuauugucaacugagacucaaaaagaauagauuugagguuguagacgggcuuuaaaauuuacucuucacgaagcuaaaauauuguaaacacaauauggcuacauaauuuaaaaucauaucacacagauaugugcccccaagggcccugauucaguucguggcucuucugggacucucagcuaugccuggauguucaagagucagaaccuccccccacccuccaccccagaacugggacacgucacagaccaggaacucccuaaccagcucuagccucggcccucaucaaagacugcauuucccaucccugagcagacucuuggcuuccccugaagcccagcaccagccaggcugcagaaaagaaaaaaagagucuagauauuuauuccccgguacggagcccaaacaagcugugcccaacggaagugaauaaauggacugacagauucacuguccaaucagagucuccauaugcgccugccagucagaaaaggaggaggguucuuccggaaaucacauugcagguucugcgagaguuuacgugauuuuguguguuguuuuuucaacucaacugccgaguacugagggaagcucaggaagcucugaagauacagcauggccagcacauccucacucuccgcaaaggugaggagcauauauuccucgguucagagcccaaagaggcugaaaccagcggaagugaauacaugaacugacagauucacugaccaaucagagccuccauacgugccugccagucagaauaggaggaugcuucuucccgaaaucauguggcuuccaugcuauugugagucaauugguguguugugcuucgaccucaacugcugaguacugagggaagccuaagcaagcucugaaauugcagcauggccagcacaugcucacugcccacaaaggugaggagcuggagccauugugguggguccuacucggggcugggcgggaaccggcagguuuaugcagccgcgugugaggucucuuaguguaagccauuccuagacccagcaguggcaucugaauaacuucccucucugggcugaaucugcacaaagcauuugaagcagggccuuguguauagaaacauccuugacaggaugccaguggcaggcaggcuugguuccucuaguagagucuacaaguucuucuccuguaucauuuuuuguugugauucaucuggaguuaauuuugucuaguuguaaaaggcaucccaucuguugggugacugagagcacguucuuucaauaugucucugcuuuuaaggaaccaaaaaauagauccguuaauuuuuguacagcugcaccuucagccuuuuagaaaacuguuucugagacaagcuauguugucacgugcauuccagucucaugcuccccagggcaaugacccugcuuuccuuuuuauuagacuuucuuaguuugaauguuacauguauguacaagagcguuuuaaaauuacucauuuaaguccugugauuaacuguccuuugcaguggaagaaaaagugcauuccuguggaacuaugucuucugccuucagacuagaacaggaggaauuguuuacuguguacacaauagggugaaacaauguagacaagagcuagcucacagacuaaaguuuaagggagucaucugcaggggucaucauucugaggcaaagugagugaauguuuuaaauuccucagcauuuauuaauucaugcauguuuauagaaauuguacagauugguggguauacaaguuggggauguucugugugaucaaacuuuguugauguaauuaugucagcugagaagcuguguguguaucagguuauagaucagcagguaauauuacacauaaggacaagaucauacaucaucuuauuuuggcauuuccucagcaggaaauugccugcucuucuugaaagucacuauuguuaugcauuugucccuuguuuuauuaccaccagccacaaugcauguuucauggaaauuaaguccacgguucaaaaguagauuugaguuucagaggguuuuucauguguucauggugcuugucaggaagcagacacuaaauugcucuuccaaguuguuuccuucguggguuucagagggcauggguuucccuaagucacaaagaggcaugagagacugcagagccauagccaccauucugaucuucuccaugcagagagaucuguagagcauggggccucacuguuugaaugaugaguaguagauugacagugagaaauauaacaguuaaagccacuuugaguuauuuuugugggaguuugugggguuuuuuuguuuuguucuguuuuguuuuuuaaguuucaauacacgugugcucauagguaacauuguucaaguucacauuuaagggacucuucccauauaaaggaucccuacaaccaaugcccuauuggucauaaaacagcagagaaugacagcuuaagcaauguccuguugacucuuucuccucucugauuuuaaucucuuacaacauugccauuugucagauuggugugagagcuucagccaucuuguuugcaguacagguugaaauugaaaauaugggggagaaagcacagaaucuagcaucagcauucaaguugaaaguguuuuuauaaugucuuguaauagguguuuggggaagcaaaagugagugccagcuuuuacaccagaguggccagauugaugagaagcaaauagcuaguacagcagacuguaagaauccagaaaguuguucuguuuggauguaaggagaacuuucugcccaugagucacaguggaucaaaaaguaaaaaugagguuaugaaaaagacuuaauugcuuuuguuugaauuuaaauaauggcaauaaaugaucauugagcaaaaauguaauacuuuagacaagugacccauuucaauucuucugaguaaauaaccaggcuuaggucgucacacauuuuugguucggggaauauauuuauaaauguuuaagaguuuuuuuuuuuuuuuuuuuucauucagauuuagugaguuguggggaaguuguccaaagaauuagucccugugcuuggguugcugagagcaagauguuuuucauggaaucagcauggguaguuuugagccauccuugucuaacaacucaaugaaauguaaccuguucccaacaccgaauccaccuugccuauaaaggacgagcaguuaagacccuguccuccauuagcaggaguggucaccagggucacccucagaguguccugaaaguucccagggcacuuuguuccuuuacaaaccugcaguugcccccuacuugcagcucugucucccugaacuauacucucuuccuacauccccccuccauaugaccccuaccacuucuuuccccauuuaccucagucuacccagagagucuauucuauuucugcuuugcagaaagaugucugugucaccucuccaucucuucucuuuacauaaccucucugggccugugggggauagcuucauuaaaauuuaccuaagagcuaauauccacuuaugggggaauguauaacauuacaucauucuaagucuggguuaccucagguagggugauuuuacucuagcugcagucaucagccuguugugcugcagucauuucauguugucauauuuuuagcagcugagugauacuccauuguacagacauaccacauuuguuucuccaguuuucagcuguggaacaucuauguguuuuuaccuucugucuaauacaaaugaagcuguuauaaacauaggugagcauguguccuggguugcuggauggaguaccuuuuucauuuaugccgaagacugauauagcuugguccugagguggaugcauucccaguuuccugaggaaucaugauacugguucccuuauuggccauauuugucugcacuccuauaagcaguagaaggugucacacuugcuuuauauucucacuaauaugaaaaucauuuguguuaguuaucuucaccauugugacauguaacauggacucacaaaguaguuuucauuugcaauuccauaauggguaaggauggugaacauuucuuuaagaguuucucagccauuaucaacagauugucuguugagaauucaugguuuaaaucucuacccuauuuuuuaucuggaguuuuugauuuuagaucaucuaguuuugugaggucuguauauauuuuuguauauuacaaguuuaucagguauguuuaaauuguacaaauacuuuucucauuccuuagacugucuauuuguccaauugucugggcuuugaccuuagaaaaaccucacuguuccaugagguccaauuuaugaauuuaucuuaguuucugcacuauuaguauucuguucagaagggugucuccugugacauugaauucagugagguucucccauuauacuucugucaggaucaaugugucugguuuuacuugaaaucuuuggaaaucuauuuggaaaugaguuuugugcagggcaaagaagauagaccucuuuccauacaucuccauguagaacugcaguguaacaagcaccacuuugcuaagccaagugugguccugauaggcccagguagacaugguuccugcccgugggacacuggugugagccuccaugaguguugauggcuguuguagguuuaaguaaggcuuguuuauguaaucauguacaaauuuucuggacccacuaacagaggacucuuuucucugaaaucaggauuucauuuucagaggaacuucuucccugugaaugcuaaugccuccaugcugguuagaaacugcuggaguccuggaauugaggguguagcucuguuacaucgaaguuguaaaaacugagauuucaggacagcuuuuaaggcuaugggaaaaaacucuaaauacaugauuuugaaaauauauaauuucucaacucagccaaaaauauggaugcaauaugaaucauaugaggggcuccuuaaggauucuaaaggaaccaagucaguuacccugugagccagcaagugagaaagaugcaaaggcagggugauaaaaaggcaggcacuuuccagaguucuaggucaguuuggccaggggaauggccagucccaggagugguaaaaaugguaauuugauggcauugcucaguugaacuggccucugaaguaugcuuaagaaaggcugauggaucccugaauucuuuugcauuguuaagagaaaaaaaaguauguuuccugugccuuaagaaucuagacuugugccuugggauguuguuuccugaaauacucaaaaggaaaccuugaauaaaugauuggauugauauggaaaauaaugauuaggucuggaguugacuugaguugagguaucuagaaaaauuuuaaggauaaaaagagaaguauugcucucucucucuucuuucuuucuccuguccccccccccccccccaggacagagagagaucuccagggaagaaacagaacauagagagcagcagacugaaaaagcugucucaagcagaacagaggucaucagcuagaauccacaguuugacuuugggucuuuuucuguuguuguuguuauucccagcaucccuugucucagaaccccuuaauggucuuguuuuuuucaauaugucuaguuggauuccuuaagaaacuccagguauccauaugugguuugaauuuucucugggucuucaacucuauuccauuaaucaaguugugugucuguaugccaggaccaaugaaaaaguaugauguaaaaucaaacuucuaggccuuuagacccaggcuugggaaugugaccucugugacucaaugcuggaagguaugcuaauuauaaaacagauagaggcauuccuccacccacccgcuuccuggguucaaggaguguucauucaaagucauccugacccacccugacuauugcuggaacccgcuaugcaaaugugcuaguguuaggggcucugagaaacugucuugagaaauaacccgcacaauuaccagguauuccuugugacucuugugacuuugcacuuccuugugacuugacucuuaacugguauuuuugguauuuuccaacaaugcccuucccacccccuugaguuguuguuucuuccuuuaaauacccccuuacacagcuacucagggugccacaguccucuaucccugagugguguaugaccuugagcccaagagugcucuugaauuaaaaguccucuugcuguuuucagcaagacuguuucuccugagugauuuggggugucaccucuccugagucagaacgugggggaguccucacguugugagucuuucacauguaguuauuuuccugaucccgauuguuguagcucuccuggauauuuguccugggaucuggaaauugucauuucauggucuguaaauguuuuuggcauuuugucaggcauuguguugaauuuguagauuacuuuugugaagauuucuauuuugauugccuuaauccuaccaauucaugagcacaagaaaguuucccaucuucuuaggucuacuucaauuucuuuaaaugauugaaauuuucauacaaauauuucauuugcuuuuuuuaaagugacuugucuuauuuaguuuuuuuucccaaauuuuuuuuaaaaagauuuauuuauuauuuuacauaaguacacucuagcugucuucagacacaccagaagaacuugucagaucucauuacaggugguuaugagccaccaugugguugcugggauuugaacucaggaccucuggaagaacagucagugcucuuaacuacugagccaucucaccagcccaauguugaccagguagacuaauugaaccauuauucauuauuuauuuauuuacuuauuuuauuuuauuuuugguuuuguuuuuuuguuuuucgagacaggguuucucuguauagccguggcuguccuggaacuuauucuguagaccagggcggccucgaacucagaaaucugccugccucugccucccaagugcugggauuaaaggcaugugccaccacugccuggcuuccaauuuuuuuauuugguauuaucuucauuuacguuucaaaugcuauccugaaaguccccuauucccucccccuacccugcuccccuacacacccacccacucccacuucuuggcucugguguuccccuguaccugcagcauauaaaguuuacaagaccaagagaccucucuucccaaugauggcugacuaggccaucuucugcuacauauucagcuagaaauacaagcucugggguacugguuaguucauauuguuguuccaccuauagcauugcagaccccuucagcuucuugggagacuuucucuaucuccuccauugggggggcccugugcucguucgaauagaugacugggggcauccacuucuguguuugccaggcacuggcauagccucacaagagacagcuguaucaguguccuuucagcaaaaccuggcuggcauaugcaauagugucuguucuugguggcuuauuaugggauggauccccggguggggcagucucuggauggucgauccucucauuucagcuccaaacuuugucucuguaacuccuucuauggguguuuuguucccaauucuaaugagcaggggcaaaguguccacguuuuggucuucguucuucuugaauuucacguguuuugcagauuguaucuuauaucuuggguauucuaaguuucugggcuaauauccacuuaucagugaguacauauugugugaguucuuuugugauuggguuaccucacucagggugaugcccuccagguccauccauuugccuaggaauuucauaaauucauucuuuuuaauagcugaguaguacucuauuguguaaauguaccacauuuucuguauccauuccucuguugaggggcaucuggguucuuuccagcuucuggcuauuauaaauaaggcugcuaugaacauaguggagcauguguccuucuuaccaguuggaacaucuucuggauauaugcccaggagagguauugcaggauccuccaguaguacuauguccaauuuucugaggaaccgccagacugauuuccagagugguuguacaagcuugcaaucccaccaacaauggaggaguuuuccuuuuucuccacauucucgccagcgucugcucucaccugaauuuuggaucuuagcuauucugacuggugugagguggaaucucaggguugcuuugauuugcauuucccugaugauuaaggauggugaacauuuuuuuggguccuucucagcccuucaguauuccucaggugagaucuuuguuuagcucugagccccauuuuuaaugggguuauuugauuuucuggaguccagcuucuugugcucuuuguauauauuggauauuaguccccucucugauuuuggauugguaaagaaccuuucccaaucuguugguggccuuuugucuuauugacggugucuuuugccuuacagaagcuuugcaauuuuaugaggucccauuugucgauucuccaucuuacagcacaagccauugcuguucuauucaggaauuuuuuccuuguguccauuacuuucgaggcuuuuccccacuuucuccucuauaaguuucacugccucaguuuuuauguaaaguuccuuuaucuacuuagauuugaccuuaguaccaggagauaggaauggaucaauuagcauucuucuacaugauaaucgcuaguugugccagcaccuuuuguugaaaaugcugucuuuuuuccacuggaugguuuuugcucccuugucaaagaucaagugaccauagguguguggguucauuucugggucuucaauucuauuccauuggucuacaugucugucccuauaccaguaccaugcaguuuuuaucacaguugcucuguaguacagccauaggucaggcaaggugauucccccagagguucuuuuaucauugagaagagcuuuugcuauccuagguuuuuuguuauuccggaucaauuugcagauugcccuuccuaguucauuggaagauugaguuggaauuuugauggggauugcauugaaucuagauugcuuuuggcaagauagccauuuuuacuauauugauccugccaauccuugagcaugggagaucuuuccaucuucugagaucuucuuuaauuucuuucuucagagaauugaaguuaucauacagaucuuucacuuccuuaguuagagucacaccaagguauuuuauauuauuugugacuauugugaaggauguuguuucccuaauuucuuucucagccuguuuguccuuuguguacagaaaggccauugacuuauuugaguuaauuuuauauccagcuacuucacugaagcuguuuaucagguuuaugaguucucugguggaauuuugagggucacuuauauauacuaucauaucugcaaaaagugauauuuugacuucuuccuuucccauuuguauccccuugaucuccuuuuguugucgaauugcucuagcuaggauuucaaguacuauguugaauagguagggagaaagugggcagccuugucuagucccugauuuuagugggauugcuuccagcuucucaccauuuacuuugauguuggcuacugguuuccuguagauugcuuuuaucauguuuagguaugggccuugaauuccugaucuuuccaagacuuuuaucaugaauggguguuggauuuugucaaaugcuuucucagcaucugacgagaugaucaugugguuuuuuucuucgaguuuguuuauauaguggauuacguugauggauuuccaaauauuaaaccaucccugcaucccuggaaugaaaccuacuuggucaggauggaugauuguuuugauguguucuuggauucgguuagcgagaauuuuauugaguauuuuugcauugauguucauaagguaaauuggucugaaguucucuaucuuuacugggucuuucugagguuuagguaucagaguuaauuguggcuucauagaaugaauuggguagaguaccuuuugcuucuauuuuguggaauaguuugugaagaacuggaauuagaucuucuuugaagaucaacugcaacugaggcuguacuuuucaccaguggccuuccauggucccucacugugacaagccucaucuguucuuaauggugucuuccugccuucaaaaccaauaucaccuuggugacucuuucaccuuaccaaguacagcuguagcagaaggugcuaucuuggcuaucucuggaacagaguaucuuuuugcucuuaccaaacacuucccagaagcuuucaccucagugauaccagucuccucuuaaucaccacuaaugucuuagcuccagcuaaccagcaucaauugucucaguagaccuuucuauucuugacucuauagccagagccacguggccaaagcuguugaguuuugcugcuuauuugggcuagaacauggccccuuuuucuaucacauuaucaccagcuuucuguuuuccaacucucucacuacauauuuuuggauuuccuggaacuuacagaguagauugaccuugaacucagagaucugcagggaucugucuccuguaaugcugucauuaaauguguguaccacuaugcuuggauuuaagcauuucuuucccuagaaccugcuuuguaccacauuggccuugaacccagagaacuguuuggcuuugucuucagagaucaauaguguguacaaccaugccuggauuuaaauuuaucuggauaggaucuuacucuaauaucuuuuaaucuguuaacagucuccuagaaugugggauucaguuccaauuuacuuccuggugcugcuuuaauaaucguaucauauauuuuauauuuauccuuucuaagcuugcuauacuuauucaaaaugcucuuuaugguacuuaaccagagaacaaugacucugcugggauauuuuugagacuuugucaaagcauuuaauauaaaucucuguaccuuagacucagguagacucuucagacaagggcaaaaagcauucacauucuucaccaaauuaccaggaaaaaaaaaaaaaacaaaaaaaccagacucuagaccacauacugaaauuguucuccacugagcccucuugggccaagucugcacagaacaaaugaauaucaccaagaagucauuccuauucuuccuaagauauuguauuaagccgaacuuaaagcauuccacugcuuuccaaauccaaagucucccaauccacacucuuccugagaaaagcauggucagguguaucacccucgugauagacaaacccuagucccugguaccaauuucugucuuaguuaggguuuugcuucugugaacagacaccaugaccaagggcacucuuauaagggcaauguuuaauuggugcuggccuacagguccaaaguuucaguccauuaucaucaagguaggaacauggcagcaucauagucuaggaggagcuaagaguucuacauuuucauuuaaaggcugguagcagaaugcuggcuuccaauuugguaugaugagggucuuaauguacacacagugacauaccuacuccaacaaggccauaccuccccauagugccaauuucagagccuagcauauauaaaugaucacacuaugaaacuguauauuuuaaaaaauaaaaauuauaacuaugaaaaauaaauauuuuaaaaauguauuuauuuuaugugaauacauuuuaacucucuucagacacaccaauagagggcuuuugaucccauuacagaugguuggcagccaccauguguguugguaucaccacaucugaaacccaugacaucacauaggggggaccugcagacacgccaaagcaacagccaccauauuuccagauuccacuugacucaccucccaccuuuaucugugauuacaucaucauccauauaugaagaaagcacucacccccuguucgcucucuucccgccauucuuuccacagccaccuugccucucucucuguguuucucacucucucucucucaauaaaccucauguggaacuuuuuggaauggugugguccuucugaagccaugcaauguaaaagaucauaacaaugugauugcuggaaauugaaaucaggaccuuaggaagagcaggcugagcucuuaaccucugagcuaucucuucagccagaaacagaaauuuuuauguaaaguauguaaugaagaaaauuguuuuuauuugguaucuuucauauuguaaaucagcaauuauuuaaaaaacagaauauaacaacaaacuaaauuauagauuccaagcccaaacuaagguuaguaaguacuguauguuaguucaucucaucucuaauaaugcugaaagauaauuaauauuuuugacucaaaaauggagaauuuuccuagauaaucuugcauucauugguaucaauuucuucaucuugucagugaggacuuaagcuaucaucauccagaugucauagcuaauaaaucugauuaguguugggaagaucagguugcaauccauucucagcuagacacugugguugaggcuaacugggcuccaaaagacaccacaucaaagcaaagcaaucaaacagaaacccauacauaaugagcaacuauaaaaacauccucaucagcucauugaguaaguaggauuuauggagaguaucucagaguuucuguugauucaacaacaaaagugaccaaaaagcaaguuggguaggaaaggguuuauugagaucaacuuaagcauuguaauguuuaucacauaaggaaagucgggacaggaucuaaugcaaggcagggaccuagaggcagcaucugaaggagaggccauggacgguacuacaugcugacuggcuucaccagaauugcucagccugcuugcuuucuucuuuuguaaauaaaauauuuauuuuaugcuuaugugaguauacuguagcugucuucagacacaccagaagagggcauuagauccaguuacagaugguugugagcuaccaugugguugcugggaauuuaacucaugaccuuuggaagagcagccagugcucuuaaccacugaggcaucucucuagcugcucagccugcuuucuaacagcacucaggaugccagcucagggaugacaccaccaccaugagcugggcacuuccccaucauucacuaguuaagaaagugcccuacagcuuuuuuauggaggcuuuuucuccauugagguuccuucuucucugaugauucuaguuugugucaaguugucauaaaacuagcuaguacauagggauucuucucuggugauagaucgagagucuuaacuuggcuauagucaaaauaaaaaagacaggguccuugugauaugaaauggcucuugucgcauuucaugguaaacucuggaugugaagucacuuaacccccaggauuaacucagagggauagaauuuggcaagagucucuccagaauaaccuugcugagauagagauguuugggcuucgucuuguuuuuuguuuguuuguuuguuugguugguugguugguuguguuuuguuuuguuuucuagacaggguuucucuguauagcccuggcugaccuggaacucacuuuguugaccaggcuggccuccaacucagaaaucugccugucucugccucccaaaugcucugauuaaaggcgugcaccaucuuguauauuaguaucuguacaaacuaucucuuagaauaauugccuacuccuagaucugcuacuucucgagauccuuugcagccugucuuaguuaggguuuuacugcugugaacagacaccaugaccaaggcaagucuuauaaaaaaaauagcauuuaauuuggacuggcuuacaguuucagagguucaguccauuaccaucaaggugggagcauggcaguagccaggcagaccuggugcaggcagagcugagaguucauccaaaggcugcuaguggaagacugacuuccaggcaccuagggugagggucuuaagcccacacccacagugacacaccuacuucaagcaggucacaccuccaaaauggugccacucccugguccaagaauggauaaaccaugacacagcccuacacauuacaggcuauuggcuacuaguggcuguauguguucauugacaggucugucccuuguauuucuagaauuuacugucacaacuucgucauucauucuuuuuccacaaacggaauguacucaucaguaauaugcauguuuuuaaauaucuuaaacauugaugcauaauguaagaaaauauccuguuuggcucuuaguguagacuaaguguuccuguuggcccuuuucagucauuucuucuagccccucggcagucuucugugacucugcugaccacagaaucucucucuagcaaugacacacagcugccauaguaggcuaguacuuagcuaggaaaccuucauucuucuuucugcccuccacucuggacucucuagaguuacuacccucaguccugcugcugccugcccacaugagcugccccacuaccaaaccuauucuccacucccuagggacucaggcuaugggcaaugaugcagagauguccuagcucauugcugccacguauaguaaauucuccaucugaccuuauucccguucacuucucagucaguuuaucuugucuuaauuuccugggauagagucuuagcaggauaaauuugccugaaauccaucuugucuugacuaccucccaaccugcuggaguuaagacaggauaccacuacauuuggcuuaauguuuaaaaaauguaugcacauagugaauuuaggaagauugucauggugguuugaauaugauugacagagggaauaguaguauuaggaggucuguccuuguuuggggaagugcaucacugugggaguaggcuuugaagcucuguccagugcagaagagccagauuucuccuagcaaacuucagaccaauauguagaaaugucagcuacaccugagccauaccugcauagauggugcaacacuccugcuaauugaugauggacugcaccugugaacuuguaagccagcuccaauaaauguccuuuguaaguguucugggucauagggccucuucacagcaauaaaacccaaacuaggaccauguauacauuugugagaccaagucucacucuuggcuuguacucagugguuauccaggcugauaugcuagugauuuccaugugacuccacugucccagcauuacaguugccguguggccacccucaugcugguguucagugggugcauaugcaugugcagcaaacacuucacugacugaguucugucuuucaccucaguuguccuggucgguuuuucuggguuaaugguuagagcaggugugagagccaaacccuaggagagucacacugaaacagacacucccagcaugaacucagaaggaacauaagugaucacugugugucagacccugacucuguguccuucugcuguccugaccuucuuaaucacuuccagaauccaguaccacagagaagagaaauggaguaaucaccuugacagcuuugaugauuagagccugugcaggaaguggaagacauccagagacucuaccaguaaaugcuugugugucaagaguucccugucugcuguuuuucccuuccacuccuccuuggcaucaguagaauagcucacuaugaacgcaguagauuuauaugcauuuuuuauaauaauuacuauuuuauaaaaugaaaugguauuuucacuaauagcugugaaggacuaggauaauaaagcagacuacuagguuggaguugagcauuaaucucccaauuaugagaaaauauaguuauuugaaaaauguccuuauuuucucugggaauuuauuucaugguguccaugagagacucguuuagguguugcugacaugacauuuauucuguacuuugacucucuuuuuucuuccuauauuuuccccucugucuuuguuuuuaaaguaauguucaaugauacacguaauugccuugggaacacaagaacaugucaaaccaaacagcaacagaagugaagaaguaagaacaggguagaauuuaaugauagugaaacaaaaaauauacaaugacuacaucaaacaaaauguugagcugguuguuggaagagauaauucacuguuagcaaccuaaccaaagaaaaguacauagcaauaaaauuagagacaaugaugagauauuaaaauagauauuaauaaagauuagaaauuuguaaggguauaucuuaggaacuuauguucuccauuccaaguagagggaagaagcagucuuacauucuagcucaggcuggccagcaacucccuauguaacacaggcuuucauucaacuugcaaaccuugggucucaggguaugaguucugagccuauaguaguauauccguaguacugcccuuucugaaguacuguaacuguuccauuaaaaaaaaaugagaguuucacaauuucagaugugucacauuguaaauguaccucaagcugucuaugagauuuucaauacugugucugugugucugcauuucuguccauacuguggaaucaagcaugguauuuuccuuguucccuuacugaaccugaggaaugagcugaagcuuuguaauucagcuagaacacugaucugcaagccccagggacacuuuugccucccucuuccaauuagcaggcuuucccuggauccuggcauccaaacccaguaccucaugccuacccagucaggcaagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggccagucccugcccugccucccaaacccaguaccucauaccuacccagucaggcaagucccugcccugccucccaaacccaguaccucauaccuacccagucaggcaagucccugcccugccucccaaacccaguaccucauaccuacccagucaggcaagucccugcccugccuccccuuccuuccuguguauuuggacuccaguaaaaaguaacuucaacaaaugcuuauaaaucuuuaguucuuugugaauuucuagaauuuuauauguaugauggauuuuaauuguagucaaccucacucagccuccagucaccuucuggaaggauuccccucagagucccacaccaacugcaacuucccccuccuccccuucuuccuccuccuccuccuccucuucuuugucucucuuuccuucugcccuccccauccccauucuuuuccuucguuuucaguaacccacagagggguccauuuagcacugcccauauacuccucagaguaaaauccucuccugcuuagccaacacaccaaggaucacuguccugacgaaaacugacuuucacuccccuggcauucagucaucaagugucaauaucuccucaccuagaggugggguguagggugaggagagguccaggggcaggggcaacuuguauguccuucccuaauccaugcuagaacguuaaaacugauugaguagugaaacuuacucuucaaccuuuaacuuuaccgggucuaugaugugucugaugcuguacaaacagcacaaucugauccauguuagcaguccaugcuuagucacccugcccuccucuugcucucuuggagauaagaauucaaauuuuagccaaggugcacaaucccaauuccccuccuuagcuucucaguuacaaagauuacaaucaugaacacugaauuguuucucacaugcgaucaaaagacuacccaauaccaaggauguccaccagcuaaagacaguguauuguucucuucauaacuguuuccguuauaaauaaguuguguauggacauguacauauauacauguauguacguuuguguguauaaguauguguauaaagguguguguauauguauguauguuugugaaugucugcauauguggauuuguauguauaagugugugugugugcaugcacacaugugcagauguguaggugcugucacacaagcuuggccuaagucugagagaacaaccuugagcauuggucuucaccuuuaucuuguuggagacggagucucugauuguucacugcugugcauggcagguuagcagccucaaagcuucuggagauucuccuggcucugucuccuuucuccacagugcacuacaguuagagauacccuccaccacucccuccuuuauguuaguucuguggguuaaacuucaguccuaucccuugcacugcaaaugcuuccccuauucaaccagccuuauaguguucuaccuacagcgauucacgauuacagugaaauuaauggaauagaggccaaaugaacaaaaugccaggaaccaucauauaacaagcuauuaacuaauagauuaucuuccugagaugagucugucuuggaucaaaaaacaaaaacaaaaacauuuugcucugauaggcaaugcccuggagcaaucuauucaugacaaauuacugcuauuaauaugaguuuucuguuauuauuaaauauauacuaauuacuagguauuaacccacccuuuugaacagaucucugaagaaguaggaacacauacugucuuguauugaugcuuuauaugcgauuagaugucuacuuaauacuuuguuuugcuuuguuuuguuuuguuuuguuuuuuagagacaggguuucucuguguagcccuggcuguccuggaacucacucuguagaccaggcuguccuggaacucaaaaaucuaccugccucuaccccccacccccccagugcugggauuaaaggcaugcgccaccaaugcggaugucuacuuaauucuucaugauuaucccauaagaauuccuaaaauuauaucaguaucgauuaagcucucuuauaagaggaugguuauuacgucucucugauauucaaaacagcaaugagaacucggccagucuaaaagugucaccagugaauugguuucagauaguaagcagggauucuacuauucacagcauauuccaaaagguuauaaaacuauuaaucaaaagucaugaaaagggaacuaugauuuauuauguguuauaaaagaagauuaaauauuacuggguuuauguaaucaaacauuuacuaauaauuuuguucugcuuuuugacuauccaugaaccugugaagcugugacaguucaugaauguuuagccagauaauuacuccuaauggacaugcauguaaacauucugugauguaaacauuuuauucaaucucuaauagugaaauugauaacuuauugaaguugagcuucauacuggguguguuguauguguggacuaucuuccauuuuuagagacuuggugauaacaaugucuaauuaaaaaugcacuugcccauaagaaugaugucauguugggcauacugauggcuugauggggaaacacaauuuugaguucucagcuggucuuccugaaggcagugaggugcuuaacuuaaugaggugcuugaauuucugugucuggauaaagaaaaaacuaucaggaaaugugagggaagauacaugcauaucuaugaccauaucaucucugucugucugucucucucucucucucuccauguguguguguguguauauauauauauauauauauacacacacagauauguauauauauauauauacauguguauauauguguauaauauauaucuauauaugcauaucuaucucuccauauauauauuuauauauguguguauagauagguagacagacauaacucuccacaagcaguuuccugcaguuuuuguugugaaaagcagcuacuuucuguguuaggguguccgugacugacuacaugauguuaagguggaaauuaagcugcagagcagucuaaacaaugauuaauucugggaauggaaaaugauccaacagggaaaaguguuccuaacauggccauuucguuuucuccucucccuucuuccucauuucuuuagagauaugagggucuuugaguguguuaauucaugcccuagaacacaugacuugaaaaugaccaaauaguaacuguuauuaacauggcuucaugucaaaccugaccugagccucacucuacugucuuguuaggagagaaaccuccaucuucuuccaggugcccauauuuuggcucuuugugauagugauauaacagaaugguauauugcuggacuaaguuaguucacccaugacagugacuauguucguguugauacugauggucauuggugcuuuagccuagaugcaaaaggaccaggauagcaauggagcuggucacugagcaucccuuguuguucauggaugagcucaccacugacuuagacuucagaacuacaacugauaucgucuuaguccgggaagguguuagaggauauucuuuguccacucacauuagggcaguggaaggccugugauuggauaggagaagggggacugagcuaugaguuggcaggacugggagagaggucucaggaggaggaggagaaggaggaagccaacagagaggcagacagacaagaagaacagcugcaauuaccugagauuuucacaaggguagaauaauugggguaaagcuuuaucauuaucaguugguucugaaauuacuuaguggcauuuugugaaucaugacuauauugaaacauaaaucuaauugguuaucuauuaagcuuuaagagucuuguuucucucgggaaauuagguggugcuauggcugaucauggggugcaugggcguugcuugguagugaaguaaacucgggagggggagggggcaccggagagaugguuagcagagggacacugagugaaauggcacaguggaggcccuguggccccucagugccaaagaguuggcaggcagagggaccgccaagugagaguuccugcagggccacagugacuccuuuuggccccaggcaggagcucuguagcugcugguugccuugcaggcacuagcacuguaacaugcaggcucucuuuuuaaauauuucccagaagaagguauaugcuaaagggccauuaaggguuugguuuuucuuuuguuucuacguuuuuucuuuuucuuuuuaaauuagauauuuucuucauuuacauuucauuuuucgguuuuuguuuuguuuuguuuuuuauguuuuucaagucaggguuucgcuguguagcccuggcuguccuggaacucacucuguagaccaggcuggccucaaacucagaaaucugccugccucugccuaccaagugcuagaauugaaggcgugcaccacgaugcccggccauuuguuuuuuuuaaagaauuuauuuauuauguguaaguacauuguagcuguauuuagacaccagaagagggcaucauaugucauuauggauggcugugagccaccaugugguugcuggguuugaacucaggaccaccugaagagcagucagugcucuuacccacugagccaucuuaaaggccccucuauuaacauuucaaauguuauccccuuuccuaguuuccucuugaaaauguccuauccccucccuuaucccucugcucaucaacccacccacuccugcuucuuggcccuggcauuccccuauacuggagcauagaaccuucccaggaucaaggucaucuccucccauugaugaguccuuuaagguuuuauuaacuuaauacccagucgauugugugcauuuuuuuguguaggagauucaaaaguagacgacagaccuguuguuuacuagugggaaacuucaaccaagaaagaagagacaucaggaauauauagccuagagcauaggaugagugacuguggagaggguggagcacugcuuuaaauagucccuaaacccucaagcaugggacaagugagcuggggcugaguggagagaucugaacccagugauggaugcagaggaaacagguuucuaagauugguuucugaacacgaagaaugaaguaaaagaagugauaugucaaaaauaugcucaaaaaugaacuuuguggcugaagaauuuguaggaaacauugucuuauuaauaguuuuacccgggcguggcggugcaccccuuuaaucccagcacuugggaggcagaggcaggcgaacuguaaaccauaaaccuguugcuuggcuuuuuugaugcuuuuccucagaauaggaaacuuauauuaaaaguuuuauuuugccaaguuuuaaaauugaaaugagguuaucacuggagcccugagcagaaugagcaagugguuagcaauaugaaucauauuaucagaacaauaaaaaccaauuccugaagaggcagaaacuguaugugaucaaagggacugugcauauagucauaacaucaauaaaugcccuaucacuagcucucgaucucagauacaucugcagaucaccuggugugccugugagagauccaauucaaugucccagagcuacagugucuggggaucuacaguaucaguaaaacucugguggacugugaaccccugauauuccacaugauaaggagcuauagacuuuuaaauagaagcauggaucuugguuugucacucagguauauaauacaagggagaugagguguuuauaaggaaaauucaacaugaaaugacaacagagagugugccuucaggagugaaauguucuguguagaauucaagguugcaguguccaguaacuuagcauguaucccucuguuuaauuugaagggaugcaccaucaucuucuccaucauccagucucaguacuccaucuucagauuuuuugauagccucacuuuaguggcuucagagaaaauuauguuucauggaccugcacaggaugcuaugaagcccuucagaucugcagggauggucaucucuuguuaugagagcuucuucauucacaggauccgcaaaggacaacaagggacuucagggaugcagacuuaacugugugugggugucucaacuuuaaauaccagugguuaaauugguggcaggguuuuuauuagguuaacaguccuggcuuguuauuuagguuuucuuccuucucuaguccugcaugcauguuuuuuucuuacugaaccguuuauguuucuccguuuuggugacccucuuagucaacaugcuggcuucaggcccacuuauucauccuuuaaacagcuugggaaaugaccaaguagcagaugguuauuuucaguuuuccccuaagguaugaucugacuguaagcugcuguggagaugucacucaacucaggagucuguucuaauuucagauucaagccuugcuugauggcuauagagauuaaaucuauaccgcacacuauccccuuuuugggucuccuaucugcauggaacaggucucugguugcggguggacaaggagucaacaaaugagaaacaauggcgacacacgagauuguguagaaucugaauguaauuugucuaaucgagcaucaaacuuuuuauacaguagaaaauagggaaguugggugacccaccagccagcuacaaauagguuauaggauucuuacacaaaacagaggaaugcaaccauggaaggacuggcagaaaccaacugggcuaaaauucaauguuuaacaacugguaucaaaaacaacucuacguaagguccacuugaucuuagaagccagggucaagggcccuugccauaguuccuauucuagucuauuguauaguccaccuucccucuagaacauuguaaauacuuguuguuuuguuuuggguguguuuuucgagacuggguuucucuguauagcccuggcuguccuggaacucacucuguagaccaggcuggacucgaacucagaaaucugccugccucugccucccaagugcugggauuaaaggcuugggccaccacgccugguguaaauacuuguguauggguguaacucagcuaucuauaguucuaaguaucuacucugguugcuccuuagguuacacacuuccuucuuucuugauaaugguaaauuucuguguagagcagugacucagcuauccaugcccaaggucggaucaaggauugccuagaauccaauuuagcuauaugucaaaaaaucaauccuuaggagcacuugugauaaagcaauauuaagagaaagcacacagaucuguuuaugaacuaaagcaaggacauuggagcauucuuuauacaggaugccacgauucccagagacucaguguccaugaacuuuucgccucaggacagugcccagguuuucagggccugucgcgcuugucacuacuggaguggauguagcaaaucugauuucacauuuuugguaugucugguuuugucagggucagauuguauggagagugcuuuccaugcagucagcuucaucuuuuagaaauguggauacaguuauggagaagucucugacucuaaauauaggcuuaacacuuugcuuuccagcacuguuuauuuguuagugauuaaucauugucauuguaaaugugcaauauguuugaaucuauggagucaaauaaaaauuuagguggaguuuaaauguuuguuucccaggaagacuacgaauguacacaucaaggcuacaucuauuguaagucuguaucuagucuaugucuguuuauuguauugaaagauccugacacaauguaaaaggucacagaagcccugaaauggcaaaauagauuucauuguuagcagaacuagcuucacugauuuagaaaaauagaggugcacaaugcucuggccgcuccuagaaccccugugucugccaauguucugacuguuccuucaacccaugugugugcccacugcugagcccauugccagguguuugugauauugguugcuaggauagagucagaaaaucauccaagcaaccacugccggagccaauccagaguugcugcaccugcaccagacucuuuccuuguaccccucccauacccauuucuugagaaaucauuuuagaauagacuuaguuuagaucuggaaauccccaauuccccccuucuucuucucccccugagugccuauaaaaacugggaccccuuuuuccucagggucgacuccucuaucccugcgugggauacgagucguccccagagcucuggcuuucccccaauaaagccuccuaugguuugcaucaagcuuggucucuugggguuccuugcggauccccugccgcagacccucuggaccccuuugucugcguggaacgggucucucgaugcgggugggcaaagcguaggaugggugacagacagaugcacacaggaaaggucguguggaaucugaauguauugacaacucgagcaucagacuuuuuaugcagaagacaauaaggaaguugggugacauacccacaaguuacaaaugagguaaccggaaucuuacauaaaacagaggaaugcaaacacaaaacgccuaacgggaaccaccuugaauagcauucauugauaacaacugggaucaaccagggcugcaccuaagauucacucgucuuagaaguauggucaagggcuuuguguccuugccauauuuccuauuuuagucuauuguauaguccaccuuccccuuaggccauuguaaauauguguuuauggguguaacucugcuauaguucuaaguaucuauucugguuucuccuucugucugaaucuuccuucuuuuuuaaugaugguaaauuccuguguaugggagggacuuagcuuuuacauucuuacugaauuucaaucccaugguguugcucaaggacauucuaggacuguuggaacacugguggaaggcuuuagcuaugucagaauucaaucuuaaaaggcacuuauaauaggacaauauugaaagagagcacguggauccauacacuagacuaacgcgggaauggaaaauuaauguaaggguuagagggaacgccagacuccaggagcaaguuucugugaaacucuuuuggcuccagaguagauuuuaagccucuuggcuugucaaaacugacucgaccagagcgcauggcagggaucugcuauuaucccaaggcuugagugaggggcucccuucgggggucuuucaguauauguguauauguauagauaguaucagcauaaacauguaggcaccuuucagagcccagagcugccugugucuuaugagagaggauuacagaucuaugaaaugcaguucuccagugacucaggagcauuggguugagggugaaagacaaucgaauguguacauauaaauaaaugggaaaagagucugugauugcucccauuuuuuucuccugugugauugugaugagcaauggaggaacaauauggauaaauaacaguacuuauacccccuaggauauaugguggaauuucaaaaggaguacacaagagauugugauguuaaacuguguccuggaggucucuugaaauucuguguaauagacuggccuuugugugggcugagcugauccaaaccacagcuuucccuaaugcuguagcuccuguugcuugucagccuguccacuucaguuucucuguuggcuuuugcuauagggaguuguuugccucuuaaauuucauaugcaucugcaacaauuacagucuucacccaacaaauugaaacuaaggcaacauugaaacacauuugugaacuuucauuccccagugugcucuuaagcaugagcagcaacuuggguggcuucugcaggggauccuccuccagccccuaucuuguuccaggaaguuggcagccauccauggcuuaguauucagcagcaagcagccuucccccagcuugaggcugugugacuugugcauaaauaaccaaaguuugccuucaccuuaaagcacuuuuuguuucaccaugaaguuggaugugauccuuuuauguggauaaacuuaaaaucuuaaagaaaauugguuuaauuacuuaagucucuuaaaaaugaaacuucaaaacuauggcucaagacuugccaucuauaaggguuaauaaacaaagccaagcccuggauucccagccauuauguugcuuguacugccuaguuugaaugugaaguucccaacuuuagcacacacuuggaacuucuuucacugugagacagaagccugcagagcucuuccugggcuuuguucuugucuacaacaagccuuagccagacaacgaggaaguugcgaucacauauuucuuucauuggcauaagaaaaugcaaacuuugauuauuaaaaugaauaauuaguaaguaaacauucuguagcuacagauccucauacaauugcuuauuugauuacaacgugcuaagauauggacaccaauaaaauagaaucucaauuucuaugaacauacccuuguagcugcuuguauucuuauguuaauuuugguccccaaaagugcucacaaagguguccauauguacgaugcucagggaugcuccagguugauucugacugguaaguaagaugcugaccacuaauggcugggcagggcaggaagaggagagacuuuuaagauucacaggcuugagagagauaagaaggaagagauugagauuuggcaugugcugggggagggucaggagauaccacccaugagaaggugaggaauagagagcauagccaccaaguaagagccagggaauaguggcccugaaagggcugccugacugugugacagacagcaaaguuuuguaaccaauaacuuaggaaugucaaagggagguagauuggccauauaggggccaggaaguggcccugccauugaguuguuuuaggcauauaaaauauaagugcucugugugugugugugugugugugugugugugugugugugugugugugagagagagagagagagagagagagagagagaguguuugugagugaguguguauuucauucaggaaaguagaacauugaggcuggcagcuaguaacugggagcagcugcugccacugggaucaguuugguaguuuaauugggaacagcugcaguccuuaaccucuccaacauguuuaaaauuagaaaaaauaaggcugccacucauccuggaccugacaugcuucuuacugagguaaugaaaaaucaucaauucaucacaacuacaaaaacaaagaucaaaugagcaugguauuguuacugauuaagagauuguuuuuauuauucgguauccugauacuaaggaaauaguugcauuuuuagcuucauacucucaauuggcaaacaucaaugucccuugaacucuguaaaauggaaguuaaaaauuuauuagaauguaaacauaaagcuuggaaauaaggggcaaguguugaaucugaccacuccuggagcagaagcaggaggaucauagacuucaaggucaacuuggucuguguaguacugaauuccaugacagccagggcuacauggaggaacccugucucaauaaccaaaacaaaaaccaggaggaagaggaagagaaggcaaugauugaguuuaaauaaauaaaguuuuaucuaugaagauuagaauggcuggauguuuccagaauggaaagagaaauuaggaaguugauacaaguugaaaguguccaaguaaguuauuaaagauauguaaaugauaaaccuuagaaaugauagacaggagccgggcgugguggcacacgccuuuaaucccagcacuugggagguagaugcagguagauuucugaguucaacauaagccugguauacacaguaaguuccagaauagccagggguauacaaagaaacccugucucaaaaaaccgaaaaaaaaaaaaaagaaaaccaacuccaacauucauuuuaaaaugucugagcuucaucuauauguuguacagaguuuaagugacaacacugggaaagcuaugguauuucuucuucucuuuuuuuuuuuuuuagacaggguuucucuguauagcccuggcuauccuggaacucacuuuguagacgaggcuguauccagagaauaaacucuaaccauccuacacuuuacaggaauucaaauguguaccuggcacuuuguauggaugaugcaauacauagguuauaauugugcuggguaccuuauugucaacuugacacaagcuauagucacuucagacuucguauaggagcagacaggaauucacugucuccuggcugaauaaaguucuuguccuccucuggucccaggucucggcuucauugcuucuguucuuguacaugagugucuacaaaauaagcaaaaugcugacaaaacguuuaucuccuugaaacaucugugucauuaggaagcugggguuuucuucuacaggaguagcaauauuugauccauacuuuuccccuuuguagagggcagcauuauagauugagaaaugaaggacauuguugugucuacauaguuggaucacaguguugaucugagaacuugccaagcuuauuaagacuacuuccaguaugcuuuugaguagauguugcagcuaaccccaguuguauuguuuuugaaauuaaguaaaguaccagauucaagacaauugauggauuggcaugauguauaacaaaauuguaaucauaucaggacuacugccaauuaaauaacaggaaauguuuaauaauguguuuuaacuguguguuuuuaacuggaagcaacaguaaauauccugaauuagguuugacauuaccuuugaguguguugucuuagggaugugcuggugaagaauucuuggagacccaggguuuccaucucucaucuuggggcuccauguaucaucaugugguuugugagagaauucccugucuuuaccuuguauaaugauuauccucuuaacaauuaauuauguacaauugcuaccuccucagaaaaggguuuuuuguuagauuuccauuuuugauguuuucauauuuaaauuucugauuuguuugaauuauccugacaagaaacagaaaccauucucguuuucucuucuuuguuuuguauuuuuuuuuguacucuuaaguccagcacauaaaccugcaacugacauguacaauggugggaauugucuaaaauuauuuaagaaguugucauuccacaguaucuucugagcauuuauaaucauacucacagaugcuuucuugguaccaaugaguaugggggggggggggaauaaaggaccuugcuugcagcaguguuuagagaucuuucacugucuuucuugucugcuccagaagucuguguccuugauucucugucaccucaccucuaacccccaauggcagguaaggucagcagggaguuccaggggacaggaaagaaugguagugucuuuggauaugucuuuugaaauggccuuuagguguuuguuuuuuuguuuucuccuuucaauuguuccuuccuguuuuaaugaugguuuuacugcugugaacagauaucaugacaaaggccacucucauaaggacaacauuuaauugaggcuugauuccaauucacugguucacuccauuaucauaaaugcuggugcauggcaacgcccaggauggcuuggggccagaggagcugggagggaguucuacaucuuguuacaaggacugucaggagaagacuggcuuccaggcagcuaggacaaggaucuuaaagcccuguuauucauggaacagaaaaacuucaugucauccucauauaauaaagagcuucaccaugggaaggcugaaagaaauuaacagaggccuugaaauacauuuaugguggauugagacccaaaaagaauagauuugcguuuguaaaaaggcuuuagaauuuacucuuuacgaggcuaauauauugucaauacaauaugguuacauaauuaaaaaucauaucagacagauauaugccccaagggcccugacucaguucuuggcucuucugggacucccagcuguaucuggaugaccaagagucagaaccucacccccacucuccagcccaggcuugggaccugucacagcccaggaacuccccaaccagcucuggccugccccucgucauggacugcauuucccaucccugagcagagucuuggcuuccccugaagcccagcaccagccacgcugcagaaaggaaaaaacagucagauauucccugguucggagcccaaagagguugagcccagcggaagugaauacaugaauugacagauucacugaccaaucagagccuccauaugcuccauccagucagaauagaauuacgguucuucccgaaauccugugcaagguuccaugcuauugugagaguuuaagugaauugguguguugugauucuaccucaacugcugaguacugagggaaguuaagcaagaucugaaguugcaacauggccagcuuaugcucacugcccacaaaggugaggagcuggagacauugugguggguccuacucaggguuaggcaggagccagcagcuugauauagccacgugugaggucucuuaguguuagccauuccugaacccagcaguggcaucugaauaacuuccuucucugggcugaaucugcacaaagcauuugaagcagggcccuguguauauaaacauccuugacaguaugccagugacagacaggcuugguuccucuaguagagucuacaagcucuucuccucuaucauuuuuuguugugauucauuuggaguuaauuuugucuaguuguacaagucauccaucccaucuguugggugacugagagcacguucuuucaauaugucucugcuuuuaaggaaacaaaaaauagauccauuaauuuuuguacagcugcaccuuuagccuuuuagaaaaauguuucugagacaagcuauguugucacacggaucccagucccaugcuccccagggcaaugacccugcuuuccuuuuuauuagacuuucaaaguucgaauguuaaauguauguauaagagcguuuuuaaagucacucauucagguucuguaauuagcuguccuuugcagugaaaggaaaaguacauuccuguggaacaugucuucugccuucagacuagaacaggaggaaugguuuacuguguacacaguagggugaaacaaugucgacaagagcuagcucacagacuaaaguuuaagggagucaucugcaggggacaucauucugaagcaaagugagugauuguuuuaaauuccucaucauugauuaauucaugcauguuuauagaaauuguacagauugguggguauacaaguugggaagguucugugggaucaaacugaaaaaggauaacguaaaaacaaaaugcuaggccuuuaggcccaggcuuguaaaugugaccucugugacucuaugcuccaagguaugcuaaucauaaaacugauagugacauuccuccacccacccuggucaaggguucaaggaguguucuuucaaagaaagucaccgugaccauuaccggaaccugcaaugcaaaugugcuauuguuaggggcucuuagauuguuaggagcucuuagaaacugucuugagagauaaccugacacuugugacuuugcacuuccuugugacucuuaacugauauuuuugguauuuuuccaacaacgccugccccaccuccuugaguugugguuucuuccuuuaaauacccccuuauccagcuacucggggugccacgguucucuaccccgugggcccgagagugcucuugaauaaaaauccucuugcaguuugcagcaagaccauuucuuguggguguuuuuggggugucaccucuccugagucaaaacgugggggaguccucaccuugugggucuuucaucugguguguuggccgggaaacgcgaccaucccucacaccggagaaccaacuuggagacauggggauccccucuugugugcaugcuggccggugucucuguuuugagugucuguuuucugaaacaaucauuggaacaugugcuuguuguguuggguuguuugugucuuguccuauguuucugaagcauggcgaagucugaguuuggauccaucugaguuuauugaauuugugucuugguuucaggguuacgagaucguggguucgagucccaccucgugccuugguuuuaggauugcgagauuguguguucgagucccaccucgugccuugguuuuacaucuggcagagugaggaaugagugugcucugguuuuggucgucuagguagagguggacgacaguguuuguagacgauggggugaugggguuuucugaaaugugcgcgcagucgguauuugcaacuguccuuuugggccguaaggaccggaggacuguggucggcagaugugcuaagaggaccacaggcugucacccugggggaugcccugggaaguaaggagagccagggacgccuggccgucuccggggaucggucagagggaccgaguucuguugaagcggaagcuucccccuccaaaaucgucugauucuuuugccugcuuguggaggacaagaaaggggcgagugugucuggaucuguugguuucuuguguauguguuuagagcuaugugaaaaucuagagaagcaaagguaauucucauaggugcuuuauacccugacuagagauaguuuacaccugagacgugagagaauggguuuugagaaaagcuguacucuccgaccaucuggggaaaauuugguuaaaauaaaauaaaauaaacaguaucaauuggucuuuggaguccugccccuguaguuaggaaucuaguguggcuggagaagcccugcuaggagcugauuauaaacacugcucuuauagggaccagcagcuucucaaguucuaugguaagggaacagauggcuguuuuuccuacaaaaaucucugugcuugugauuauuggauucaucaggugacaaggugcuccucucuugaaauuacagcuagaaaaauuaagaauuuuguuugguuuaaaugggcaaauguauacggccauuucauuuuuguuucuaaauaguuucaaaaguauaaauauguuuuagaugucuugguuauagauuaugauuagaaauuuguaacauugguaacaaaaaguugacuuaaaacugguaacucuggguuagaguaauucagaacauguggcaugagccaacccaugggaacaggucuccaaagauacgccugaauuggguaauauucuauguaauucuuauccuagaaacccgacuuauaacagauauauuggcggcuacaccuucuuguguuugugugcaggaacggacagccaaacuuuguagcaaguaaugcuuuuggaguucauuuuuaaagaaaauagauuguuuacacuguuaaaauuggguuuugcuucucaaaauuguggcuguacucucguguuacaagaaaaauugaaggcuucucccgaaucugagccaccagcuaaacccaucggcuccuccaaaaucuauaaagccuccuggguggccuaguccacaaccuuccccuuauccacagccucaaccccagccgccgagggaaucccaaaccccuccgggcgucgagaggcagaccacuguggguacauggagcugcagagcacaguguccggguaaacucuggacccgcccaaacuucaagcccuucaguauuggucauuuuccucugcugaucuuuauaacuugaaaacuaaccacccccuuucucaggauccccaaugccucacaggguugguauaguuccuuauguucucucaucagccuacuugggaugauugucaacagcuguugcagaugcucuucacaaccgaagagcgagagagaauucuguuagaggcuagaaaaauagcucggaagccaacaggcggucuacacagcuacaaaaugagaucaaugugggauucccuuugacucgcccccguugggacugcagcauggcuaaagguagggagagcuuaaaaaucucgccaggcucuggucuccaaggugccucaagacggcccacuauuuuggcuaagguaagagguaaugcagaggccaaucgaaccucccucaguguuccuuaaaaggcuuauagaagccuucaggcgguucacucccuuugaucuuaccucggaagcccagaaggccucaguggccauggccuuucauaaggcaguuggcccccgauaucagaaagaaacuucagagguuaaaagguguauuacaagagggagacaguuaugcaaucuagugaaagaggcagaaaaagugugugugugauagagagcgaggugggaggcagaagaaagagaaaacaggagggaucguagacaagaaagaaauuucccacaguaguaggagaaaaagaaaagacaggaucuagacaggaaaccugggcaacugaagaccgagccucagcuaaagaggcucagaugugucagacucaaguuacuuauuugggauacacccuucgagacgggaagcaaugccuaaagaaagccaggaaaaagacuguaacucagauccccaccacuacaccaaggcaauuaagaggauucuuggguacugcuggcuucuacggacucuagauaccuggguuggcaaccuuagcugcccuguuguacccccuaaccaaggaaggggagauguuuuguggaccccauaucaccagaaagccuuuaaauguaaaagagagagcaggggucgccagaggaguccguucucagacuuugagaccuugaaaaaggccaguggcuuaccuguccaagaaguuacacccuguugccagcaugugguuuucuugccugaaagcuauugcugccauaacacugcuugucaaggauucugauaagcucacucugggacagcaaauagcuguaguggcaccccgugcucuuaaaagcauuauccaaaagcccccugacuggaugacuaccaacgguccugugacacaucagaacuuuuuguugacugaacgagugaccuucgcuucauuccaccugcugucccacugcgugagacugcaccuacucaucacugcgcugacauucuggcagaagaaaugaucugaaggaucaaaucagccuuggccugaguguaguaaacucgcgguugaagguaagcagaaggggggaacagcaguaagguggugaacagaaaaaaagugaucuagaccagcagccucccugaagggacgucggcccagaaagcugaacuugugacaagcucuaugaauggcaaaagaaaagucuacacugacagcaggugugcuuuugccacuguauggagcaauauacagacaaagagggauguugacaucuacagaaaaagaccuaagaugcuguggcuaaagaaaaucagauggcagaucuaauggccaaacagguggcccaaggagcaaugauccuggcagucaaggagccuaaagauuauuaaaacaucagagagaccagcuuuagauacaccccugagcauuaucaaguuauggacaguauuugacccaccugggggccaagaaauuaaaaggggugguuagguccuuugacugcuauguuacaggacucucugacuuggcagaagaaauagucaaaagcugcaaggccugugcuaugacgagguaaaauuucuaaaagaaaucuucccaagguaauuggguccaauaacggaccugauuuuguugcccagguaaaucagggacuggcuaagauauuaaaaaaugauuaaaaguuacauugugccugcaggccucaaagcucaggacagguagagagaauaaauagaaccauuaagagauccuuaccaaauugacagcggagacuggcgcuaaugauuggauagcucuccuacccuuuaggguuagaaacaccccuggacagucuggacuaaccccccccccauaaauuacucuacagagggcccccuccacugguaaaaauagccuuuguacauagugcugacaugcugcuuucccagccuuuguucucuagauguauucagcauggguaguuuugaaccauccauggcucacaaaucagugaaauauaaccuguucccaacacagaauccaugcugccuauaaaggaugaccaguuaagacuuuguccucaauuaggaggaauggucaccagugucacccucagaguucccugaaaguucccagagcacuuuguuccuuuacaaaccugcaauuguccccuaaucccagcucugucucccugaacucucucccuacauccccccuccaaaugaucccuaccacuuuuuuuccccauuugccucagucuaccaagaaagucucuucuguuucugcuuuccagaaauguguguuuccccucuacaucucuucucuuuacauaaccucucugggucuguggagauaccuagauuaaauuuuaccuaagagcuaauauccacauaucagggaaaguauaacucuuccaucauucuaagucuggguuacgucauggagggugcuuuuaauguaguuccaaucaucagccuauugucaugguuucauuuuaaguuaccauauuuuuagcagcugauucauacuguauuauacagacaaucuacauuuucuuuaucugaucuuccucagggggauaccuauguuguuuuuaccuccuggcuaguacaaacaaugcuauuaugaauauaggugugaaugugugcuucucgguugcggcauggaguaccuuuuucauauaugcccaagacugauauagcuugguuugagguaguuggauucccagauuucugaggagucaggauauagauuuccacauuggcuauauuugucuguacuccuacaaucaguagagggcgguucacuugcuuuauauucucucuaacaugaaaauuauuuguguuauucuucguaaccauucuggcauguuucauauggaaucacaaauuaguuauuacuugcaauuccauaaugacuaaggauggugaauauuucuuuaagaguuucuccgccauuuguuggaauaggugugaccugguuggaaugggugugucacuguggguguggguauaagauccucacccuaguugccuagaagucagucuuccacuagcagccuuuggaugaagauguagaacucucagcucuaccugcgccaugccugccuggauacugccaugcacccaccuugaugauaauggacugaaccucugaaucuguaagccagccccaauuaaguguuguuuuauuaagacaugccuuggucauggugucuguucacagcaguaaaacccuaauacagaauccaacuaccucaagaccaagcuauaucagucuugggcauauaugaaaaagguacuuuaugcagcaacccagaaggacacauggucacguauauucucaguuuuuaaugacuaccauuuuuguaauauucaaauguguuaaugugccucauuuucugaauucauucuucacuucagggacaucuagguuguccucaaugacaguguggugaauguauaauucuuuucaagcacuuuaguaauggccucugaguucuuuacuucuuuguaguuuguuugguugacuuugcauggcauacaaguucuuaauauauauaucuggauguacgagaacugaucacauagaccgggcuaacauccaacuccaugaaauaugcuauuuuuugucuaccuagugcugagauuaaaugccugagccauucuaacaagguugcucauuauauuuuuccuuuuuuaaacuuuaauuuucucuuuuuaaguuauucaauuuaccucaugcuugcugcccccuccugucacccccuuuuauaauucuuccuccaugcucucaucccauucuccucucaucugguggaggccccuuugguuaucccccaucccuggcaacuagucacugaaaggauacauaauuucucuugcacugaggucagacaaggcaguuugacuacaagaaccaaucuuauauacaggcaacaucuguuuauguauccccauuuccaguuguuuaggacccacaugauggcaaagcugcacaucucugacaaaugagcauggaggccuagauccagcccauguauguuuuuuaguugaggguucagacucugagaacaauaaaaguuauuugacucaguuagucuucccauagaguuccuguguccugggaggacuguaauacuggcuccuauucuuccaauagaauccccaaaccccaucuccuguuuggcugugguuaucugucucuuuaugagccagccccaggguggagccacucagaggacagcaugcuccugucuguaagcauaacagaguauuauuaauaguguuagggacuggugcuuacccaugggaugggucgcaauuugggcugguaauuuuuaggcuauucugucagucucuccuccauuccccaugcacauauuuauuuuagacaggguaaauuuuggguugaaauuuuuugugccuuccuuggugucucuacuguuucacugggguuccugccuggcaccaggaaguguccucugcaugaucaauauccccauuguaguaagucacagaugaggucauccccauugauuguuuaguuaguuaguaaguuuguuuguuuguuuguuuuuugagacagaguuucucuguauagcccuggcugaccuggaacucacuuugcagacaaggcuguccucagacucagaaauccgccugccucugccucccuagugcuaugauuaaaggcgugagccaccaagcugggccauccccuugauucuugagaguuugucuuacacccggucucugucuccaggccugccaccuccucacccccaucaguugcagauuucauuuugguuugguuugguuugguuuuguuuuguuuuguuuuugagacaggguuucuuuguauagcccuggcuguccuggagcucacuuuguagaccaggcaggccucaaacucagaaauccaacugacucugccucccaaguaaugggauuaaaggcgugcaucacuaccccuggcucauuugcagauuucuauucauauucauggccaucuagucaucucuccugucuuuccccaaaacugauccuguacaaacuguucccuuuccaugcucugccagucugaugucccucccuccaucuggcuuuuauaacuauuauauuccccuucugagugagauucaaagauccuccucauuugggccuugcucauuaacuuuugguucuguguggaauagcuuaguaauuguauuuuuggcuaauauuuacguauaaaugaguacacaccaugaaggucaauuugauauggugugccuuugguaaggaugcuauucucaaguuuccuccauuugauagcaaaucucaugguaucuuuguuuuccauagcugaauaguacuccauuguguagaugcacauuacuuuuuuccauucuuuagucaagggacaucuagguuguuucgauuuucuugcucuuaugauuaaaguugcugugaacauaguucagccagggucuuuguggaauguuggagcaucguuugggugucuaccaaggagugguauugcuggguuuugagguaguacucuucucaguuuucugagaaaguggcaaauugauuuucacagggguuuuucuaagcaugcauucccaccaacagugagcaggugguccaguuucuccacauccuugucagcaugugcuauaucuugagcuuuuggacuuacacauuauggcugguauaaaauggaaucucagauuugucuugcuuaucgccuaaagcacuguaaaaaccuuugacauaauccaacaucccuuaaugugaaagguuuagagaaauuagagauaaaggucaaaauccuaaacagagccauaaaacaacucaaggagaugaaggggauacaaauuggaaacgaagaagccaaaguauugcucuuuguugaugauaagauacuauacauaaaugaucccccaagauucuaccagagaauuccugggauugauauacaccuucagccaaguagcuggauacaaaauucacucaaagaaaucaguagccuucauuauucaaaugauaauuagaccaagaauauaauaagggaaauaacaccaauucuaguaacuaugaauuauauaauguaucuuaguauaacucuauccaagcacuugagggaucuguaugaaaagaacuugaaaucuugaagaaagaaagugaagauuuaaaauuauggaacgaucuuccauucucauguauagauaggauucccaaagcaaaaaugggcauuuuaccaauaguucgcuguuucucuuuuuauggccugugaaauuauauaaagaaaaccuuaaaauauacuuacauauacuuacuauaaaucauauaucuuuguuaauuuuuuuguagaacaugauuuucauauuuucuuuucucuaucugaaauaucaauugauucauguauuuuucucauuuuuuacaugaaacauuaauuauauuuggaauuuugaaaaauaauacguaaaaauuuaacuuuucuguuuauagccuuucauacccuaaagauaucauuaaugaauguuuaauauuauucauaacuggagauccuaaaucuaauguugaauacuacauuguuucaaaauauauauaauauuuugugggaauuaaccauacuaaaagagcauaaaauauuaaaaaugaaucauuaaaaaauauuuucaaaagcccuuauaugauuccuccugacuagugggugaguaguuaaaaugcauuauauauugguuuauacuauguaacacucaguuuacuuacaaaagauuaucaguguuucuaggacauaaaucauuuuaucaguuaguuuaaaaauuucgccuggcuuguuggcacaccccuuuaaucccagcacucgggaggcagaggcaggcggauuucugaguucuaggccagccuguucuacagaguuccaggacagccagagcuauacagagaaagccugucuugaaaaacaaaaaacaaaacaaaacaaaaagaaaauacuaauuucaaggacagugagaaauauuaucaaggauacuuuuaugauuguaagaaugauuuuaauauuuucaacuguuaguacucaacgaacagaauaauuauuuuaagguauauuucgcuguuauguuucuuuuuuauuucuuauuuuauuaauuuggauacugucucugugcccucugguuaauuuggcuaagaguuuaucuaucuuguugauuuuucucaaagaaccaacuccugguuugguugacuucagaacugaguuugauuauuuccugcaggcuacuccucuugggugcauuugcuucuuuuuguucuagaacuuucagguguucugucaugcugcugguauaacucucuccaguuucuuuauggaggcacuuagagcuaugaauuuuccucuuagcacugcuuucauuguuucccaucaguuuugguaugaugugucuucauuuucauuaaauucucaaaagccuuuaauuuuuuucuuuauuucuuccuugaccaaguuaucauugaguagaguguuguuaagcuuccaugugcaugugugcuuuccuuugcuuuuguugguauuuaagaccagccuuagucagugcugaucugauagggugccugggaugauuucagucuucuuguaucuguugaggcccguuuugugacggauuauauggucaguuuuggagaaggugcugugagcugcugagacaaaguuguauucuuugucuuuaggaugaaauguuuguuucauaacuucuguuauuuucaaugugucucuguuuaguuucuguuucugugaucuguccauugcugagagugggguguugaggucucucacuauuauugugugaggugcaaugugcacuuugagcuuuaguuaaguuuuuauuaugaaaaugguugcccuuguauuuggagcauauguguuuagaauugagaguuccuugcuuuuuguaguuuguaauauucauacagaaucuauggugucuacuuaguguuguugaucuguuugcuugucucuuuauaucuguuagguacucacagauacucuucuugcaaaugcaugccccauucaaaaggugaggaaaugcgagaugugaaccucaugauucaguuucugucugaaaugacguugagauuacauuauaacuucuguguuaggauggaggaaaagggaguuaauuugaauacauuguuaaugaaauauauguccaauaugugcgcaccaugcuuucuauuauaaacauguaugggauguucuagaaugcagugacauaugaggaugugcaugugaacuuuacucgggaagaaugggcuuugcuggauccuucccagaagagucucuacaaggaugugaugcuggagaccuacaggacccucagagcuauagguaagacuguucaugugguuuuccuugacaaguuagagggaaacuguuuccuuagguuugaauguguguuuguccuuuugcuugcuucuuuuguuguugaugaugcucuucuauaauuuacauugagaaagaagaaugaggugaacgaaucagacauggaucuaagguucacugaagauaguacguuaaacuuuccaucaacuccaauaauauacauuuuuugguacuauguuuuaggcuguuauugggaagaccacaguaaugaagaaaauucucaaacuucuagaagacauggaagguaauuuuuauuuacaugcugauccaaaugugccucagaagaaaucuucauguguucuugaaauuuuaguucaaggcaacaguguauguaaauaagcauagcuuuaaagauacugaguauuaaauucucacaaaugcauuuaccccuaugucagguacuguauuuugguuugcagggcaugcuucaguauagaauacugccuaaacagauagaauuauuucaagcacagccccuuuggcacuaaaaugcagaauugccacucgguuuacucuuauacuucucagauauugcaaaaaaguauacaguuugaucguaugauguguauauauccaaaaacuucucauaaacaaauaguucacaguaacacauauguaacucauguacuuguggaaaggugcuuaaguuuagugauaguggaaguuuauaaggcuugagaaaguugaauagaaagauuaauagaaauaccucacaugucucuggagaauaaaaagucaaacguugugaauauaauauuuguacauuuuauuucuuuuuguaccuuucauagguauauuauaaggcacauaucuaucuaccuaccuaucuaucuaucucuaucuuauauaaaggauccaggcccuauuuacuaaggauauugacagaaacacugagugucuuuuucuccaaggacauuuagaagauaucuuguuaucgccacuuagauuuuauuuguuuaacuauauaugauuuuacaguuaauugauuuuccaacuucauuggaaguaaaucaacaaacucacacugcaaaagauucuuaggaguauuaguaauguagagauuuucuguuuuuuacugguucacuguccacauauaauauggcuuaaucuauaggaaaauuuaugaaugcaaucauuguaaugaaacucugagugcuugcagguuuuguuaaauauaugaaaaaggcuauauaagaaaagauugccaugaaugugagccauuauauaaaugcuuuuacaaucacaauuaucuucaaauauuuauggaacccauaaugaaagaaaaaaccauggguauaaacaaacugaugaauucuuauuauaccugauuucuauuuccauuuagaaaauauuauaaauaaauucauacauauaaaaaagauucauuacuauaaugccuggguaaaccuuucaaaagugacaauugcaucuacaggcauaagagaauuuauaauguagagaaaauuuuucaauauaugcaaaaugcuaacgauuuuguaugucauaggcaucuucaaauggaagacagaacucauacuggagauaaaagcuaugaaggugugcaauguaacaaagugcuuucgagucacaaucaugcucagauauauaaaggaaugcuuacuggagccuuuguacuuuauacugguggucaaaugcauagcagaacacaggcaggggauaagcccugugacuguaacacacuugguaaauccuguacaugcaacagccaucugcaaagccauaaaagaacagauacuagagagaauccuuauaaauguaaucacugugguaaagccuuugcucgucacagggaucuucaaaaccaugaaaggacacauacuggagagaagcccuaugaauguaagcaaugugguaaagccuuugcucuuaacagcuaucuccauauccaugaaaggacacauacuggagaaaagcccuuugaguguagccaaugugguaaagccuuugcuugucauagccaucuucaaagccauaaaagaacacauacuggagagaagcccuaugaauguaaccaauguggcaaagccuuuucauggaacuauugucuucaaauucauaaaagaacacauacuggagagaagcccuaugcauguaaccaauguggcaaagccuuugcuugucauagccaucuucaaagucaugaaagaacucauacuggagagaagcccuaugaaugugaccaaugugguaaagccuuuucauggaacuauugucuucaaauucauaaaagaacacauacuggagagaagcccuaugaauguaaccaauguggcaaagccuuugcuugucauagccaucuucaaaggcaugaaaagacacauacuggagagaagcccuaugaaugugaccaaugugguaaagccuuuucauggaacuauugucuucaaauucauaaaagaacacauacuggagagaagcccuaugcauguaaccaauguggcaaagccuuuccucgucaccaccaucuucaaaaccaugaaaggacacauacuggagagaagcccuaugaauguaaccaaugugguaaaaccuuugcaugucacagugcuuuucaaaggcauaaaagaacacauacuugagagaagcccuaugcauguaaaaaauguaaagccuuugauuaccacagccaucugccaagucauaaaaggacacaugcgguagugaaucccuaugaaaguaaccaguuugauaaagccuuuguuugucacagccaucuucaaagccauaaaaggacauauacuggauagcaacccuaugaauguaaucaguaugggagagcauuugcaugucacagcauuguacaaaggcauaaaagaacacguacuggagagaagcccuaugaauauaaauaaugugguuaagccucugcaugucacaguguucuucaaaggcauaaaagcucacauucuggagaaaagccuugugaaaguaaacaaugugguaaagccuuugguugucauagccaucuucaaagccauaaaagagcacguacuggagagaaaccuucuucacguaaguacuguggcaaagcauuugcagaaaacacuaaucuugaaaagcauaaaaaaaacccuacacuggaaagacucucuauguauguaaccauugugauaaagccuuugcucaucacagcuaucuucaaauccauggaaagacacauagaggaaauagacacuaugcauguacccaaugucguaaaguguuuucacauaacaguagucuuccaugccauaaaagaacauguacuggauagaagcccuaugaauguaaccaauguaguaaagccuuuucacagaagaguuuuuuucagugucauaaaagaacacauacuggagagaagcccuaugaauguaaacaauguguuaaagccuuugcucuacacagccauccucaaagccauaaccggacacauacuggagagaaacacuaugcauguaaccaauguguuaaaguguuuucacauagcaguaaucuucagagucacaaaagaacacauacuugacagaaauuguauggauguaaacaacaugguaaagccuuugcacauguggucuucaagggcauuaaaaaccuagaaugcagugaacucuuuugaauguagucaacuugauuaagacuuugcauaucagagucuccuccuuuuguaugaaacagaucauucagcagagagauuuuguguguguguguaggcuuguaacucuuucaucuacuugucccaugcuuuuucucuaguaaauuaccuugccuaucuuuuauaugaggaauugugcguuuguuauugucauaggugaugucuuauuuaguugauauccacaagagacugcccugcuauuuuucgaaggggauaggcgaggagggaaucuugggaucaugguagguugggaaagucauggaaaacugaagcggaggggaaaacaacccaggauuggaaccuucagccuauaaaguuuccugcuugcaagguguacugggucaauaguagcacagaacuuguggugguaaccaaauauugacugguuuaauuggaugcacaugaaacaagaaggagccuguaacugacacugguugaucaggaacuagaagcaagauaagcaaggaucauacuuuagaaccaaacaugacugucccuugcccaucaccacuauccccacaaaaaaacacagugauguucugcucuuuucauaguuuggugauucguccaacugucauuaaugucugcucucauuagggcaugggaguaauauaaaugacccacaacuaaacaguagaauccagguuuccagucucuauuguuuucuuuaucuauaagcuuggggaacagcagagaagaggggaagucuugcgcgcgcccccaacucuccagcaagaacaacgcuacaacaggauccuucugcacacguuuauucaguccuguuucuucuuguuuauaucucccuuguuuauaucucccuuauuuauaucucuccuguugauaucucccuuguuuauaucucccuuguuuauaucucccccgaacccugggccucucacucuuuuauacucucaguucccauccacgcacagcaggccacgccacuucaccaggcacgcagcuucagcuaaucagggcagcaggggcauaucuccaucaaacuggauucaccuguauccugguacaccugcgcagcucucaagauguuuguggcuuauaugaggaagucaggugcaagucauacgacuuauuuacagucccuggcgccuuugggacugccgccacacccgcuccuaacaucucccccuuuuuucuuuucuggcagagagaaugucuguagauagcccccgcagccaugccccuuacccguccuugggugacaaacagcauugguuugaucccugucuuagguuggugacaugcccagggagucuuaucacuaccucucuauuaugccaagccacaccuggggagauuguguuuugcuuguggcaggugcaucaaaaggccaggauguugauuaaucuauggccagaucuuaauugcugcaagcaagccucaugggugaagguagaggucugauccccagugugcaagcauaggagcccuacacaaaaccaucccuuaggcucaucacccagagaggucuuggccagcucccgugucguuuuuccugagggaagggaacuaggacacugaaccuucaugcaaucagacgugccuuccacaggaugccaacagcaagcuauccucugugcagugcuuagccucgcaccccacggcauaacgcagcauaauuucuuuuagagcggcaagccaaaucugaggagauugucccgccuccacugcagcaaaagucuacucuaccauggcgaaagugcgggccgcacacucugcaccuaacacaugugccaaacacacaacacacacacacuauugcaagcauacaucccagggcucucauccccgcucaucuucccugaagcaagggauagauggccagaggggcuaucucuuuaaggggaauucagggaucaaaaagcguggaaaaauuugaaugucaugacgagcugguaucggcuucuggaacacggaaaggauuucccaucuccacuccaucguuugugcuugcgggaucauccaccacauucacaggggcaacuggaucaggagccucauucuugcagcaucuuaccaaucucuccggcacccaaagagguucugucugguccuguggaaacacacaaacagacccucucccccacuuuaacaccggaucuggucgauccccaggggagauggacacaauaccucgugguaaugagaccauaaccucaaucaccuguguguccaucuggggaguuaauacaagaguuaaguuuucacugcugaggaggcauagggaggaggcacagaagcuaauucgccuuccuccucugccucggcucuuuuuauuuuguccuuucuguccaccugauaacacugugucuccuuucuuuuuccuuuuucuuuuuaagcccuucuccuuuuccgacauacucucuuguugcucuauaaggauuuucugaccugucuugacugccucuacacacaguuucaaacaguaacagaguccauauaucagaacaaacaagaccaaaacuaucagaccuacccacaaagggucaauggaagaaaaaagcauaacuacacagcgaggaucuauugaucacuacacagagguuaucauaguuccuuaacuugucccaaaaccgugaaccuuaacuugucccaaaaccgggaaccuuaacuugucccaaaaccgggaaccuuaacuugucccaaaaccaggaaccuuaacuugucccaaagccuggaaccuuucguuaccuugugccugcuuccuggcaacuuuaugcuugccucuauuuuauccgagguccuucccaaacuccugaguuauuuugugccuacuuccuggcaacuuuaugcucaccucuauuuuauucgagguccuucccaaacuccuggggucgcaaguuucacucaccgugaacuuacccugccggcaaccacugacugcugaaaguucugaacucggugggggagucgguuccccguacgggccaccaauugucgcgcccgcucucgaccagcaagaacacgaccaccaguccuucuaacagcaguuuauucaguccuccucuuucaguaccguuccucagcugaagaguucugaauccacgccggauccuucucaacagucuguuuugcaggaacacuucauuaccaccauuccccgugaugcaguucugaauccucccuguagcagggggucuucgcuugugccugaagauguuucuuuucccggguuucagcaccacuucuugcgcgcgcccccaacucuccagcaagaacgacgcuacaacaggauccuucugcacacguuuauucaguccuguuucuucuuguuuauaucucccuuguuuauaucucccuuauuuauaucucuccuguugauaucucccuuguuuauaucucccuuguuuauaucucccccgaacccugggccucucacucuuuuauacucucaguucccauccacgcacagcaggccacgccacuucaccaggcacgcagcuucagcuaaucagggcagcaggggcauaucuccaucaaacuggauucaccuguauccugguacaccugcgcagcucucaagauguuuguggcuuauaugaggaagucaggugcaagucauacgacuuauuuacagucccuggcgccuuugggacugccgccacacccgcuccuaacagggaagaaggaauuguggaaaccagaggugucaaagacacaaggagagcacaggcuacauaauuaccugacugggauuccuggaguuucccagauguugaagcccaauuuuggagccuauacaggucuacacuagguucacugcauauaugcuguuguucuuggauggugguuuuguuugugggagguguugaggaauacugagaguaggagugaagguuuuuuuuacucuuuugccugcucuuaggacuccuguccucaagucuugaaaugaggguuugugccuguucuaguuucaucuaaucuuguuuuuucauuccuguguuugguagaccuaguuuuuccugugguucuuggaaagaguuuaguuggggaguaauuuugagugcuagaaagagggauaguuccaguuggacuggauugcauuagguaagaauuaauaauaauaagaauaggggaaauaggcaaaaaaauagagauaaaaggcuuuaaaguuuacaccagauaaaguuuagauauaagagauuugagcaucauuuguuugugcaguuacaugaguggcuuccauaugagauaacuugaaaaucuagugugcaagucuuuaaccuuuacuugagcugugauuaggccaaguguuuugcaggaagaaagugugguuuuaggaucuucugauuccaaggcagaagagauagucacaccagaaccacaggugcaugaaggaagagacaaaacacaugugagaaguaggugagguaaggggagaaguaaaaauuaagggugaucuaaagaguauccguggcuuccaaauggagcgaagagggaacagaguagaaaaauaaagggcccuccacccagugaugguucccauagccuagaagccucggggcgggggacacugagaauuuauggcacauagcaggcaauuugcagugagaaaugagugcaggguugcaauacuuaggccaggugcuugugaagauacaucagguagcucugaggaggaggaggaggaagcaaggauauggucacguguccaagagggcagaaggaagauggagggcuacacguccuagauggaaggaaguugaagccccauggauuagcucaacaaagauuucagauaaaugccauggugucuagaauuuauaucuagggcagccccaagaaaaauaagagaacugaaggaaagaagugucucaagucacagaggagagucaucucuauucauguuaagugggcagaacuagaaggaauucuaguacaccagugugacuuuuguaauacuaguaaggaaaauaggaaguucugaauugacacuuaacacuagaggagguaucuacacuagauaccuaguaucugacacuuaauacuagaucucgagauccuggacagaugaaguuccuguccauccguuuuagguguuugagaagccuagacacaguuuucuucccccaccucaguucuauuucccaaggugggaaucugugaguuauauuguuuggauuuauuuguuuccagucaugacguggcuauuuuguacguguguuucugucaguaguaucuuuaguauuugucuuuuuguuauauuagaccgugacagacacgaugggacagacugacucucauuuucuucccucucacucccuuaacaucgucuuggcucauuuuaacgagaagaccagagcucacaaucuguggauggaugugagcaagaagaaaacggagacauacuaaagcucagaguggcccacucucagaguaaaauggccaacagauuuggaauuuuccaucuucucacaguauuagcaguagaaagcaaaguguuccagaaggugggggaauauccagaccaagucccuuacauucuagucuggaaagauuugguuaccaauccucuaccaugggugaaauccugucuauugccccugacuuacgcuacuuuaccaccagaaacuaugccuguucuguuggcaaaagaaugaaaacgggaagauuccaagccuccgaagguucucuauccuuucuacaggacaguacacuagaggaggucacauuuccuccccccuuuacuugacugacagugcggccugggggcgggagcugcauugaugguugauggcugguuggggcaggcaucuuaggcagaggcccauuauucaccacuagaugccccacccaugccuggaaguccugcacaagcgguuccauccaugcccuggccagcaguuccaccaucggcacagauguaccaaccacaagggaucccuccagcaaagccgguggccccugcaccagucauccuuccacuacuugaggccccucagagccccuuaguguccacaugagaguggagggagggcaggcccagggcaggaagcagacugccauagcacuuccccaggcuacagcaccagaggcaaauuccacuguccuaccccugagagccaccgguccaaaagaugaacgugguauccagaaacaucacuacugggccuucgccauggcugaccuuaauaauuggaaaagagaacaugcuaaguucucugauagcccuaaacagcucauugguuuacuagacaccauucuuuuuacccuucagcccucuugggauuauugucaacaauuguugcagauucucuuuaccacagaggagauggaacucaucauccuggaggccuggaauccuacuuuuuggagacacaaaggaggggaggcugucuccucugaauguccucauuaagggggaguuuuaugggaaguaccagucuaaugcuaggggagggggagugagccccaggcugcugcaggaggacccagcagagaaagcagauguaugccuauugugcuugcugcaggcuggagggaggaugggagcuucagggggcgaggggguguggggaaugaaaaggaaagcugucuguacauaacacugaaaucucucuaguaucaguaauucgggguuuacaacauccuccccuuuuggugacucuagaggccaguuuuggacucuuuauaggucuuaauugucugugcuaacuggaugguacugggaucucaucaccaucaguugaauagucccuaaccucugcuuuauaggcuacaaaagcuuauugauuaugcauggccugaaugugaccuguaacagaagaaccaucagggggccugugaauguugaagugaggguaguuaaccauggagacuuauagaauagugaaugauagcagcuuuuggaguuuucucauucucuuuggcaccucucugugcuuucucuaaccuuagcuagugauucucuuauuauuccagagugauuacaugaaagcaacauucuccuucugcugcaggaacacuacucuaauccuuguccguucugcagaacuaccucagccagggaaucuauauuucaugcuaggugugcgauggauuuuucuaagcuuuggaugucuugaucuauaucuaauuuaaggcuguuauaguucuucucuugccauguuagggcugcuaaccugaugucugcucccagaauuacagccaaaguugaggaaauagguucucucuucugccucaucaggucucccccaacaugccccauuagguucuucagcacuauuucuucugaguaauagguuauguguggcaccaacuggacuagaauacaaaacuccuuugcaguagggaaauuaaggaucucucugugcaaccacagugucaacucuguugaacagguccaccaagccugcucagggggcaggggugggggaaugacccauuuggaaugaacuguggggguuguuugauuacaaaagugcuggugugacaagggaacuucucccaggcagguccucuguccugauauggucuucaggguuaaggcugggccuucuugggaugaucugcaugcagugucuuucucagauucauauuuagauauaaauccaacaccuucauaaaaggaggucuggaauuauagcacagccagcaggaggugguuagcugugggugggagccuuucaaaaucugaaagguuuuuagcauccuuaaccugagcagaccuacuugcuccauaugauucaaaaaagauccucucucuuuacccagacgccagaaccucagcauccagcagugauuuggcccugaucuagggcacagugcagacuaccugaccuucuggaucuugcccagcucucacaagcuugcagaccccacagcacccggaccacuuagugcacaagaacacagacuccccaccccagggcgugcagccuccaagccucucuuccugcucugcccagaucacaggcaggucuuccuucacuggcagccuccuggaagaagcaagagacucuggcagaggcuucaggcuugcugggcagcagggugagucgcuccucuuccccuacaucugccuguagugagugugagagagcggggcuggcguuauuauucaagaauuaacuaggacaccccaccaguuuacagugcacagucugugccucuggaugcauucagaggugcacaagcaguuuccagcaccuacucagcuugguuaaaccuggagaugcuuuucugcagcauuuauuggucuuuucagcaugugggggaggggaggggagggaaauuguuccuccuauacauuuaguuguauaggauauguaaccuaugagcugacccugauaaaguuacagcaccaagagugaaauguaguggcuuugccugccauucagggucuucccucugccucaaacucuggaagucuucaagaaaucaaagguuucucccucccccucucucucugucugucucucucugucucucucuguguguguguguguguguguaaaauguccuauccagagauauguccuccguguguguguguguguguguguguguguguguguguguguguguauguguguguguguguguaaaauauccuaucuagagauacguccugcagugaaagaaacacauauuucaauauguuggaaaggaaauuucauuuuugucugaugcuauuaaaaggaaaauaggauguaaauauuauuuaguguauuguuuuaauguuacaauacccucaguuuuuuacuaugguuuucaucaauuugauuuugauauauaaaguagcaggaaauaugcugguauguuaauucucuuuuggauguucaaaauaauaaugaauacuagcaacacaauuuuguguuuugaauugcagauaagaaaacuuguguggagagagaucuuauuucucaugucuuccuucuccugguguaguuuggcuucuuucaaauacaacuuuucuaccacuuuguggucaggaguggguaaagugaaagaagaggagacccuccacagguuuguccucucaagagggagaaaucugcucuuucagccuauuugugaacugcuaaauccuaagccaugccaggcaacacagagucacaggguuggagagacacaggcagccauuguagcuguaugcagaauucugagcagcagcuccuguccaaaccugucagacccauuguaugcugcugcguucccacuacuaccacagguucagucugucaccaaugcugcuggggauauccuguaggcaagcagguguguugucacuucagucuuaggacaggagcagacagccauccacugacaccgggcugaagguguugaucuccuaugauaccaggucuagaauuccaugcuuccauucuuguucaugacugucuacugagucagcaaaaugcugccaaauuuuaucuccuuggaaugucuauguuauuaggaagcuggguucucugcuucaggaguuacaauauuugaucaauaccuuugcccuuuguagagagcagcauuguagauuuagaaaugaacgacauuguugaaucuacagagcuggaauauaguguggcucugagaauuucccaaguguauuaggacuacuuccaguaugcuuuugaguagauguugcagcuauaccaauuucgauuauuuuugaaacuaauuaaaguaacagacucaauuugauagauuggcauaauguauaacaaaauugcaaggcuaucaugacuacugucaauuaauuaaaaacaaauguuuaaugguguguuuuaacuaugguuuuauaacugguagcaacaguggaucuacugaauaaacauugacauuaccuuuguguugucuuacagaugugcuggugaagaauucuuggagauccagggcuucugugucucaucguagggcuucugggagaaucaccuggcuuuaucuugaauacugauuauccucuuaaaaauuacugauguacaauugcuaccucuuaagaaaaggauucaguguuaaauugccauuucuguguaccauauuuaaauuuucuuaaauuuaauuuuauuuuuaauucauuuuuuauacuccauauuccauuuccugugcccccccauccaccccacagcuccacauccuaccccuccucccaccccagcugaccucuaaacucccuggggcuuccugucucuugaggguuaggugcaucaucucugaaugaacacucauauuaauuucuaauuuguuugcauuauccuga

SEQ ID NO: 2564 - RNA, 540 nt, Mus musculus
uuuuaauuuuuuuuauuuuuuaaagcaauuccaaaguuuauuagccauagaaaaaacugauuucucaaagucaauucuuauucucuguagaauaauauacgugaacagaaaaucacuacacuuuugguccaagauauguuggguuuuuuccuucuucuucuucagaugacagauggauguagcccaaucuaagaucacguguacuugccccaaauguucagcauaaauacagaagcgaugaacagaagacucaucaccagcacugggacaaggcccacuuugagcccugaggaaucuuccguguagaaucgccacauccccccagucccugcagagguggugcggccugcgcuccgggucccacagcuggcauuuuuucucugccagacaguggauccugcagcccuuguggccaccgcuuugcugggagaguggccagaggaacccacguuggugccacugggcuuuggacccggcaugcugaugccuaagaacggugggcacaggaggcaggaagaggguagucgggaagcuuucccg

SEQ ID NO: 2565 - RNA, 540 nt, Mus musculus
cgggaaagcuucccgacuacccucuuccugccuccugugcccaccguucuuaggcaucagcaugccggguccaaagcccaguggcaccaacguggguuccucuggccacucucccagcaaagcgguggccacaagggcugcaggauccacugucuggcagagaaaaaaugccagcugugggacccggagcgcaggccgcaccaccucugcagggacuggggggauguggcgauucuacacggaagauuccucagggcucaaagugggccuugucccagugcuggugaugagucuucuguucaucgcuucuguauuuaugcugaacauuuggggcaaguacacgugaucuuagauugggcuacauccaucugucaucugaagaagaagaaggaaaaaacccaacauaucuuggaccaaaaguguagugauuuucuguucacguauauuauucuacagagaauaagaauugacuuugagaaaucaguuuuuucuauggcuaauaaacuuuggaauugcuuuaaaaaauaaaaaaaauuaaaa

SEQ ID NO: 2566 - RNA, 4644 nt, Mus musculus
aagaguccuguccuagcugcuuguggaucaacauguagaacucucagcuccuucuccagcaucaugucugccuggaugcugccuugcuugccugccauaauaauggauugaaccucuaaaaauguaagucggccucauuuaaagguuuucccuuaucauugggcauuagugucucuucacagcaauaaaacccuaagauaauugguuuaucaggucuacauaaugccaucuggaacaaugcuaagaaacugagcuucugaugggcaaaggccauucccacacucaagacaaucugugguuucaaaggcacuaggcucaaaauagcuguuguugguaaauuagugagucaaacgauacaaugucugauacaaugauacagugucugauacaaugauacaguguguggcacacuuauauacugucugauacaaugucugauauaaugauacaagucuaaaauauggagugugcccaggacagauaagacacaauggaaagagaaaagcccacuuaaaaugucagcaguugcuuguccugagucuggcaacccaucaauccacccgggaaggauaaugauguuuucuggaaacacacaccucuuucuccuccaguuccaaaauguccugacuagggcuccucuacaacuuuucugaaacuuuuccccaaccccuuaauaaacaaauauauuguuccugcuuuuaaagacucaccagaauuaagaaugaagguaaguauuuggcauguaguaaaauuaguagauaggcuagaugguagagacacaaacaaguuuuuaaucucagcauucagggaacaaaggaaggugggucuccaaauuugaggucagccuggucugcaaagugaguuccaggacagcuggggcuacacagagaaacucugucuaaaacaaccaaaaaccaaaccaaacaaaauaaacacacacacacacacacacauacacuaaaaacaaaaaauuagcaaaugcuuucuucuugggccauaaaaagaaaacacagcuacugaguggggaaaauggggucuacaaaguccagcugaaaaaggguucagugugaggccacuuucccagcagcaggaaacccuuugccuagauuucaacaaugcugagggagaaagggugaauccucacagggcucccagcaggaaccauugucucccaccuacugaggaucccucagagugguuugcagcccacuccaugacauccggggaaggagacaggagccacuucuuuaccccugggcucccaccugguuccacucacccguauuuccuuaagaaucaccucccuuuuauggacaugagucaacaacagccaggaugcuuggauggacucaaugugacccagaugacagcaucuuuucuuuaaaugggaugcaugggaaacuuucaaagaaauauuuggacaaauucccagaagacagaucaaaugaggaugucucgagucuuccugcaggaacuguguuuucucccagggaggaccauagaggaucccauggggaggacucugaggagcgccaccuucacagcacuguucugaugaagaugguguuugguuaaggcagaucgaguugcauaacacagcaggugguaagaacacucuguggccaugacuauuugaggcugagacuacacuaggcgauggacucauacagaagcucacagcaggcuuugcacaauggcagucuggcuuucuaggucaagcuaacuuauuccaagcacauguauagauaccugaucuucugccuggcugggagcccucccugcugagcccacucucaaagccauucucagaauguguuccaggcuccuggaaagcuuaucucuaagccacagucaccaagagccuguggagguuagagcaacucuucagcaguggcagcaugcucaaccugaugcaguuaaccuggcagaugcagcagauggcugacaggacacgacgacagagcuaccaacugugagacugacgaugcugccuuguagagacaauuauaagucugugucuucgggccugaccccauuuccccacccaccuuggagcugcugcaggcugagaguuuagcagcauagggugguacuagauagagucccccuccagaacagcagcugugaccugaaagcagacucaaggcccugagccaagccaugaaagcagagugcagccucagagcacuguuuuacauuagaaccccuaagcuggauggaccauauucaggguuguguucaguacgcuccuugcuauuacauucuuuccauggucaacuugauuaguuuuaggagcacugagggcauuuggaugagacacagcuuugggggaaggagaccaguccucaaagugggcuauaccagcccacgugcuggggucccagaauaaaauggcuggggcggggagggccaguggauaacugugcguuucccucucccuuccuccuccuggguauaagugacugcacacugcugccaccacagccugguaaguugccucugccuccaagcugccaggagacaaaauaaacaguuccuuucccacaugauuucuugucugguauugguuacaggggugagaacagcaaaugauacccugagucccacagugccaaguguggccaugacaggcgguguugugauagacagguggcuucacucacauggaugcucacagaaaaccuugcacacuuccagccaaaugugugugcacugcagcucacauccauuuuagcaggcacuaugcuagcugcacauggcuuauguaugcuuuuggucccagcacucugcaagcaaagguggaucaaggucauccuaguguacauaguauauacagggcuguacagugaguauacaguguauauacagggcuguacagugaguauacaguguauauacagggcuguacagugaguauacaguguauauacaggacuguauagugaguauacaguguauauacagggcuguauagugaguauacaguguauauacaggacuguauagugaguauacaguguauauacagggcuguauagugauuauacaguguauauacagggcuguauagcgaguauaccguguauauacaggcucuauagcgaguauaccguguauauacagggcuguauaucgagagacuggaagaggaggaguaggagagagagaugaugugcccucugaacauaccgucucuacaagaagagggucuauauuuuuaagauaauucauuacuauagcugcuuugguauucugucuucaccucuaucagaucuauauuucauuuuaaaaaaggauuucucguuaucacagaaauugaaaaauuacuaaaaugaaaaagaacuauuuuaagauugacuuuuaacuuguguguguguguguguguguguguguguguguguguuggggugcacaugagugcaaguguuugaggagggcagaggcaucagauuuccugaagcuggugcuacgauguugugagucaugugcucuuaaccaccaagucaucucacuaaccacuaagccaucccuccgaccucuggagaaagaacuauuaaugcuggauacuauucugucucuuauaaaccacccaaaguucuuccaagagcagagaaaacucaccucaucaaggcagccacaugguguggagcuuacauauugcucaaagaccuuucuguuuuauuccaggaaacuaacacaagagagaccugccaaucccacaaguuaggaaauuccuuccuggggucacugaguucaccuaccuauaagaugacaaacuugaagcaaucccuuacuuucuaacaucugugacuuuagugaccaucaauuauacagaggaacugaccacacacaccucuggucuuagucccuuugucacaugaauggaaagacccuaccgccagaaagagugaggcauugcagaaaauuagaucauuuuauuuuggcuucucuaaucuacagcuugucugaagagccgagaagaugaaccaccauuuuaagaugacguccagagcagauaagcaagaggaagacaccaaauauguucuuuaagggccaagaugaugcugaugugccagguuucagauuugagagcagcugaggccaugaugcaccuggagccuaaagcaaaaacggaaaaaccugaaugacagcccaggaguuuccagagcaguacaaaguccucuaucuggcuccuacaacugucguaauaagaacugccaucauuugcugaugaaaauuaggaauguauuaacagcaaucacauuuaacagcuacaucugugggguuugccagacguaacacauuuugaaugaacuugaucuccguugcuuccuauugauagguugagcuacaaacaaggaagccgauuuuaauaugcauccccauugaauuuaaacugaccaccaagcuuauaaucucuggcuguagagacgaggacacaaaggguuaaguaacuuccccaaagucacacaagcagccauguuguugugacagaaaacauuauuagggucuuggaggaggaaaugucccuucucaaacauuaagccaagaaaaaaaucagaaacguccagcuuauaauguuagaauacucugauucuauuacagcacuuacuuuucccccucaaacugauacuuaaaaaacuc

SEQ ID NO: 2567 - RNA, 397 nt, Mus musculus
caccacgcccggcucaagcaggcacuuuuuaaaaaagauuuauuuauuauguauacaguauuuugccuucacauaugcaugccuguggaucagaagagggcaccagaucucauuauaguuggucaugagccaccaugugguugcuggaaauuggaaauugaacucaggaccucuggaagaguagccauugcucuuaaccucugagccaucacuccagcccaaacaggcacuucuuaaauuguagcccagaaguaaauauaccauuucaauaaauuaacgggaaaacaacaaaucaaaaaacaacaaguucagacaccugcagaucuguccaugcaggcucugacuuccugccugcuacaauccuagcuaaaaaaaaaaaaaaaaaaaaaaaaaaaau

SEQ ID NO: 2568 - RNA, 4218 nt, Mus musculus
ucuuucuugagguguccugauuuauuuuugcuuagcuggugcaauauugcuuaaccuuggaucguugaagacacaaggggccaaacucauaaucuuagauuugcuaaaauauugacuucuuuacuguuuuaacuuaaagcaagugaguggagcuuccuggagcauuugaugguacuguaccucugcgaaucccacagcagacuuuacagucuuggcggccuggaaugaaguagagcguguggugugucaagacucuuugauuguuucuuaaaacaaauacuaaaaauaaaauaacacauccuuuaauagucacuuuaugugcauaggcuggaguuuugguuauacaugguacacuuuugggccaauauaauaggauuuccaaugaauagaaaauguguuuuaaaaauaaauuuauaacaauaaaauacguuuaucuaaaucguagugguucacaaccuuucuugggaccagcauuuggaauauaaacagauccaccuucucauggugguguccgugaggggcuguuggagaucgggugugagaggaaggacuuguaauucauugagcuggaagaugccugucuuucauaaccauuuuaguggcaaguuguauuuccuguguuugucugugaggaggagugugaggauugucugcuguagguuauaauucuuuaacucacaaaaugucugaaucagccugucaccuauuuagauuuuagcugaguaauuuacagaccuucuacaagaauggccuuucccucucuuccuucuucccucccucccauccuccuuuccuuucuuugacagggucuccuuuucucccucugucucuauccuuccuuguagacagugugucuugaagcacauguuggccucaggcccuuuaccuccugagugcggggauuauacaucaugacaccuggcuguacucaggcucaaauuuaggguucuguacgugcuaggcaagcacucugcccacugagcuccauucccagccuucccucuguagccuggcuaaccuggaacugcuuggguagacuaggcuggccucaagacuuggauuguauagauguagccacuacaguuggcaagagcagaaagcugaucaacauccugcccuuuccugucaggcuggacuucucccugaccguuaaucguaacuuggaagcuucggacagucgggggaagaugggcauacacggauguuuucugggggaaauggcauacgcucagggaccauaaaucucugcacauuggagaacuuagaaacagugccccauuaacaggucaguagccacugucacuggguuaggaaauguuuguacccuggcuggcuguccguucucuuccuaaaaggcuugagguaugagguuuaugaaaggucaagcuuggaaaaucagaacagccguacaagccaucuccugcauacacgccuuccauuucucucgguauuuaccugaguugccugugccugcuugugcuuagaugauaaaagagaguccguguuccaggaagacacgggccgugguuuccuggagccaggcaggaggaaaugggaauguacagacaguggugaugcugguuacagcugcucuccagaggauacacuggacagagugcauccacugagcuucuuugcucaccacccgcccgcccgcccgccugccagcccgccagcgcuuccggugucucccuccugcugcuguucugccgcuuaguuaagcaccugaaguugguggagcauuguuuugauucaguucaguauuuuaaagagggcacuacagaguccagauggugacaucagcaagccaggucuuaggaucuuugcuuuacaagcuagaacacgugucugucuguuuuuuucuuuuuuuuuuuuuucuuuuuuuucuuaaugauacuuuuaccacaauguggagugugcauucaaaacugauggugaacguaaagaaaugacagcuuugaggccuucaacugaauuuuggauguugaccuucucaggugugguggugcgugucguuaaucccagcauguaggaggcagaggcaggcagguaccucugaggucaguauacuaaauuccaggccagguacagcuagguagugagacccuguuucguuuugcuuuuacggauugaaaacaugaaucccaaugaaagauacacucgugcugggggcuuugauggguguguguaggccagguguuggcacgggaugucuucuuuaaccccccccccuuuguuaaaacuugucuuugaccauuuauuuguucauggcgggaggugagcgucguguggcacacacagcaugcccauauaggucagaguuaaauucguucuucuuccaucuuuaugugagaucauaggauugaacucaggccaccagguuacaaagccaguggcuuuaccagacaaagcaucucgccagccuacuaccuuauuacuuuuuaagacauggccucuugcugaaccuggaacucaugcuuuaggcuaagcugguuggccagugaacuccagggacccgcuugucacugucccccagagcaugccaccauggucaguuucugugggugcuguggaucugaccugugggccucgggguugcauaguaaacauuucagugacuggccuaucucuccaguucucugugcuaacuguaaauagcagaaauggcaggaugccauggcuggcuugccuuucagcaaagagccagucuacagagacuguaaucagcacaauauccgaagcugggcacuggccucucugccccaggcaucugcugccuaaucacucagaacugaugggcgcuagaugcccucaaacaguagcaagggguaccuuucucuuacccaguuucuauuaacuuuaucagcucuuaauaaugccccugaauucgcaagagcucaccgucaauugauuuaaaugccaccucccauggcacuguuugcaaacagcaacauucugagggaagacuuaacugcaaaaugcugauucaucuaaagacuucggucacacugggcuguggcgucucagucaaacagaaggaaacuggcccucggugucuugugagucugugaauccuugugacaguguguuaguguuguacacaccagacauggggaaagcaagucagacauguuuuggcuuaacaguguuuugucuuucuccaacaucucuugagcucccaucugaagaacugguuuuaucuggcccuuguacauccuuggcaagcagugaguggacccuuagccacugacaaaaacgacuuugaaguuuuauuuugcuucgagacaggcucuucuguggcucaagcuaccuucuaacucaaaauguagccaagaauggccucagacuuggacucguacugucucccccucccgagugcuagagcuacagaugagcaccucgcaucucacagacucaguggugugguggagugcaugcuagauaaggacucugcguacaucucaagccccuaagguguguuuaaauauuccauguuuaaguuacagagucguagagaacauccuuuucuccugauuaucccuaucccacccugaacacaagacuggcuuucucaguucagaaaaguaagcuucaagucauuacuggggccacaauuuuaguaauggaggucagguaaccuaagagugggcagagagaguucauuguuuagaauuuguggccagcaagcccugacauacggacuuuucagguacgaaguggggcuuucuauuguaagucucuggugccuuuuguaacugccucuccugguuucuacauuaacaauaauaaccaaacccuucaaguugcugauggcagcaaaccccaaagugcccuugacugcccauuuaccuugcugaagagaggccagagggccguccuccugccaaucccagcaggacuuucaucaguaauucauuccagcaaaauggccccuuuauuagcugaacuccccaaacaaaggcugggcaaagcaaaagcucuuucauaaaaagaacaaaaccguggaaacaaguuccccgaauguccucuaacuuaggacuaccacacagagugguccugucugguccuggccagauguggcucucucuagagaguuguaccugcuggagacugggacaggcuggaacaagagcuuaagagcagcagacaccaaugaccuacuugacucgugggguuuuguugcugucuuuugcuuuuaguuuucgauguugaagauca

SEQ ID NO: 2569 - RNA, 1293 nt, Mus musculus
gaugucggcucucugcuccucccuguuccagagacagccacaucuucuugugcagugccagccucgucccguagacaaaauggugaaggucggugugaacggauuuggccguauugggcgccuggucaccagggcugccauuugcaguggcaaaguggagauuguugccaucaacgaccccuucauugaccucaacuacauggucuacauguuccaguaugacuccacucacggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccggggcccacuugaaggguggagccaaaagggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaacuuuggcauuguggaagggcucaugaccacaguccaugccaucacugccacccagaagacuguggauggccccucuggaaagcuguggcgugauggccguggggcugcccagaacaucaucccugcauccacuggugcugccaaggcugugggcaaggucaucccagagcugaacgggaagcucacuggcauggccuuccguguuccuacccccaauguguccgucguggaucugacgugccgccuggagaaaccugccaaguaugaugacaucaagaagguggugaagcaggcaucugagggcccacugaagggcaucuugggcuacacugaggaccagguugucuccugcgacuucaacagcaacucccacucuuccaccuucgaugccggggcuggcauugcucucaaugacaacuuugucaagcucauuuccugguaugacaaugaauacggcuacagcaacagggugguggaccucauggccuacauggccuccaaggaguaagaaacccuggaccacccaccccagcaaggacacugagcaagagagaggcccuaucccaacucggcccccaacacugagcaucucccucacaauuuccaucccagacccccauaauaacaggaggggccuagggagcccucccuacucucuugaauaccaucaauaaaguucgcugcaccaaaaaaaaaaaaaaaaaaaaaaaaaaagauguc

SEQ ID NO: 2570 - RNA, 783 nt, Mus musculus
acuagcaguaacaguggagcuggagaguauugcaccuucucgagacugcacggcgagaaccaccaauaaugugguggaacuuguggcccuuuccaaggccacggcucuuucggccagcagauaucaacccaugcaucucucugugcuuguggacugguuuagugauccgcugggugucaggauuucugcugauagcuuuagggaguggaucaaugaggguaaccucaaaaacuuuguguguggaaucuucaccagcccaguaggaauucaggacucucaaagccccauaauggugcccagcucucuccucagcaacagacugaaggcuuuggggcaaauuucagcugguuaacaccaugauggucaggcaugccguaaguugcacccuuaggaaccaggcguuugcgaccacaacggcagacaggaauccuguaaaugacauagccuugcuuagucuuguaccccagucuucgcgcuuuaucaggccagguggggccgagaacccuguucagcacagagaacuggcgauaucgccagcaguggacccucagaagaaagcgcaucacgucggacugcuucuuccuccauagcuccuggauguauuuguaugcacccaucuuggcucaccugaugacugccgccagaggaaagccagagugguuuuaaauuacauuucuaccauagcucagugaagcauuuggaaauaugcuuaacaacuaacuaucuggcuuucauuuucugcaaaguuuguuuuauaucuucaauuaccuguacugaguaagu

SEQ ID NO: 2571 - RNA, 2777 nt, Mus musculus
aaagaaaaaagaaaagggcagguagggaggaagaaaauuggacaauuuuaaaugacuugaauccagaauaauaaagaauucuuacaacuacugaaaaauaaaguguuuaauuaaaaugugcaaaaacgugaauagcuacuuuaccagagaagauuuaaagggccaauuggcaugugaaaaaguaacaguaucagucaucagggaaaugcaaauuaaaacuaccaucuuguuccaauuaucuaguguuaugugacaagccagccucaaaagugguagcuuaaaaugacaauauguuuucuacacguaucucugccaacugggacggccuaagggacaacucaccucugcuucgguuggcacuggcucagcccucuuggauucagggcugggacugucugcagacccauucacucuguuuggcaguuggugguacauguuagcugggaugauagcuaaaacuguuugaacacuuucacaucacccuuccagcaucccaagauuccuguuaucacggcuagguuccaagagccaagcgccccaagggucaggaccaguuagaagcugcuccacuccuguccuauagaacacugguguucugucuuauucugcauuagaagucagucauugagguugguccguauacaaagggaggggcucauaucaaagccuugaaggcaacuacaucccaaauacacacauugcccccuacaccuccccuaagacgcuacagauaucagcaucaggaucaggcucaaagaauguaucgucugagucaagcgcagagggugcccuccaaacagaaacaagucaacugaagaccuaugaacuaaaccgguucucucuccucaccuccauacagcugugggucuggaugacacuccuggaauacauuguugagaaagagaaaacaggagaccacaaaagccauuagcccauccacucugaaauccagcacaaaccuguuaccacguccuaaauuagaguuuaauguuauuaugugagaauuauuacagucccuggcuucuccugggcucuuugucaucuuuucuugaauucaggauuaauuuuuccuugcacauaagagaaggugagugugaugguuaguauugucaaccugacaggcucugggaucaccuaugagacaggugucuauggacaccagugagggauuaucuagauuacacuaguuaaggugggaagacccacccuaccugccagaggaaugaaaacaagaacuugagcugaacugacauccacucuguuuccugacuguacccaacuauagugccaugugacccacugcaucacgcuccugacuguggagucaugugaccugcuacuuccuacuucugacucggacuguggagccacgugaccugcugcuuucugcuccugacuguggagucacgugaccggauacgucaugcuucugacuguggagucuugugacccgcugcuuugcauuccucaccaugucuucugcgccacgaaggacguaacccuggagcuguaagccaaaacauaucccuucucccuugccaagaugcuuuauuacggcaacaggaagaguaacugcugcguguuucugcgucaaccuccuggccuaagaggaaucuaaaaguuuuauuucauuaaauggaacuggaguuacagaagcuaugagcugccugaugucauguugguaacugaacccugguucucugggaaagcagccagugcucuuaacugcuccagcccacuaagggagaauuugugacugccugacugcuuggaaguugugccuaaacauaaaguauacauagacacaaacacaaucacacuccuucagcaaagacgggugagcuuuuccuccagagucucagcacugagcaccacacuaagaaaauacuacaguucuuuccaacaucagaaacgcagcuucauggcuucauucagaacgucgcuaaagagcugccaucauaaucaacagacucuaagaaaagggagaccuagguugucuaacuuacguuucccaacuugucuccucgccagcaacaaaauuucaaaagcaggcaaagaaacaagaaagagaugagucaugcuuaggaaaaaacuaacaacggaaaaugucccaagaagcccagacaauggacucucuggacagaaacuucuuaucagcuacuuuaaauauguucacagguaaccguuucuaaaggacguuuuaaaggugugagaaugucuuagagauggugcauggaugaagggaauaaauuaaaagugaucacagagauacuaugcuugaaagguacaguagccaaaacaaaaauuucacugaguuaaggucgcaggaaaaagaaucagugaaaagaucaguugaggaaacugaggaagaaaauuguaucuaaaaaugaagaaaaugaaaggagccucggagaucugaaggacgccauugagcaugccacggaucugaggggcgccauugaacuugcuacggaucugagggucgccguugaccaggccacugaucugaggggcacuauugagaaugccauugcucugagaggugcuauugaguguccuacugaucugaggggcgccauugaacgugccacugaucugaggggcgccauugaacgugccacugaucugaggggcgccguugagcaugccacugcucugaggggugcauugagcaugccacuaaaagugucauggguuuugcgaaggucugugaaaagagagaaaggacagaaauaauauaagaaaauuuaauaccaaaagucuaaccucugcaucua

SEQ ID NO: 2572 - RNA, 1382 nt, Mus musculus
uggaaagguccgaauguucaaaggcauuaauaaagcccgagccaaguaggaagaaccugcugcugucuagcgugcgauugugagcgagcaaguggggagaugguggcgcccuugaaaagaaggaagaggcuagagcggcgucuagauucccacuuaacccuggccuuggcaaggcaagccugaugccuaaaccuucagaaaggggcacccugcuguggacaucugagcuggacacugcagcagauaagacuucccuguaugcauuuagacugagcagucuggauggaagaacagaauguucaaaaacuuuuaagaaacugaccucaacaugacugguuugaucaacaggaaauguagaaauaaguaugaacaggucggcagggcagaucacagagacccuagcagcugaaaggcuuuggucuugggugagagugcaguuaguagaaagcugauggagcucugagcaaagacggugcuuagggcaguuaaacuuccuguaaagggaggcuagggguagcucuuguagagcagaagaggagacaaugagauguuguggugagugcuccaaagagaaaaaaauaaaagguugaaagacucuucucaggcaggcugagcacugcacccacaaggcacuugugcuguguuaguuaugguaggugggccagcaucgguucaugggaaggaagcucgcaaggacuagaggugaggacuccagagaaaggagagcuaugguauuugaugugucaagugauaacuuuuguggucgugcugcucccaguuggacccuuccugccauccuaggcuucgaugacccuguucucuugauugucccaccucucugaauguuuccugcagucaccuuuugguaugacugccuuuagauaagguugauugauagcuuuaacuuuuguuuucuuuugagacaggauugugcuauguauauagcccacauauucucaaacucauaauccaccuaccucagcgucccaagugcuggggaaacaggugcgugucacugcccccagccagcugcuucccuuccuacuuaaccacagagcuucccacccagccuugcugaacaaguccugaucuuccccucaaagcagugugcugaccacagugagucucgauagcaugagacggaaaggcugagagacaaccugauguagacugcaucugggaaaucucuggguuuuuuuuuguuuuuuguuuuuucuguuacuugcacaauucaaauguaccuggccccaggcauacuuauacaacacuagagcaucuuuauuuaaacaucaaguaaccauugcaaaccaugugaaaacaaaauucucacuuuuccuuuuuuggguuuuugagacaggguuucucuguguaguccuggcugu

SEQ ID NO: 2573 - RNA, 19486 nt, Mus musculus
acugguggaggugacugcuuuauuuccaagggugagauguuuguuggauuuucauaaaacuuuacagccaugugcugagauauauucuguaauagcgaagagcauguuguggagcugcucugccaggccuugauuguuuaagaggccuggaaaggggaggccauacugcagucaccuucccauuucccugaguaacuacugcaaauauagcuacauauaguuccucauugucuuucagcaacuucagccucaguacugcugccuccauuuaccaugcuccaauaagaagagaaguucuagcaaacauagagcuaguucuaacacagcauauauaguccucaaacgaccaggaaacacaacaguugccauagcauggaaacuuugucuugagguauuuaaaaaagaauguaaccugguaaaaaugauaaucgguuucagugguuaaaugguuaagaaacauaugaguuguucauaauguucauuguacauaaauacuacagagcaugugguauuccaucuugaaaaugacuguuuucuuauggaaauaggcaucagaaugcuuacagauuuaaaguuaauuauuaauugauagaaaauggagauuaacuaggcagauguucuaacaggaaccugaggccuuuggaucaaacaguagaccuuauauuauucauggaccaccuuggagccauuuaguugacauuaaauuaaugaggcacuguagugagaccucauguuaccaugccugugcagugaaauugcacuacagaaaaaaacagcagcacucccacaaaauuaagaaauguugagggcuuaugcauagggcacgauuguguaauaacuuacuaguguuucacgaggagcaacagccaaacugauugacucucacuuagaauuuguucuuauauucauaauaccuaauuaugaauaaaugaguaguuuugauuuugaaguaggccugccuauucauuuguuuaaucucuuucaaaauucuaagaagcaguuacaaacugauuuuauuauuuuauacccagugauuauaagggacaaaaggcccacagaagaauggccaaguuagugugugauaacuaguuguccugcugacagggcgcucugccaaggccaccaggaguucuuuaccuuggccagugaaccugcguggagaaggcucauuuacuacucagccacucucuccaugguggcagaaauacccauaaucccuacacucugagguauagucucguaauugcuugaugucuuccccaaagaagugugcacugccaccauguccucuguacaagcuccuuacuccugaggcuccauuccagucauuaucacagcuuuucuuugaggaccuauuuguguuacauuuaaagauaaaaguaaaugagacagugguccugcccugaguuaguuuggagauagucauguaggugugguacagguuguucagagaauacagauagagcacauauaaccugaacuacacuuccagagaaaguugcauggugcaggcaacuucuuuugcuguaguuuuguuuuauucuagggauaaaauuaguuuacacuguugagcaaauagucuaaugcugagcauaucccuaguccuguucaccaaguugccuggccuugaacucaccuugaagcccacacaagccuuaugcuugcugucugcaggccugcaccugcauaugcuuugguugaaucccaaagcaaaacaaauuagugcagcaaaacuacuuaaaggaaugauaguccaggcgaaguacaggacugccugccuggaagcagagggaaaguaggacaugggcuuauuuauuuauagugggaacagggaggguuaggguacaggcaggaugcaguuagagacuugagcuugugagagucauacagaaaggguaacuguguuuguccaaagcagaguaguuaugaaagaguaaaagaauugcuugcuggaaauguauuuguaucucauuacucacagaggauggguuccgaggccuucucucacccaggacacccaagccugcugaugcuuacaucccuguaugaagagcauagagcuauguaccauuucuacauccccuguaugaagagcauagagcuauguaccauuucuacauccccuguaugaagagcauagagcuauguaccauuucuacauccccuguaugaagagcauagagcuauguaccauuucuacauccccuguaugaagagcauagagcuauguaccauuucuacauccccugugugaagagcauagagcuauguaccauuucuacauccccuguaugaagagcauagagcuauguaccauuucuacauccccuguaugaagagcauagagcuauguaccauuucuacauccccugugugaagagcauagagcuauguaccauuucuacauccccuguaugaagagcauagagcuauguaccauuucuacauccccugugugcuuacaguucuagguuacugagaacaccuaacacaguguaagcagcucuuacccugugcuuuuuaggagcauugacaagaaaagaccagucagugcuuguucagcucacauguaaccaugcuggccucaacuguacaguaugcuaaugugaguauaguaugcuaaugugaguauaguaugcuaaugugaguauaguaugcuaaugugaguacaguaugcuaaugugaguacaguaugcuaaugugaguacaguaugcuaaugugaguacaguaugcuaaugugaguauaguaugcuaaugugaguaugcaaaugaaugcuggauaucccgaagaucugugaaaugauugaaggcuuuguuugcaugggaucaggguagugcuuauuauuugacaaauccaaguguuccuguugagacuuuucugguauucugguauuuguuuguucaugugugugugcuugcaggcaggcauuuguuuguucaugugugugugcuugcaugcauuugugcgugcagaagccagaagagggugucagguccgcuggaguuagaaguuauuguaagcugccugaugugggugcuaggaacugaacccugguccucuggaggagccgccagugcuuuucucuguaguuauuuuuaacuugcuuugcuuccuuccuuuugucucugugugagauguguaugaucguuuguuuuggugaggguggugcuagagcaugagcccaggaccuuucuuucuuugugaguuuuauuuuugguuuuuauauauuggcaguggugcuagggaauguguucagaaccuugcuugugcaggcagguauacugcuauugagcugugcccugcacugcccagaggcuggaguaguuuagucuuucuggaaauucccaucucgaggucaucugggggcacuucccuaauuugccuguuagccuaaaguaggugucaucuuuaaggucucauuuauggacaacaaagaugcuucucucagaaaauucugagaauuuuagcaccucugccaggacccagggagacugggaccaaguguaugucuuuauugcccacugcuacaguauagucagauuccguacuguuggaguacaggaugaagauugugauauuuaguguaacccaucaaauuaacuugguuuccuuuugauauguuucuagauuuuuccauuugugucaagcacuuuuuucacaucucccauuguauuauaugguuuagguuuuuggaaggaauuguagacguugcaucuuuccuugccugaugcuuagcucuucagauguauauguagcauuuaauacauuauucagugacuauuucagagauguguuaggcaccguccuaggucugaaggaaugacugaagugcaucacuggcucuuuguaccugguuagagaacucagggugagguaggaucgacacuagccuagagaagaaauggagaugucugcauaggggacauaggaagaacagggauggaaucagcaacuucagccucauuaaauauagagugguggaagauuuaaagaaaggaagaagagguuagccauugaggugccuuggagaaaaacgugcaaggcagaagaaguguucagugcaaagucugaaggugaggcuaucccagauuggagauaagaggagaauuugacauagaaauaaauggacugaagucagaaagguuuacggagucagguacuguggggcuugaaacacaaugcuaaagacugaguuuuacuccaaaagaaaugaaaugaacaauaugaguuauuuaaguauuuauuuauuuuuaugucauauauauggguauuuuugccugcauguaccaugugcaugaagaggccaaagggcacuaaagccccugaaacuggaaacugcauaguauuggcacagagacagacagguagaucaguggaguagaauugaagacccagaaauaaacccacacaccuauggucaccugaucuuugacaaagaagccaaaaccauccacuugaaaaaagcagcauguuaacaaauggugcugguucaagucuuggugaucgguuuguaagagaaugcaaaucgauccauccuuaucuccuuguacaaagcucaaguccaaguggaucaaggaccuccacauaaaaccagauacacugaaucuaguagaagagaaagugggaaagagccuugaacacaugagcacaggggaaaguuccugagcagaacaccagugacucaggcucuaagaucaauaaucaacaaaugggaccucauaaaauugcaaaggacaugucaguaggacaaaacagcaaucuacagauugggaaaacucuuuaccaacccuacaucugauaaagggcuaauauccaauauauaccuagaacucaagaaguuagaguacagaggaccaaauaacccuauuaaaaacuggggaacagguccaaccauuugccuaggaauuucauaaguucauucuuuuuaauagcugaguaguacuccauuguguaaauguaccacauuuuuuguauucauuccucuguugaggggcaucuggguuguuuccagcuucuggcuauuauaaauaaggcugcuaugaacauaguggagcaugugucuuucuuaucauccugagugagguaacccaaucacaaaagaacucaaaugauauguucucacugauaaguggauauuagcccagaaacuuagaauacccaagauauaagauacaauuugcgaaacacaugaaacucaagaagaacgaagaccaaaguguggacacuuugccccuucuuagaauugggaaaaaaacacccauggaaggaguuacagagacaaaguuuggagcugagacaaaaggauggaccaucuagagacugccauauccagggauccaucccauaaucagccuccaaaugccgacaccauugcauacacuagcaagauuuugcugaaaggacccugauauagcugucucuugugagacaaugccggggccuagcaaacacagaaguggaugcucacagucagcuauugaauggaucacagggcccccaauggaggagcuagagaaaguauccaaggagcuaaagggaacugcaacccuauagguggaacaacaauaugaacuaaccaguacccggagcucuugucucuagcugcauauuaucaaaagauggccuagucagccaucacuggaaagagaggcccauuggucaugcaaacuguauaugccccaguacaggggaacaccagggccaaaaagugggagugggugggcaggggagugguggggaggauaugggggacuuuugggauagcauuggaaauguaaaugaggaaaauaccuaauaaaaaauauuuaaaaagaaaaaaaaacuggggaauagagcuaaacaaggaauuaucaacugaggaaucucaaauggccaagaagcaacuuaagaaauguucaacauccuuagucaucaggggaaugcaaaucaaaacaacccugagauuccaccucacaucagucagaauggcuuagaucacaaacucagguggcagcagaugcuggugaagauguggagaaagaggaaaacuccuccauugcuggugggauugcaagcuuguacaaccacucuggaaauuagucuggcgguuccucagaaaauuggacauaggacuacuggaggauccagcaauaccauuccugggcauauacccaaaagaugcuccaacauaauauguguagcucugaauuuuucuguuguugcuaggaucugaacccaggcccuacaaaagcagcaaugcucuuggccauuuaguugucucuccagcccugcagaggguugagcugccuagauugugcucuggaugcucuguugaaaguggacuguggggaucaaguuggaugugcugaguggugggugaauuauggguccuucagaaugguccacauaauucucucauuguaguuuguacugaaugaacuugguuaguagaaaucuauuaaguaacuagccuucaucagauauggcuuguuaaaauauaauuuuaagaacaaguaaauguagccgaguuuaguucuagcaaggaacaauuggugagucagacagcacucaagcaaacuggacaguucuuaagagauaaaguucuuagagaugagaaagggaggccuggcaaguuaguccuuagaggagcuagcacaaaguugcccuucaaaagucuuuauuaggagaaggugcugagaccaugggagucgcuggcaggccuucagguaggagggcauuaaaacauaaauggggucagaaacauaaagaaacuucucucucucuaacaccccgagaggagugaaagagccacugugacaggccaggggcagagaagggagccuucagaggacucugaacacaggaaauaccagacuucgagcuuuuaggggccgguaggaacuugcacacuguguauuuugggguguaauagccgaaugugacacaggacagaggagccaggcaccauggaucagcggcucaguuacucuucaguugcugugguacaauacccuggcaaacgguuuauuucugauuuguuugacauacagccccucaauguggggaggauagcagagagccuaaugccagccucuuaggaagcagagugacuauaucucaucugcacauaggaagugaggccaugaaaccucagagccuguugccagugauguacuucuuccagcaaggugccccuucuaaaggcucccuaacauucucagcacacgaacuagggaccagguauucaaaugcaugagccugugcuggggguggaggaagaggacacacauauuucauagucaaaccacaacagcuggguacuguuagaucauagcacaccaagggaagagcugcagggacagacccaugaccuaacauggagcauggagaucaaguacagaaauagcacaucuggcuacagcaauaccuuagcuucuuuggaccuauucugaucaguuggcugcuuguaauucgguuagguuuggcugcauuaccaaaaacacauacuuuauguuagguuuuacuugccaagugaguuggcaguugauaaugugggaccucaaaguauagaaauagucuuaggucauacuugauuuaguacaguguaacauacacacaaugauaugccaaugaucucuaucauaucugugaaguacaauauaaaauuuauuuuacuuucauuaguuuuuuauuauauauauuuuuauuuauuauuauauuuuacuuuuaccugaaagguaacucuuugggagacuuuuuuaaaaauacuuaucucuguauaugucuucaugucuucaugcuauuuauagugcugaccuuacaauaacugcuucacauuuucuguugauuuccauuuagucucuauuugccuacaugucaugcuagccauagguucaugaaguagcauagguuagucaucuuucuguuauaagaaaaugucugggauaauuuguuaggagaaaaaaaugggagaauggugcuagagaaauggcucagcaauuaagaguaccugaugcagaggaccugaguucguuucccagcacccacgugucguggcucacaaauagcagcagcuccagauccuggugacccccccccacacacacacacgugcacgugcacaugcacacacauacagguuugcuuaggcucauggucuaggggucuucaccuuuccucugugccucugguacacacgguggacuacgugguagagcaaacugggcagaacaaacugcucaccucauggcugaagcagaagaggaagaggaaggcuucgggugcuguucaguugccagaggggcagccuugcaugcaagaaguccuggguuuaauucccaauaccacauaaaccacauggugacacaauccuguaauccuaacaaacuggaaguuagaggcaggagacucauaaauagcuauguagcuaguuugaggccagggucugacaauucauuucagaugacagaagcacuucccacuuguucccacacugccaguggccacaguaucucuaguagaagcauggcauauucuaggccuuuuacagauggaccucuggaggccagucagugucuaagccauagcuuaggaggcaaggagcugaguguuagaaaggaccaucgggccuagcaaacacagaaguggauguucacagucagcuauuggauggaacacagggcccccaauggaggaacuagagaaaguacccaaggagcuaaaggagucuccaacccuauagguggaacaacaauaugaacuaaccaguaccccggagcuccugucucuagcugcauauguaucagaagauggccuagucggccaucacuggaaagagaggcccauuggucuugcaaacuuuagaugcuucaguauaggggaacaccagggccaagaagugggaguggguggguaggggagugguggggaggguaugggggacuuuugggauagcauuggaaauguaaaugaggaaaauaccuaauaaaaaaauaaaaaaaaaaagaaaggaacaucgguacugcagacauacccuuugcuaauucacuuagucauaaagcuuagucuugauauauaguauugacacauaugaauauaacuauauuucaaggaauauuuaauuaauacauauuucaaaauaggaaauauaagugauuuaaacguuuuuacuuuauuuucaauuugcugcuuaaguauucuagcuaauugagaaaauuaugaagaagaccuuuugcgggcauuagaaaaugaaauuuggggaugucuaauauuaaaggagcugcuuuuugucuucucuuuuaaagcugauucugaccuggagccugcgucugaguuaggaggagauuuguugaagcuuuaccugagucagcacuacccugacauugacauuuguguugaugggaggagcuuccgagcccacagguggggacugauggaucugcuggugugacauagguucagagaagagugggugguuuuccagcacauuccugcagacauagggcuccacagcagcuguucagggucagaaucuggcagaggagaagcuggccaccagacagggcuucaugccugcaggcucacauaugcacaaguuucagucugagcaaaucugcucaaauccaugugaaccuaagaugucaucagaagaaaguguucugccuaaaauagguuuaaaauucauguuaacagaaaauguaguuaugcaguuuuuaguuuuuaugggcauuauaguaauauuuguauuacuauacuaauaagcauguaauaaacuaauuucuacauuaauagcauauauuguauuggauacacuuuggcucaaauucugugcuucugaauagaggauguuuaugaauaacauugauuaggaggucugaugcuacaauguauuuaaaaauauagucugugcuuuagacuugacugcugagauagcucaggguuuuuagauuucaaauuaaagccuacccacuguuuuggucaugcucuuuuaguugucaaguaccuaaaaucuacuuaacagaagaaaaaaauuaacaagaaauagaaauaguuuguuggaacuggagggaaagaaacauaggcaggucucagcuguggaugagaaacagccagaagucugaggaaccagacaguucucccuccacgcuucaaauaggaagguugauaggaaguuccucugugcgcaccuacagaggaugaagcagacucugcugugguuguguguguguguguguguguguguaagcaggcuuguaugcauguuagggugcacauguguguggaggcccacauugagaucaggugucuuccuugaccacuuuccauucugaggcagaguuuuuggcugaacccaaaacuugccaaucguggucccuaggguucaccuaccucugccucagaagugcuugcauuagagacagaagccauggcuacuugcuuuuuauaugggcucugggggaaaccacagacuuuaguccuuaucuuuguauggcaagcacuuuaucuacugagcagccuccacccaagaagcaauguugaagacuccauagcaguaguuuuagaauacaggaauaccuccuaaacucagaaauccuaccgauuguccaguuaauugugacaacaaugcaguaaggagacuguuuacugcucagaauuuggugauacauauuaauauuuuccuaaguuauaucaucaucaucaucaaaguuuagcuacauagcccuagcuggccucaaccucacaauucucuuaccucaguauccugagugcugaccuaacagacauacauaacuauacuuagcacuuuccuaauucuuaagaaauuuucauuauuauaucaaaauacagaacuugguagagauuagacaauauguuuuacaugucauauuauacauuuauuaaacugugagggguguguguguauguuugucugccugucugcaugacugccuguuugccugucuguauuuugccaacaguauuuuaaauuuuuacuucauuuuguagcagauuuuuucuugaggccacaugagcacugaaguugugcuaaucggacccuuaagccgccgcugccacagaggaaaggcacagccucaugaccgugaacauuugcagcuuguccucagugcuuaccuguggccauuccccuuugugccuuagacuggacuaaguggacuaagagaguaauuucaggagcuagaacuagaauauuagguuuuugagucaccagguagacaccaggagcugaacuuagguccucuggaagagcaacaagugcucuuaagcgucgagcugucucuccagccccggggcuccucagccugcuaacucaguggcccuccaaugcaguuccucauguugcagugacccuaaccauaacauuauuuugcacuacuucauaacugcaguuuggcuacuguuauaaaucauaauguaaauauuuuuggagauaaagguuugccaaaggaguugugaccccccagguugagagccacuguccuagaguguuagauguaguuuucauuuaugguuuaguuuuguucaucuugugguaaaaaggaaaucuggauuaauagaaaagcaauuuccuaaggagauauuuuaaaauaugaccuauuuugcuaccuuguuuugcauauuaugauaguaaauucugcaucauauuaucuuucugguucaaauuugaacuuuaguucauaguaguucuguuaaauucaaagaauugagacaaauagcucagaaaauacacauuugugaguagaccaugucuuuaucucuguccuccucauccccagcacuucugcccuagucagaagugaagggaguuuuacuaaggauggaaggcggcagguaaguccgguggucucagagcuccccacucguuacucagguucucuuacugacacuguucucagugcuaagcagcagaaugcugcugauuuauggagcucagcugcaucagucuccugccucgacuccacuugauuacuugaugaguccuagcuacauacugagcauuucuguuugcuccuauuuucuccuggcaccucaaagcuaugcuauaccccaacagcuaccgccaaacaaccacucuguugcugcccucccguuuuaaaaugccauuuauuuuaauguuuguuaagacaaacugaauguuacacuuugaagguaauuuauuuucugagucacauuaagauucuaucauauugccuuauugaaaaaucaaagcagugauuccuaauuuuagcuucaugacacucaggaucugguauuuucuuaucaguguuugguauuauauuacuagacauucauuguugaauuguaauguuguccaguccuucuuuaagauuagugaguuauacaguaccagaagcucagugaguuacucugggcuaggccaccaucuaugcaucuuuggguacauuagccaaaagccuuucagaaguagcaggcuuuagugaguuggucuuucugaaucuguauucugauuucagcauuuacuaauagugggcaaguucuuuaaucucuugagucuaaauuucuucaucuguaaaaguaaaaauaguaauaauaguaaguauagaacaagaggcaguaugaacugaaucagauauucacaagaaaccacaucucuguguggcuagcauauuguaacacuuugaaccaaauguuaguugcucuacauacacacuagacgucuggagaaguauagcaucgucugggacaccucccucucuaccgcagacggcagguaugcgacaagacaaagaagguguaagguggcuauaagccuaagauauuuaucugauucuucacagaauaaauuugcuauucccugucuuuacaggauuuauacuuaaugauauaguuauauauacuuaaugaacuaauuauaagauuucucauuacaaaagaagguuauuagcaucuuaguauuguuuuauuaauggugguuugucaacgugagaggcuuaaaauaaugcuaagauaggcaagcaauagacgaaaagaggggaaauccuuagugccacuagccuucgaggagguugugaaggggagcuaaaagcaagaagaagcacuaggugucugaaacaaagaaggcacgcagaccacagacugcugagcucugcuucaagccuccaggugcccucuggagaacuugcuggccgcauccagcuuagugcacuugcccagcagaucauuuucuacugagccuuaccucuguccuaaguuuguacuuuccagaaaaacaaauuuggcuuagugauaaauuccagagugauuuucaccuccaguguaaaggugaacuguaaauacuacugccuguguuuaaagaaggaagcuuugagcuuuccuggucauacucucuucaaacuccaauggaggucaugaaggagaucaccagggaucucagagcaguaacacuuuaaauguuuaggggugagccagcagacuuguggcccucuguccuacccaguaaagcucugugaaguugacaaaaaaguucguaccuuccaaaaauuacuuggguauauucccauauacccaucccauuuggauugucauuuugaugucauaaauugauaaauacuguacaauccagcaauauguagaauauaaaaaguugccauuccaggggcaucugaggugggugcuuugaauauauaauuagggaaugggcacuuagagccugcuguugaguucaguuaacaauauaaaguauagugagagcugcugagauauagccaguaccacacucagaugaauucaccaagguuuuuaaacccauuuuucauuuuagagaaauuugagcuagaaaugaugauaaauacauguaucauucuugcaagaagagcucugauuagugaauccuuuuuaaagaaagauuggccuuauagugaaagacaaaacuugugagggaccuuuaugaggugcuauggauggaacccagagcucugccacugagcuaccuuuccacccugcacguucauuccacguaauuaucuaugaugccugugaugugccagcuuguuuuaaaauccuaauacauuagauuaguuuaguuuaguuuaguuucuuugagacaagguuucucuguguagcccaggcugcucuggaacuugcccuguagagcaggcuggccuugaacucacagagauccgccggucuuugccucccuagugcugagaguaaagucaugugccaccaccaugcagcuaguuuugguuaaucaacugugaauuuggcuauauuguaucauuagauagggccuuuauuguacuuuacaauuuaacuuuaaaaggcuauuccaugaaagcugcaaucaaaacauagucucuaaaauauuugucacgaaguagagugcauaauggugacguuuucagaaagugucugcacucgucuggguuugagccuuaaucaguuauguggagcuaaauaaagcaagagcuacuuuccccaccucccucccuuaaagcaggaagacuuaaaaguuaucuccucgggagcccuuucugagcaaugcaggccauuguucugcauggagugugaaucuaguucagcuagcaucaggcaguguggacugccauuguccugaagcagcagcaagggggaaaugagggcaucuggguacagccagaagcagcguagucaguugagaucaaauuuagucaaaagaagaaaauaguuucugacauguuggaaacuaaaaaggauguuucaaagauucuuaauauaccaugccauccacagcaccguuaacuggaggcagauguccuaauuaaaaaggaaucuuuucuaaguuucuauuuuaaggucagaguaaucacuuaugccucguacgcuuuuaaugcuuucucuggagagagcuagcaugcugugagaguucaaaucuuguggugcagacgcaggguuagauuggauagcaggagguaugcacaguaacuuugagagagcaucgggggaagccagagaagccuggggcuugucggacuccagcacugagcugaccuuggaagaaggaaugaauggccugcaugcugcuacaugugucuggggacagccccacaagguucuuggaaaauguugaagcaaucauccaucagaaaagcccaucgcccagauauuuagaggcaccuuucuccuccacucugcucgguuauggcaagaaugacucaugaggagguggcucugggaucagugugccuuagacuucagagugcuguuacacaagucaguggucagaggcauucucaugacuguccacacaaaagucaugacaugcuguguauuuguguaacuuuacuauuaggcuuagccagauaaaugguaucgauuagaauguuagaauucuaaugguauuauucauuaaggcuuuuugauggauugggcauggugguagauugcaauuagauauaacuaauugcagcacucaggugacugaggcaggagagucaccagcuguucauaucccaucuaaaccagccaguucaagauaauccuaagaaacuuagucaaaccugucucaaaaacuauucuguaacaguucgaugcacacucauagacggugugcugcugagacugagguccauaagggauaagggugacacacacagaguaggauagugcacacauaggcuguacagugagauuacuguaggagaauagccagggcaggugucuugaagggcugcccagugcacugcuaaccuuggucaucucugaaggcugggguugaaguaaaaaggggcaaaugaggaacuuaagaccucguuuauacaguucaguggcgaacuucuacagacaucuuagaauuuaaaaucuugcuuuugacuuuccuugcuuuaggaaggaaucacaaacuguaauguuuguaaucuguccauguagacucagucacacuuuacagauucuaccuuuagucuaccuuaaugcuucguuguuguuguuguuuuguuuguuuguuuugagauaaaguccugcucuguaauccuggcugacugaucugaguucucuauguacaguggccucaaccuugucucucuuccugggucugccuuuccaaugcuuggguuacagguaugcaccccaugccuggcuucuguauuaaaacagaauucuuagaucagugauuugauccugugagucuuuuuuuccuuucccuacguguguguguguguguguguguguguguguguguguguuucauuuucuuacaugugugguucauguagguauacuugggaaggucagaagucaaccucgaguaucuuccucugcugccauccaucuuauauucuuuuaaaauuacauuuauuaguguggaugugcaugugugcaugccauggcauguuaguagagaucauaagacagucugugagagccaagucccuccuuacaccaugucaguccuagagacugaauuuaagucaucaaccuuggcagcagugucuuuaccugccgagacaucuugccaucccuccacauuguguuuugagacagcucucucacugaaccugaaacuuuucauuuuaaguagucaggcugaacugcaaaguguauagucuacuguuuaugucuccccagcccucuaaauacaccaguuuacaggugugcuccacuaugucuugccagaauagggcauuagaccccugggacugaaguuauagauguuugugagccaccauguggguggugggaaucaaaucuggguccucuggaagaagagucaguucugaaccacugagcgucucugcaggaagugugggugcugguaacccacacucaggccuuacaugugcacaccaagcacuuuauccauugagccuuccucccagcaucuuuucccaagagagaauuuagaagcuaaggguuuuccucuugucagugcuuuagccaagggacacacauuuuguuuuguucuaggggcuuguggguuuugagauggggucucacuuuguagcccuggcuggccuggaacucacagagacccaccugccuuucucuugagugaugggauuaaagguguaugucacugggucugaugaggcauugcauuuuuaaaacuaaaccuguguuuccugaguuuuuauaguucuucuuuaccaaugaacuguguugagcuuccaaguauuaggggauuuuucacuauaaauccaucacugcuugugaagagaaagauaaauguuuaguuagaugaaaguuuuaaaagaagaacacauaauaaauaucuguuguaauuuccuuuuguguaaugauuuuaauagauuuuugaagauauguuuuuguggugauuguuuuuagaaaauguauaacuugugauuaugagguaauuuucuucuuacauagagaaacuuuaucuuagggaguauaaaagggguuaagagaaaaaaauaaagggcuggagccuuccuuugcuuuaaccacucagucaguguguguguguguguguguguguguguguguguguguguguagauguguaagccaucgccaguguguccuccccucccugcucuucuccacaggcccugcccacaguccaccagagcgcaacacuguucuguauguaggacucaaugcugcagucacaguacuuagaguaaaacccaauacagauaaacucagcgggaauuugggaauaaauaguuaauuaauauuuuauuugaaaagacaggaaaauuaaaaaaucucucuuuucauuucuucaggccuagaauauagccuuugucaaauguaacugcagagaauucagaauuagagcuuaaaaccucuauugaaaagucugucuuuaaaaaauucauuuacagugauuuccaccucuuugccuuuuuguaaaauuuauuuuuauuuuauguguaucaguguuuggcuuacauguauguauguguaccuggugcccacaggaugucagaugcccuggaacuggagccauguauaguugucagcugcuuugugaguuugggaacuuauuuacggccuguacaagagcagccaaugcuuucaaccaucaagccgucucuacagcccuuucuuuucuuguugcuguuucuucugcaaguugcuaaguuauacaaggcuguauuucaacagugcuagcagcaugucaccaacagagauccaucucucauuccucuaacccacaauaagagcaccuccgcucuuacgccuccauuuguagaugaugauuuuguaguuuuguaaauauaaagagcuuuuaacagaacaguuuaagugauaauaagggcacuguaauuuguguuuuacuggacugaacuugcuuacucccuuuguguuuagagacagaaucucaugagguagcuaaguugacuuggauccccgugccucagcuuuccacauguaggauuacaggugcauguuaucaagacuggcuuuugaauuaauguuuuaaacaaacaauguguagguguaacuguuuauauuuuuuguuacagguauucuaucagucaguaaaaacaagacaaauaggauguuuaaagagguggaaaugaaaauuuuguaagaucuccauuugcacagcauguaaauacucaccuguuuccauccucucucuucagggccauuuuaagugccaggucgaguuauuuugcugcaaugcugaguggcugcugggcugaaagcucccaagaguguauuacucuucaagggugaguaagcauaauguuucaugagucagcgugacuauagaagauuacagaugauacacacagcauucuuccugcguucagaaaaaacauaucuuagaugguagaacuucagaacugacguuuuuucuaaagcuaaaggcagaggaucacuuaguaaucaaggucuuaucugaaucugcucaggcccugaaacagagccgagagacugcagcaccacacaccgguucucacacuugugaaggcugagagaucaucaaggcuuccuuagcuuguggacagcugcucccugugucucguggggcguuugccauuugucuugucugaaaggauuucugugguaucucuccaaacacuacucuguccuauccaggcuccagccucugcuuaauuuaagcuuaucucuuuccaguggccuccucucugugcugaaggcuggagcuucagcgucugaucuggggaggacacagucaguuccuggugcacacaugcauagugcacacauuccgauuaagggauauuuuaacugucaggcuuaaagcuucauuauccuguggguaagaggaguuaaaaggcauaccugcuggugaccuauguuaccacuguugaaauacagcgugagggggcuggagaaaagcucagugguuagagaccuucuugcucuccacaggacccuaugagaguucccagauguuuggacagcuuacagaugccugcaacuccagcuauggggaucugcuguccucuucuggacuucauggguaccagcacauauagacauaaauaaaaaauuuaaucucaaaaaaaccccaaacaaacaaauaaacaaacaacccaacuugaaag

SEQ ID NO: 2574 - RNA, 8202 nt, Mus musculus
augauaaagaugcacagcaccucagcuaagacuggauuaagucaggaagacaauucuugcuccuucugggaugaagggcuauuuacuaagaggcauaagcaccuaaugcuuucccaagugaaccugauauucaagguuuaauauuugacccuuucaaguuauuuuccuauguacauucaugucuggcauguaccauaaaaaugaaacguccuagacacccccuucuccucaaaccaaauuucaccguuguucucaaaucuuuaaagccauggauuagcaccaguuguucacuuccaagauugaccuugagauacuuucuucccacuaaucaauuuguuuguaauaaauguccugaugaucaugcuaauuaccagaucugaaaaucugaaagauaaggacaccucccaggaagacuagaaacccaagaaacacucaugagauuugcaggaacccauguaagcugguuuuuccuggagaaagacucucagcuaggcaugguaauacuugcccuuaaucccaccagugguagguuauggugcaacacaaaagguaaaauuaauuuaauuaauuaaauaacuaucuacuucuuugcuuuuguaauuucacacuauuuccuauagucucauuaauaacagcuuaacacagaaaaagcugcuugaucaauauguuuauugucuuuaugaaaaaaucuucauagaaaacugcuuuagcuuucagcagcccuuuccugagcucugaggaagcuugccuucuuuugagcaacccgaucuuucuucugggcaagagacauuuugggacgauuccaccuacaaaacaaaguaaggaauaagacaggaauaucucucaagugcagcugaaaaaaaaaaugacaaaaccuuuguaauuggauagauugaaaaucucauuaucugaagauguguguguguguguguguaugcauguguguauauuauagguuuuccuauauauccuuuaguuggcuuugaacuuguugcaauugucaugccucaaaaccugaguacacacauuaaguucuaauccggguacucaacugcaauggcuauauucucauuguuuacgccaucaaacucaagucuaucucagcugagcaugauggcucacacuacaagcccaguauucacauugucagguagaggcagaaauguuaugaauucaggcaggcaaagaaagguuacucuauagguagcuaaaaagaaaccaugcaggacuguacuguaacagaaugggcaccucaguagcuucugagguuggcacauugcugucaccacaauuacucuagcaaaccugguucccucagcugcugccacauuaugcagagcuagugaucgaguuugcucaagugcacagaaaucugaccagcaagaugcagcggguuucuuuccuagagaauuguaaaccacccaccucuucuucuucacuucucucuugggcuucuucucauagacuggauucucucggauagcagcaugagcuuucuuauacaucuccuccaucuggaagaaagcaaagcaaacaguauuugccuucauuucaugugcccuaaagguacaguaccaccugcauucaguucucaaaggauccuaacuaagccaauauuaccuccuuauauccccaagugcagcccacccuuauccuuacaucucacuguuuaggaugaacaccugcaugcuuuccugagaacuacaagcccauuuuuguacaacuauaccauacucuguagucuacugccucaccuaaauucuuucaaaagaagguguacaccuaaaagaugugaacuauacagggauaaagacacacuaacaagugagagcaagggcaugaggaggggguuauccuaccaaacuagguaacaauuuuuuuaucaucccaaauauccaaauuuauauucccucuuaugugacaggccuuuuaagccagcaccagagacauacuauaccguugccaauuuuaguacgugguagcuaucuuauuagauuucauuacuggaaccuuugauucaaguuuguuuuaaaaaauuaaauucaauguggugguguacgccuuuaaucccagggaggcagaggcaggcggauuucugaguucgaggccagccuggucuacagagugaguuccaggauagccagggcuacacagagaaacccugucucgaaaaacaaaaacaaauuaaauccaaggcuauaaaccccugaaguauaauaggugcucaagaacaggaaugccaagagcuugauacccugcaagcucuuauuaaagugacuguaauccagcuuucuaaacuaauucauuucaacauggaagaggugacaaagagaaaauaauuuccucacucucucaagccagugaucccaguacucaggagacagaauguucuucaacccucuaucauacaaccugacaacugcaaguuaaaccacccaguucuuucaaacagcuucacuauguagaugaggccauggacucacucacucacucugcugagaaacauuaagucugcaggagauuucagcagcuacccacaacacuccugauaaguaaaagcaacuacaggauggaagcucagaggcugaacacagaagcuuuaucccauagaaaacccugagccucaagcugagcaagcacagcaugaggaagucaguacaagacccagaaagacaagaaagaagugaagugcacacaggaaaccaugaacugagucucauguaagauuauguccagaggagagcgcacagaccacagaaagugcuuuccacucuauacuucagagaggagacuuuagaguugauagauuccaguaucaaacucaauuacuuccccaaccccuacuuuuacaaacaacugguagagccccagaggauuucaauaaacucuaaacugcaguaggguaugguaacucaccccuuuaagucagacggucuuuuuuuuuuuuuuuuuuuuuuuggguuuuccagacaggguuucucuguauagcccuggcuguccugggacucaacucuguagaccaggcuggccucaaacucagaaauccgccugccucugccucccaagugcugggauuaaagggucaggacugucuuaaauuccauggugacccugguugaauaucaagucccuagacaaauccaggagaagugaggcuuguccuccccaaccucaacccccaaagcuggguggugguggcggcgcacaacuuuaaucccagcacaagcagacggaucucugauuuccaaggccagccuggucuacgaaguugaguuccaggauagccaaggcuccucagcaaaaccuuauugcacaaaucaaaaaguuaagucucuuauaaagcagccauucaaaaaggaaaaaaaaaaaaaaaaaaaaaaaaaaaaaaaaaaaaggcuguacugugacagaaugggcaccucaguagcuucugagguugguacauugcugucgccacaauuacucuagcaaaccugguucccuuagcugcugccacauuaugcagagcuagugaucgaguuugcaguuuucugaccagcaagauacagcaggcaaugcaggaaccauuccuacuacagggagacuuuaaaugcuagaagcccauauuuauuagcaucuaaaaauccucuucccgccugaccaauauacuaacuucacucaaaaggagcagcugcuuaguagccuaucuguaucuacccacaaagccacauccaaccuuccaguuugcaaaauaaaaucaauguuaacacuacaaccacugaaauaagcaguuucuguaagugaacaucauguucggguaaauuuuuaccaugucuggaguuacguuguucuugauguacugagagaacuguuucuuauacgcaucuucaucuuccuccauuagguagcgcauguagucugccacauucugacccaugaugugcuuccgauguaccucugcauugaacuccuugcuuucagagucauaaccagggaaucguuugguacuaagaugaaaauuuuaugucaguauacagacaagaaauuacaacacucccaggaauucacuucaggagccgccuucagucccgucuugaaacaaugauuacaucacaugcaaucaaaggaccaacuacuaacugcucaguuaguguggugucaucauuggcagcucaucucugaauugcacagauaaacgaccauaaacacacuugcuuuucaccuuccuagagucugcucugcccagggugccucagaacuccugggcucuagccagccuguugaucccaagaacccagagccaccagugcuuucuuucacagguuuccuugcccuguggcacagguggcaguucaaaagucaucccuuaaguauuuauuucucagugguagcuagaaugaguuagugacgugucuaaaucacaaucaaugaggauguucaaaaagaaauuuaugaaaauuuaaguuagucaauaugcuaguuacaacaaaaaaaugcauuaacucugaggaauuacaaauuaauuuacuucaucucuaguauucagcaaucuuaaugacugaaaagcuuuuaaaucucaggcuuuugccucuaaauguuuuauucuagaagccucauuuuccccuaacccaaaaaaugaacuuugacuggcaaaugcacaggaccggggguagugcuacacaacuuuaauccuagcacucgggagacagaggcuggacaaucaucacccugaguucucuaguacagguuccuuguacaguaacuacacagaacaggcauugaaugacugcuagucagugaguaaccaguaggaaauaguggagucaucacagaaaucuuaaauacuaucuauuaccuaugagggauagacaagccuccauccacagcucccuucagggccccaaaaacuuuauugccaguuguaguucgggcaagaccugcauccagauagcaagugaaggcaccaggcugaccgucaaugcuuuccacauuguauucaccuccauucaccuccacuuggccuucauagaucuuguccaugccaaaccuauucagaagcuaugaacagagaagucaacauaaacagucucaguacagucaagccacuaaauguacuucauguuacaacaaucucacaauuugacuccuacauuucuucagucuuuauauagguaccugggcuuugcugccuaucuaaacgacuugucuacaauaucccaagacgacaacuucccagacugauaaaaccauguucccugcugaugacuuugcaagccacaagcaaauagcaggcaccuuauugaagauauuauauacauacccugcgggccagcagcaggccagugcaauaggcugcagcauaauuugucaggccaacuuucacaccauauuuuggaaguucaugugcauaugcugcacagacgaucauauccccuucuauacgggcauaugcaaucugcagugagaaaagucagguuauuaacuuguugcuaucaaugcuuugguaccugucccaccuaagugccucuuaacaagcugugaugagaagagacaacucauugaagacuaaucuguaugggcaucaacuacauggugguuuagggggaaaaguaugguuaaaauacauauggcauguuagaacucaauuauaauagcucuuucuaaauacugaaggcauuauuuauggugggugaguuggugaaaucauaggugccuuuagaagucaacaaacugggcaggagaugaucucagacuagauccugagcucauggcuauauugcaagauucuuucaaggcuggccuggucuacaaagaauuacaggucagccagggucauacaguaggaccccaucucaaaaaagggcaccuuuaauccuagcccuggggagguagaggcaggcagagcuuuaaauucaaggccagccuggucuacaggcaacagccaagguuaacuaaauaaagauccaccaccaccaaagucaggucucacuuacuuaaaaguaucuuuugagcuaaauuuaaccaagucuuagacacuucauccuuaauuaucagaacaccagacaaccccaccuucaguuaacaaagucacaaaaggcaagugcaccuaucuccugaccagcaaauuuuuauuguaaaagcccugaauacagggacugccauuuuuaaagggcuuucaaaguggaagacauuuuuguguauuuuaaaaccuauuucaaacaguaaauagaaauagcuugucaugcugggaugacagaugagcaacccugccuggcaacaagaguccuaccacccuauuaccagccuuuuuaaaucaguaaaauggcacacaagcccauaaaguaagcaccaggaguuaaugcgugacagaugaagguaauuggaagacuauucauaucaacagauuucccaguccuccucucaaauuccauaauggaaauuaagcaaagccaggauuuccaaaccuuccccccacccccaccccccccacccgccacugaaaucuacuaacacaagaaaauagucucucccaaaaguuagaguugaugcgucugaccacacuacucaagucuaggacauaacucaccuggcagaugauaucucuguuaguuacacgaacuaucauccuauauuuggguguguuguacuuauucuuguccuggaucaccaaucguuuucgagcauaguagucaguuuuacccucugcaaggggaaaaaaaaauuuaaccagggaagguuccaccuugaaacagucuucagaaacuaaaacagaaaaaguucauaccucgccgccuucgaaaucucacuugguaucuuuuaaaguaggccuuauucuugacaacuuucacaaaccccuuuaaaggaaaaaaaaaauuaucagggcuuugcuaauuguuucgucccaugacuuuuuucuuuugauacaggccaacuauguagcccaacaugaccuagcauuugguaguuucugagcgccgaauuaauaggcaagaaccaccuggguuuuggucuguauuuuuuuauuuaacuauguaacaaaaucaugcccaaguuucaaaagcaaauuauuacaagugucaacuucuauagcauguuucuaagcugaccggaaacaagaaucgcuguugugcagugcucaaccuuuaauaagguuaguuccucaugcuguggugacccuuccccaaaccauaaaucucguugcugcuucguuaauuuaaucuuguaguuauucaucguuaauacaaauaucugacagauggguuaagaaccagauggagaacugcuguugcacugguucucuucgccaaacacaccuaacuaagccucagaaaacacguaaagauggcugggcggaauagggcaccgacccaagucgcuccauccacaacugcaggcuccuuacuacaacuugcagguacaaagacauuuucguacugccuuuaaacaaucuuucaauuccuguaccacugaucgaucccuacgccaaaccgccgggauguaucaccuacaccggagccaaucugugccgacaacugcacaccucaccgagaaaguucaaccacucggcgcucacuuccucccugccuaaaccgggcucaaauggcagaguacgaucuacaauuacuccucgcaaaugaagagcugcaccccaccucucaaguccgaucucagcaaaucucugaaaacagggccagacucuggccaggaagagccaggggccgccacaucccuuccgggacgcagcagcgccacggccuccacugacagacacucccggcuucagggcucugugcgaggccgagggauucgggcuuccguggcacggccuccugacgaccccggagacaacugcggcuggcagccggacucggaagccucgucccgagcacccuccgccgcggccccucccccggcuggcacccggcagccauuaggccacgcuggaacggcgggcgcagagccgggaaucgaaugccaucugccccccgggucgcacgagccgaccccgagcgggcauccgcgagaggagggggcaccccggugcacgcacgggccugagacccagaugcccacucaccauccugcggaauagagacccgcaaccgcggcuccacgcagaccugcagagucggccgcgcuaagggggaaaaagaccggagucacguacgcaugcgcaguauguagcaccaccagcacgcaagcgacgugagaaagaguggcugu

SEQ ID NO: 2575 - RNA, 26268 nt, Mus musculus
acggugcuaaugacuuuuauuguuuuaauuguacugaauauuaucucagcaaacacauacuuaacauagccagguggugguagucaguaaucccagccuuggggagucuguggcagggagaguaagagacuuugcuagccuagucuauaagaugagaaccuuuguggaaaacauuacccaagugaaaaagaucuuagcagauguguucuuuucccuacccuagauuaucagacucuagaaaaagaacucgcacaggaagaucauggccugcugcaauaccacauuugcggagaagaagaggucgccuuccacgaagagcacuccagacucagaacucagaaguugugaaagaugaugaaggcaaagaagauuaucaguuugaagaacuuaacacagaaauucugaauaacuuagcagaucaggaguugcagcucaaucaccugaaaaacuccaucacuaguuauuuuggugccgcagguagaauagcauguggcgaaaaauacagaguuuuggcucgucgggugacgcuugaugggaaggugcaguaucuuguggaaugggaaggagcgacugcauccugacuguaggacugaacguaauguucacugcacucguuuucuguugguacaguuaaaaaaaaaaaaaacaaaaaacagaguguggguuuuauuaucuuucuuagaaaaacaaacaaagagaaaacacaaaaauauucacaaaaggagaugauacuggccuuaaaacauguucuugucaauguuauggauauugucauaaaaaaagauaucuuuuaaaaaucagaggagagacuuaauuuuuuuaaaucuuaagauuuguagacuguuucuaggauaggcuauuaaacaugauucauacccaugcaugguguuagauacuuuuuauaauuauuccauugagucaauuuuugugauuagugguuaucagagcaaacagaucauguagauagcacaaguauuuggagaaacauuguguguuuuguuaacaaaauguuggaaagauuuauuucaauacccuuuagauuucauaaagugcaguguauauaaugucuacugaaagacuguaaaauauugaaauuucuuucaagcaaaauguaaaaaaauauauugagccuguaaauugcucugugacuagacuucauugucgucuuaauauauucuuugcauguacauguauauacacacauguguauauauaugugugugauuaugugaccuaugcaauacaaauuaugggaaugggcagcuuuggaguauauaucccauaauucuuauuucaggaauaguugcaguauuuacacagcagcauuucuucucaggcguuuauugggugcuguugcuugcuauguaugaagagaaaugugucaaguuuaguguguacugaagaagggugugaacaacaguguacaugggcuuuuagagggcuuuucaguccuuguaacucagcuguugaauaccuaaaacaaauucgagugauaacuacauuauuuccuauuagaagugacguuuucaagugauuguggcacauuaugauuguaaaugucucaguuuuaacagcaagucugugggagcccagugaagacuccugaaaugucuguaguaacuguuagucauguuugaguaagcguaguaugaacaaagucuuuuauugcacaggguuaacaaacaguauguugcuagcugaggcuaacugcuguuuuauuacaacauuaccucuuguuuuuauaaaauguaccaagauuuuaaauugauaucuuuauuuuacguguuaaaaaaaaguuucuuuuaucaccaguguuagaguugucuucuguuuuuuugguuuguuuugguuugguuuuuuucuuguuguuuucuuucuuagccaaagaguaaacagaagaauauuauuuugguagcucuucauuuuacuuuuauaaugauugguggauuuuagacuaaaaauuggggaaauuucugccaaaaugaaaaaauaugugacguguauugaugacagaaugcuaaaauugugguuagugcuuauuuauuccauuaauugauuauuugccuguuuuuaaagaaacaugcuuuauuuccuuaagcaucuucaaaagaugacuuuucuugucacauuguagccaaaagaagcagagaauuucuuguccugcuuuugguuccugguuaaccagguauaaugagcuuuacaaagugcaaauuacaaacugucacuucuguucaccuccaccaaaacuugauuuccccuagcuauuaauuuaaaguugccuuuccugcagcugcaauauuuugaauaacacagagauuguguuaauuuuugaauguuuguuuauaucuagggguaauggaaaauguaauucccguguaaccuuauucacuccagcuguaucauauuucauuuuucccaaaguucuuuaauuuuaacugaacaccagcaguauuuuuaguaauucuuuaagauacuuggaagacaauuuaucaagcugaacugucucuagacuuaauuauugugaaugucuguuuucuuuuaucauggugguucacauggcucugauguucaguuuguauuuuugaaauugcuuuacuuagaauuaaaacagaccaacauuaaauguguguauuuuuaaaagagcuaaugaguuuuucuucuguaucugcuugaaaauacacacuggugcagcaguuaacugcuuuuauuuagcuagggaggaggaauuuuccaauucuuuuauauacuugaauuagucuugaagaacuuugcuuccauuuccuuuugucauaaugauaauaguguauguucacugugagugaucuuuuaaaaaaggauuacaugcuuuguauuugaaagacaguguuuauguccuuuccucuuccaaagacuguagaaaaaucaggcuucacaguuguuucuucuuccuagguauuggggcacauguaaacagacuucccguuuuugcuauuuuuuuuuuuugacucuaaucuacagaauagaaaaguuguaaaauaauauaccuuccuuccuuuuucauuuuaagcauuuaagagaaaaagagagcacagaagcugugaaucuuggcagcugcuggaauagguaagcguaggugaaaaggacaaaguccuguuguguuagguucuggcacguucagcaagcagcuacacggcaggagcggaaauuuuuaggaaaagcgucguggaaguauucccagguuuuguaaaaagguagaagguagaaggaaaggaaaaggcucagagagacuuggcagcagcuccaaaagagaccauaggagaccuuauguaaucgcucauuuguaaccacccuguucuuuaggauaaaccaguuaagugagugugugugccuuaccagaauaauuguaaauccucaguguuugacuucaugcgcgcacgugugcgggcugugugugugugugugugugugagagagagagagagagagagacgugcacccacauugugauaagagucaggucuuucuggaacgauagcuauuggaaauccgggcacguuugagagcugagacugucccaucuuuauuuuuuguugaguauuuguuuucucucauggauauaguuagauuucuguuuaucaguguugggaugaaguucuauuuuuggcugauuuguacuccuguuagguacuauuaaauuuuaguuauuaaauuuugaaagaggguguuuuaaggcuaacagauacccauguaauaauuaaagauagauuuccccccacccccaaggcccucuguauggagaaauuuucuuuucugaauuaagaguacaaaacuccagaagucccauucaguuucucuuaaggcauuugauaugucauaguuuuugaucauggaaaugaaaacaugacauuuaaauguaaaguaaaagcuuugucugaucauggguauuuuucuaauugguguuaguuaggauucauagauaauucugauacauucugacaugugagaaacuugcagcaucucuaagcaaauagaugguauauauacaaauguuuguaaguuauaauaccagaguaauagcuacaugaaauauuaauuuacuuuauuuuuuaaauuagaauaaagucaguguguggauguaugcuaguauuucuuaccacuugagaggcugagauaggaagaucaagaguuggaggcuagccugggcuauauagugagacacuguccaaauuaauuaaaaauuaaaaaugaacaagaauaagauuacagccuggcgaugguggcacaugccuuuaaucccagcacucgggaggcagaggcagguggauuucugaguuugaggccagccuggacuacagagugaguuccaggacagucaggucuauacagagaaacccugucucuaaaaaccaagaagauuguaaauuaacaagaugacugcccauuuguaccuggcagaguucuuuauuagccaacucucuuuguuuauuggcauuuucuguuucuggaaaugaauacaaaaauugaauucuuaguaauuccuuuucuucaaaguaauucuuugguuacuuaagagauuccccgggcuggugagauggcucaguggguaagagcacccgacugcucuuccgaagguccggaguucaaauuccaguaaccacaugguggcucacaaccauccauaacgagaucugacucccucuucuggagugucugaagucagcuacaguguacuuacauauaauaaacaaacaaacaaauaacucuuaagagauuccccauuguguauaaacaaagaaacaaaaccuucacagguuauauauuauguacauuuggauaaaacauauccugccuagccauuugucaggaugcaggccuguaguauuauacuugauauuuucuacuugagaggcugagauagauucugucucagaauuacuaguuucuguuguguuuguuguauuuauagucagucauucuuuuugccccuuugugacauacauuccucuagaagccgaugucaaguuccugaaugaacaaaauuaguguauggggaaaagaacaagaauagaaacuggauaacauuuuacucaacugcaucugacaaaaccaaacaaaagcacauuauucuguagucuuuaguugggaucucuucaggcuucugaacagcaucucuguggagcuuauggaacaugcucccugugugucaugucuguuuggaaggaucacauacuuaggcuugaaaacauuugaaaggucugcccaagccuguggacugccucucguguaguuccuuauucucaucaccuagucuuugcacaguuaauaacauauuauuguuuuuauuuuauuaugguauuccacccucuauuaacaacauuccaaaaaaguugaugcccaucugaauuuuuuuaguggugguguggugauugaaacuggguuucucuguaacucccacuguccuggaacucugagaucugcugccucugccucccaaaugcugggauugaaggcucuggccaacaccacccugucugaauauauccugcugggcuggacagugguggcacccaucuuuaaucuuauuaauccgagcacucgggaggcagaucucugugagucugaggccagccuugagcaaguuccuggauagccagagaaacccugccucaaaccaaaaaaaaaaaaaaaaaaaaaaagcaaacauuuaaaagaaggugucauuuaauaguauuaguggaaugcacaguaaauuuuaaggagcagaauuugaaacaauauuacugcuaaaaauuuuguugaguuuuguuuaguuuuaguuugaaauuaaauuauguuaaacuacuuuuucuucaacauuuauguguuacuugugagucccugcauugcaugugugugcaccaucugggagcaggugcacaaaaaugguuuggagagauggucuggaccucugaggcagaugugagauguggguccucugagagggcagcaucucucuaaacucaaacuuucuagaaauaucccugaaaagaagcuucauggaaucuuugagucauuuaagacucaauuuugauuucuauaucuacucuuaucuacuuccagauuucauuuaauaaguccauagugaaaaaauauuugaacuguaacuuuauauuagauucucugucucugcccucccaccuuucuuucuuuaggcccuggguaguccaggcuagccaugaaauugcuguguaguugaagagcaagagcaguguauguuguuaaccucuaaguuaucauuuuugcuaccuuuuuguucuuugagacuugcuuuccuguaggaggagauacagaaaucaugcugcucugaauccuugauccucaucuuuacuguucucauguauugggagugccaugccuagcucauaguagguacuuuaaucaaccccuaaaccaguuagagaagcacauuaagaaugccuuuuaucccagcagguggauuucuggauucgaggccagccugguuuacagaguaaguucaggacagccaggacuacacagagaaacccuguuuugaaaaaacaaaaacaaacaaaaaaaagaaugccuuuuuauuuggaagucuuguagaauguaguaaauguuuucaugcuuuuauaagaacaguuuugcugggcuugguggcacugucuuuaaucccagcacuguggaugcaacagcagggaggucucacucacuugaggucagccugauauauauggugauuucaggacuacaaagugagauaugucaacaaauaaguaaaauuaauaauaaagucauuuuugaggcuauagagaugacucauugguuacagugcuuaguguacacauuaggaucgguuuggaugccuagcaccuacauagaccucagaagggugcuguaaccaauaacccuagcucugacgggggcagagagguguauucuggggacuuacgcacuagugucaucaaaauaaugagcuccugugucagugaggaaaaaauagaguggagaucaauaaaggaagguacccagcauugaccccacgcgugugugcgugggcaagcagcauagcgcaccccaugguguauguaaacuuuucugucuguagggaauugugagcguugcuguguugcuguauauaguggugcucacagagauuuagaugggauucuuacucagcccaaccuaggugguugcucucacuugugccugucucugguagugggauucauguuuguucauggugcacuggggauuuuucuccccucuucaacccaucuuauaaacucuacuauagaguaagugaaaagauguuaaaccagguuuucugggguaaguuuauguaaauaaaauuuugcacuuuauuuuaagaacaauucuugaguuaggcuccugagaguaguuuguucccugaagauccuuucaugauucuuuauggaauagaggggcuuagaaauuugacagcuagauaauuguuacaugacuaauggaggggauagcaacuugauuuaaccaucucuccagccccaagacaauguuuuuguuugaggagauuguccaguguguaaauucaagauaacauuauuuaauuggauuuuuguuuguuguguuuguguuuuuuuuaaaguuuuuuuuuuuuucuuuuuuugguuuuuucgagacaggguuucucuguauagcccugcuggcuguccuggaacucagaaauccaccugccucugccucccaagugcuggaauuaaauugggauuaaaugcauguuccacugaugcccggcuuauuugucuuuuuuuuuuuuuuuuuugauaaaagguuuuucuguuuagacuuggcugucauagaauucacacugugcuauguagauuggccaggcugacaucaaacucagauuugccuaccucugccucuugaguauugagauuaaagccaugugccgccuccacugcccagcuaauaaaauugauucuuaugagcagcaacacuuauauggaguugguuugaaggaggaguuuggaaauguuuagagaacaagcuaaaauaaagggccuaguaugauccaaacagagcuucauagaaacugugauggcucagaagacuagaacaacuguuagaaugaggacagagcugugugguggugcauaccuuuuaucccagcacuugggaggccaagagagguaggcagaucucugaguucaaggccaguuuggacuacagagcaaguuauaggacagccagggcuacagagacccuguauugaagggggcauggggaggaacagaaauacaaaccugaugugaaguuucaguuggacaugaauaugucauuggcuacccucauuauacuguggcaggagauuugcugggauuuuuuguguaugugcauggagauucacauauauucgacaugugugugcaugucugccuacauguauggaggccauagguugguugaaguuuaucuucuguuguacuuuauugaaguagggucuauuccuggucucaaagucaccaauucagccugucuagcaaguuuugucugguccguugucuuugucucccaagugcuggaauuagaugugugcuucaccacaccuugcuuggcuguuuguguagauccuagggauucaaacucugguccuccugcuuuugcagcaaacaauuuacccauggagacauuuucucagauccaaauuuguaugcauuuuauccauaacuugugagaauaagugauacacuaaaacaucuuuacaaagacugagcagcauucaggagguggcaugcuuuuucuugcuuccauuuuauaaugagaauugagacuaaaagguaaaaaagaucuaaaaaccuuaaagauuuggaaggaaacuagucaagggaaacagggagaggaccugcuccagguucauuuacgaaauucuuugcucauuucaucuugggugcauuauuaagccuuuagccugucgcgaagcaacaaguacuuacagucuuguugcacguccaccuucuaacguagguucauaguaguguguuuuguuuuuaugauuuuaugagauagggucacacuguguauaccaggcuacccauaaacucuuagaaauccauuagccuuuugucuccugacauuaaaggcacauacuacuacaccaagcuccugcguguguuuaagcacuuuuauguuuucuucuacccaaauguucauauuuuggauuuuagguauugcaaacaucuuuaaauugggcccagggaacuuuugcugggcugucuguccuguagaacugguucccaaaccaacaaugucaggauugagguagggaaugacuuaggguuucugcuaguuuagguauaugugaaugagauuaaaagugugugggguuaauuaggaaagugaagggagcugcaaagucaguuacuggauaaucaaaggagucacuccaggaagaaaaggagccucagaggccgcagggagguccagucucuguuggaagcauauuauuaaagugccucacaccgagauccagaucugaccuaggaguuucugaguuucuggaaugagcacaccucacccuugcaguuucaguccuuccuguggauuguuugcaguccucaagcucucucagaaacagcuucgaaucacagaaaacagucuaaguacuucugaaaaccaacggcuucauucugauguuuauccuagaacugacucuauaacuagggcuaggcagaagcaguaggacugacagcuuugggaagcuaaugauaccaugaaguagaagagacagaaaaguaguggguauuaagucaaggaaauggagagguaacaggauggcagagcaugaaguacguuugguugggguaguaagaaguagcaaugcuugauaguaauggaagaaguugggagggguaggcaccaaauugugugaggcguccuguauauucuaguccaugucuuaaaacagcugccuguuuaacauguuccccaaaugcuuaaauuuauuuauuuauacucucugugugcauucuuccugacuucuggugucagugccagaagaggaccuuggacuccauggaacuauaguuacaggcagcuguauguauguggguauauggaacagaacucggauccuccaaagaggaacauuuccagcuugaauuuuaugauuuuuauuuuuaucuuuuuaaaauuauuuuuuugaagacaauuucauguauccccgguuggucuggaacuugccauuuaggccaggaugaccugagcuugugauuaucuugcccuaucuucugagugcugggaugacaggcauguagguacuaugcuggauuuuauggggggguugagggucaaacaccaggggccggagacauggcucagcaguuaagagcacugucucuucuuccagaggucaugaguuugauucccacaaccacauaguggcucacaaccaucuguaauuggauccaauauccucuucuggaugcucauauacauuacauaaaucuuuaaaaaaacaaacacaucagggcuucacuugugcuggagaaaaacaguggcuuaagcggcauucccagcucauauuccuuacuucagaaacaugcuguugacuaagaaaacaaacauguaauggagacauggcagagcauguagaaaauuaaaaaaagauucauguguaugaguguuuuucuuucauauuuguauguauaccauauuaucugcuuagugccuguggaagucaagagagugucccagaucagauuuucuggaucuugaguuacagauacuugcgaaccaucguguaggaggcugggaacugagccugggguccuugaaagagcaauaagugcucuuacccaccaagucaucucucuagaccccguaauuguguuucucguuacuacaguauuuaaaaguaauucagaguagaaugaaaaaaugucagaaaaagaaaaugcuacuauaaauggaaaggguuucauuguauuugauucgaaggccuauucuggauuacagauguagcucaguugguagaguccucauuugccuugcccggggcccuggauugaucccagcacugaauaaaacugguuaauggugguucagacuucuaauuccaucacuggggaaauggaggcaguaaaauaaguagcuuauggucaugcuauauacaguuaaagggcagccugggcuacaugagacccuaucaaaaaucauuucuggggcuggagagagaugacuuagugguuuagaguacuuccugcucuagcagaggaccagcuuugguuuccaacaccccacauggcgauccacaaccagucuuuuuuguuuuuuucccuuugauacugauuuuuuuauuagauauuuucuucauuuacuuuucaaaugccauucccaaaucucucuaugcccuuccccugcccugcuccccaacccacccacuccugcuuccugggccuggcauucuccuguacuggggcauaugaucugcgaaauaccaaggggcuucucuuccuagugauggccgaguaguccauccucugcuacauacgcagcuagagacaccagcuguagggguacugguuagcucuaguucagguguuccaauucuacuggcuuguggaggcaccaggcagucauagugcacaugcaaaaccauagaggaaaagcacauuauaaaccuuaaaauacaaucagcauuuugucguuccagacagugguggggcagggaggcagaggcagaucucugaguuucaagccagcuaggacuacacagggcuugucucagaaaucuacaaccgaacucaacaauuucauagacacugagaaaaaugaacagcuuugcuuucaaaggugcuuuuuggggcuggagagauggcucagugguuaagagcacugacugcuucuuucagaggucccgaguucaauccccagagaccacgugguggcucacaaccaucuguaaugggaucugaugcccucuucaagugugucugaagacagcuacaguguacccauauacauaaaaucaaucaauaaguaaaucuuuuuuuaaaaagagagaggccgggcgggguggcguacgccuuuaaucccagcucucgggaggcagaggcaggcggauuucugagucugaggccagcuuggucuaaaaagugaguuccaggacaaccagggcuauacagagaaacccugucucgaaaacaaaacaaacaaaaaaaaagagagaaaaauacuuuuugcaggguguggugauggcacgcaccuuuaaucccagcacucaggaggcagaggcaggugguucucugaguuugaguccaguuuuguuuaccaccaaaccugauaaccuaaauucaaucccugggaccuacauaguggaaggagaugacuugauuccugaaggcuuccucugugacacuggucuccuguauccaagaugcuaugguguauguucacacacauucauaaccugaccaucuaaaccugacuuggaggaaauguuaauuuguuacuucucugcuaccuccaaaugggcaugucuuaguuggcaggaagagggcgaaugaguggaacagggccauaggaaugcaggugugguuagugcgaagguuagggcaguggugguacauggaugcaaaagaugucaaccacccuuugucccacuuuuaaaucacauaaaaaguucaauuaaaaacuguggggcugggcuggugagauggcucaacagauaagagcacccgacuguucuucugaagguccugaguucaauucccagcaaccacaugguggcucacaaccaucccuaacaagaucuggcguccucuucuggagugucugaagacagcuacaguguacuuacauauaauaaauaaauaaaucuuaaaaaaaaaaaaaacuguggggcuggagagauggcucagcgauuaagagcacugacuucuucuuccagaggagggguuuuguuuuucuuuaaaucaaagguagaaagguuagguuuugcuggguguggugacauauguuuuuaauuccagcacuccugaggucgaagcaguuagaucugaguuccaggccagccaguaaacccuuaaaaaaaaaaaaaaagaagcaaauuaacaacacccccgccccaguguuacaccuccaguaauaauagacauaguaauguagaaagggaaauuuucuuggggucuccccaccaccaaagaacuauauaggcugcuaggaaagugagaguuggccacucccagggaugaacccucuuuauugguuauucaaaauaaugcuuuggacuuagcagcuuguauuuauauauuugugcauacauagauauguauauuaauaacucagacuaucaaucugaguguagaggggcaugagaggguuugcagagaguacauugaaggaagggaagauagggaagggagaggugaauuucauuuuaauuaaaauguauuaaaaagccaggcaucuccgggcagugguggugcauggcuuuaaccccagcacuugagaggcagaggcagguggauuucuaaauucgaggcuagccuggucuacagagugaguuccaggacagccagggcuacacagagaaacccugucucaaaauaaaauaaaauuaaauuaaaagccaggcacuguaguacaugucuuuagucucugcacuugagagacagagguaggcagaucauugcaagcuugaggguacccuugucuacauagugaguucuaggacaguuagggcuaugcagcgagaucuuaucuuaaccaaaccaaaccaaaccaaaccaaaccaaaccaaaaguauuaaaacugguuugguuucgucuauucuucuucuucuuccuucuccuccucuucuuuuuuuuuuuuuuuucucgagacaggguuucucuguguagcccuggcuguccuggaacucacuuuguagagcaggcuguccuugaacucagaaauccaccugccucugccucccaagugcugggauuaaaggcgugcaccaccacgcccggcaucuuuuuaaagauuuauaugagcacacuguagcugucuucagacauaccagaagagggcagcagauccuguuagagaugguuuugagcaaccgcgugguugcugggaauugaauuuaggaccccuggaagagcaguuggugcucuuaaccacugagcuagucuccagcccuagucuauucuuuaauguugggucagaaaguauuuauucuauauuugaugacuauugccagucaaauuuccaggggcuggggaauugucucagugagggcuaaguguuugccauguaagaagcaggaucugaguuugggacuuuagcgcccaaacaaaaagcuggauagaguagggcaugcugguaaauccuaacagacacgagacaggcaguuggagcagcugucuggagcucacuugcuagccagugcagcaaaccggugacccccaggcuagccucaaacucagagaucugcuuuccucugcuuccucagugcaccacuaccacccagcuuuugugguuucuuugaauuagggagucguauagcacaggcuugcuuccaauuuaugaagauccucacucagucucugggauuaaaggcauuccuaccacaucuguauucauaacaguuaauuauuuguacaaauguaggaguaaccucaaaggaguuuugacuucucaagaccaguuagcuggcuaacauuuaauauucaaggauaacuuguauauauauuuugaauagauauugcuuccugagccuaaagaauauauauauauucuuuuguauguauucauguggguguaugugcugugauuuacauaugaaggucagaagacaacuuuguggagucugauuugaucucuccuucaaccuuaacuacaggcugucagacuugcuuggcaagugcuucauacccaguaugcguccugggauagaggagugaacccagacuuugggcaacugaugcucuuugcuucucuaauucuuuuuuuuguuuguuuguuuuuuuuuuuuuguuuuuuucgagacaggguuucucuguauagcccuggcuguccuggaacucacuuuguagaccaggcuggccucgaacucagaaauccgccugccucugcuucccgagugcugggauuaaagacccuuuagguaaaaaauauauuuaagcaauggagaaaccaagugaguacaguaauauaaaaacuugauagcuguggccuuucaaaaugugaaagaaaaacaaauuuacuuaagauugaaauuuuuaaagaagcuuuaaggaguagguaacaauuaugauagguugguaagacuuccuugauaguaccuuuuauuaguuguauggagcucaguacauagucuguuguucauuuaagauaaaaguucacaaauauaguauauagugccauaugagccacauuguauuauacuccagaagaaaaaaaauuacaugcuauaucaauguauuuuaaaauuucagauaaagaauuuucacuguagguacaaaauuacagguacuuguuuguuuuugcuuuuguuuuuuacuaaguuuaaaacaucauguuuaauuguaaauauuccuaaguauauuuugauuuauguuucaacaaugucuucuuacacuuacuuagucucuguuuauugacauucauauaaaagagcacacaguccaacugcaacuaagaacaaugaucucuaaacuuguuaagcuacuguaguaauuuauacaauuaacaagacaaaaaucagagcaagugauggcuuacuugauuuuaguauaauuaagacaguaaggucaaaaaacuucuaugaagcagaaaauacacauuuaaaaauaaacauuuugguuuuugcuuacaauuuuacuucuuuaugauuaauacaggcaacaugguucuuaguaucuuuuuacuuuugucuauaaaaauaaaaucuuuuaacauuccuaaguuauucgauuuuccagcaaagcuacuaugaccauuuuaaauggcagugaguaacugaguaagaauucaaaaagucaguggcacaaauuccauacauacaagaugauguaacagauacaguguuaaguaagcaguuaagaacacaguacaguaucagcuguaucuaagagguaggauucuuagucacagucuuucagaagagacgcaguggacucugcuuuaucaguuaggauagcugucuagagcuugcuucucuugcacuuaaaguagggaagagaguuuuuuuaggcaacgaucucauuggccucuuuucugcaucuauuguaggagcuugguuagaagccuagggcauuuuucuuggucaguuauugaucacauauaguauuuaucucacauuuugaaaagccucuggauagggaaaaauaaauuucuaguuuccucccaagggccugagaaagaggaaacuauauuuuugaacuauucugaguauaaauuguaaaugaaaucaguauuucucuggguaucauaauuuugugugugagguagcaggguagugcaagaucauuaauacguaauaagaauuccagcaaaaaaaaauauguguauguuuauauggguucaauacccagaucugacuauugacuaucucuacuugacaauacauuuauuauaaacacuacaagugaguguaacuuaaauucuguuucaugauaaaccuaaaucacuaguacuugaauaaaauuguacuacagacugauaaaccagaaaggcagaauguuuuuguauacauuggcuuuuauuucuacauuagguguuuauaauuugggauuguucuaagccaauaaaugaccagagguaauuuugugagagcuauaauaaaaacuguaauaaauaugcauaccuagugcuaagucuuaugguaggaauauacauuucacaaaaucuaucugaacauuuauaauaaaaacaguaauuagaauaaaaagcuaugacaaauacaauuucuucuggggaauuuuagauuacccuccuuugaucugaucuuuauuauaauuggguuagcaagaagagcccaccugauucuagauguuacacuucucuagguaaacuuguuggaucuggugucauauuuaucucauuuuuuuccuucauguuucugaugguuuugagaauuuagaaaggagcuguuuauuuacacugaugucagaucuuuucauuaguaugucccucacaccugcuugugauaaugcauuaucaauaccaacuuaacacugcugaugcguaauauaaaaauaaguucaucuuaucucuaauuuaaucuuagcuaacgucuagacagaaugcaucucagucacaaacaucaacuacccuuuauauaccuuauaucaaagacaaagacacugucuaauuuuuauaaagaaagaaucccuuuccaguuuuaauuauaaaaauguuagguuuuggaaguauagacuaaguauauaaaaacuaauacuuguggauaauauuucacauuauauuugguuguaaaaaugauaggaguauuuuuucagugguaugcuuguauuuacuuuuuuuggagagauuuaguagagaaaagcugaucuauucaguccaugauuauauaauuaucaaaugauuucuucuuuuuuucuuuucuuucuucuuuuuuuuuuuuuuuuuguuuauuuuuauuuuuauuuuuguuuuuucaagacaggguuucucuguauagcccuggcuguccuggaacucacuuuguagaccaggcuggccucgaacucagaaauccaccugccucugccucccaagugcugggauuaaaggcgugcgccaccacugcccggccaucaaaugauuucuaauguaagguauuggaaacuucuuuaacuuguaccugccacauauacagagaaaauucuagguaaaagcaaacugguggcauguuuaugaacauuguuaauucauuuaauucauauaugauaucugggaaagauuuuuaacuuuaggaaaauaguuauuauggcuucauucaauuaaaucuaaauuuuacaugacaucuuguuucauacuuaaguauaaaacaagucaauaaaguuaucuggacauaaugauuuuccuuucauaauaaauuuuacauuaucuuacacuuacauacauuucuaaaaauguuaugggaaauaugacuaauaucuugacuguguaacaguguauuagaauuuucuaccucuuuuuuucaauguuaaauaaucuguguuggaguuuuaaguucuacuuuuccucuuaucuucaaauagacuuuucagcguauaaacuugaauagcugacaccaccaccaugaccaucaaguuaaccacagaccagaaauugacucugucaaaguugcuuucuuguauguuucgaucucgagcuucaaaugcucuaaguagaguuuguauguggccacuuuugcuuagucuggacuugaugcuguugauggauuccuggagaugaauacaauaauuuuacuauuaaaaauacuaagaacauguuuaacaauaugcuucaugcuaguucuuaaaauacaagacaauuuuuuaaauagaugggaauacaauucaauuaaagggcagguaugacuuguaucaucuaaagagcccccaugaaguuauaacauaguaaggauaaauuuaaauuucuuuaacagaggaauaauucuuuaaccagaaaucgaaaaaacaagaucaaaguauuugaguagcauagcacagggccuuuuuuuguuuuguuuuuguuucuuucaaaauaggguuuuucuuuucuuuuuuuuuuaaagaauuuuaauauauuuuauuuauaugaguacacuguagcugucuucagacacaccugaagagagcaucggaucccauuacagaugguugugagccaccaugugguugcugggaauuggaacucaggauucugaaagagcagucagugcucuuaaccauugagccaucaauccagcucaaaaaccagauuuuucuauguagcuguggcuguccuagaaguugcucugugggcuaggcuggacuugaacucagacagaucugcuugccucugccuccugaaugcuggaauuacaggcaugugccaccacugcccggcagcaacaggacuuuuauauauacugucucucuuguaguccugacaauuuuaccuaacacauuuuugugucuauaauacuuuacuguuugaauguuaguuaugucauccaggcagcuucaauguaauuacacagagucuggagugauacaagaggcacaagccauggauugacagcaacaccuguaagacuuuagaccugugaaauucacuucagauuugugagacaauaaauccauuuuguuguuguuguuguuguuuaaaguuucacuacaucugaaaaaaggguauuuucaugauaggauucacuuaagauaugugauuugaaaaacuaauuaauaagaggauaaacauaacauugagacuugaaaugauauaaaaaaauggcaaaaccaacaguuucuggaaaauacagcuaagauugcuuaguucaaucccugacauauaguaaaacacuggaugcuggauugucauuacuuauuaaaagggccuacuaaccaggauaucuucuagcuucaucuccaggacaucuguauuaguaauauacuuuuuccagucuucuuggccuugaaccucuucucccauauuauccaggaucaauucaaagaaaauuaccuucucagaaauggugcugaauguguuaucaaagcagaacauguaaucaccaucuucagucucuauacuacauuuaaaaaaaagggcacacuuuuaguauucuguauuucuauuugggaaacaaccuggacacaucuauucaaauauuuucaaguuucacacacuuggaacuuacuuggccaauuauguuauauugaucuaauuauuuugagguggggccugggaaaaauaccauucacagcugaaauacaugauaaguccuaauaagcuuuaauauuuauacuuuauuuaaagaaauucuauauuaaguccuauucauaggcaacuuuaacaaccaaucuacccuucaauugagauuauucuuuaaacuguguuuuguuuaauuuucaaaagcagugauuguuaaaacuggagagaugguucagugguuaagagaacuugcuaccaggcagugguggcgcaugucuuuaaucccaguacuugggaggcagaggcagguggauuucgaguucugaaauccagccugaucuacagagugaguuccaggacagccaaggcuacacagagccauuacagaugguuguaagcuaccaugugguugcugggaauugaacucaggacuuuuggaagagcagaagagcaaucagugcucuuaacugcugagccaucucccuagcccuaccuaugaaugaaucuuauuccauacaaaagauaauuuucuuuaguaagacuucuuauaagggcuuaguuauguccacaaauuuucucucuuagauaaaccuuucuggauauauuuacacuaucugucauucaauuuucaauuucucaagagagacuucaauugggauuagaggaucugagaagggggaguggggagucagagcugcucuuuuuauuguugcucaacauuagaguuauuuuuacauccuucuaauaucuuuaauucauugucuuuauuaaauuggacauuaacuugcaccuccuuauaucucagcauauuuugucuauauuucucuuugguugucacucagcauucuauaguuaugcuugacaaaggcaggcucuucagugaaacucagaucuauuuggcaccuguuaauuugggggcaagagucauggucagcauggugagcucuaggacagucagggauacauagagagacccugucuuaacacaaacaaacaaagcccuaaaacugcuaagagcauguagcucagagauggacccuuugaccagcaauauaccuuuauaguguccagguuuuacuguuaugccuuucuuucuuucuuuuuuuuuuuuuuuuuuuuugagacaggguuucucuguauagcccuggcuguccuggaacucacucuguagaccaggcugaccucgaacucagaaaucugccugccucugccucccaagugcugggauuaaaggcgugcaccaucacuccccggcgccuuucuuuuauauacauauauguauguguguguguauauauauauauauauacauauauaaaauuuucugaaacacaaauacaaccugugauaaucauguuuuauguuaauuucacuuuauuucuaguuuauuuuuucuuugagcauugugaauaguuuuacauuacaaauuauucaacucacuacacuuguccacaauucgugccacuauuuuuauauauuguaccucuuucgacccuuauuacauuggaagaugguguaauugguuaugucuagguaaagugaagaacaaaucuaguaagcugaugacauagcuuguugagggccaugaugcggcuuggcuggccugcccuccuuuuggcgcuggggauuaaauccaggccuggaacacacgaagcaagcacucagccuggaacacaugaagcaagcacucagccacugagcuucaucuccagaccaaacgcuugcuuuucugauuuucaaauuaauagguuuuucuauaacacugcucagaguuugccgguauuuuuuuuuuuuucaagcuccucauuuuauuuguauaugaaaauuucucccaaggcuuggccccaugaaaauguuuagagaugacuggaucauaaguguuguauggacuauuuggaaguagggccuacaucgagaaaacagaauggagagugacagugguguguguccuugaaccuggucccuucucuuuuuucugcucuauuugccaugaagugagacgcuuugcuccucuaaauguucugaucacaauauucuuugcucaccauguaugugccuacaauaaaauggaacauaguaacugugcugguuugagugaaaauggcccccaaagguucauagggagugguguuuauuaagagguguguccccauaggaagaagugugccaguguggguaaucuuugaguuuucaaauguuuaagccaugucugucucuuccugcuaccugcugauccaaauguggaagucucagcuggcucuccaugacugccuucaugcagcuaugcuuccugccaacacaauaaaugaacugaaccucugauccuauguuuaaugucccaauuaaacauuuuccuuuauaagaguugccgugaucauggugucucuucacagcauuaaaaaccuaaagacaguaaccauaaacugaaaucuaugaaaucaaaaaauaaaccuuauuuccuuuaaguugacuuucuuagauacuuugucuuaggcagaacaaauacuggugaauaaagugaggaaugagggcuggcgagauggcucauugguuaagagcgcugacugcucuucugaagguccagaguucaaaucccagcgaccacaugguggcucacaaccaucuguaaugagaucugaugcccucuucuggugugucugaagacagcuacaguguacuuacauauaauaaauaaauaaaucuuuaaaaaaaaaaaagugaggaaugacuuuaaaaagauagaaaagagauaaaaauaaaaagauagaaaguaaugauuauuuccuaagaaaaacuuucuaucauacucaacguauaucaacauuuguauugacuuuuaugauaauguaaaacugguugaugacucuucagagggucugaccuguaccucacaggcugccagugcucgucagaggaugauuaugaauguagcucaacacaaaacaguaaaacuugcuaaaaauaugaaaccuuuuuuuuuuuuguaauuucucuuuuauaacuugauuacacaguucugaguguaaacucuggagauuguauuauagugucaaaagguuaaacacaccugaguauuccaugggggaugauacugauccaaaaagggcaagacauauauacauacagcagguggauggaucucugugaguucaaggccagacuggucuacagagugaauuccaggacagccaaggcugcacagaaaacccacuaucucgaaaaaaaaaaacaaaaagaaaaacaaaaacagcugcacaucauggugaacaccuuuaauucuagcauccaugaggcagagguaagcaggucuuugaguuccaguccaaucaguuacgugauugagauccugucucaaaaacaaagaaaaccaaauauuuuuuuucuuagccaagaaggcagauauaaaaugccacaacagauuaacaaaagcacaggaagaaauuagcugggugugguguucuccauaguaaacaccuaugaucacacccacuggaggaggcaaaagcaggaggauuccuugaucccaagaaauagaguaacagacuguagugacagacagacaaaguggaaaugaguacaucuuaauuuggaaaaacggcccacuaucaaagcccgugcaaaaucauacagcuauggacgugcugacguccugguccucucuuccuuucacuagagucagcuaaacagacucaauggagauaccugggcaugguggcaugcaccugucauacuagcacuuaggaguccaagguuaaagaacugcugcauuccaagccugccugucccacccccagugucucaaucaacuuacguaugaacaccaucugauuuucuuuguucaaaaacuaagguucugcccucuggagagguaagguggaaaucaauaucuaauucuccuccaucuaaaaccuagagaagagaaaaauacauauuacaaacuuugaaaauacaaaguucuaucaaauaaaccaugugaugucaagauuuuaaaaagauuuuaucuauuaauguauuuauuggaaacagggucucuuuauguggccccggcugucuuggaacucacuaugaaaaccaggcuuggccagccuuugcuuccuucggagugcugggauuaaaggcaugcauccccauuuaaaagaugugcacguggaggccagagguugacauccuguauugugcuccaacuuacuuuugagacagggucuuauuacauagcccaggcuagccuuaccuugucaucuuccucucuuagccuccugaguauuuagaauuaucagcauacaguaccaugcuugcuugcaaggaaaguucugaugaauaaaauuucuuuucuuaccuagauucuuucacuaaacccauagcugguuucccugugccuaguuuuacuuccuuuaaaucugccuuucacagucuaccuaccuaucugcuuaaucuuacauggccuugcaaaaaauaagggaaaagguauucaucacaaaacacauuuauggucccuucugcguugccucgauguguggucuauuuucuuccuuugcuacuccuacccuaagaccugacagucuucaaagcuaauaaaaccccaguacuuauaguaugccucggaacacuuaaacuauacauccuacaaucacaaugucuagucaauucuucccuuuucuaaaacuggccucauuccuugcauucuuaacucauuuucagauuuauuuuuauuuucuccaacaauccuauucucugaaaaccaaaaaucaugcuuuauucaaauugccuguaggaugugaugguucaugcuguaauaccaguccuggguggggggggaggacacgacuuagagaaggacuccugugagaucggaggcuagccugggcuaaauacugaauucaaugccauuggauacauaguugaaaccuugucacaaaaaccagagcaaccaaccauccauccaaccacagccuaccaaacccaucaagcccaaacaaagccugccuaugaacccccaaacuccugagaaccagguuuuucucaguuuguuccuccuccuggaacaauuccuugcauacauuaauuguucaguaaaugcuaaacuuuuguucacaaguggaaaucaagaaauauuaagcuguaaccuuaguugugcugagauuuuuguauauuaugacuuuagauacuuccuguaauuacuguaaacaucuauaaauaaucccaaaggcuccacauauaaaaguuuuacauaagaauuaaaaaaagauuuaauaauaagcguauucugcugauacuaaaaagaaaacaaugacacgggaagaaagcugacaaaguucaauggaagaaaggucauacacuauuaucuuauuugauuucaaagugauggauguacacccgggaugacaauguaccacuaaauacagcaacaguccauuucaacacauuucaaaaucugacuuagagaucuucgcauggacacaauucaauacucccaagacuggguuucacuaugcagccuugacuguucagagauccacuugccucugccacgggaaugcugggguuagaggcgugugccaccacugcccagccacaauucaaaacaucgugccgauuuuauaauaucgggauuuggugaaaguggugagagugagucaaacaaguguuaucacuucguccaauaauaaagaagaacguguaucaaccccuuacagcgaacuucucagaacuguaggguauguaaacuagcuugaaauggcuugggggaauuaagaaacaaagaguaacgccauugacgucaccagugcuggccucuuuccgaccagaggaaagggaagagagaggguaggugucaauuuuaggacuggccaaacuugugaguuccaggcucccaggagccccgcuuaaguacgccugcgccaagcaggccaguuucccaggagacccuccucggauucaccucggucgcugucccaccuuuuccaaguaggugagaggcgaccauguggugcggcccggcccaaggaaggcuagcccacuuccgcacuuacuugguauucgaucuccaacgaugccuucaggggcaugggcugguagaaacacuccuuccggccggccggcagcgugaagguaaaaucacuguccaaagagggugugaagccggccgccccgcgcagcaacgcugcgggcagagcggacaggagcagcacggggaauggcagccacauccugccgcccaucccugucgaucucugccuggacgcguguagggaggugcgggauacuggugucuccgauuugaaaucccgaucugagggaacuucaggcagcggcgagccucacucucuuggaagguggaagcacugccuuccacugggccgggcgagggcggggccagcguccccuuucggcugccuucuggguuucgcauccuuccuucacaccaga

SEQ ID NO: 2576 - RNA, 101517 nt, Mus musculus
guuucccaggagacccuccucggauucaccucggucgcugucccaccuuuuccaaguaggugagaggcgaccauguggugcggcccggcccaaggaaggcuagcccacuuccgcacuuacuugguauucgaucuccaacgaugccuucaggggcaugggcugguagaaacacuccuuccggccggccggcagcgugaagguaaaaucacuguccaaagagggugugaagccggccgccccgcgcagcaacgcugcgggcagagcggacaggagcagcacggggaauggcagccacauccugccgcccaucccugucgaucucugccuggacgcguguagggaggugcgggauacuggugucuccgauuugaaaucccgaucugagggaacuucaggcagcggcgagccucacucucuuggaagguggaagcacugccuuccacugggccgggcgagggcggggccagcguccccuuucggcugccuucuggguuucgcauccuuccuucacaccagacuugucgguuucggcuucccucacacacgccaaucaacguuggcggggguaacgacgggaaauguaguccgaggugaccacggcacgccgcucauccgcgcuuccagacucauuucccggcaugcccugcgccccgcucccguucgcagagccccgcguggugggcggggucggggcccgggaggcgggucccaacggcugccgcggcgguucgaacucggcgccucggagguucgcugguucuccucaucgagagucagaggcuuccaugucgugggcugcgagagugucccaggcuuccgagcgcagaggaggcucgcggugcgccguggucuggggacgcuaaccccgccugcgaucuggguggugagcaaacgccuccuggcuggaaaagggcuuucccgagggguuuguuuucucuugggacagucgaccugcgccuggccugcuugugaggcguuuucuuuuauuugaggcagaaucggaaaggaggcugccagacuuugcucuacucccuacaggcagauggaggaccucuuucuugaaauaaaauacuguauaaaaccauguacucuuucucaagcggaaaguccugucacaggauuuuauagaguguaaagugcuuguccuucgcucgaugagugugcgugugugagaacucauuuuucacuagacuugaagauacgguugucagggccgcccuauagguaagaugauaagccuuucuacguacacauacuacagguaaacguaggaaaaugaggauguuuaaauaccagacguauccaauucugaacggcuagaaaauucuuacgugaaaaugcacaaguugcugaacguaaaagccugacuuaaaugguguccuacaguacugaucagcauuuucuagucucaaguuucuucuuuucucuccuccauuauucuguacgaagcuagagauguugcauagaugugaaguagcauggauuccugagccacugacuggggaagucuuccagcuuaugcagaagcaaauuuguuaaaaagaaaaccagaaacaggguagaaaaggguagaaacauuuacaucuacaaaauaucucguuuaauuuuaggccucaacuuuuuccaauaaggugcgagguguuuuuuuguuuuuguuuuuuuuuccaauccacccuacuccugagaaauuuugcgugggaaauuaauguaccaggaccguuuuuaccugagugagggagggagaaggcaguuuauucauuuauccguucaaaauaauugaguuuuccuaagugcauuacacucuugaacauaauaggugggaauuaauaauaucuguaacccaaauuuuaagaaaggcaaugaaagaggugcuacagugaaaaaaaaauuaaauggaauaugagagagaagugaaauuguaagauuaugcagaaaguucuauaguaggaguggaaauucuaaaacuuuuuaguuuuuauuuuaguaauuacaauaauaaagcauccuuuacugugauuucaagaauauuaauuuuacucugugucuguggguguuugggauccucugaaacucgaguuacagaccauuguaagcuaccaugugggggcugagaauaucaguggcaacccuuugaaagagcaaugccuuuaaacccagagccaucucuccagcccaucaugaucuuucuuuuuuuuuucuuuuuuuuuuuuuuaagauuuauuuauuauuuauuauauguaaguacacuguagcugucuucugacauuccagaagagggagucagaucucguuacggaugguugugagccaccaugugguugcugugauuugaacucuggaccuuuggaagagcagucaggugcucuuaccugcugagccaucucaccagccccaugaucuuucuuuuauggccaagaaacuuaguuucaugcucacagguuggugcagcaaacaguucacugcauguaguucuaugaguugaacugcuaacugucauuuuuguuuuguuuuguauuuuuuugagaccaugucauacuauacaggccagguuggcuuugcgcucacagagacccacuugccucuacuucccaagugcuaggauuaaaggaaugguaaccauauccacucucuacaugucauuuugaucugugauuaugacucgcgaguguuguuaaauuuuacaaccacugugaaugggaggagauaacuuaccugguaauaauagcuuuuaagaauuuauggaagauuuuuguuuuguuuuguuuuguuuuguucuuuuuugagacaggguuucucuguauaccccuggcuguccuggaacucacucuguagaccaggcuggccucgaacucagaaauccacuugccucugccuccugagugcugggauuaaaggcaugggccaccacgcccgacagaagauuguuguaacaucagauauccagggcuucuaaaguuaaguuuuaacaucucauauugaaguuaauuagaaaacuauaccuugauucaaaucucagauugauccucuaaaauugugugacuuugagcaaauucaucuucuacgaaaaaauugcauccauucauuugugugugucugugugugaugagugucaugacuguggaaggcaauggacaaccugugggagccucuccucuacccugaucuguugguccugaggagcacccucgguucucagucuuggugccaagcacagguuuuucaauuuuauugcugugagauuauuuuaauuuauaccauaaaaucuucaggcuaacuccaagaaguuucuuucuauuuuuuguuaaggaaauggaauuuaucucaucagacuacuguacuaaagacaacgacaaugaggaggaaaguuugcuugcaaacguugcuucauuaagacaugaacucaaaauaacagaauggaguuugcacaauuuaggggaagaguuauccaggcaaggaaauaaaaucacaugaauaaauuguaaaguauuuauaaauguaaaauggcuagauuucauuauauguucuguuuaguaugucccgggacuaagacauaauugugaaaguggaaauauuaacaaacauuuacauauuaagaaaacaucuuuaauauaucaggaaccaguauacaauauauauucagauuacuuaucuuucauuauuguagcugcuuuuuuauuccugaaguaaagagauucaugaaauauauagcuaauguaaacuaauugugauuuacugaaaguguguuggaaacacagucuuaugcucauaacuuuggaucuaauuucugauuauuauauguagaaauuugugguaaaaaguaugucagaaaugaucuguaguuuuccuuuuuucuguaguguuaguccaagugaaaauucugaguaugucugcaguccuucaagaucugaaaggcuuauuuuggaagaacucacccaaccuagccaccugggacguuugauuuacccaccuuauaagaaaguuuguaaaacaucugauaguacugauuaucaaaagaaaucaagagaucagguuauuaucuuuagaucugauuauuuaaaauaucuuccuuugcaugucuuauguuuuuacauuauuauagucuuuuacuauaguuauugugauugaaauauaauuguucuuuuuaaauauauguggaugaguguuuugucugcauaugauguagaggucagaaaaguguguuggauccccugaaaccugaguuaaaaguccugaguucugggcaguaaguuccaguuguaaguuucuauguggaugcuagaaauugaacccaguccuugagaaaacaacucgugcucuuaauugccaccuccccagcuccauaauuauuccugucugaggccagcucuggcgguucuucugguucugucuugaggguagcugaggccgggaagaguguaggcaggggcaagacuuggucuugcaagauauuuaggguugcuuuuuuguuuuguuuuguuuuuguuuuuugcuuuuuuuuuuuuuuuuuugguuuuucgagacaggguuucucuguguagcccaggcuguccuggaacucacucuguagaccaggcuggccuugaacucagaaauacaccugccucugccucucgaguccugggaucaaaggcgugcgccaccacgcccgguuuaggguugcuuuuuaauaauaaaauguuuaccuguccuaagucuaaguuacuuguaaugguagcugaccugccugucugaguuccucugaggccagaaacugcagucucuguaguucagcaucuuauaguaaaacaguggggaguuaagcaaaggauuaauggcuagggcuguuuuucucucuugcccagaagccuugccucugcuugucaggcuguagagauguuuggagcaauaaacuuugaaccaggagaagaauaucaugcucccagaaggaaaaacuuacucaaguauauaugcauaaacucacauaaauuuguauuuaaauucacacaugugcauuuauacaucuucauacauuccuguuggggccagcuacaugcuuaugucauaauuacauacucacacacauaauuaagaaguaaucuauuuguguauauagcaugacuacaagacaucuucacuguucugcagagaucugcucaaaauggaugggcuaaugccuagugauuauuauauauauuuaauaguaagaggaaaagccuauuagaaggaauuuuuccucaacuguaaucucuuuggccuugucuagaaaagcaaauccaucauggccuuacaguccauaguggaaccaucucaggaagaucaccugccaguuuuuagcuucuccuagaugguuccuaacauguuccuuuuauacucuaacuuuuuuuuaaaagauuuauuuauuuauuauauguaaguacauuguagcugucuuuagacacuccagaaaagggcaccagaucucguuacagaugguugugagucaccaugugguugcugggaauugaacucaggaccuuuggaagagcagucagugcucuuaaccgcugagccaucucuccagcccauacucuaacuuuuuaugcaacgaaaacuccacaguuaagaggaauacuaugaaguuuucaauguauuauguaaaauugccaauguauauuauauaaauuuuaaaaguaaaguauauguuagguuuuuuuuauauaaagaagaaaugcaagugaguaauuauuuauaugcauuuggaaucacuaaaaaaucaaauuauaaagauacaguaaaaagccaggcaugguggugucucacaccuauaaucuuagcacuuggaagacugagcuaggagaauuccaggguagccuguccugaaaauuuauaucaaacaaacaaagcaacaaaaaggcugacgauuuagcucaguugguagaguucuugcuuaguaagcgugggccuugggucugacuuugagcaguucauaaauugggcauaauaacuuuguccaauaaccucagcacugaagagguagaagugagagauucagaaguucacggucauccuggcuuauguaggguagggagugugaagucagccugaaccuaucucaaaaaacguuaaaguuaauguguuaaacagcuucuaaagauggcagauuauauauuuuucuuuucaagacuggguuucucuguguaacaguacuggcuggaacuugcuuuguugacuuggcugucuuggaacucagagguccuuaugccucugccucaucaguguugggauuaaagauguuuaccaccauuccuggccaaggauauguuuuuguaugcuuuuccuuuuauuagcuugcuuuauaguuuauauauauauauauaaauuucucaaaaaauugaaaauaacucacaaaauuaaaauauuuuauauauuauguuauaaaauuagcaucauaaaaauguaugcauaaguuaaaccauauuugucucauuguugcuugccuuaugaauuccuuccauauccuuuuauacacaguaaaauuguaaauauccuuagguguagaaauacaaagguuucuaucauauuuauguucagcagugauauugugaguugacuuauugaguaauacccuaguuuaauaaaguggaccaugcucuccaguuuguacuuaauuuguacuacuaugacuggaaaagaaugucucacauaauacucccuaaugcucauuguccugaguuguucaauaauuuuaauggcaauuacugcuauuuucuauuaauuauauauacacaucaaauaauuuaauguacauugucuuuuuuuuuuuuuucucuuuauuuucaggugucuuuuucaucuguuucuauggaucaagagguuaaaaaccuucgagagaaacuucauaaacuuaggcaacagaaugcuuguuuggucacacagaaucauucuuuaaugacuaaaauagaaucuguccacuuugaauugacacaaucaaaagcaaaaguaugucucuugaugggugaagagaauauuuguaauauuuuaugauuuauaauuagaaauuuuuuuaaaagauuuauuuauuauuauaucuaaguacacugcagcugucuuuagaggcaccagaagagggcaucaaaucuuauuauggauggcugugagccaccauguggcugcuggguguugaacucaggaccucugacagagcagucaguacucuuaaccccugagccaucucuccagcccuagaaaauauuuguauugccuaucuaguagguagaaauuuuuauacucuaguugaauauugauaagggauagaaucauaccuauaucuaaagauaauuuaggaaacuuuuaauuaauuuuugcauuuagauaaaucagcuucuuaaaaucuuacuguuggaaacuuaaaaaguggaaaaagaagggauggaaagauagcuuauauguuagagagcacuugcaaacaaaaacagaaccaaauaaaacaaaaacagagaaacaacaaaaacccuccgcaagaaucuuugggcuugugggagagcucuaaaugagaugggaguagaaccuuguguguguggcuuuguguugaucccuuucuuucuaacucaaccucaucucugaggcuuuucucaauaucuucaucuaacaaacuuccuacuuuuaccuugcuguugguguucuaggauuggaaaauaggaugcugaugacauacuuauagagccucuggguuuuuguuuucuugaugucuucucaguucccuauuuuaaacuuacuuauuuuuuauuauuuuuuuaaaacuuuuuaaguauaagcaguucuuauugcuuuuuugauuauuggcuaauucaugaauaauucucuaucuuuuacauuauggauuccuuuccugcuucagugguuuuacuauaucuuccuggcugcaggguugcuaugcuuuucugaauuaucuagauuuucuuuauuaagcaugauuucuaaaauuaguuuauauaaaauauauuaguuuauauauauuauuaugucaaguacacuauagcugucuucagaugcaccagaagagggcaucagaucucauuacagaugguugugaccuaccauguggcugcugggauuugaacucaggaccuucggaagagcagucagugcucuuaacugcugaaccaucucuccagcuccccugaaauuaguaauuaguuguuuuuuuuuuuuuuuaagauuuauuuauucauuauauguaaguacacuguagcugucuuaagacacuccagaagagggagucagaucucguuacggaugguugugagccaccaugugguugcugggauuugaacucuggaccuuuggaagagcagucgggugcucuuacccacugagccaucucacuugcccgaaauuaguucuuaagucauaaaaauuuaguauauauauuuuuuuuaccuaauuuuucauuuuggucauauaacuuguauauaaucuaacacacauacacacauacgcagagucuaacuuacaugaaauuaauauuccuaggugauguuaggaauuauuguauguaguuucccccaaguauaccgagauauuuaaggauaguggcagguuauaugcugagccugucuuaugaugaugauguguacagauaagagcugaucaaaggaauaaauaauuuagccagagacugaggaguccuaaugaaccgucucaucugauaaggaaagaccaauauucaaauagauugauuuauuuacugaaacauagugccauaaaaguugucuuuauguuuuagauugcuaugcuugagucugcacaagagcaggcagccaacauuccaaucuuagaagaacagauuauaaauuuggaagcagaaguuucagcucaagauaaaguuuugagguaauuacacuguacagccuguaaauuuuuauuuuguacuuguuugguacaucuuauuaagaacuaucucuuauacuaucuuuucuacccuaauaaguuuuuggugacuuauuaaggucuuaacacaucauuaaguuuuuuuucagucagucagagcaucucauagcuguaacuuacaugcaguguacaaggacuaaagaugaauuauuuucaggugagauccuuauuugcauacuuuuauuuaauaugaauuaguuuauuucuugcccuauagugcaguacacacccauugcuucaguggaguuuaaguacaagacaaaggguauuuuuaucauuuauuuuuaucuucuauuuuaaauguaauguguacugaacaucauguuacauuugagugauucucauuacuguucugggacuuguaguauuagcauuaucugauaauuuagaagaaauguggauuauugagcccuaucucauauauauguauaugagauagggcucaauauauaugaauagggcucaaauauaucaauuuauauaaaauagggcucaaauauauaaauauauuuuauuuauuuauuuauuuauuuugagacaggguuucucuguguagcccuggcuguccuggaacucacucuguagaccaggcuggccucgaaaucagaaauucgacugccucugccucccaagugcugggauuaaaggugugcacuaccacugccuagcuauaaauauauuuuauaauauauauaaaaauaaauauauauauauauauuuauauuuuguuuuucgauacaaaguuuuucuuuguaguuuuucaguacuggaacucccuuuguaaaccagacuggcuuugaacucagagauucaccuacuuuuuccuccagaguucugggauuaaaggcuuguacuacuacuauacccagcuaaauuuuaaugaguaccacaggugaaucugauguauguuaaaaugucuuuuaaguuuaucaguuuuagagcuuucuuuguaauacauacauauauuuagcuuaaauguauucuguguucugugaauuuuugucugcucaauguuuuuuuauuaauucuuugagaauuucauauaauguauuuuaaucugaucauauuccccuuuuccaacucuucucugauucacucuucucaugcauccagcuuugucugugugcaggagcacucuuacucacuugcucacucuacccaccacccacacuuugaaucuuuuuuguauuggccaacuauuaugucuggggccuguccuggaguauaguuuagaguaauggagaaaaaccaggguuuacacuguuaaagaaaaaugaaucucauucuuucagaagguaucaaaugucaguugcuccuugguuagggguagggcuuaguacuugccuucuuccguucuggauuuucuggaaaacacuuguuuucccuaaagucacacacuacucucuggcucuuaaaauccuucuguucucucuuccaugcagaucucugagccuagguuuccuuuacaacuuaaggcugaauacuccacagccucuuauucuuugcacauugacuaguuaguugugggucucuguguauaacuguccaaggcuuugacaggccuggguaagcugaggcagggcauggaguugaggaauaauuauucagcagacuuuucucugagggaacaaugcuugauucuggggcuggcuaaguacucccuguagccagugagaagcaucacacacacacacacacacacacacacacacgguggaugaagcaaagcuccaacaagcaagcuccaacaaguuuaguuuuucucccaaguuuuuauaucccagcaaaaucauucaagcaguacaaagagcacauuugaacgugauugcauucuauuuuucaauuacaaugaguauacauagaaaaacauucccuaagacucucacauuaauaaacauuacauacuacagguaaaaccaaauaaauuauuccuaagaacccacauauauucauaacuaaacaaguuguuauagauuaacaauguaaucaagcaagguaauuuucucagccaguuuuucuuauuaguaggcugcaauuugucauuacaaagaaaggaucaauuauuuuauuauuuauauuaaaaaguagucuuauaaaaaucuuaaccacagaucuaaacuuuuauauaaaaaaaaucaguuauuucuacuuuaaaucugccgaugcucaucuacucacuaacaacucuucuauuuauuuauuuauuuauuuauuuauuuauuauauguaaguacacuguagcugucuucagacacaccagaagagagcauaagaucucauuacgaaugguugugagccaccaugugguugcugggauuugaacucaggaccucugguagagcagucagugcucuuaaucacugagccaucucuccagccccucacuaacaacucuuuaauaaucauaucaugaagcugagggcaaaaaaucaguacaagaaguuaaucaucaccuuguucaccagcccggcuuuagcaagagucauaucagucagugcuaugcaggcugccauuguucuuguucccucaccucaaaaaaauccccagcucaacuauuaagaaugaguauuucugaacuucaaauuguucccuaagauuuucuacaucagagucacugacaaaaacaucuuaacuuuacuaacagucuucuacuuuuuucuaaggaucauugcuaacaaucuacaucucuuaaguuccuucugaugguaauagaugaaucauuaaucugcuucaggagcaaugcuugaaaaagaucaaucacuauuauuguaagugccaauguuacugcccagugaggggcugaaagcuuccuuagaguuuucauauagcucauggaguauuccauaaaggcaacaaguagcaagaugcuccauaacagcaugaaguccucagguccuguaguugucaaggcugugccucucugaggcacauccauugugauugugcuaacuggugggcugcauuccaugaauucuaaagcuguuuuacuguuuuucuugcauggcccgaaacauauuugguuucagacccaggacaggggacugaaguacauauuuuacauaccaaagcugauuuugcuuucagguucucccagcaucccucagucccuaucuggcauacccugccccccacccugaacuuuccagcccaggggcugggcugcccuucccccagaggcucuucucuauauaauccagacguuuuagucucucucuuccucuucuccucucucccugcgagagcaugcccuucuuucucccuccccuaaccccacuuucuccauaguggcuuccuaagagaacugcuugcucucauagagguccugaguucaauucccagcaacccccugguggcucacagucaucuguaaugggauccagugcucucuuuuggugugucugaagacagcuacaguguacucacauacauaaaauacacaccucagucccuuuuccugggucugaaaccaaacacauacaauacgacaucaggaauuguuuucaauuuagcaauuguuguccauuuaccagaauaauaguaguagauucuccccuagguucuuagccuuguugacagugccagauacagcuucuauuucauggaacaagccuuauauccaaggagaaagugguugguuacacccuuaacauuugugccacuauugugucagugggcauaucuagugagacaggacauuacuguagcuggacgaguucagcuugaugagauugaugugguugguguuaacuuuuuucuccaguagcaugcauagaaccuuucugcacuaugaaagcuagucggggacaagcuuccaguugaguacuaucuagaucucuucauaugcuauuacucaaguauguugugucuugagcaucaaauugugacggguaacugaacaauggcaauagccucuaaauuugggguucuaugggcccauuggucaggacucaaaaaguaguaaucuguugcuggcauggugggcugauuuuuuggggggggcggugcagugaacuuuauugaugguauucaagagaguagggagggcucccuaggccccuccuauuguuauaggggucuggaauggaaauugugagggagaugcucaguguugggggcuaacuugggacagggacuccucagcaacugagggccucucuuuugcucucaguguacuugcuggcaugggugguccagggucucuuacuccuuggaggccauguaagccaugagguccaucacccuguugcuguagcuguguucagcaucaaaccagcaaacgagcuuuacaaaguugucauugagagcaaugccagccccagcaucaaagguggaagaguaggaguugcuguugaagucacaggagacaaccugguccucaguguagcccagguugcccuuuagugggcccucggaugccugcuucaccaccuucuugaugucaucauacuuggcagguuucuccaggcagcaugucagauccaugauggauacauuggggguaggaacacagaaggccauaccagugaacuucugguucaguucugggaugaccuugcccacagccauggcagcaccaguugaugcagggaugauguucugggaagccccacggccauuacgccacaacuuucuagaggggccaucuacagacuucugaguguuguaauggcauggaccauggucaugagcccuuccacaaugucaaaauugucauggaugaccuugcccaggggcgcuaagcaguugguggugcaggaugcauugcugacaaucuugagugaguugucauauuucucguggucacaucuaucacaaacauggggccaucaguagaaagggcagagaugaugacccuuuuggacccacccuucaagugggccccagccuucucuauggugguaaaaacaccaauagacuccacaaccuacucagcaccagcaucacccuguuugauguuagugggaucuugcuccuaaaaaauggugaugggcucuuccugucccaggugcugcaggagccucugguuacugugcagacaugaccaaauccaagaaccacacacaccacacaaccagucccacaaauggcacagaaauggcaucaagaaacccuggucacaaaaauacgaaucucuuaaggggguugagcccaaguuccugaggaacaugugcuuugccaagaagcacaacaagaaaggccugaagaagaugcaggccaacaaugcaaaggcagugagugcgcgcccagaggccaucaaggcccuggugaagccucaggccaucgagcccaagaugccaaagggccccagccacaaacucagccgucuggcuuucaucgcucaccccaagcuggggaagcagauucaaaguuacauggccaagggucagaggcucugccaaccaaagcccaagguucaaaccaaggcaggggccaaagcuccagcuaaggcccaggcuucagcuccagcccaaguucccaaaggugcccaguucccugugaaggccccauagaaaaggcuccugccagugugaagacagacggacugcgguggcacaccuacccacaaacuauuuucagaugaccaauguccuaugcuauuuuuacaaauaagcucaggcaagaucuguuuaaaaaacaacaacaacaacaaaaaagaaaauggugaugggcuucccguugaugacaagcuccccauucucagccuugacugugcuguugaauucgccauggguggagucagacuggaacauguagaccauguaguugaggucagugaagggguuguugauggcaacaaucuccacuuugccaaguguagagcagaagacagcccugguaaccaggugccccauaaggccaaauccauucacaccgaccuucaccauuuugucuaugggacgaggcaggcacugcacaagaagaugcggcugucucuggaacagagcuuugugugguaucuuuuuuggggaacugccaccucccccugcauuauggaauaacugccccgcccauuauggaauaacucuuuuaaaacuuuuguauagauauaacuauguguauauaacuauacauauauaacuauauaagcuauauaacuguaacuauauacgugagguuuucauauggcauuaucaaaaggccucuaguacuaguuuuccuucccuauauucucuaccuugucuucccaucucccacaucacuuaauucuucuugucccauuuuccaccuuucucuuuuauaaugcuuuaucuccccuuucuugaaagaucuuuccugugugcccuuccuaguuaaccugaccucugaguuuaagaggugagggauugcuauauuguucaggcugucacugagucaucaucaugccucaguaucccaggugguuggacuacaggcauacauuauuguaucuggcucgauauuuauaucauauauaauaguuacuguaauuggauauuucuuuuguagaagugcuuuuuuuuuucacagucucaguguuuuuauuuauuuauuuauuuuuaauuagguauuuuccucauuuacauuuucaaugcuaucccaaaggucccccauacccacccccccaauccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccggguacugguuaguucauauuguuguuccaccuauaggguugcaguucccuauagccccuuggguaauuucucuagcuccuccauuaggggccgugugacccauccaauagcugacuguggucuuccuugggggugagucaugaugugaacaugccauggcacacauguggagguuaggacaacuugcuggaguagcuuuacucauaauaugugggcucuaggaauugaacucaagucauuaguguugguagcaagcacuucacaccuuagcagucuugcugacucuucuuucuuuguguuaguuaugauaguuucacuguguaaacuaggcuugcaucugaguuauggagaucugccuccuggguguuaaagguguuccugggcuauuucuuguauucauauuuccucuauuuuauguguacagacaauuuugucugcauguguaucugugcaccaugugccugcugcuuauggggcuagaggaggcaggcagauuccuuggcccuggaguuaaggauguuugugagcugccauauggggacugggaauugaaccuuaauccccuggaaaagccucaagugcucuuaaccacucaaccaccuuccaggccccugcuauucuaaucauuuucuauuuugguuguccucaauauucuagguaacgaaaugauaauuaucaacaaagaacaaaacauuucuuucucagugcuacucuuccauucuuguguuuuccauggguaucuuugguuauagacgugauaacaauuacauuuucuuuccaucugagguauauaguagugcuucuaguuuguaugaaauauguuuguuuuuagaaauuauagacuuuguauuccugauuccacuaccccugccucacaaauauucaaaaaugcugugaauauaccugugccacaaggcucaguuguugaaugugaaauaugaugugagcuuuuaguuuagauggguuucucacuucaugaaaguauuuuaugccauauagccuucuguugaugaguuaugaauaugccuuucucucuuauaaauauguuugucuuaacucacugauuuaauuauuauuaaaguaauuaugucacauuauucuuauauuucuccaguaaauauuuuaccaguucuuaaagcuuauucuguauuuauagagaagcagaagauaaauuagagcagagucagaaaauggugauugaaaaggagcacaguuuacaagaggccaaagaagaguguauaaaauugaagguggacuuacuugaacagaguaaacaaggaaaaagguaugugggauugugggauuuacaaauuuguagaaccaauccugugcaugcgcuacagcugcuguaccacugaacuguauugcucauacacacacacacacacacacacacacacacacacacacacacacauauauauauuuuuaauagguuguugccauguaaucuuggcuggccugguacucacagggaagcccaugcuggccuccacuuugcuguccuucugccuucuuuucucuucuuuuccuuuucuuccccuuccccuucucuucuuuucucucuuuuuuucuuucuuuugguuucccaagacaggguuucucccuguagucuuuccaguuuccccucugcaaaccucccauuccaucaccccugcccuuugccucuaugauggugcucucccccacacccacccauucccaccucacuguucuagcauccucucacgcuggaguaucaagagccucuguaggaccaagggccuccccuuucuuugaugcuagauaaggccauccucacauauguucaggggauuaagguucaauuccuagcccccauauggcagcucacaaacauccuuaacuccagggccaaggaaucugccugccuccucuagccccaugagcagcaggcacauggugcacagauacacaugcagacaaaauugucuguacacauaaaauagaggaaauaugaauacaagaaauagcccaggaacaccuuuaacacccaggaggcagaucuccauaacucagauacaagccuaguuuacacagugaaaccaucauaacuaacacaaagaaagaagagucagcaagacugcuaaggugugaaguucaguuaugauuauccuacauauguagcuggaaccacaggucccuccauguauacuuugguuggugguuuagucccuaguuaaccucugggaaguccuguuuguugauauuguuguucuuccuaugggguugcuauaccaggcuccugucagcaagagcuucuuggcaucagcaauaguguggggggguuuggugucugcagauuggauggaucccuaggugagauggucucuggauggccuuuccuuuagucucugcuccauuuuuuuuuuuuuuuuguccuuacauuuccuuuagauaggaacaauucugaguuaaaaauuuugagauggguggguggccccauuccucaacugguggccaugccuaucuacuggagauggucucuacaggcucuaucuccccuuuguuggguauuucaguucuugucauccccacaggguccugggagccucuaacuucucuggugucugggacuuucuaguggcuauucccaguucucuaucccccacugcuacauauuucuguucaauuuccuggcccucuauacuucugucucuucccacaccugauccugcccccuaagauuuucaaaggaaacauuuuauuacauuuaaguguguguguguguguguguguguaugugucuacauauaggacagcuuauaggaguuguuuuucucuguuuaccuugugagucccagagauugaacucugaacccuaugcuuagugguaaaugcagaccaagucaucucuuggcccuccuuaaauuuucauguguugauuuuguuacugacauuuuagacuaggacuuuuuuguuuuguuuuguuuuucgagacaggguuucucuguauagcccuggcuguccuggaacucacucuguagaccaggcuggccucgaacuuagaaauccgcuugucucugccucccaagugcugggauuaaaggcgugcaccaccgccacccagcuagacuaggauuuuuuuuuugugugauauuaguaaugauuauugauauaaugauauuuauuucugaaauuaauuucuuuuuuuguuuuuuguuuuuuuguuuuguuuuguuuuucauagcugaggacuaaacccaaggccuugugcuugcuaggcaugcacucuaccacugagcuaaaugcccaaccugaaauuaaguucuuacuuaaaacaaacaaauuaguuuucuauauuuacacugagaaagucuuuacuauuucaucuaaauaaaguguuuuauauacucuuuuuaaaaauugguuuauaaauacuauagaaaaagaaagucaacucaugagaaagugaucaguuuacuuuagaaauauauaaauaacaaaaaagucuguuuuaugauuuuugucuuuugagaugaaguuuuguauuugugcuaaccaaggagcuacuuauuuauuaauguaucgaacacagagucuucuuaggucgccuaggcagacuugaacuuguauaugauccuccugucuccccuuuauaaguccugggauuacaggucaaagguacuaggccuugcuggaaugauuaaauacuaguaaauuuaaauuaauaauauugaaagauuuaaauuagugagauuuuauagaaacuaugauuaaucaguuuuuguuugauuuuguguucugugugggcucugaguuagugcucaugcauauuagcaagcacugaacuaacugaacugcaucuguagccuacugcaucuuuugcauaggauaaaauaauaauaauguacauguaaaaacuuuuuaaauuuuuauuuauuuauuuauuauguauauaagugcucugcugcauguacauaccugcaugccauaagaaggcauuagauccauuuguagguagucaugagccacaaugugaguacugggaacugaacucaggaccucuggaagagcagccagugugcucuuaacugcugaggcaucucuccagcccccauaaaaacuaaagguuuauuuauuuaauguauaugaauguuaugucugcauauguguaugugcacuacuuacaugugguaccugguacccauggaagucaaaagaggacaucagaucuccuggaacgggaguuauagguaugagcugccaugugcaugcugggaacugaaacugggucuucugaagagcaauaaguacuuuaacuguuaaucuaugcuguagcccauaaccuacauuucuauauuugacaauaaaacauaucuuacagauuuauacuaugauauauguuagauuauaaagaaaguaaccucagauacucaggagucugagaaaggaaguccacaaguucagguaaguuuagcugaguuucagagugaauucaccuucagccuugacagcccagggagcucgucuuuuaaaauaaaguaauucaaagagugcuggugauauaccucagaacaucguuaggauguacagcuagguucaguccucagugccacaaacaaacuaauacaugaauaggcagcauugucuucaguagguaagucucugcuucauaugcacuuacccuccuacacacuacugugaucauggaaguuacguuuucacguaaguccauuuguaagagcauuuauacagaaacauuuguuauuuguuaggcaguauuuuauaguggaaaauguuuagauuugggagucagauuuuaccucucgucuuuauuaucuuggaaaaccaucuaauuuuuaaaacuucagcuuuuuuaucuauuaaguugcuauugccuugguaugcacaagaaaaagaaacauguaaaauaacguuauguaguaaaguacuuacaaauuuuaauuauuauguaaaauuugugguuuaguacccuaaaauucacacucacucagauaaucuuuguauuuggguauuuaaagagauaacaauaugggaaaaccagauuuagaauauaacagcuaaaaacuauaaaaggagagcugcuaguuucccucugcaguacuuagauaagagaugguaacuaacccuaauucuuuccuuuugucuacuuuucccuucccuuccuuccccuccuugccuucccuucuuuccuucuuuucuuuucuuucuuccuuuuggaagggaaauaaauggggcacauacagaugaugacacauacuugaacuuaaaaguaaaauuaaauaaauauuaaaaaaggagaaaaaacuaaaaaaaaaaaauaacagcuugaagaguugaacaucacaaguaaaaauguuuaugcagagccaggcacaguggcacacaucuuuaauuccagcacuuggaaugcagaggcaggaaaaucucuguuccaggccagccuguuguaccuauauauagaguuccaggacagccaugacuacauagagggacacugucucacaaaaccaaaccaaaccaaaccaaaagaaccagguagauuuaguuauuauacuuucauuugaaauuuguuuauaguuaaagaagcugaaaaauagaaaguaaaguuccugaagggaaaggcugaagacuauaaauggaacaauugacuuuggguaauagaagaguuauaaguuucccugaugugauggugugauuuuaaauauuaaaaaauuagcugggcggugauggugcacgccuuuaauuccagcacuugugaggcagaggcaggcagauuucugaguucgaggccagccuggucuacaaagugaguuccaggacagccagggcuacacagagaaacccugucucgaaaaaaaaaaaacccaaaauuaaaaauguucuuguauggggaugauauugauuuaugaagcuuaguguucucagguaaguaugaagaaagucaagcuuauucaggaaguaaaaagcagguuuaaacagugguaguaaauggauucuuauuguuuaguuuuguauuaguaaauauuacagguuuuuuuuuuguuuguuuguuuuuuucugagacaggucucacuaacucuggaugacuuagaacuuauuguguugaugaugauguuuucaaacuaaaagagauaggcuugccuuugucucaugaaaguuacuggguuguuuguuuguuuguuugaaacacaugaagcuguuuaguuagguugauagcaguuuagaacacuaguuugugaggauauguccuguuugucaaggagaacugaggcugcacguagcccuggagcugaggaacagcguuggucuuuggcaaacugugaguucauaguucugauuaaccuugcucugcacuguaaucucauauuucuccuuuuccauuuugaagaucuugccuuccuggugccugggcuugcacagcugguucuuuucaaguaagaaucagccagguguuuggggauuuuaaccuugcugauacuaucuuuuguagagguggcaaugacaaacuucugcacagaggaacuugguugagggcaagagguccagucacagguagcaagccacugcccaacugcuucaggaaaaccacucuuuuuccucuguggcccuagcgaggaugaucaggacagucccaggagugaugcuggcaggcagccuucucaugugcugacagaagggcuuuuuugccauggcucagcagcuucggagacacaucuuugguaggauaauaccuacgcauuuuucaaagcuucaccacuuagguaccaccauucuugucaccaccaacuuuuuuugugacaguagcaaggaucuuuuuuuuuucuucuuuucaaccuuggacuuggcagcugaguauuuccuuuuguacaagggcuuucuggaauacauagcagaucgggagugccugccaauuccucuaacuagggcaggggcugcaauggggcuucccuuuccugggcuuuuuagcuuuaggguuacccuuuuuuggcugcaccaguggcuggggcaucaguggcgacagcauugccaccagccuucuuggcuggagguuucuucucuuuuguauugggcuuggcuuuuuugccugccaucuugaaagaugggaaagagcuuguuuuugguuuuuuuuuuguuuguuuguuuguuuugguuuuucaagacaggguuucucuguguagcccuggcuguccuggaacucacuuuguagaccaggcuggccucgaacucagaaaucugccugccucugccucccgagugcuggaauuaaaggcgugcgccaccacgucuggcuuguuuuuguuuuuuuuaguaacuuaaaaaauaaccuuugcauggauuauugaauugaguaucuaacauuauauacuauagauugguuuuauaagacuuguaaucuuuagaaauuuauuguucaguguaaggaugcuucucuacuguuuuccagauuaggggauagaauuguauguauggaauguauaggaauguauguauguuucaaaguugauaaguauuuauguuauauuuuguuuauguuguuggagugagaaaguuauuguagugaaaccaaaccccacaguaaagccugauacucuguuuugguuuuaaaaaaaucuacuucuaugcuaggaaagaugauucacuugguacccgcuagacacuauugcauacacauaucuguaucucagcacuggggagauggagacagguggaaucuuggaacacguugucuagcuagucuagcuaaaacgaugagccccuagcacacugugagacccuguuccaaaaaaaugaaguggagaacaauugaggaugagacuucaaguugaccuuuggccuccaaaugcauguccaaacacauggauagguaggcauguacacauauauaaaagcauguacaccacauguguccauacauauacacgacacauacccgugugcguauccacacgaacauaaauuugcuuaaagauuaauuucucaaugcagagaauuccuuuuauuauuucuuuuaaacgguagagcugagcgacaaaggaaugaagcccucuauaaugcagaagagcugaguaaggccuuccagcuguacaaagaaaaaguggcugaaaaacuggaaaaggugagagaaguguuuguucaaacucagugucuuguguuacuguccauaguuaaaaguggauaauucauagaauguuuuuuuaaaauaagauuuauuuauuauuauaucuaaguacacuguagcugccuucagauacaccagaagagggugucaagucucauuacggaugguugugagccaccaugugguuacggggauuugaacucaggaccuucagaagggcagucggugcucuuaaccacugagccaucucuccagcccacauagaauguuuuuaccuauggaauaauaauucuaaagauuuuauucauaauaaaauaacauuuuuauuuuaauugggaagugguggugcacuccgaaaucccagcacucaagaggaucucuugaguaagcagguggaucucugugaguucaaagccagccugcuauacagagcuaguucuaaaacagccaacgcuacaaaaaaccaaaaccaaccaaccaaacaaaaaaacacccaaaccaaacaaaaaccaaaacccuguuuuggaaacaaaacaaaacaaaacaacaacaacaacauccccaaacuuuuauuucaaauugauuuuuauuuuguguguguguguguguguuuaaucauuuuaguuuuuaaaauuacauauauauuugggagguaggggcuauaugcacaugaguguaggugcccauggaggccagaagaaaguuuuggauccccucguacucaaguuccaggcaacugggaaaugaacuuggguccucuacaauagcaguaccuguucuuaaccacuggauucucuccagcccuguuuaucuuuugagaugaccuuucaugaaguuguccacagugcuucugccucagccucugaaguagcugggauuauagcuacuuggaacauuauguccaacagaggaaaguuucuaaaauauuaguaaggaagaugcuuaccaauauuuuuauuaucagaagaaacuuuuauugaaggaagaguaaguacaagaaagagaaaauauauagagagaaggaguaggcgaguagaaguuggaacuagaaaaguagaagcaggaaauuauuggcuguauuuaaugguggaaaucuugggcauuaacaaauuugugcagagaggaaggugaaauguacaacuguggacgaugauaaauagaacaacuucugaugaaacucaagaaaaaagaagaccaaaguguugauucuuugauccuucuuagaagggggaauaaaauacccauggaaggaguuacagggacaaaguguggagcagagacugaaggagagaccacccagagacugccccaccuggggauccaucccauacaaucaccaaacccauacacuacuguggauaccaacaagugcuuccugacagaaggcugauauagcugucuccugagaggaucugccagugccugacaaauacagaaguggaugcucacagccauccauuggucugagcacaggguccccaaagaaggagcuagagaaaggacccaaggaacugaagggguuuacagccccauaggaggaacaacaauaugaacuaaccaguacccuuagagcucccagggacuaaaccaccaaccgaagaguacuuauggcuccagcugcauauguagcagaggaugguuuuacuacuccaacaaaggccaaacaucugauagugcuacuccuuggaccaagcauauccaaaccaucacauauggugucuugguucuuuucaggcgcuaugacaaaacaccaucaggcuuaugauuccagaugguuaagaguccaugauugcagaacaaagacauggugccagaaacagcugagagcucacaucuggaucuauaagcaggaagcagaaaacacauuggacauaauggcagucuuuugaaacuccaaauccacucccaguggcacaccucuuucaauaaggccacacuucccaauccuucccaaacaguucuaucaaacacuagccugugggaguuagucucauuuaauccagugcauauggguuccagggaagaaacuuagguugucaggcuugcauuguuaaacagaaaguacccaugcccacugagcuaccuugguugccacuuguauugcaguuucauugggaauauuuuaaauuuucaaaaauuacauuucugacuagugagauggcucauugguuaagagcgcugacugcucuuccagaggucaugaguucaaaucucagaaaccacagcccuggagugagcaggggucuggagcaaguggagguuggggguaggcggggagugggggagcaagagggagaaagggaaggggaaaaaaagaaugaaaaaaauuguauuucugaaacacauggauugaauuacuugcauguguaaucccuauuugaauugcuugccuuguucauguuuaaccugagcauuuugccuucagguggcaucauucuugccaaucuguuacuggcccuuaagcauuucugaauaaauaguaacaucuuccucccugucuuuuguguauauuguuucuuuuuacuacaguaccagggacuuaaauauaaggaauacuuagccuguuccuguuucuuuccaauaucacuacucauaguuuuagcuugaaacaauguaaaacuuaugauuauaguaguauauucacuuaaaacaauuuuuuauuuuagguucaagaugaagaagaaauauuagagagaaaucuuaguaacugugaaaaggaaaauaaaaggcuucaagaaaaguguaaucuguauaaaagugaacuugaaauuuugaaagagaaauucagguacuuuauuauggaaaaauaauuuugaugugcaagugggaagaaaggaaacauuuaaaaccacauuuuuauuguaaauauggacuguuuaguaauguagaaggcuaagauuugugacugaaacucucuagguauaaaacuaauuuuaauauaagacagcuuaauucuaacacauuuguaaauauagaauaaugcagauuaauacagacaaaauguuuuuagaguguaauuacauuagcuagcuaguaaagaugcuuaaauaggaagaaaaccacucaguacaauuuuuuucauuuauaaaaaagagcagguucaaagaauauccauuaauuuuccauagucaagaagguagauuagggacuacugaggugucuugucagauaaagacacuuacugcauaaaucugcugaucggaguuugauugcuggcaccccauaaaaggagagggagagaaccaauuccacauauuuguccuucaacugucucucucugucccuuacuuccucacacacacuaauaaugaugaucaaugaauuuuaaaaauuuaaguuaaauuagguuaaagauguuaacugggucuucugacuuugguguucuauacaacauaauuuuuucauaacuaauaauuuuggucaacuuucagaagguaauaauccauuuuuauaaucuuagacucaagguggagagaacaaucaauauuuuuucugucuaauuguaucauuauagcacauuuuccuuaagguggauacauuuaguauuuugguagacaagaugaaguuauuagaguaauuccuagagccucaugcuaucaauuauaacuguauaucuauaaguauauauacuuugucuauauauauauuauauauugucuuauauuuuauaaaauagcuuuugaacagaucuuguuuuuauuuuaaagugugugugugugccuguuuuaggggugaggaguuguacuugugagaacagugucuuuggagaucagaagagggcguuggauuucuaaagcuagaguuacagacacugagccacuugacaugggugcugggauuggaacuuaugucccccuguuagaguagcagagacuuuucauuucugaguugccuccccagccuuuguuuuucuuuucuuuucuuuuuuuuuuuaauuagguauuuuccucguuuacauuuucaaugcuaucccaaaggucccccauacccacccccccaauccccuacccacccacugccccuuuuuggcccuggcguuccccuguacuggggcauauaaaguuugcaaguccaaugggccucucuuugcagugaugaccgacuaggccaucuuuugauacauaugcagcuaaagacaagagcucccggguacugguuaguucauauucuuguuccaccuauaggguugcaguucccuuuagcuccuuggguaauuucucuagcuccuccauaaggggccgugugacccauccaauagcugacugugaucauucacuucuguguuugcuaggccccuguuuuucuuuucuaaguacugacuuuuugucucacugauucuuugcauuuguuuguuuccauuucaguaauucccugcuuucuuuuuccaagaugacuucacuguguaacagcccuggguauccugaaacucucucuguacaccaggguggacuuuaucucagagagcugccugccucugccucccaaauucugggauuaaaggccagcuccucuauugccaguaauuucugccugguuuuaauuauuuauuccuauuuuuuuaugaauuugguuuguuuuuuucagaguuuucaagacaggguuucuccguguagcccuggauguacugggaccuacucuguagaccaggcuggccuuagaucuaccugauucuaccuccugagauuaaagauguacagcaccgugcccagcauaaauaucuuucuuugcaauuguuuucagaggaaauucugucuagagacauacaguuuaagcagaaguuuacuuagcaaagcaaagcaaaacaagcacacuccaaagagagauuggagugacuuguccugaggcagcuggauaguagccaucaguccucuguguggauacuuaaacuauuuuuguaguggaugacauagucauguggguguaguaacuuuuuucccucccagaucauggugaacaagaucuuuccauaauccucuugaaaguucacaaaggugagaggggcacaguugucaaaaccacaaugugguaaaaauccuuugaguauacaguguuuuguuaguaugcauguguggcaguuaggaaagugcccuggcaccucaguuucucauuagugggaagacugcaacugcagcuuuaaguacguuuaaccacaaugaggcauucuuauagucaggacacagcucucacaaguucccugcuuaccucagagcuuaacccucaucuaccagguguuaucauccuuuucuccuuucuuucucacacuguagcccaggcugguccagaggcacuguaucgcucaggcucugcucaaacucagaauaguuguuuugucuucaucucuugguugcugguaauacaugugggcuacuaugcuuguccucucauccuuguaucccuaggauaaaugccauugggucauuguaacuaauuuucaguaugggcuguauucaguggacuggcauuuuguugaggauuuuugcuauuuuuauguaggauauuggccuauacuuuucccuuuuuuguuguguccuugguuuaaagugagaguauuuaaaggugauuauugaaaaugugugcauauuucacuuuaaugcuuuuuucuucacagggaguuaaaagaagaacauuacaguggaaaagaaaaauuaaugauuauggcaaugaaaaacucagaagucaugucacaguuaacggaaucuagacaauguauucugaagcuagagagggaguuagaggacaaagaugaaauaguacgagaaaaguuuuccuuauuaaaugaaaaucgagaauugaagguucguguugcaacacagaaugaacgacuagaguugugucagcaggacauugauaauucaaggguggaacugaagaguuuagaaaaacugauaacccagauaccaguaaguauguuugaaaagaaaucuagcccaccugacugugcaguggaaaaggaaccugcuguguuaaagagugucagucauucuguggccgcuuuccuagcuucuguccucacccuugcuugcucaguggcgcuuucaucugguaccuauuuccucacacucaccuuucuuacccuuucacccuuucuugcccucugagaugcauauauaggaacugcacagaauuuuugaagaguuuuauugaaggauuauuuauguguugaaaauucaauccuuuaaaguauacuauugcuggguaguguugaugcacgccuuuaaucccagcacucaggaggcagaggcagguggauuucugaguuugaggccagccuggucuacagaguuccgggacagccagggcuacacagaaaacaaaaacaaaaaacaaaaguauacuacugagcugaguuuuagguuuguagcagucauugcaauccagucuuacauauuuuuauuauaccuaaaacuucccuugugccucuuuacaauuaaugcaccccacucugggaaaccaauaauaguuugaauuuuuuuuuaagauuuauuuauuuaucauauguaaauacacuguugcugucuucagacacaccagaagagggcgucagaucucauuacggaugguugugagccaccaugugguugcugggauuugaacucgggaccuuuggaggagcagucagugcucuuacccgcugagccaucucaccagccccaauaguuuggauuucuauggguuugucuuuucuggacauuucauaugaauauaguuauaacauuaugugaauuuucuugcaucuguuuucauauuuugagggucauucauaucaagacauauuaguauuuuauuucuuuuuaguuuugaaugguauucagcugugugcauguauugugucuuauuuaggcagugguuggugaacauuuggacuauuucugcuuuuagucuauguaaaucaugcugcugugaauauuggcauagaagucuguuuguuagcaugcucuaauuuuucuuggauagauacguacuagugaaauuucuuggaaauaaacuguuuagaauucuuccaacaccgguucuuucucugcaucucuguugacauuuguuguaugucuuacuuaucccucuuaguuaugugaacugguguuucauuaucauuuucauuuuuauuuuuuuugauugcuaauguugaacaguguuauauauuauuaaauaguguagaauuuuaaauauucauguaugucagugagauuagauaggugaacauugacagguaugaaauaaggcaagaaugagaaagugauacauaugucaugguuuguuucacuucggaauggaugguagacugcauggcagauuuuacaaguuuuaaaguauugucagucauggaaguaugaagcugaaaggaacuuggaaaucaucagauuugauaaugcuauuuaacuagugaaaaaaauaugggugcagggaaauacuagccuaacaauugguuauuguuugaaguuuuuagucauuggguguuuuguucuucauuauaacuacuuuuuaaaauucuguauuauuuugaaauguauguguauucuuucuauccauaucuuaaauauugcuauguauaaaugcaucuagaaugacuuugcuuaaugaguuugaaaauacuguauacguuauuugugcuuauuauguuuugaaauguauucauauugauuuauauaacucaaacaugcuuauacauucuauugauaaauaccagauuguuuccaugaaauugauaguuuuccaagcugaguguuaagaagaagacaguuguaucacauauauauuuuauguuuauaagugucuguuuuuacacuugcaguuaaaaagagaaauaguuggcuuuaggucaucucuuuguaagcaccagaggaguaguguuucugacaaggaggacaaaugcauuggcugcugugaggcaaauaaacucaugauuucugaauugagguauauuuuuucaauuuuuuauaagauuuuuuuuaaagauuuauuuuuuauuucauguauaugugcauauuguagcugucuucagagacaucagaagagggcaucauuucccauuacugaugguugugcgccaccaugugguugcugggaauugaacucaggaccucuggaagagcagucaguacucuuaaccaaugugccaucucuccagccccauuucuuucuuccuuuccuucucuuucccuuucccucuuucuuucccucuuccuuccuuccuuccuuucuuccuuccuuccuuccuuccuuccuuccuuccuuccuuccuuccuuccuuucuuccucccucccucccucccucccucccucucucucucucucuuucuuucuuucuuccuuucuuucuuucuuauacuuuucaauuuuuaaaguuaaaguaaauagaauguuuccuuggucuuuuaaauuaaaaugguuaguugauuaguuuaaaaaauuuaagaaauuccagagaaucuuauaaaaauacuuacuacccaaguuaaauuugguucuuuuuugugugugguuguuuaaagucuauucuaaacaacuacaacaacaaaaaauuacaaguuguaaaauacuuugacccuuuaccagucucaugugaagguuucuuugauaugaauuauuugaaguggaauuuguaaguuguagaguauuuauauuuucaauuuuaguagcuuuuauuauguuuuuaaagaggcugaagugguuuauaguccaacuaguggcuugugagaacuuuaguaucuuagcuagggcacagugaugcauacuuaaaucccagaacuucggagacaaggcaagcagaucucugaguucgaggccagccugguauacagagcaaguuccaggacaagggcuacagagaaacgcuuucucaaaaaacaaaaacagaaauaaaaucuuuuauuuauuuuuuuacacuccagauuuuaucugcaccccugcccucacaaccuucccugguccacccucuuacuguuccacaucccauaccuccuccccaccccaccugacuucuaaauucccuggggccuccagucucuugaggguuaggugcaucauuucugauuaaacacagacccagcaguacucuacuguauauguguugggggccucauaucagcugguguaugcugccuguuuggugguccacuguuugauagaucuuggggguccagauuaauuaagacugcugguccuccuacagggucacucuugaccccucagcuucuuucugccuuuccccaauucaaccacaggguucagcagcuucuguccauugauugggugcaaauaucuguaucugacucuuucagcugcuuguugggucuuccagaguguagucaugcuacauccuuuuuugugagcgcuccauaaccucaguaauagagucaggccuugggaccucuccuugagcuggaucucacuuugggccugccacuggacguuuuccucaggcuccucuccauuuccaucccuguaauucuuucacacaggaacacuuaugggucugaguuuugacugugggauggcaaccccucccucauuugauguuuugucuuccuguuggagaugggcacuauaaauucccucucccuacugucaggcauuucaucuaaggucccucccuuugaguccugggagucucucaccucccaggucucugguguauucuggagggucccuccaaccuccuaccuccugagguugccuguuuacauucuuucugcuggcccucagggcuucagucuuuucccuuacccaauaccagaucaaauuccccucucccucagcaucccccauccacuuucccuccuaagucccacccucccuccccacuugugauugcuucuuucucccaagcaggacugaggcauccucacuugggcacuucagcuuguugaccuuuaugaguucugugaguuguaucuuggguauucuguacuuuuuuuuuuuuuggcuaauauccacuuauuaguacauaccaugcauguccuuuugggucugaguaaccucacucaggaugauauuuucuaguugcauucauuugccugcaaaacucaggauguccuuguuuuuaauaacugaguaguauuuaauaauugaguaguauuccauuguguaauugaaccacauuuuuuguauccauucuucuguugugagacaucuggguuguuuacagcuucuggcugucacaaauaagguuguuaugaacauaauggaacacuugcuccuguggcaugguggggcaucuuuuggguauauucccaagagugguauagcugagucuucagguagaucuaauuuucugaggaaccuccagauugauuuccagagugguuguaccaguuugcagucccacaagcaauggaggaaugcuccucuuucuccacaucuucgacaacauguguugucaccugagguuuugaucuuagucauucugauuuguguaagguagacucuuuagguuguuuugauuuucauuucucuuauuacuaaggacuuugaacauuucuuuaggugcuucuuagccauuugacauuucucaguugugaauucucgguuuaguucuauaccccauuuuuucauuggguuguuuggcuuuaaggugauuagcuucuugaguucuuuauauuuuggauauuaguccucuaucagaugugggguuagugaagauuuuuuuucccaaucuguagguugccgauuuguccuauugacaauguccuuugccuuacagaagcuucccaguuucaucaauuguggaucuuagagcaugagccauuggaguucuguuuaggaaauuucccccuuugccaaugaguucaaggcucuuucccacuuucucuuuuauuagauucaguauaucugguuuuauggugagguccuugauccacuuagacuugagcuuugugcaaggugacaaauaugggucuauuuucauuuuucuacauacagucaguuaguccagcaccauuuauugaagaugcuuucuuuuuuccauuguauauuuuuggugucuuugucuaagaucaaguguccauagugugugguuuuauuucugggucuucuauucuauuccauugaucaacaugucugucucuguaccaauaccaugcaguuuuaaucacuguugcucuguaguacagcuugaggucagggguggugauucccuagccauucuuuuauuguuaagaauugcuucgauugauauucugaguuuuuuggccuuuccagaugaauuugagaauugcucuuuccaugucuuugaaggauuguguugggauuuugauggcgauugccuuugguaggauggccauuuuuacuaaauuaauucugcaaaucuaugaacauggaagaucucuccauuuucugagaucgauuuuuuuuuucuugagaaacuugaaguuauugucauacaggucuuuuacuuguuugguuagaguuaucccaagauauuuuauauuauuuguggcuauuauuaagggaguuguuucccuaauuucuuucuuauccuguuuaucauugguauaaaggaaggcuucugauuuauuugaguuaauuuuauguccagccacuuugcugaaguuaucaguuggagaaguucucugguagaauuuuuggggucgcuuauguauacuaucauaucaucugcaaauagugauacuuuuauuuuuucuuugccaauuuguauccccuugauguccuuuuauugucuuauuguucuaguuagcacuuugaguacuauuuugaauagauuugggagagugggcauccuucucuuguccccaauuuuagugggauuucuacaaguuugucuccauuuaauuugauauuggcuguugguuugcaguaaauugcuuuuauuauauuuagguaugggccuugaauuccuggucucuccaguaccuuuaacaugaagggguauuauauuuugucaauugcuuuuucugcauccaaggagaugaucaugugauuuuuuuucuuugaguuuguuuauauaguggauuacguuaaugguuuuuauauaguaaaccaaccuugcaucccugggaugaagccuacuugaucguggugaaugaugguuuugauagguucuuagauucaguuugcaagaauuuuauugaguauuuuugcaucgauauccaaaaucuuaaguaauaacuucuggcuucuuuucguuugugcuaggauuaagcuugcaauaagagaggcugaaauucaaaagcuucaugcaaaucugacugugaaccagcucucucaaaauguugcuaaugauagucaagaaugugguaaaguaaacacguuagaaacagaaccgguaaaauuaggagguagucaagucggugaguauauuacauuugaauuacuuugauaaaugacaauuagcuuuugcugauaguauuuuaaaggaaaauauuauuaauugaugauauuaaaacacuuagucuccuauuaauaccuaugguuuguaaagacaagaauuauugugcaguucuuagacuuugcauuguuuaaaaaaugauauugcugaaacaaaauauccaauaagguguaccucuuuuaaauacgcaaauggguugcugagcaugguaucacuuuggaggcagaggcagguggaucucugugaauucagugacagccugguguacauaguccaaggacagucagagcuacaaaguauaacacugucuugaaaaaacaaaacaaaaaaccccaaauauacauauuugcuugcaugcaguugguuuacguguuuguuuuaaaguauguucaugcaguuguuaacaucaccauagccaaaacauguaacacuuuuaucaggaucuuuuauaguccuuuucaguuuucuuuaguuuuaauuucuguuguugcuuuucagugcugggaauugagccagggauggagcuauauucucagcccuuuauuaaauucucuuaaaagugaaagcuguuuuuuucagaaaaaaaaaaaaaaguacuuaaaagaauaaacuuuucuuuaagcaauacuuugcaucccacuaguuuuuaugcuguauuaucauuuuauacaguuuaaagcaauugauugcuucuuuaguauugaaucuugggcuauguguuuguguuuuuaagucugauuuauuuugcuuaguauuccgagauuuucaaaauaucuuuaaaacauuagucagggaacauauuuuauguaauuuucuuauuuacuuuuuuaguaguaguuauucagcccaagacuucauguaggccuugcuggccuggaacuugcuauguagaccagucuaggcuugaacucagagauccucugcaucucauuuuguggaagucuuucaugagugcaguugacuguagaagccagcagaguguaucagauuggagcugguuauaagcaauugugaauuacuugacagguguucuguaagaccucuuacugcugagccaucuauccagcuccuuucccuauguuuuaaaauaucagucauacuagguugaugguuuuaguuuuacauuuucuucauaccugaugaguuucaauauauuuauuguagcaauuauugagagaguaguauuaaaaaucuucaaauacauuugauugcugauuuauguguuguuguacuucugucaggauggaaccuuucuaguccuaccuuccuccccuacaagcaaguaggaaaaaaaacccacuguuuuaaaacugaggcuggccuugaacuggcaguguaacaaaguuggcucuaucauaguacuuuguuuuaaucacgcagcucucccaguuccucccugugcucccuguaccucuggcuacuuccuuccugucccucuuacacuuucucagcucaugcauuccauucacauguccucucucuuuccccucucuuauucuaauuucaugauuuacacauguguguugugcacugucauaaacauuuauaauugaaaucugaguugcauauauuagaagacaaaacaugguacuugucuuucugaguuuggcuuauuucauuuaacauuaugaucuucauuuguacccacuuuccagaaaacaacauaauccauucuuuaugccuauuuugugcaguaauaaauacggauaugcaaguauccuguguguugacuuagaaucucuugcauauagaguggucuagcugggucacauguuugauuguagagguuagaaaacuuccagguuugacaaguuggcucagugggugaaggugcuugccaccaagcgugaccaccuguguucaguaccugggccacacagugaggagaggacugauucuagaaauguguccucuguugcuccaugugcauucuguaucauguacucaugcacacgcacauaccgacuuuucuuuaaagaaaaacuucuauuuugauguccauaauaacugcauauuaucauuuguucuugguauuaucuauucuacuguguggaguggacucucugcaauuggaguucuuaaaacaaaauccuugccuauaccuauauccugaaguguuuuacaauuuuuccucagguaacuucagaauuucagcuuuuacauuaaguuauuuguucaacuuaaauuguuauacaggauaaaagauagggaucuaauucaguuuucucuauuugaaaauccacucuucccugcacauuuucuuaaaauguugucuuuuuuucaaauguguguuuuugacacucgucaaaaauuaaguggcuauaccugugucggcuucuuuauggguucuucucuauuucauuagccggccucuguuuuggugccaguauugugcuguuuuuguuguugucuguuuucauuuuuguucuuguuuuuuugauacagggucugccuguguugaccaugcuggccuugugcuuacuagagauccacuuacuucugcugcccaaguucugggaguaaaggcgugggauaccauguucaguaauaccaugcuguuuuaacacuauaguucuguaauguaauuugagaucaaguguugugauaccucucguauucuuucuguugaauauugucuugguuguucaugaucauuuaugauuccauauaauuauugaaauaguuuucuaauucuguaaaaaauuauuggaauuuugauugauauuuauuuaauugaaucuguaguuugccuugaguacuguaguuauuuucacaauauuaauucugccaauccaugagcauaggagaucuuucuaacuaauauucucuucaguuucuuucuacuguaucuuaaaauuuucauuauagagguauuucaucaccuuagcuuauuucuagguacuuuaaguauuauaucacauuguugcaauuugggaugauugagcuucuuucuaucugugucuccuccugcccauuuuucccuugucuuauugcucuagcuaagacuucaagcacugccaagagacaggacagugauccccuugucgcauuccagguuuugaaugaaguguucuucauuuucucccauuuaguauaauaguggccaaaaguuuuguugucuccagcuuguauuaugguaauauguagugcucuaugccuaguuucuuuaggucuuuuuauuaugaaagaauggugaacuguauugaaugccuuuugugcacaaauugagacagucauaugguuuuuguccuuaagguuuuuuauaugcuauauuacacuuacuaauuugcauauccuauaauuguuuauauuauaaauuaaacuucauuauuaaaucuuucaacccuuuaagucugcuuuugacuuuugaacuucuauuuagagcaguuuuuccuuuguguuuaauuucagaaaguauaaaggauggagaucagcagacugugaacaagcaguaugaaagagagaagcagcgacuugcuaccgggauagaagaacugcgugcuaagcugacacagauagaagcugagaacucugacuugaagguuaacauggcacacagaacuagucaguuucagcuaauucaagaggaacuacuagagaaagcuucaaaugcuagcaaacuagaaaaugaaguaaguuuggauuuaccuggguauaagugcuuauugcuaugggguuuuguuacuauugaaaucuagauuuauacggcuuuggaaaaugguaccauauaaguuuuaauucuuuuaaaaucauauuggaaauguauguuugauuuauauugaaaguaggaaaauacuaccucauagcuaaaaguucucaaauuugauggaacaaaauacaaguuaauauaauaauaauaauaauaauaauaauaauaauaauauaauaauucaugguuguaggucuuagauugugauuggaagaguuuuaauagaggauuucaaauuuuaccuaacaucagagccuccucagaaauauguuaaucucuagauuucugagauucuagcaguuuuucuucaguugguauaacucaugaauucucauuuuaaaacauuacaugugaauuugauagugugguuauaaucugaaaagauaacaaugcauguuuucauugucucaucauuuacuuuuuaaaaaaguuauauauuuaucuuauuaauuucuauauggcauauuucuucugccuguacaacuucuaaaauuuuuuuagugcaaaucuacuaguaauuaaguucuuacaguuuuucucugagaaaacuuucuucucauauugugaauguuuuuuauucauagauuagagacuuuuuccuaagccccuuaaaauaaaucuuuuuaaauuggaauuuuuuuuuacaauauauucugauuauacuuuuccuuuccccuaauuccucccagaucuuuuccaccuuccaaucauccaaacuuuauucuauuucuuuaucucucucuuuauaaagaaaaggaacaggcaagcaaaagaauaacagggcuuugccaucaguuuauggugagaaaccaguagccuugguguagccugagauguuugguaauugaauucaggcuuucugcaagagcagugaauauucucaaccacugaaccaaaucuccagcuuugacuuuauauuuucaggcuuauaaccaacucuaaaugaaaacacuuuuuacauagaaacacuuuuuacauagagauuuaguuaacuuauaauacuugugaaacuuagaaagugcugauuuauaauaacuuuuaaaacauuauaaauauaucauagaaaagcaaaacaugucuuuuugaacguauuaaaaacugugaaaaaagaaauaaagacuauugauaauuccaccaccagaaauaacugcuauuaacauuuuauuaaguaaauucaaucuguaccuacuuuaaaaaaguggaucauguuguauauacuuuaugacccaaauugcuuuccuauuauauaaguagaagaagugagacacuaucucuacuuuauuuuuuaguauuuguuguuguuuuuuuuuucuaaauucucuccuaauuuaggucuuuuuuuuuuuuuuuuuuuuuuuuuuuuuuuuuuuuugucuauauuuggaauugaacagagagcuuagcucauguuagggaggcacucuacuggugaguugcaucaccagccuaguuuuguuuuguuuuguuuucuuuucuucuucuucuucuucuucuuuuuuuuuuguuuuuuuuuuuuguuuuuugagacaggguuuauuuguguagcccuggcuguccugaaacucacucuguagaucagguuggccuugaacucagaaauccgccugccucugccucccaugugcuaggauuaaaggcgugcaccaccacugccuggcuaccagccuaguuuucaaguuauauaaacuaacagauuauucacaauauagccuaaguaucuauuacuauaauaauuucccguuuauuaguuauaguguaguuaggguuuggaaugaggagcaauuugauuuuaagaugcaugucaguacuuuuaaaguuguguuuuuguuuuuguuuucagaugacaaagaaguguucucaacuuuuaauucuagagaaacagcuagaagaaaaaauuauugcauauucuucuauugcugcaaaaaaugcagaacuugaacaagaacuuaugguaaaauuuacucuuuuucuuuguuuuuuaaaguuguugugucuauuugauuuaugauauaguuugacucuuaaguuacuuuguuaguuucuaauugauaauacugauuuaaagauaauagugcaauguugcgauuacccaccuuuacucugucaggacuugucuaaccuuuguuccuuuuaguguuugaaauuggauccuuaacauucaguguauguacauuuacaauuguuguaucuucuuuauauauugaggcgcauucauccaugagugcauguauagcaucuagacaucaacauugggugugguucuuuuuuuuaaguuaguuuguuguaagacacgcuuucacuauguagcccuagcuggcccuaaacucacagagauccuccugccucuacucccugagaacuaggauggaaggcauaugccaccaugccagacuaacacugauuaucuuccuguucauguggacaucagaggacaguuuugagaaaacaguuuucucuucucuccauguggaucccagggauuaaauucaagucaucagacuuggugccaagugucuuugcaccugaaccauuuuacuguccugucuuugcuuuguauuuucgaaauauugacuaaaauauguuggagagagucucuucucuggucauuugugcucuugcauuugaguaucuaccuauuuuuaaaaauuuguuaaguuuucugcugcaacuucagagacuagauuguucuugguggcuuaguuuuuacuuuagugacuucuccuagcaguggauucguaggcuugguguccuaauagcacacgaggucucugggacuuguagcugugcugcugcugcuucaucgcuacuagaaugacuuuccaggcugugcuccagcuaacccgacaguggcuaccuaugaauggcagguccaagaaucagguuaguugcuagauucauguauuuuuaucucaaccucuguuuuacuuauauuauuccuacuauuuuuauuucuaggagaaaaaugaaaaaauaagaagccuagaaucaaauaucaacacagaacaugagaaaauuuguuuugcuuuugaaaaagcaaagaaaauucaucuugaacagcauaaggaaauggaaaaacagauugagcaaguaauguauucuuuaauauauucuaaccuaaaauucuucauguuucaaagaagaaacaaaggcuucaaaauuaauaaugagaccugaaacaagaaucucacucuuucugaauaauuaucuaauguuuguuuucuuuucuucucccuuuuuuuuucuuuucuuuuugguaguuguguuuggugguugugugugugugaggggugggguggagggcagggggcgggugucacuaugaauuucucacuguccuguacuuaacucauuauguagacaggguuugccaugaacucgcagagauucaucuucucaugccucccaaguccugggaucaaauacuguggcacuucaugaggcuccaacauuuuguuuucuuuauuuuuuuuuuauuucuguugauggaacccaggacauugacauuguccauacuaaccagguacucgcccagugagauggcucagcagacauuaggugccugcuucaaacucugaugacuggaguuuaaauugcaucaccuacauaguggaaggagaaacugauucuugaaaguuguccuucaacuugcaugcacuuaaacacaaaauaaaauaaaauguaauacucuuauuuuuuaaagaauauguaaauaaagaaaauuucuaaaaguguucagcaaaauuuauaaauugguaaucaguuugaccuagagguuuaaaagaauuagaaauaagagagggaagagguauaucauuauagaucauaaaauacaaacugauuuaaaaaaaauccaaagaauucaacucaggcugaagcaguucuuauuauguaggggcagguggaucucugugaguucaaguccacuguagucuauauggcaagugucagaccagccaggaauacacaaugagaucuggcuuuucaaaacaaaauaaaauaagcauaguuucauauuuuuuccaaaagaaauuuuaguucuaugugguuugacugguaaauucuucuaaacacuggagcaagaaauaacugauauucugucgucgaccaggagaugaugaaccaccuugaguacaaaacugacagaaagauaauaaaaugucacuguguucuuuuuagaaugugagguagggaguuguugguguucagggaaucgccacucaaaccauacguaccauaucaguuaagcaagaauagauuauugaacguacaccuuaauacuggacauccaggacugcagaaaggucuugggagucuaauugcaguccuauucugcucucagaguagacucuguaggaaaaaccagguucagaaguguaaagggcucaccaggcaaaguaugaucagcuaaccuguacgcugguugguccugaggaagauaagaggguaguggaugaguugugaacaggggaauuuaagaacacugagaaaauggagcauaagcauuauaaucauaauuuuuuggcuuauuaguagcauucuucacuguuagcuacaaaagccacagugagcucacacauagcugcaggaauggcugcccagugguuagcucugacucaagauauuuuagacauaauagcucauauuuaccuuugguuugauggguccuauguaaagcuuugugaaaauuuuaagauuagcaaaccucauacaaaacauucagaacauacagaacaaaacaggauauguggucagcagguccuugagccaagucacuucucuguaucaaagacuggcaggcguguuacaacaagaauaugaaauagcuggcaggcaugcaacaaaauagcuacagcuauucugaggacgucacagcauaacaggagugagagggaagauugaccauagagaauacugacaagaaugcaaaacaaguguaaucuucuuuuguuguuaguauuagugcaaagugguacugcuuuagaaaacaauuugacauuuucuagguaaaaaauguuucauauauuucuguauaauccuaguuauuugucuugggauauuggaaacuuauauuuacaguaaaggcaauuguuuuuuauuuuauuuuuuugaggcagagucccuuguagcccaagcuggccuuguaugugcugugaagcuuaaacuaggaauuagagagcagcucagugagucccagggucugaugucagaggccagcacagaguuaacugugguugaaggagcuguccuagaaccugacugacugugugugguauuucauguguuuauaugucucacugugaaaggccagcacaguguuaauugaagacacaagagcuuuuguauaaccuauguugacuguuucaugaguuuauguauaugaaaauucgaaagcuuaggggcuacagggauaucaugagaacuaaauuugaucccaagcaccuauguaaaaugccaggugaagugguucauguuuuuaagcacuggggagguggagaaaggaggaucucucggcuuugauaacaaggcaaucgagcaggaucugugaguuacagguucagugauagacccagucuuaaaaaauaaggcagaguaugguaaaggaaguuaaccaauaucagcccuugaccuguaaaugcacauggacacacaugugaacauauauacacacacauuuuaaaaaccccuaaaauuagaaaaaggaaaaaugauuacuguauauaauuuuuuaaagucuaggggcuaaagaggugacucaguaguuaagguuacuugcugcucuuuaagaguaccuagggucuggagagauggcucagugguuaagagcacuggcuacauuucuagagguccugaguucaguucccagcaaccacaugguggcucacaaucauauguaaugggaucugaugcccucuccuggugugucugaagauagcgacagcauacucaaauacauaaaguaaauaauucuuaaaaaaaaauaaaagagugaguaccuagauucacuucccacugaccauaucuuguccauaugcaaccucuuguaacucuaauuccauagaucugauacuccauucuacccucugcaggcaguuacacaugaugaacaaacauacacucaagcgcacaaacauacacagaaauuaaaccuuaaaaaaauaucugucauuuagccuggguaugguggcacauaccuuuaaacauaguacucagugggcagaagcagguugauuccuaugaggcuauagcaggguucuaggccagccagagcuauauauugagacccugccaauaaacaaacaaguaagcaagcaagcaagcaaauggguagaugaugaucuagaauuguuaaaaucuuauuuuaugucuucuaaacuguuuuuccuuccauguucguaaacuugccugaauauaauacaaucaucccaucaucccuuuauuuccuuaggaaauucaacccaccaaugccuaacccugagaaugcucaaauucuucauauaaaauaagacaaauuuguguauaacuucucucuauauucuuuaaauaucuguggaguacuuuaugauagauaauucgauggaaauacuauauaaauaguuacuaugcuucauugcuuaggaaauaaucacaauaguacagauaaauguuuucauuguguaguguuugcauauauggaugcagauccuuugauauggagaaccaaauauauauguauaauagggaauaacuagauaacagauguauacacacacuuaaggcaaacaauuuuuaaagcaacugcauuuuacuaaaugguuuguguuugaauuauucauguucagaaucauaacuuuuuugguaaacuuuauuuauaauuuuuuuccaccuuaggauacuauuucauuuugauuucauuacuauuaaaauguaauauuuuggggacaggagagaugguuuaggauuaaagugcauguugcaccaacaugcagaucugcguuugagucuccauuacccacacagaaaggcaagcaucagugcuagcaggcauuccugggauuuaguagcuacccagccuaguguguccuucagccgggcucaacuuucucaaaaagaaaacugguagaaaauagagggaagaucacugauccauacauguguauacacacacacacacacacacacacacacacacacacacacacacacacucaccuguacaugcaugggcacacacaauuuuauauauauauauaaaguuugcuuuuaccaguuauugguuaaauuguggagaauaagaauuuuuacuuuggacuggagagauggcucagcguuuaagagugcuggcuacucuuccagaguucaauucccagcgaauacaugguggcucauaaccaucuauaaugagaucugaucccuucuucugggcugaaggcacacaugcaggcagaauauugcauaaauaauaaauacauuuuuuaaaaagagaauuuuuacuucucaugaaaguguaaauuuuaacuuaauauaguggugcacacuugagaugcuaagagagaaggauuguaauaagcucucgaucagucugguuuacuuagagaguucaggcuaaccuaaagucucaauacaugcacauuauuagauuucugauaaaagcagaauuaacccacuuuaaauuuuuuacagauuuauauauauuuaucuuacauuguauguguuuugccugcuuucuaugaaugcaccauguauaugccuggugcccacaguugagacugggguuucagauccccugaaaugggaguugcagaugauucugagccacaaaccuggagcaauaagugcuccgaaucacuuggccaucuuuccaguuggaauguugagacaaguuugcuaucagucuaagcauagccuuugcugcauagucaggcccagucucaaaagcuaaaacagaucaagggugaagggagagagaaaaauuuugauguucuuuuaagagaauaccuacuaaaaugaaaauaagccuagccuacaucaagaagucaauuucuaggugacuuguucuagguaaacucuuauaugugugcauaagcagacuuguauaaaggaugcuauuccaacauuguugcagugauuaaagcaagaggucaaagaguauaguacuuccuaaguaaaugaacuggacucacauaugucagcacagauaaacauuugagacuguaguaaaauaaaaagcaaguugucaaaacauaaagauauuggaaugaucuuuaaauuucaagacagaaaauuguauuccauauuguuuaugaugauacauguuuaaugaaaguauaaaaauaggccagucaauggaagaaagcagaaagagaucggcauauaauuuaauuuuuuaaauuagaaaaacuuaagaaaauuucuaaaaugcgaaaauuuacauucuuucaaauauauuuauguuuaaaguguucucagugcuuuuaaaauguaauaugaaaacccuguuuuuauauuuagcucgaaacucaacuggagaaaagagaccaacaguuuaaagaacaagaaaagacuauguccauuuugcagcaagauauacuguguaaacagcaucaccuugaaucacuagauagacucuugacagaaaguaaagugguaagagcuuacaucuuaaguuuauguuucugugacauaaaucuaauauauucucaauauuuauuuguaauccuaacauauuuuuuuuuuuguuugguuuuuuuuguuuuucgagacaggguuucucuguauagcccuggcuguccugaaacucacuuuguagaccaggcuggccucgaacucagaaauccgccugccucugccucccaagugcugggauuaaaggcgugcgccaccaccgcccggcccuaacauauuuucuuaccaaaauuuauuuacaggaaauggaaaaagaaaauaugaagaaagaugaagcuuuaaaagcauugcagauucauguaucugaagaaacaaucaaggcuaguauaauuauauacuuuuugugguuuuguaugugcaugugugugugagugcacguguguguguuugugccugugugcgugcauguguauguauacacaugccauggcaugagugugaagucaagagucaguucucuccuucuauuaccugggucucaaggauagaguuuagguaaucagguuuggaagcaagaaucuuuaccugcugagccaucuuauuaacccucuauuuugcuauuauggacauuuuuaugccuuuccuucugauaaauuauuaaaaauauaauguauacuggaggcuuuuccccacuuucuccucuauaaguuucacugucucugguuuuauguggaguuccuugauccacuuagauuugaccuuaguacaaggagauaggaauggaucaauuugcauucuucuacaugauaaccgccaguugugccagcaccauuuguugaaaaugcugucuuuuuuccacuagaugguuuuugcucccuugucaaagaucaagugaccauagguguguggguucauuucugggucuucaauucuauuccauuggucuacuugucugucgcuauaccaguaccaugcaguuuuuaucacaauugcucuguaguacagcuuuaggucaggcauggugauucuaccagagguuccuuuauccuugagaagaguuuuugcuauccuagguuuuuuguuauuccagaugaaucugcagauugcucuuucuaauucguugaagaauugaguuggaauuuuaauggggauugcauugaaucuguagauugcuuuuggcaagauagccauuuuuacuauauugauccugccaauccaugagcaugggagaucuuucuaucuucugagaucgucuuugauuucuuucuucagcgacuugaaguucuuauuauacagaucuuucacuuccuuaguuagagucaugccaagguauuuuauauuauuugugacuauugagaaggguguuguuucccuaauuucuuucucagccuguuuauccauuguguagagaaaggccauugacuuguuugaguuaauuuuauauccagcuauuucacugaagcuguuuaucagguuuaggaguucucugguggaauuuuuaggaucacuuauauauacuaucauaucaucugcaaaaagugauauuuugaauucuuccuuuccaauuuguauccccucgauuuccuuuuguugucuaauugcuuuugcuaggacaauguugacuagguagggagaaagugggcagccuugucuagucccugauuuuaguuccugaauagaacagcaauggcuugugcuguaagaucgagaaucgacaaaugggaccucauaaaauugcaaagcuucuguaaugcaaaagacacugucaauaagacaaaaaggccaccaacagauugggaaaggaucuuuaccuauccuaaaucagauaggggacuaauauccaauauauauauauaaagaacucaagaagguggauuccagaaaaucaaauaaccccauuaaaaaaugggacucuggcuggagagauggcucagcaguuaagagcacugacugcucuuccgaagguccugaguucaauucccaguaaccacauaguggcucacaaccauccguaacgagaucuggcgcccucuucuggagugucugaaggcagcuacaguauacuuacauauaauaaauaaauaaaauaaaaucuuuaaaaaaaaaugggucucagagcuaaacaaagaauucucaucugaggaauaccaaauggcugagaagcaccugaaaaaauguucagcauccuuaaucaucagggaaaugcaaaucaaaacaacccugagauucuacuucauaccagucagaauggcuaaaauaaaaaauucaggugacagcagaugcugguaaggauguggggaaagaggaacacucuuccauuguuggugggacugcaagcuuguacaaccacucuggaaaucagucuggcgguuacucagaaaauuggacauaguacuaccggaggaucccacaauaccucuccugggcauauauccaaaagauguuccaaccgguaagaaggacacaugcuccacuauguucauagcagccuuauuuauaauagccagaaguuggaauagaacacagaugccccucaacagaggaauggauacagaaaaugugguacauuuacacaauggagcuauuaaaaagcuauuaaaaagaaugaaucuaugaaauuccuagccaaauggauggaccuugagggcaucauccugagugagguaacccaaucacaaaagaacucacaugguauguacucacugauaaguggauauuagcccagaaacguagaauacccaagauauaagauacaauuuguaaaacacauaaaacucaagaaaaacaaagaccaaaguguggacacuuugccccuucuuagaauugggaacaaaacacccauggaaggaguuacagagacaaaguuuguagcugagaugaaaggauggacuagagacugccauaccuggggauccaucccauaaucagccucuauuugcuaacaccauugcauacacuagcaagauuuugcugaaaggacccugauauagcugucucuugugaggcuauucuugggccuagcaaacacagaaguggaugcucacagucagcuauuggauggaucacagggcccccaauggaggagcuagagaaaguacccaaggagcuaaagggaucugcaacccuauagguagaacaacaauaugaacuaaccaguaccccccggagcucgugucucuagcugcauauguaucagaagauggccuagucggccaucaguggaaagagaggcccauuggucuugcaaacuuuauaugccuaaguacaggggaaugccagggcaaagaagugggggggggggggggagaagagugggaggggggaagggggacuuuugggauagcauuggaaauguaaaugaagaaaauaccuaauuaaaagaaaaauauauauaauguauaaaagucaauuaaagugucgggaaaauggcuuagagguuaagagaguguacuguucuugaauaggaccugaguuuaguuccagcagccuguggggcagugacaauugccuguagcucuagcuucaguggaucccaccccuuuuuggucucagaguacacacaaagguauuuuuaaauauuauauuuuuuucuauaguugcaacucauuaguguuaccaaugagaaauaacaaaggaggagggcucauguguacacacaucuucccccacagacacaaacauaauuuaagcaaccuuaaaaacaaaguaguaguaguuuuaucucaaacuauaacggcuguagccacagagugugauaagugcuuaauuaacauggaaaaggcacuaaauuugccuguaugugucugucuguguaugaaaaaacaguauauuuaggauucaauccuauaaucuugaaauguuuccuuugugaauaacgaagaauuacuauauauucuuuauuuuuuauuaaaguuaauaggucuaaauaugcugccaucuuauaccucacuauaaaagauaccuacuuucugccugguacgcuguuuguaaccuguuuugugauuguguauacccauguaaacaguuauggggaaaagagacagagacagagacagacagagacacuuagaaguugaaaucaggucuuuuccucagucuuauuuuuugagauaggcuaucuuaccaaacuuggagcuugccacuugagcuauuuugccugacaugugagcuucaguaaaugugccugucucugccuuccugauauuagaauuauauacccaugcaugcugacacagcuaacuucuuauguagugcuagaaucugaccugugaccccagugcuugcuguguaggagcucuacugaaggagcugucucuccaacccaaaaguuauaccuuuauuuauuguuacggaucugggcucacucagauucacuaugaccauaaauuaauuucagcaagaagaagcuuuuucuuuuauauacuggcauccacuguggggccagaaccgcaccugagagcacuuccaggauguagcaccuagccauaucagcucgagguuuauaaaagcaaaaaccacagauugcauguauucugucuauguguaggcagggucuaauuuucacauguauaucuugcaguugccauagucaucuuuuugagcagagucagcaagagucagcuuuugauuacaaaaguugaaacagcaguuagaguuuuugaccuacuacucacuaucuugguagaacagcaaauuuuauaagaccaguuaauuuaaaaauaguuuucaauguuuggggaaaaagagaaaugggcuguuagggcacagccuauucaaguuaaggguuuacauguuagagacauuuuuugcuuuucggucucucaaacauaguaagucuaaacuuuuuuuuuuuaaagguaucuaccucaccagcuuuuuuuaaagauauauuuuuauuuauuuuauguauaugaguacauuguagcugucuucagacacaccagaagagggcaucacaucccauuacagaugguugugagccaccaugugguugcugggaauugaacucaggaccucugggagagcaguuagcacucuuacccgcugagccaucucuccaguccauaagucuaacuuuaaauguaauauuaaccaccacacuguaguuauuccuauagcauucagcaauucuuuaacguuuacugucaugccaguucauuacaauauauuauauucagugcaauaguaaacuuaauuuaaaaaauuaguaugcaggucaagcauaguagcccugccuuuaauccuagcacuugggagaagagucuagaggauuuccaaaaaaaaucaggcuaaccuggucuauauuguggguucuaggccagcuaaggcuccagaguaguaccuuguuucaaaaaucuagggggaaaaagguaaauaacuuuguaaaguuguaggcaugaaacuauuucauuaaauaauauucuaaagugguuaaccuccugguucuuaugaaaucaccuaauacaucuaagcaguguuucauauguuaauggccagauaagagaugugaacucaaaaugaacgagucauacauugacuguuucccccuuggcgccuuuuaaaaaccuuauugguucuuugugaauuucaucucaugcguuccaaucccacucuucuucccccccuuguaccuguccuccacccuugcagccuuccccucaagagaggaaaaaauucacuguggaagcuguaguguguuauauaguauauccuuuuggccauacaguguacuuauguauaauaauaaaccuaaaagaaaaagaaaaaauaaucuuaugacuugaugggauagaugggugugguuauguauguaugcauaaaccaaagaccuuguugucuuguugucuuccccccacccccaccccccagaguuucgcuguguagcuuugacuguccuggaacuaacucuguagacccagcuggccuugaacucacagagaucuaccugcuucugccuccaacgugcugggauuaaagaugugugcugccacugcccaguuugaauuaguuuuuuaaaagguuuuuuguuuuguuuuuguuuuuguuuuuguuuuuugguuuuuugagacaggguuucuuuguguagcccuggcuguccucaaacucagaaauccgccugccucugccucccaagugcugggauuaaagaugugugccaccacugcccaguuugaguuaguauuuuuuaaaaguuauuaaauuugauuugcuccuuuauauuuagauagcacaaagcauuuauuuauaaacacuugagucaaguuuugcuaucuuuaggaaaaauaauuucacagauacuaagcaaagaauuugcuuuuuuuucuccaaaaaauuuuaugucuucuuaauaaaccagaauuuccaaaugguaucaucuuagcaacauucauaggauauuuguacuaacuuaagaaauaagcaauauguuuaccuuuuuaagggagugcuuuugggugucugcuugcuauucuuucaaauaaccauucuacagauuugaaccccucugucaucucauagugccucuuccugaacuuacuuuguucaggaaucuauuaugugauuccucuuugguucccuaguuugcugugaagaaugaauuuuuacagugaaucuuuuucugucauacuauuuuauauacuaaauaaaacuauuuuagagguguaaauauuaccuaaauuuuuugaucacuuugauguguguugagauugcuuacaacacugcacuuaaguguguguugcaguauaugguuaguagaggucagaauaacuuuccugaguugauugucuccacugaacaaagauuucucacccgaggaauaccgaauggcagagaagcaccugaaaaaauguucaacaucuuuaaucaucagggaaaugcaaaucaaaacaacccugagauuccaccucacaccagucagaauggcuaagaugaaaaauucaggugacagcagaugcuggcgaggauguggggaaagaggaacacuccuccauuguuggugggauugcaagcuuguacaaccacucuggaaaucagucuggcgguuccucagaaaauuggacauaguacuaccggaagauccagcaauaccucuucugggcauauauccagaagaugccccaaccgauaagaaggacacaugcuccacuauguucauagcagccuuauuuauaauagccagaagcuggaaagaacccagaugccccucaacagaggaauggauacaaaaaaugugguacguuuacacaauggaguacuacucagcuauuaaaaagaaugaauuuaugaaauuccuaggcaaauggauggaccuggagggcaucauccugagugagguaacccaaucacaaaggaacucucacaauauguacucacugauaaguggauauuagcccagaaacuuaggauacccaagauauaagauauaauuugcuaaaaacauuaaacccaagagaacgaagaccaaaguguggacacuuugccccuucuuagaauugggaacaaaacacccauggaaggaguuacagagacaaaauuuggaagugugacgaaaggauggaccaucuagugauugccauauccagagauccaucccaugaucagcuuccaaacgcugacaccauugcauacacuagcaagauuuugcugaaaggacccugauauagcugucucuugugagacuaugccagggccuagcaaacacagaaguggaugcucacagucagcuauugaauggaccacagggcccccaauggaggaacuagagaaagcacccaaggaacuaaagggaacugcaacccuauagguggaacaacaauaugaacuaagcaguaccccggagcucuugucucuagcugcauauguaucaaaagauggccuagucggccaucacugcaaagagaggcccauuggacuugcaaacuuuauaugccccaguacaggggaaugccagggccaaaaagggggaguggggggguauggggacuuuugguauagcauuggaaauguaaaugagcuaaauaccuaauaaaaaaugggaaaaaaacuauuuuagagguguaaauauuaccuaaauuuuuugaucacuuugauguguguugagauugcuuacaacacugcacguaaguguguguugcaguauaugguugguagaggucagaauaacuuuccugaguugauugucuccacugguucaggaaucaaacucaggaccccaggcuuguguagcaaguguuuuguuuuugaggaagacuuucuacauagcccuggauuuccugcaucucacuauuagaccagccuggccuagaacucagagauuugccuuccucugccuccuaagagccgggguaaaggcaugugccuccauacccagccuugguuuuucuuguuguuggauguuauauuuuugcuuguucuuaccuuaggucagacaacuggauucagcguuagaaaucuguaaggaagagcuugcuuugcauuugaaucaauuggaaagaaauaaggaaaaauuugaaagacagcugaagaagaaaucugaagagguaaguugcuuuuuuauuuagaaaauuuacaaguuauuuuuccccccuucuuuuuaaaugucugcauuuuuucucugcauguacaccugcacaccagaagagggcauuaaaucccuuucuagauggucaugagccaccaggugguuguugggaacucaacucaugaccuuuggaagagcagccaaugcucuuaacugcugagccaucucaccagccccaaauuugcacuuauuauuuuguuuuauuuuuaaauagucuuuucaauauacuuaauuuuuuuuuaacugaagacagugguuguaucuuuuuuuuuuaaagguuuauuuauuuauuauauguaaguauacuguagcugucuucagacacuccagaagagggcgucagaucuuguuacagaugguugugagccaccaugugguugcugggauuugaacuccggaccuucggaagagcagucgggugcucuuacccacugagccaucucaccagcccaauauacuuaauuuuguuuggcguuuuuaaagacaagauuggucuaggguauccgucgguaacuucagacuugcuauauaagugaugguauagaacuuaagagcuuccugcuacugcuugucgagugcugagauuacagacguguauagccaugccuggcuuuugugcugcuggggacggcacccauggcaugcuagguaccccuucucuguuacugugguaagacaccaugacuaaggcaacauagagaagaaagaauuuauuuggggcuuccccuucagaagguuagaaucuaugaccagcauggcagggagcauggcaacaggcaggcacuggagcgguagcugagaguuuauauguugagacacagccaugaggcagagaguuaacuacaaauggaugagucuuuugcaaccucaaacccuaaccccagugacacccaucuucuaacaaggucacacucccuacucuuucccaaacagucucacccaccaaguauccagugauauaugccuacgggagccauucucuuucagaccaccauacuaggcagaaucuuucaacaacugaguuacaacuucaucuccuuaauaugcuuaaaacguacaucuuuauauauaauauaugugacauuaaaaacaaguucuaaauuauauauucuuuaaagaacagacuauuucauuacagcauaaaauauaauaucuuaaaauucaaauugauuuaguuuuuagaaucagaguaauaaguuauaagcauuacagaaugauuuuaauacaaaauaaauaauaucuaaagcauuguuuuagauuuaggaguauaaaauucuuccaaaauuuaauuuuuuuguuuuuuuauuuucuuuuguuuucuuuuguuuuguuuuauuuuuuuguuuuguuuuguuuuguuuuguuuuguuuuucaagacaguguuucucuguguagcccugacuguccugaacucacucuguagaccaggcuggccucaaacucagagaucugcuucccuccuaagugcugggauuaaagauguguaccaucacugcuuagcaaaaauuaaaauuucugcuuuuguuucuuguuguuuaaugacuaagacucagguuuuagaagcugaacuuggugccgcauacuuauaaucccaguacuuggaugacugaugcaggagaaucaugaguuuuaagcugacccugaacuaccuagguuuuuuuuuuuuuuuuaaguuauuugcuuuauuuacguuucaaauguuauacccuuuccuaguuuccccucugaaaauccccuauccccucccugaacuaccuaguuuuaagcuaucuaugguuauguagugagauacuauuauuuuuuuaaaucagguuuagcaacuaaacuuuauugagauaaaauuugcaguuacuagauuaaagacccuuuuugacaugcugaggaaauggcucagcagguaaagccaguuuugccagccccaugaugaucugcacucuauccacgugguaggaaagaggagugccucccagguuguccacugucaagucuaauucuguccucugcuucuucucauguauuuuguuuucugagacagagaaggcuuugauauaguucuagcuagucucuaauucauaauacuccugccucagccucccaaggguuggaguuuuagguguguacuaccauaccuaccuuaaagauaucuuuuaaagaaauuuuggagaccaauguacugaaagcuuaaauauuuaaagugaaucauuaaaauuuuauaguugauauuguuaugccuuuauguguuagaaugugaauauucugcauuuauuugcuauaauauuauauaaacuauuauauuaacaguauuuaguauuauaaauaucaccugauuuuauuauguagugauuuugguuuuauaucuguaaaggggaaaggucaucaaaugaaguguagauuaacccaggguucccuuuguccuucccguucugagauggguuguagaaagcauucuuccuauagcauuaaaaugugacaugauguguauacucuuccuacaaggucacauaagaacaguuuaccagcccauaguaugaaaaugucuuuccuucucaguauccuagcuguccaaaacaguguaucacauaggaacauuucagaaacauaccaaacaagagccaacccuauaagcaugucuacuucaucuccccugucagaauuaugaacccugcccuucuccguccaugaccaacuaugcugcugugugaaaagugggacaauuaaggaagacaccuuuuauguuuguuguuuuucauuugaaacauuucauuguaaaaagaaauguguaucuuugcuagguauauuguuugcagaaagagcuaaagauaaagacucauaaucuugaagagacgagugaacaaaaugccauccuacagcacacucuucagcagcagcagcagauguuacagcaagagaccaugagaaauggagagcuagaagauacucagaguaaacuugaaaaacagguauauauuauuaauuaaaaauaguuugauuuucuuaugaaauaaaauuuaaaaaucauuugcagauguuugauuaguaaacauaauuucuuauguaaucagaccuagaccacuuacuaccaaggucagauuucuuaugcuacaaaauuuuauuauaauuuaaauuucuugacugaauuuuuuucuugaaucuaaaguuaauaacuaucugaauuauuaugucuucugaagucuccuuuuugaaugacacauguaguaugaaaaaaaaaacccuuuuccccaaaaaaauaacugcuauuggguuacacaaauaaguuuugaucucgggauuauagccagugguacaguuccuuucuaguacacauaaggcuuuggguucaauuuuuaagaccacaaccaagauuuguuuaaauuaaauaaugauguuaccauuucacugaaagaauucuagacaauuugauacuagagaguaaucuuuucucucugucuuuuuuuuuuuuuaaaugguuuuccaagacaggguuucucuguguagcccuggcuguccuggaacucacuuuguagaccaggcuggccucgaagucagaaauccgccugccucugccucccgagugcugggauuaaaggcaugugccaccacgcccagcaucuuuuuucuuuaauucguuauuaacuuugucucaaucucuuucauaaauauuccauuuuuucucuuucauaagaaauaaaauauauaaaaaauauagauuuucugauuucuuuuuaguacaucauaauuuuuuagucauauauaugauuaaauauauauuauuagcaaauaauauauuggcagaauauauuggcaauacauauauauucugaauucauccucagccacccucucccuuuuuugacaugagaagaaaaaaaacauuuucaaguugggauaauaaagaagaggaaauaggguggagagacggcucagcaguuaacagcacuggcugcucuuccagaggaccuagguugaauucccagcacucacauggcaccucacaacugucuauaacucaagcuucagggguucugacaacuucacacagacacacauggaggcaaaauaccaaugcacauaaaaauuauuaaauaauuauuaaaaaacagugaaaagugaaauguuuaauguuuuguguauuucuuuccccuccucuguguuuacauuccuucccuuuucuuacuugugcuaaggaaugaauucagaccucucgugugcagcgggcacagcauacacggucucaccuggacuuguucaguucuucuaacucacuuuccugguacagaugugcagcuacuuuaacuuaucuuaaaaguuaguuuuguucuuauuguuucaaagcagccucauuuauauuuuaauuuuauuauuaaauuuuugagauggagucuuuuuauauuuuugagauuggccuugagcucugggacucaggcccucuucuagccucagccuucccauuguuugagcuaucguuacauuucaccauaccaaagcuuaccuugauuuuuagaauacaucuaaaacuaaaugauagguuagacuacauauaaaguauguuuuuucuggauaguguuggcuuguaauuaaauuuaaacacuuaacugaaaaaugcuuaacagguaucaaagcaagaacaagagcuucagaaacaaagggaaaguucaacagaaaaguugagaaaaauggaagagaaauaugaaacagccauacgugaaguggauuugaaaaggcaaaaaauuaucgagcuaacugguacugccagguaaaacuugaauauaguaguuauuagcccuuucaaugauguauugguaaguuugaguuucagauuuaauaauaugcagugagauuuuuuucugaggaauuaaauucuucauagccuaaguuccuguagcauuuucuuauaucucccucauagccuuccuuuuuucuuucuuuuuaucauacuacaaauuuugcuuucuuuucuuaaaauaaggacccuauuuagcuuauuuuaggguuccccacaacauuuaguaugucuuauaguuuacaggcacucaguaacugccguauuagauuauaaauaacacugaaaguugcuaacaggcaaagcucuccucacacuguggaaucucucagaggaccuaauuggguauuuucuuguuguggugguggugguuauuguuuuguuucauuugguuucucaagacaggguuuuucuguguagcucuagcuguccucuaacucacucugaggaccaggcugaccuugaacucagagauccgcuugccuuugccucccaagugcugggaucaaagauaugugccaucaccacccagucaggggacuuaauuguauguaggauaaauaaugucucagccuugacuagacauucaaaauuaucucaguaaagugacauaauucuacccccauuuauaccaguagccaucaaaugugaacuuacaugcaggaacuaaaaccuuauguccccagauuuccuuugucauugacgggauuaaguaugaagauagggccccugggcuuagaguaguacuugcuugaccagauacaggcuucuuaacagugccagugacuuauuguuccuucaagauuucuuuccuauugacagguaucuagccacuaauacagcauuuccacuggugacaguugugaggccaugaagacugcucacacuguagcacuagcgcuauccuugaaauacaaggauacaagaaaugcugcauuuccaaucccaggcccauugcucuuuucuccuuucccagccaacuucugaaaacuccuguuguaccuuuuggagcucauacacaucugcuauauucucugccuuuucuuuucucuuacuauaauaaaccucugacauuacccugaggacauuauuaguucucuugcaggcuucuaaacuaaagaaaccuuuucccauguucuuauaccagagagucaaaguuguacucuagcuaaugucaucagauaauguccaucugacuuacuguucuuuccaauaucagcucugguucaucaguguucauuuaacugauucauguuuugacuugaguuuucuuuuuucuuuuuuuguauuuuguuuuuuguuugcuuuuguuuuuguuuuugagauaggguuucuuugugucgcccugucuguccuggaacucacucuguagaccaagcuggccucgaaccugccuccugagugcugggauuaaaggcaugcgccaccaccgcccgacuggaguuuucuuuuuuuaaagauuucuucucugauuauuauauuuccaucauacuucagacauccccguaguuuacccuagagcucacuguuucuaauauuuacuauuauuucuaauauauuacuacucugauacccuuuuugcuuccuuuccucugauuuguuuuugagacagggccuuaguguguaguuugggcuacuucaaacuuacaaacuuugcuccucaucucucuccucucugcuugaacugagauuguagcuauuucuuuucuuuacugaccuaaaaaucaaguuagucacuaacaucacucuguuagccuucucuuuggcuuaugcugaccaaucuaagaauuucuaaucaguuuuaaaacuaaaagucuuuuaauagacauuuugauaauaagucuuuaauauagucuuuaugauaauuucuuuagccucuucauuaauguuucaaauaauggaacugucacgugcuuauccuugcauguucucagucucuacaaaauuuuauaaaguuagguauaguuagacugaaaaaauuuaaaguauaauaggugacuuaaaaaucugaguggagauuuugcuaauacuuauccuuauagaauuuacauacuuaaaguaagagacaagucuuuugauuuaaaguugccaaauuacauguucuauuguuugguuuuuuaauuaggcaagccaaacuugagauggaucaguacaaagaggagcugucuaaaauggaaaaagaaauaauucauuugaagcgagauggggaaaauaaauccaugcagcuuucucaguuagauaugguuuuagaucaaacaaaaacagaacuagaaaagacaacaaauucagguaaucaacuaguuagcugaauuuaacuuaaauacaauacccgugugguguguguguguguguguguguguguguguguguguguguguguguguguguguguauggugguuugaauaagaauggccucucuaggccuauacauuugaauccuuugucaucagggaguggcacuacuugugaaggauuaugggcuguggccuuguuggcauagguauggccuuguuuugggaaguaugguacuaggggugggcuuuaaaguuucaaaagcccaagccaggcccgguuuggcuuucuucuccugccauuuuuggaucaggauguaggucucaguugcuacuccauuuucugcuugcaugccaucauagucccuacacagugacaguggacuaaacuuuuaaaaguguaagcaagcccucaauaaaagaaauauuuucuuuuuuuuuucucuaagaaaaauauuucuuuuuguuuuaugugcauuaauguuuugacugaaugcaugucugugugagcgugacaggucaccuggaacuggaguugcagacaguugugagccacaauaugagugcugggaauugaaccucugacagagcagccaguacucucaacugcugagccaucucuccaacccaaauguuucuuuaagaguugccuugcaggguagugguggugcacgccuuuaauccuagcacuugggaggcagaggcaggcagauuuccaaguuuggggccagccuggucuauagagugaauuccaggacagccagggcuacauagagaaauccugucucgaaaaaaaaaaaaaaaaagaagaguugccuuagucuaggugucucuucauaguaauagaacacugacuaagacauauuuaaguggaauaagggacaguguucaguauuuugccucuuuuagauaaauaaaaguagauacccuuauuuauaaaguuaucagauuuuuuuuuuuuuugucuuuuuagagucucaugaauccuaggcuggcaccagaacuauauauguagugaagaacaaugaacucugauccuccugcuucccaccucucuagugcuaagguuaauauacagguaccaacauguccaguuuaucaguacuggagaguaaguccaggcccuugugaauguugggcaaguacucuucaaacugagaguuuuguagauucuagcccacagguggaauauuccugugugucgaugcauauguauguguauguuuuauuuacaugcucaugugauuaugcgcauuuuggucuaugugcauguggaggacagaguuugaaguugaguauauuccuggacugcuguucaucuuauguuuugagacaggguuucugacuaauuggcagggcuaacugggcaaugaacuccagcaaucugucuaucuacaccaguacuuuauaggguuacaaauacagucuuauguauguauguuugguaaguaaacucggguucuuaugauuaaacaacugauuuaauaacugaaacgucuucccugccccuugaauauuauuaauuauacuuacucauaaguucuuaauaaaaaugauuacauauauuuuuuaaugauuuuaucuucuuaauagugaaggaguuagaaagguuacaacaccacacagaaacugaauuaacagaaaccaugcagaaacgggaagcucucgaaaacgaacuacagaaugcucauggagaauugaaaaguaccuuaagacaacuacaggaauugagagauguauuacaaaaggcucaguuaucauuagaggaaaaauacacuacaauaaaggaucucacugcugaacugaggugagucaaauaauaagaaaagauaccaugucgggcagugguggcauacgccuuuaauccuagcucuugggagucagaggcagguggauuucugaguucgaggccagccuggucuacagagugaguuccaggacagccaggguuacauagagaaacccugucuugaaaaaaaaaaaaaaaaaaaaaaaaagaagaagaagaagaagaagaagaagaagaagaagaagaagaagaagaagaagaagaagaagaagaagaagaagaaaagaaaagaagaagaagaaaaaaaaagaagaggagaagaagaagaagaaaagauaccacaauuacacauauuucucugauuauuuuuuccauucaucuuuuuuuauuagauauuuucuucauuuacauuucaauugcuauccccaaagccuccuauacccuuccccugcccugcuccccaucccacccaccucugcuuccuggcccuggcacuccccuguacuggggcauagaaucuucacaagaccaagggccucuucucccauugauggccgacuaggccauucucugcuacauaugcagcuagagacacagcucuggggggguacugguuaguucauauuguuguuccuccuuuaggguugcagaccccuucagcuccuugggugcuuacucuagcuucuccauugggggcccuguguuccauccuauagaugacugugagcauccacuucuguauuugccaggcacuggcauagccucacaggagacagcuauaucaggguccugucagcaaaaucuuucuggcauaugcaauagugucuggauuuggugguaguuguauaugggauggauccccggguggggcagucucuggaugguccuuccuucaaucucagcucugaacuuugucucuguaacugguuccauggauauuuuugcuuuuccuuuuuuuuuuuuuuuuuuugguuuuucgagacaggguuucucuguaucgcauggcuguccuggaacucacucuguagaccaggcuggccucgaacucagaaauccgccugccucugccucccaagugcugggauuaauggcgugugccaccacgcccggcuaguuuucuuucuucuugaguuucauguguuuugcaaauuguaucuuggauauucuuaaguuucugggcucauauccacuuaucagugagugcauaucaugugucuucuuuugugauuguguuaccucacucaggauaauauucuccagauccauccauuugccuaagaauuuuauaaauucauuguuuuuaauugcugaguaguacuccauuguguaaauguaccacauuuucuguauccauuccuuuguugagggacaucuguguucuuuccaacuucuggcuauuauaaauaaggcugauaugaacauaguggagcauguguccuuauuacaaguuggaacaucuucugaauauaugcccaggagagguauagcuggaucuuccaguaguacuauguccaauuuucugaggaaccgccagacugauuuccagagugguuguaccagcuugcaaucccaacaacaauggagaaguguuccucuuucuccacauccucgccagcaucugcugucaccugaguuuuugaucuuagccauucugacuggugugagguggaauuucaggguuauuuugauuugcauuucccugaugauuaaggauguugaacauuuuuuucaggugcuucucagccauucgauauuccucaggugcaaauucuuuguuuagcucuguaccccauuuuuaauagggugauuugauuuucuggaguccaauccuauucuuuuuuuuuauccaguuuauuagcagaucuuuuuuuuuaacuuuuuuuuuauuagcagaucuugucaaccugauuucuaaaauauauuauaaaauucauugacuuuauauuaccacuaugcacagaccauuauuguuucuuucaugguguuuagcuaggccuuccuaauggacuccuuauauguucuuauuuuauuacuaauccauuuuccauagaauuuauguuucugauuauaaacguagauuauauugauuuuuaauggcuuccuaaagcauccccaguaaaaucuucauuccuuuggaaaugaaacaugaagauacaacuucauuacuaaauagauuaguucuugccaaacaaacaaaacaaaacaacaaaaaccccaaaaacaaaaaaacagaaaauaccaaguauugggaaguauguagagaaauaaaauucccauuuauugcuaguagaaaaacaaaguaaugauagccacugugggcaauaauuguaauuucuugauaacuuagacauaaaauuaucauuuaauauaauaccuuucuuagucauauaucuaaaagcauugagaaugguucuuugaacaagaauuauacaccaguguuuauagcaccucucuuuacaauagccaaaaaugugauaauuugucaccauugaugaauggguaaagaaaauaugguguauccaugcaaggaguauuguuuagguagaaaagcaauaaaauagugauaauccaugcuacaaaguagaugaacuguaaaaacauuaugcuaagucagagaaggcaagcacauggggcauaauuuuguuuauaugaacaguuucuugaacugauaagucuaauagcaaagguugguacuugccaggaacuaggggaagggauaacagaaaaauaaucccugaaggauaugggauuuaccuuuguaaaacaguauugggaacagauaauggugaugcuacauaacacuguaaauguaauuaauucaguugaauuauguaccuuaaaauguccaaaaggacaauauuuuauguguuuuuuaaaacuccaggccucuagaauaccaacccuguaugaugagguuucuguuuuccuggccuggccucauuucauacuguucuugcucuguuuuguuuugaggugugugugugugugugugugugugugugugugugugugugugugugugugauguguacguauguauguauuauccuauauagugggagcacauggucuguguggucagacagugaugucggugucuuccucaguuucucuguacuuuauauguuaagauaaaacguccauagcccuaacccugaguaaaccagcuaaauuguuccagggaacccaucucugugugaguuaacuuucguugucaggcauuuucuuuauacaucauuccuuugguuuaaauacuuucaaucggaauuaacuacacacguucuuuugcuuuuaauuaugggaagcaauaacaauaaagaagcuauaguuucauauuaucuacuuugauauuuuucuuuugacaaacuuuagagaauguaagauggagauugaagacaaaaaacaagaacuuauugaaauggaucaggcgcuuaaggagagaaauugggagcuaaagcaaagagcagcucagguuguuuuucccuaauuauauuuguauaaauuuucuacuaugggauaauuaugaaggguuuuaaaaauugccauuuuuuucuggauauaaauauguaagauuagaaauacaacuuuuuuuuauuuuuagacaaauugcuguuugaccaguuuggccaugaguuuauacucuugccucagauuccaaaugaugggacuauagauacuuggcugaaagacuuguuugucuuucuggaaauugcauagggagguaaauucuuuaugauuaaacuacaacucagcucaaccaguaccuuuugagaguaaggguucacuugcaacccuuuauauuauuuauuguauauuaaaagaacaugggauggaacacauuauugugagcuaaauguuggaggaaugaggcauuauuuagcaguuuuuauucuaauauaaauugacaccggaauccuuuuauuuuccuuuacaucuuaaguuucuauaacauauauguaacauauggaaauucaagucccuacuugaaaaauacuucauuuggaauaaacuuaucacuuauugauuucuguagugaauguauauucuaaccacacaaguguuuguauuacaauaaaauugagcaaccagcuugauacuacuuuuguauuuagguuacacauuuggauaugacuauucgugaacacagaggagaaauggagcaaaaaauaaucaaauuggaggguacccuggaaaaaucagaauuagaacuuaaagaaugcaacaaacagguaauuauuuaaaaauuuuguauuuuauauuguuuaacaacuaauacuaugagcacauacacccacacacaguguuuuuguuguuuaugaugaugcauguugcagugcuaaccaaguuggcccugaauuccugugcccagcgauccuccugucucuccucacgaguugcuagcugugcauggcuagugugcauggcugugguguguuuauagaaugcacgugauggaaacauuacauacuuuuauucaucuuauacauucuacuuaauacuugcuuucuccucaauguuauuuugauuguaauuucuuauaucaauguaucuaauagacuuaucacaauauguguauguuugaauaguuauaaaauauuucugggaggauuuaaaaauaauuuuagaggggcuggcgagauggcucagcgguuaagagcagugacugcucuucugaagguccugaguucaaaucccagcaaccacaugguggcucauaaccaucuguaaugagaucugaugcccucuucuggugugucugaagacagcuacaguguacuuacauauaacaauaaauaaaucuuuaaaaaaaaagacuaauuaaaaaaauuuuagaaccuaguugucuaaaaaaaucaugugggaaagaaacuuugcguucucuauauuuuuuaucuuauauauauuuuaccuuuaaaauuauaaagcuguguuuuacauuuguuuacuguacuugauguauaaauaguaauugaaacaguuacagaugggaggagcuaucagaggcuuguucacaaaauaagccaagagaugccaauaaaaaagagaauggugguuguagcccacuauucuuauaaucuuuaaaugcaguuggaauauuugauuccugacugugacaagucggcccuggaaagaaacagcuauggcuagaugccauauguagaggagggcuaucauuugaacugagguacucugggccugaaaacaaggaacaagcuagccucuaagugggaaacagcccccuuagguaacaugaacuccuggaggcuaagacauggagacaagugccuuagguaacaugaaugggaagaggcuaagaaauggggaugcugagaagcuuagguggcuagaagcuuggacucugaguguaauacuuuuuuuccugcuuucuguagugcggugcagacuucaacaccuaggauaucugaagagagugauaacuccaugccugcaguuagcaguuggcucuaagucuagggacugcauuuuugccauguuuuucuacuaguaggaccugaaguucaggucccaugggugcacucacaauuuccagagaauccuuccuccuggggguauuuaguguugagcaggguuugaaacuuggauuagucaaaugcuuucagaaaaaguaauagccauuccacuauaaagagggaaguuuuuggagucugugaaccugccuggucuacaagcuguaaaacuaaauggagccagaaguggcuuuugguauauaaaaagaggaaauccauagaauaaaugaagccuuauuguauaacugaccccuggucccaagaaucagcuucaauaguacaaaaaaauaagagauucaaacuugaacugacuaacuucccaucugguagacuucaauaccaaaggaccaaaaagaaacuauuccaauacuuguauuuuauuuaacuaaaaaugcuuuucuggccuaggugugguggugcaugccuuugaucacagcacuugggaggcaaggggcagguggaucucuguaaguucaagaucagccaggucuacagagugaguccaagacaguccaaggcucuaaaagcaaaaaacagcuuuucuacaccucccuuuucugugccuguguucccccccacacacacccacccacccacccuuccuuccuuccuuccuuccuuccuuccuuccuuccuuccuuccuuccuuccuuucuuucuuuuucuuuuuuuuuuuguuuuuuguuuuuuguuuuucgagacaggguuucucuguauagcucuggcuguccuggaacucacuuuguagaccaggcuggccuccaaguuagaaauccgccugccucugccuccggaaugcugggauuaaaggcgugugccaccacacccucgcacccccccccccuuuucuuaaauuauacuuuuaacauuaggcuuaucuuacuguuaaaaaaaaaaaaaccagcucaugcaguuuuagauuuucacauuagaguauccucauuuuguuuacauuuuugcuguaugacuagaauuuuuaucucuugcucuucucauucgguuucuacuauuuuuuuccuuuuaagauagcuuuuuuucagccggguggugguggcucacgccuuuagucccagcacuugggaggcagaggcaggcagauuucugaguucaaagccagccuggucuacaaagugaguuccaggacagccagggcuauacagagaaacccugucuugaaaaaaaaaauagcuuuuuuacuuuucuccugaaagacucugagaggagccccucacucaggcuucaggacaauaguggacacccaagaacucaugauagaccaagcuugaugcaaaccucaugaggcuuuauuuggggaaagccagagcucuggggacgacucauaucccacucagggguagaggagucgaccucgaggggaaagaggucccaguuuuuauaggcccucaggggagaaaggagaagaguggggaguaggggauuuccauaucuaaacaaugucuauucucaagaaauggguaugggagggguacaaggaaagagucuggugcagguguagcaacucaggauuggccgggcugugguugcuggggagauuuucugacucuuucucagcaaccaauaucacauauaccuggcaaugggcuucaucagugggcacacacauggguucaaggaacagucaaaacauuggcagacacacggguucaaggaguggccagagcauugugcgccucuauuuuucuaaaucagugaagcuaguucugcuaacagagacaucuaucuugccaauuucagggcuucuguuaccuuuuacauucugucaggaucuuucacucccuguuccucuuccuuuccuuuauuuaacuuaguuuuauuucuaucuuugcucaguuuuuaacuucauagcuuacucuacaugauuuuugccauuuuuuaaaauuauuauuccauggucaucaguaggaaaauggauggaaaucguuacguaaagggaaauaagcuacaaacagaaaagcaaguauugcuuguuuacucuauagaaggaaucauuucaaacaggaauuaugacacuggagaaauggcucaguggauaaguguacucacuguucuuauagaggacccagauuugguucucagcacccacauggugacuuacaaccauucuuaauaccaguuucagagccucugagcuuugugggcaccuggcaugaggugauacacauauauccaggcagucaaauacucauacauauaaaguaaaucuaaagacaaaauuuagacuagaaaauagccaaacuagagugacaaggauauugagagaagguaauucagaguggauaugaauuagcaaaguacaagacugacucuauuaaaaugacacaugggccuguuauuuucuaugcuaacuaaaggaagaauugugauuuagauuuucaucuuucaguggauuuuaagugugcauaaaauauauaaucaucuuauuaaggauaauucguauacuuauaaauuaugcuugccuuaaaagauaccucuuuuugguuuuuugagacaggauuucucuguguccuuggcuguuguggaauuuacuuggcagaccacauacaucuauuuuacucugcuucccaggugcugggauuaaaggugugcacagucacacacagcaaaaaaaguacaguuuaaacuagacauuuaguuuuauuuuaugugaguggguguuuugcuugcauauauguuugugcaucaugcauccucaagaggccagaagagggcaccaaauccccuacaucuggaguuacauacauuugugagaugccacacacaugcugggaacugaacccaagucucugcaaaagcaauaaguacuuuaaccacuaagcccucucuuuagccccagaaaaauaaauauuuuucuauuuuaauuuuagcuuuuuguuguuguuguuauuuuugugacaaggucuuacuguauaguuuaaccuggcuuugagcuccuuaacccucugcuucaaccucuaaaaugcugggauuauagcuaugcucugccuacuuuuauauauuuuagacagaaguguuuaaaauuuaauuuagaacacaacuaugaguaaauuauauuuucuuaguuguguuaauaauggucaucuguuugaaauucagguagaaagcuuaaaugaaaaguugcaaaaugccaaagaacagcuucgagaaaaggaguuuauaaugcuccaaaaugaacaggagauaucacaacugaaaaaggaaaucgaaagaacacagcaaaggaugaaagaaauggaaaguguaaguaaaguauuuuccacauaagggaaaagcaaugccacgaacaugcuuuaaacaccuugguuuuaaaauacagaaacugugcucuaaguuuuuaaaaacuaauuauuugugucagaugcuauuaguucuuuugacauuuaaaaauuuuugauuauucugguuuugauaugggcaaggacauaauaaauccacaguauaugcuuuuguaucaguuaaauacuuauucaucauaaauaugcuaugcaguagaauugagauacagaacuaacaaguuaaaggaacuugaggaacuucacccagaugaugaaaaaggauaacaguauuauuccaacuaaguacauuguguugccagaggaacauagugauuugaugacuuuauauuaauuucauguauauugauuguugaaucuauucaauacccuggucuuuuuaaaaugcgaauuuguuucugugaguuugaaagaccuccgaagggagacccucacucaagucucaggauaauagcggacccccaagaacucacgagagacaaacuugaugcaaaccacaugaggcuuuauccggggaaagccagagcucuggggacgacucguaucccacacagggguagaggagucgaccucgaggggaaagagguuccaguuuuuauaggcccucagggggaaaaggagaagggggagaguaggggauuuccauaucuaaacaaugucuauucucaagaaauggguaugggaggguuacaaggaaagagucuggugcaggugcagcaacuccggauuggcccugcugugguugcuggggagauuuucagacucuguccuagcaaccaauaucacaaacaccuggcaaugggcuucaucagugggcacacacauggguucaaagaauggucagaacauuggcagacacacggguucuaggaguggccagagcauugugcgccucuauuuuucuaaaucagugaagcuaguucugcuaacaaugaaaucuauuuugccaauuucagggcuucugugaccuuuuacauuaugucaggauuuuucaagcucuaauagacauaacuuuuucauugucaaaaacucaauuguuguaauuccacaguaauuauuagauuugauugauuaugucucucccuauagaauuuaguguggacacuuugucuccuuuuucauuuauguuuucugaacacucagagcugucuuuuaucauauaguaaguauaaauuagcuuuuauugauugaguuaauuauaaacauaacucaagcagagucuauaagagaaaauuuggaaaauagugauguggaaaugauuaaugcuccuaucauguggguucccuaacagugaaugccuaaaaguauuugcaaagguaauuauauucauuuauauccugugccuccaugcccugccuuuuuuacuuuuuguccuugaagucaaaugcuauuacucuaaccugccuuuuuguacugaauuagaacugaccuugugccaggcagugguggcgcccgccuuuaaucccagcacuugggaggcagaggcagguggauuucugaguuugaggccagccuggucuacagagugaguuccaggacagccagggcuauacagagaaacccuaucuugagaaaaccaaaaacaacaacaacaaccccccccccaaaaaaacccaaaaccccaaaacggaccuuguauuuuuuucuucuuagaagcauuacaaguuuauuauccaaaagguuuuuagcuaguauuuugaguuucuuaaugaauuccuguuucauauuuaucauauguaucucaucugaagauaauuuauauuuuauauuuauauuauauacuauuuuaaauaaguuuuacaguguagaauuuucuacuucugucaaauuaaaacucacaaaauugcuucuugcuuuuuuuaauauuccagauuuuagauuuccagauaagaaauucuuaaccuguccuuuacuaggaauuuaaaucgcuaauuuaauaauacuucagagggaauaauagcgaagugacaaauuucaccuucauaaagaauucacaacccaacuguguagauuaauagugaauuuuaaugccaauauuuaucugcacaccugccugucugccuaucuaccaacuaucugucugucugucugucugucuaucuaucaaucaucugucuauucaucuaucaucugucuaucuaucucuaucaucuaucauuugucugucuaacuaucuacaucugucuaucugucuauguuaggaguguauucauguauguaaagccugaaaacaagcuugguuguuauuucucaagagguuauuucucaggauucucaagaauccaccuuuuggguuuuguuguuguuuugcuuuguuuuuugacaaguucuuacauagcccagacuaguuuugaacuuccuguguaguaaaagaugaccuuaaaacucuccuccugacucuuccuucccccaaauccugggauuguguuguguacucuaccgugcuucuuuuaauguggugcugaggagagaauccagacuugugggaaugcugagucaugcagaauauuucaguaagaguuucuaaacugggagugguaacaucucucucucucucucucucucucucucucucucucucucucucucucucaagacuuguuuauuuuauguauaugaguaaacuguaacuaucuucagacagcaccagaagagggcaucagaucccaugacagaugguugugagccaccaugugguugcugggauuugaacucaggaccucuggaagagcagucagugcucuuaaccucugagccaucucuccagcccaguaacacauaucucuagucugaaggcucagaaagaagaaucucaauuugaagguuagcccagacuacucuccguuuucaaguagccugggcaagauccccagcuaagauagaugcguaaaugagauucuugcaguggguguacaugcuuguuauucuagcuacuuagaauuugagaccagccuggauaacguuucucaaauacagcguuuaaaaaguagcuggggcgugucucagggccgagcacuugcuuagcauguugugguucuggauuuaaucccuagacuaaaaaacuucccguuuuguuagagauuugucauuuuauuaugauuaaggcuuuuugaaauauuaacuuguugcauguaauuuuuuaauaaaauuaauauuuuacuuaaaucaucauagcaaaaauguuaagcaaaaaaaguuaaauuuucuauuuccccuucuuaaugagauucaagcaucucccccuugggcccuccgugcuguguagcuucuuugggucugugguuuauagcaguuauccuguacuuuauggcuaaaauccacuugcaagugagcacauaccaugcuugucuuucugggucuggguuacaucacgcuggaugaucuuuucuaguucuaucuauuugccagcaaauuucaugaugucauuguuucuaauagcugaguacuauuccauuguguaaaugaaccauaucuucuuuauguauucuucgguggaaggauauggguuguucccaguguguggcuauuaugaacaaagcugcuaugaacacaguugagcaagugucuuugugggaugguagagguucuuuuggguauuugccccagagcugugacuugagguagaucuauucccaguguccugagaaaccaccaaauuuacuuccaaagcaguuguacaaguuuggacucccaccagcaauggaguguuccccuggauccauaucuucgucagcacgagcuguugcuugaguuuuuuaucuuugccauuuuuuuuuuuuuuuucgagacaggguuucucuguguaucccuggcuguccuggaacucacucuguagaccacgcuggccucgaacucagaaauccaccugccucugccuuccaagugcugggacuaaaggcgugcgccaccacgcccggcuaucuuugccauuuugauggauauaauauggaauuucagaguuguuuugauuuucaauuccuugaugccuaaggauguuaaacauuuaagugcuucuccaccauuagagaguccugccaagaauucuguuuagagcuauacccauuuuuuaauagacaucaaggguggauggagggaggaaagugggucggggaguagguagguaugaggacaggagggaugagguaagaggagggaaagacaacuguauugggguauucuuuguauuuuuuuaacaucuuuaauuuaaaaucucauauuuuguacugacagacaacacaugucaauuuggaauagucacaguuuaagaagagaccugaaagccaccuaaaaauuucaaguguccugagugaaagauguuggcuauuuaucuacucauacauauuaaauuguugucauuccuuaugcuguauauaucauagauuaaagaaacaugguugccaaaauuuacuccuuaugaaacauuaaacggaugaucacacuacgucugccagucagugacaauagcaaugucugacccuaccccuggacauuuccagauacuaacgaaucaguguuuucuucacaguauuuacuacaaauacuguuuuauuuccucacuuaagcugugugcacacaaguguuucucccauguugcuucauagaagaagaaacuacacuaucuugauugauuuuauuuccuuuggccucaauaaaauaaauuacagauauuaagugccuguaaauggcuauggacugauuaugagucucaaacagcucauccucauuaucaccuucugcuuaggcauaacacauuccacauuuuuaucaauagaaggcaccucugugaacuucucucuuucucugcccacuuuuguuccucagaugaaaaacacucagacagcuuuauuauuuuagaacuuuccagauagcacaauugcugggcacggaaucucccgcccuaaccuuaucagcuaaccuauagcagccaucaguggaggccgcugguuguagcuucccuaagaucuuacaugguuguuucaugcuucuccuuccaaagccuggcagaaaugaccuguucuuucccugggucucuuuuuccuucuccugagacccggaugucccaccuguuucuucuguccagcaguuggcucuaggccuucuuuauugauacaagcaagaaccaauuagggagucagcaccuuucccuacauuaacuuauagugguacaugcucauuuuauuguagauuuuauaaagauguuuuuaggggaguucucuuaugaaaacaaagaaguaaauccuaaguauauauuuuauaacuauaaauuucauuuugaaacccacaaaugucuugugcuuuucagguuauaaaagaacaggaagacuacauugcuacccaguacaaggaggucauugauuuggggcaagaauugaggcuaacccaggagcaaaugcagaacacucauucagaacugguggaggcucgucgccaagaaguccaagcacagagggaaauagaaaggcuugcuggugaacuggaggauauaaaacaacucucuaaagagaagguaaaccuauucuaaaugauuugauauuacugaagaauuuuaaaaauuuuaauuccuuuuuuaaagaaggcagauaauaaugcuugucacuaaaccaccaguacuuaaccuuuuuauucuguacuguguuguacuauagugugaauguauuuuuuuaaguuaucacauguuuauucuaauauguggaaucuuggugcaaaaagagaugaguagagaagaaggugccugaggaagggaaaguagaaguaagagaaugugauugguguuggguggguuugacacaauuaauacauaauagaaaugauuuauauauaaauuauuuugacauuuuaauaauucaaagacuuucauaacuuuguacuuuaacauuacuguggugguucaaauauacuagacccagcuaguggcacuaauaggaaguguagccuuggagugaguguggugucauuggaggaagugugucacuguggucaagggcuuugagacucuccuccuagcugccuggaggucagucuucuccugccuuugaacaaggugucgaacuaacucucagguccuuuucuaccaucauaccuacccuccgucaugccuccugcugugaugacaguggacuaaaucucugaaccuguaagccagucccaauuaaauguuguccuuuauaacaguugccuugucaugguauuucuucacagcaauaaaacccaaacuaagacaaauaccauaauggcaauaaaauagaaguauauauuugauauaacuaauuacucuguaguaaacuaucaugauuaacuuuuucaugaacaauguuuucuaguucccacuacaguugucucaaauacucuccagucgcugugaagauacaucgugauguauuucaugucaccagacuguccacuuaaaaaugguuaaaauaguagaaccaggugugguagucuacauuuguaaucccagcacauagucaaccaaagaaggggaagcucuagcuugaggcgaaccagggcuacaaugugggauauuauuuaaaaaauaguacauauuacuacaauuuuuaaaauaagcuacuaguauuguacuuagguuuuaaauucuuuauaauauaauauuuuauaauaaaaaaccuucaaaaaugaacucuggccacacuaguucucaauaaaucgaguuauguagcacuuuagauguucaaguguuugaacuaucuucuaaauuaaaaacugucaaaauuucuuuuuuuuuauauuuguauguauguauguauguauguauuuauuuauuuuuaaaaacuuuauuucagaagcuuugugaugguaaaguacuauuuaaaaucaagaguacuaauaaaaauuuauuuucucagaaauacauuuagcaacuuguuuaaagagaauuuagacugauuuauuuuuaauuacuuagaccuugagaaaaauuuuauuuuauucuggaacuucuuauuauuuuucuacuuuccgguacacuuaauaauccaucacauaguaaaaacaauccuccuuuagcuuuguuagguuagcuguguuuuuauucagauuucuggauuauuagagcaguuaagaauauguaggaaaauuauuagcaauauaacagauauuaggauguuuaccuaaaaagggacuuuuaucucauuuguguucuucuuugauaaugucugaguuuaguauaauugcuuuuauuugauaaacuaagauuacuuaauuucaaagugaguuuaaugggacauugcuuaaaaugcaaguuuuaaaauauuacauuuuaaucccaaacuaauuauagauucauguuuaucuuuugcuuugggucaaaccuggauauuuuuuaugaauaaucuaauuagaauuguauuuagucuuuuaacauaaguuauacuuguaacucuucaacucacauaaauggccaggccccuccccugaggaccuccaccaccagauucaaccuauagaacacucucauugcccuaauggcugacccagccccugccacacagaguacaaagcucaaauucuggucuuaaaguccuagcaauccccaccuuggaagucuuuacccuggaaagcuucucccacgcccacgcccauuauuaaggucuucauuuacagacucucugcucuguccuuugcugcuucucacccaagcagaagccaccacccccucccccuggguauucucucccaauaaaucuguugcaugagguguguuguguguugugacugccaggauuccuuucuccucagagcuguaacacaauacuuauaguccauccucuaguuauuuuuuuuucaacuaaagggagaauuaaaauaauagaauaccugguauuauuguuauuguuggggcaauacaugugucacuucccacgcaguuuuauuaguuuugacuaguuaugauuggguagcagauguuuaugacucuuguugaguuauuucaaaacuuuuuuuuuuugguuuuucgagacaggguuucucuguauagcccuggcuguccuggagcucacuuuguagaccaggcuggccucgaacucagaaauccgccugccuacgccucccgagugcugggauuaaaggcgugcaccaccacgcccggccuuauuucaaaacuuuuaacuuaguucuuacuuuaaaauauuuccauccauauuucacuaguguuuccucuuauccaugagaaaugcacauuuuaaagaccuuuaguagguauaugcugagcucuacacacauacacuguacucuuugagaugggcacuuccgggccauuauuaagucaaaagaggguuccuggaacacaguuaauuugauaguaguuacacuggacaaacagaugacucaugccgugguagacugagcaagagauacaagcuuuccucaagcugcucauaauagcccacaauuugaaaacuauaaguuguuuauuucuguaauuucacauuuguuaucuuuggacuguggaugacugcagguugcugaaacucuagaagguaaagcaacagagaacaaaccucuuuuauucaaggggagacuacugcgugugguaaagucuuauaauuaaaaucauaaccacaacuugcauugaccaacauaaauagguuugaauaaaaauacaaaucaggcuggagauaugguucagcaguuaagagcagccuuucccaguaucuacaugguggcuaaugacugucugucuaacaacuaucuguagcuuugguuccagggaauccaacacucuguguuggcauauguagguaccagguacacacauuuuguguguguuuuguauguguguguguguguguguguauucggaacaaaacaaaacacuccuacagauuuuuaaaaaauacaaaucauuccuguaaaagcagauaauuuauaugguaagaaaaaacugcacagagacaccugagagcaggcucuuaucugccaaaguggaaaucauuauuugccaaaguucagcauuuuaugguuuuuuguuucaagaaaggauuggcucauuaacuuauguagaauauaauguacuucuuuuggucaucucugaaacgucuauauucaaaaguguacuguauaauaagccuguguuuuacauaaagacuagcuugcuuccauuaaggcacugaauuguuuuaacuaugcuaaaccaaauaagcucccuacauuccauuuauuuaaugugucguuuuuaaggaagcucauggaaaucguuuggcugaagaacugggggcuucucaaguacgugaagcucauuuagaagcaagaaugcaagcagaaauaaagaaauuauccucagaaguagacucucugaaagaagcuuaucagauagagguaaagaaaaauuaaauuugugucaguagcccccacaaagaugaauuuacuuacuaggaugaaaacaugagucuaguuuuugaaguguucauuguaaucuuuaaugcaauuaaaaggcuauugugcucuggaguuaagaggucuagcuccuagccgggugugguggcgcacgccuuuaaucccagcacucaggaggcagaggcaggcggauuucugaguuugaggccagccuggucuacaaagugaguucuaggacagccagggcuauacagagaaacccugucucaaaaaaccaaagaagaaaaaagaacaguacuacuacuuagaauauuuuucuuucuuuuuuaaagauuuauuuauuuauuuuaugcauauaaguacacugccauugcucucuucagacacaccagaaaagggcgucagacccaauuacagaugguugugagccaccauaugcuugcugggaauugaacucaggaccucuggaagagcaguuagugcucuuaaccacugagccaucucuccaggcccugucuaauguauuuuaaaaagccuuucuaaaaacagccaauuuuuuuccaaaaguuuacuuaacuuaaucuggaauggauuaacaacauuaaagcuuuuuuuuuaauuagauaauuucuuuauuuacauuucaaauguuauccccuuuccuaguuuccccucugaacacccccccccccccacccugcuuaccaaccugcccacuccuccuuccuggcauucccgacuagaccauccucugcuacauaugcagcuagagccacaaguccuacuauguguuuucuuugauuggugguuuaaucccagggagcucuggggguacugauugguucauuuuguuguuccaccuauggggcugcagaccccuucagcuccuuggguacuuucaccggggacccugugcucuguucauuucuuuuaaaacguuugaaaauauuaccgaaacucauuguauauguucuaaauaaucuugaguuuggugcuaagaaaacauuuuuuuuuucuguaaaacaaaggcuaaaaaagcauuuguauuauaccuuuuuccccuuggaacauugucucaggauguagcgcuuacuuuuguggaacucuauguaaaccaagcaggccucaaacucacagagauccauccaccugccugugucuccuuagugcugggauuaaauauaugugcuuuuuuuuucccccuacuuuuguauuaaacucuuauugagaguuuaguaacaauuuaugaggcccuggggauggggagaggggacuuguaacuaugucuuauuuaaaugcauuuagauucagaucucuuuaaaaacauugugucugcaaaugaaacacauuuucaagcugaauccacaucuuguaaguuuuguaaucuuuaaggauaacuauuaguccaucucaaguauuugccauuaacuguucauauuuucuaaucuguuaucuauaguuacccauuugaagccauuaauuuauaaauuaccuaaaauuaguuagucagcuaguucauaacuuuuuaaaaugguucucggagauggagcucagcuagaaccgaugcucuuauagaggauucagguucauuccccagcucccauauauagcagcucaccacugacuauaccaucaguucucaggggauaugauauccucuucugaccuccauggguaccaggcauacaugcagcaaaauacucauacacauaaacuuaaaaaauaaaauaaccuuuaagguuagagagaugacucagcaauuaagaaaauaauugaucuuccaaaggacccagguuugauucccaggaccuaccuauaucagugauugauacaacuaccuauaacucuagcucuaguaugucuaugccucuggcuuauauagacauuacuaacuuaauuacacacucgcacaugcauacaguuaaaaauaaaauaaauauuuuaaaaagucuuaauguuuuuaguaaaugggaauauuuuuaaguaugacaaaaauauauaauuuauauaaaacauuuuuccuuuugauugcuaacaaagauuuauuuuaaaaguguguguguugcuucuauauacaaugaggggacugagccaggcacacuuguacaugccuguaaucucaacauuugagaaaaacauagguucgaagucaacuuuggcuacauagcaaggucuugagaccaugucuuuaaaaacccuaaaaauuaaaaaaaaaaaaaaaaacccaaacaaaaaaaccccccaaaaauacccuaaaaauaaguaaauguauaaauuaaacaagaagauauagcauuauagguacaguuuaaaaaggaauuuccaguuuucauuuuaauuuuauguauauggguguuuugacugaaagucugugucccacaugugugcaaugccugaguaugccagaagagguuguuggaugcccuguguggugguuugaauaaaaauggcuucucuagccuagucuacaaagcgaguuaggucagccaaagcuacacagagaauccgugucacaaaaaucaaccaaccaaccaaucaaucaaucaaucaaucaaucaaucaaucaaauaaacccaaaccaaacaaaaggccccauugcccaauaaggaguagcacuauuaggagguauaaccuuguuagauuuugaggucucaaauguucaagccuggccaguguaucauaguugccuccugcuccuugcaaaucagaauacagagcaaggggaccacuccuccuuuacuguugggagugcacacuuguguagucacuuuggaaaucaauguggccaguuucucagaaaacugguaaucuaccucaagacccagcuauaccacuccuagacauauacccaaaggacacuccauccuacccaaggacacuuguucuucuguguucauagcaacuuuauucauaauagcagaaacuagaaacaaccuagauaucagucaaccaaauaauggauaaagaaaaugugauauauuuaaacaauaaaguauuacucaucuguuauaaaaaugacaucaugaaauuugcaggcaugguugaauuccucgugaccagucccuaaagggaugaugagucuuucucugacuguguccgugccagaagccaucaacuaauucccguguccacacuauagccugcaccauggaguagggccagcuuuccugugcucacuccacugccuaccuaaaugugcuaugaauuggaaagggccagcaccagcucuccuguacccacaaacaucaacauggcuuuaguggcagcccacaucaugggcauccacaugaauuguggugcuaacauaggcugcagacaucagcauguccccuggcuguaucaggaccacugacccagucauggccucagcagcuucacagaccguggaccucaauacagucuuaagaggugacaauaccauucacuucaggauggacacccacccacaccaccccgacuccuaccgaagcagcaaagccaaaggcaucagucaguggcacagaccuacauguguucaugugaaucucgguuucacuguagacagcaucauggcccacagguaccaacaugaccuccaguggcaucacagaccaugaugguacuucagagggguccaguccagaaagugaaucuuuccucaucucauugcccagagccagggggauuccccgccugggaggcagguuuggggacugugucugcaucugcaugagcucaagacuguuguaugcaauuccgugggcccuacugagcaaugacaguauaucggccucagccucucaucuugucacugccaucacugucuccaguccccuagcucugccucucucuacagcacacacugcucaguuuuucuaucuuuccuaccucucuaucacuauucauuguagugguguuuccaacccacaacacaagaccugggugacacucucaacauuacccauuuuuaauuuuuucccugcugcucaacaccaccaacauugugacccaaugccccuaucucuuauuucuuucucuucucuucucuucucuucucuucucuucuuuuucuuuuucuuuuucaugcuuuuggguuuuguucuuuguucuuugggguuuuuguuggugguggugguguugcuguuguuuguuuggauuuuucuuuuuugagacagaaccucucuauauaagccccgacuguccuggaacucacuauguagacuagacuguucuggaauuugaagaaaucaccagccucugccccuggaguacagggauuaaagacauguacuaccacacccaacuaugagaauauuuucuuuauauuacauguacagucauuucucguauuucuccaguugucucuaaaguuucuuuuaaauuuauauaagucugaaucaaaguaugauguauagcuaacuauuaagugaauguaagcuuguguucuuuucuuccuugaguauugcauuuagugugaaaucagauguuuacagcuauacauuuaaggaaaaauaauaguagcagguauuagaauaacuccauccuguuuucuuuuuauaauuuugggauuauaaagaugauuucacaucaagagaaccaugcaaaguggaagcuuucugcugaaucucagaagacgucuguucaacaacugaaugaacaacuagagaaagcgaaacaagaauuggaagaagcucaggauacugugagcaauuugcaucaacaaguucaagacaggaaugaagucauugaagcugcaaaugaagcauuacuuauuaaaguaaguaaacauaaaaguaaugaaauacauuugugaaaaauauauuuuccuuuucucauuuauagaggucuucaugacagauuauugauuugaaauaaaauauaucuuuuuuagaaaaaaauaugagacauaauuaacauaucauuacuauaaaauaauuuauauguuuaaauauaaauucuuauauuuauaauauuuacucuuggguuuuauaucugaugugccuuaaaaaauauugaagcuuuuucaaaauuaauaaagcuacuuugaaaauuaugagauuaaaaauaauaagauuacauucagaacuuuuuuuuaacuggauuuaaauguauauguuuuuuaaauggccuacacuguguguucaucuguuuugauuauagcaguuuguguggaguuugaaauuaacaguauggacacauaaauccucauuuacaacugcuaauguauaagguaaaguuaucagugaagaccuuuaaaaagaacagagugguagcaagauaaaagucauugaaaaagaaauaaaauuaauaccuucuccguauuugcauuuugugcuuaacucaguaacucauucuuuuucagcaauaguuuacuguuauauacaugugaauagacauaaucucaaauuauauuuaggugcugguaauauagguuagugacugaguuuguguuuaacauacaggauguucuggauucagucuuuugcauuaauagaauauuuaggcuaaccacuguguuugugcauguauguuaagaaugaacauacuaguguuuggcugugggucucugcaucuguuuccaucagaugcuggaugaagucucucugaugaccauuaggcuaggcaccaauccaugaguauagcagaauaucacuaggaaucauuucauugauuuuuuuuuuuuugccagucauuauugguucuauuccagaucucugggcuauccagccccuagguccuggucuuccaaguagugucauggcaugggucucaagauggaccaguuggccacuuccacauauccuugccacauuuaccccagcacaucuuguaggcaggacaaauuguagaucaaagguuuuauggauagauugguaucccaauccuuccauuggaagucuugccuaguuauaggaucuggccaguccaggcuccauauccccccauugcuagaagucuaagcuagggucacccauauagauuucugggaguuuccauugcccuagguuuccagcuugucccagaaaugcucccucuucuaauuccaguugucucucccaauacucucgcccuccuuccuuucccuaccugaccccuccuguucccauucccauccuccaauccagaccccuccaacccccagccaccugaaaugucuaaucuauuuccccuuuacagugacauccaugcauucuccccuccccaccuuccaccccuugagcccuccuuguuacuuagccucucugccucuguggguugcugcaugacuauccuuuauuuuaagguuaauaauucauuuacaagugaguucauacuauguuucucuuucuggguuuugguuaccucauucaggaugaacuuuucuacuucuauccacuugccugcaaauuucaugaugucauugguuuuugugcugaguaauaguccauuguguaaauuaaccacuuuacauuucuucuaguuuucuuuauccacucuucaggugaaggacaucuaaauguuuccaauuucuggcuauuacaaauaaagcugcuaugaacauaauugaggaagugucuuugugguaguauggagugugcuuuggguauaugccgaagaguaguauagcugggucuugagauuggucaauucccaguuuuugagggaacugccauauugauucucaaagaggcuauacaaguuuacauuccuaccagcaacaaggaguggaguguuccucuugcuccacauccucaccagccugagcugccacuuguguuguuaucuuugcuauuccgacagguguaagauggaaucucagaauuguuuucauuuguauuucucugauagcugaugauguugaauauuucuuuaaguauuuuucaaccauuugagauucuucuauugauaauugucuguuuagaucuguacuccauuuuuaguuagauuauuuguuuuauuuuugcuaucuaauuucuuaaguuccuuacauauuuuggauauuaguccucaaucaguuguggaguugguaaaaauacuuucccauuccaaagagugcacuuuguucaguuaacaguauccuuuaccuuacagaagcuuuuugguuucacgagucccauuuauuaguuguugaucuuagugccugggcuauugguguucuauucaggaaguugucuccuguauuuaugaguucaagacuauucuccacuuucucuucuaugagguucaguguauccagcuuuauguugagaucuuugauccacuuauucaggguggugaguguguauuuauuugcauucuucuaugugccuauauccacuuagaccagcaucauuuguuaaagaugcuuucuuuuuccauuguauaauuuuggcuucuuuguaaaaaaucuaguguccaagguguguggacauacuucaggggcuuuguguggacauacuucaggggcuuuguucgauuccacugaccaagcugucuguucguauaugaauaccauauucauauacagcuuuuauuacuguugaucuguaguacagcuugaaaucauccaaacacgguggugagauggugagauggcuggugagauggcucaguggguaagagcacccggcugcucuuccgaagguccagaguucaaaucccagcaaccacaugguggcucacaaccauccguaacgagaucugacucccucuucuggagggucugaagacagcuacaguguacuuacauauaauaauaaauaaaucuuuuuuuuuuaaaaaaaaaagaaaucauccaaacacuaggaggagcuugaagaauccuguggaagagggggaagaaugauuguaggaucuagaggagucaaggacacuacaagaaaacccacagaaucaacuaagcugggcucacaggagcucacagaggcucacagagacugaaccaccaaccagggaaccuauaugagacucacuuaggcauucuacacauaucuaauaguuguguagcuuggucuucuugugagacucccaacagugggaguuucagggguuguuucugacucucuucccuaccuuugggacccuuuccuccuacuggguugccuuguccaaucugaauaaaagaggaagugccaaggcuggagagauggcucagcaguuaagagcacugacugcucuacugaguucaaaucucaacaaccacaugguggcucauaaccaucuguaaugagauuugaugcccuuuucugggguggcugaagacaccugcaguguacuaacauauaaugaacaaauaaaucuuuaaaaaaaaaagaggaagugccuagacuuaugcaaaaaaaaaaaaaaaaaaaaggaauggacuuacuauuagugcuuuuauuaagauaauauuccaacugcuuggagucagugacgaccaguacauaugagacccuagguugaaccccuggucaagguaaaccaauauauauguuuguaucuauguauacacacacacacacacacacacacacaucacaucacaucacaucacaucacaucacauacacacacacacugguuuuuuucuggaguucugaaagcuuauaaaauucacauaaaauuacagaucuucauuguaaaaaugaauaaccuucaaaauuaaaauauucuccauuguauccuuaguuauaguuacuauuuugccuacuugcuaaguaauguccaugagaacagugaauggauuuguuuuuacauauuguguaugaguguuuugcuggcaaucuguaugugcacuguguucaugcaguacucacagaggccaaaaaagggaaccagauucccuagagcuucaguuauggaugguugguuguaagccuucauguugguacuaaaccaauuccagguucucuucaagagaagcaaguguucuuaucuacugaaccauuccuccaaccuucuaaguaguagaaguucuuaaguaaaccauagauagagaaaucuuaaaagagaaguauugggauuacuuauuguagcuaauauauagugguacuaguuuuaacacugugguugacacagcucuuaaagucaaccucagcauuucuauugucgaaauuaaagaggacaaagagaaagaauaaaggcauuuaaucuaagagauuagcagauguaaccauaaguaauuagacauggguguacauaguucuggaauguagcuaaguugguggagugcucgucuaacaugcacaaagcccucauacugaucccuggcacugcauaaaaccagaugaauggguauaugccuguaaccucaguacuugggagguagaauucaggaauucaaggucaugauuggugguucuauauuauuuauauuguacguacguuauuuugcuuaugaaauugaaauuacaaccagguauaaugaugcauuuuuauaaucccaucauacuaagaacugaggagagucaaacccaaguuugaggccaaguuagguuagauuacaaaauaugcugcucuggcucucucuacaaaaaaaauauuuuuaggucuugugguuuuucaguauauaucuuaaaguuucuuuuccaaaauaauucuuguuuaggaaagcuuucuuucuuuuuuuuuuuuuuuuuuuuuagauuuauuuauuuauuuauuauauguaaguacacuguggcugucuucagacacuccagaagagggagucagaucucauuacgggugguugugagccaccaugugguugcuaggauuugaacuucggaccuuuggaaaagcagucgggugcucuuacccacugagccaucucaccagcccggaaagcuuucuuauaauaaggacauaagcacagauuaacugaugguuugaaugagaauagcccgcuuugguucauauuugaauacuuggucccuaguuuauggaccuauuugggaaggauuagaagauauggccuuguuagaggaguuguaucauugguggugggcuuaaagguuucaaaguuucaggccauuuucaguuaaauuuuccuuucugccuucuacgugcugcucuuacacccugccuauacugcugugcucuacaccaugauuguccuagacuuacccuuuggaacuguaagcucccauuaaauccuuccuucuauaaaaugucuuggucaugcuauugucucacagcaguggaaaaguagcuaaagcagaaguuugugccaagugagugcuauugcuguaacaggccugaaaaugcuggugguugguugguuuguuuguuuguuuugagaaauguugaagaacuugacacuuuggacuggaggguuuaauauaucacccuagugugagcauaguacugauagcuuuguggacuguggaggcccaguucaggauguuugaaagagaaauaaaauuagcaauugggccagagaucauuuuugugauaauguggcuccuuuuugcucuuguucuaaaaauguaccugaagcuaaauugaagaguuuggaacuaauuuuguuggcagagauuucaaggcaaccaaguauugacuuugucaugucauuuauuagugaccacucuuaaugcuaaucuacaagaacaagaauaauguaguuuggggagaaaaugagcaccaggauauuuaauguuggagccaaauuuauacugaaagacauaagaagaaaugaaauaaagggauuguugccuugagugaaaccccacccagguagcccugcaacuugugaaaagaaaagggccuaggaauuaccuguuucuaaugagcaauaacaaaucaaagcuuaugcaaauagaauucaaggagggagccagcuucagccauauguuucuggcuguagagucaugaggaauacaggaauaaagggguuauaggaucucccuccauguuaaggaaaccccggagguuagguauguggcaugggaguccgugcuuggagcuugggaaaggcaauucauugccugaagcuguggaagugaagccaggauuguguuggagacacgaagaugauggagguacuagagcagagggaugacugucaggaagagcuguuggcagggacugaaaccaauccaagacagggaacuguguugcagucagcaaaguugugaagagugaagccaucuaagcccuuugacaggauuuagagcuugcccuguuggauuuuggcuuccuuugguccaguauucccucacuaugcccucauucaccccuuuuagaaugguaaucuauuuucugugccauuguauauuagaaggauaauuugcuuuuugauuuuauagggagugaaguuaagagguugccauuaguuucagaagagacuuucaacuuuaaaacuguugagacugaguucuuuugaaguuggacuucauauggcauugcaauauggccauaagccuuuggggggggagcaggaagugggaugcagugguuugaaugagaauggucccuauuggcucauauguuugaggauuugguuccagcuuaguggaacuguuggaaaggauuaagagaugcggccaacuuggaggaacuaugucaauggaauugggcucugagauuucaaaaguccauaccauuuccaauuagaucucuuucuuugccucaugcuugugguucagcuguaagcucucagcuacuucuucagugccaugccugccugccugccugauguuauacuuuccuacuguggugaugauggaccuacccucuggaaugugagccccacugaaugcuuuauucuauaaacugccuuggucauggugcuuggucacagcaauagaaauauaacuaagacaaugaccuauauguacuuaauuccuguuauaauucuaaaaguaguccuuuuauguauguccauguuagauuaaggaaaaaaauaguucaccgauauacuuucacagauaaacuuacagguauaagauugaaaucuuuaacauguaaauauucucuaaugaaaauucagguuucaugaaauuccuuagcauauuggaagcaguuuccaaauaaaaauauuuaauuuucacaaaaugcaauuaucuguaauagaagaagguuugaacaacacuugcaaaauucucaagaacuauuauuuuaaaacuucccaugcucccagacugggaggggguagugacuggacuguaaaaaaauaaaaguaauuuuuuuaaaaaaguucccagccaggugugguggcucaugccuuuuaucccagcacuugggaggcagaggcaggagaauuucugaguucgaggccagccuggucuacagagugaguuccaggacagccagggcuacacagagaaacccuaucucaauaaauaaauagauagauagauagauagauagauagauagauagauagauagauagauuaauaaauaaauauuuuuuaaaaguuaccauacugagacaaaggcuaacaaaaaugacuucuaagagucugugauuuuauaaguaguauauuaaacagaaauauauugaacaugcacuauguaccaauuuuuuuuuuacaggaaucagaauuaaccagauugcaagccaaaauuucuggacaugaaaagacagaagacaccaaguaucuaccagcuccguuuacaacucuaacagaaauuauaccugauagucaacauccaaauuuugccaaacauucucagauaucacuuuucaaaugcagaaaacuacgucggucuauuagugccagugaccugaguuucaaaagucaugguaaugacgaucucucugaagaauugcuacaggacuuaaaaaaaaugcaauuugagcagacuucagcgauagaaaguggucauaaagaccuaccuuuaacccauucagagucauuuaaaccucucccguauaaccuagaagaugauaguucugaaaguaaugacuucaguacucuuaguggaaugcugagauacauaaacaaagaagugagacugcugaaaaaaucuucucugcaaacagcuacugguuuaagucagguauguauuuuacauauuaccagauauauuaacuuguuguauacuuguaaucucagcacugaggagacagaaacagaaagauuguaggcuggauauccuuacucccucccccgcaaaaguaauaauuuuuauuuagugaauauaauuuuauuacuuuuggagaaaaaaaccccauauagauugacuuuuccuuauccaaaaugugggguuagaaguuccaggcuuccucaaauugggaauauuugaauacuagcuuggagauuguuuuagucaggguuucuuuuccugcacaaaaugucauaacgaagaaccaaguuggggaggaaagaauuuauucagcuuacacuuccacauugcuguuuaucaccaaaggaagucaggacaggaacucucacaggguaggaacuuggaggcagaguggaugcagaagccauagaagagugcugcuuacuagcuugcuuccuguacuggcuaguuuugugucaacuugacacagcuggaguuaccacagggaaaggagcuucaguuggggaaaugccuccaugagauccaacuguaaggcauuuucucaauuagugaucaagggggaaaggccccuugugggugggaccaucucugggcugguagucuugguucuauaagagagcaggcugagcaagccaggggaagcaagccaguaaggaacaucccuccauggccucugcaucagcuucugcucccugaccugcuugaguuccaguccugacuaccuuuagugaugaacagcaauguggaagcguaagcugaauaaacccuuuccuccccaacuugcuucuuggucaugauguuugugcaggaauagaaacccugacugagacacuuccccuggcuugauuagcuugcuuucuuauagaacccaagacuacuaguccagggauggcaccacccacagugggcuaggcccuacccccuugaucacuaauugagaaaaugucuuacacauggauaucaugaaggcauuuccacaagggaggcuccuuucucugugauaauuccagcuuguguccacacaaaaccagccaguucagagauauuaugaacaauuggguuucugaaauugaaguuuaaaauuuagauauuaucagcguauagaugauauuuaaagccauaacacuggguuauaucaguggaauaaacugagacagaaacagucauuccugaagugucuugccuuaagcauucaagaaauugaagaaucuaggaugggaaauguagcucaguugguaaagugugugccuacucugccugauguucugaguucacccuucaguauugcauacacuaggcauucaccugugugguauuauauuacaaugauauuauauauuauuauuauucuaggauuagaaguuuaugguugaguaauuuccaggcaauacugagcuguaugaacuauugucucaaaaauaaacaaaaaacaaacaaacaaaaagaacaacaaaccaaccaaacaaagacaacuuuuuugaaagaagcaagguagaucucugaguucuagaccagcugggacuauacagugagaccccaucugagagaaagagagaaacagaaagacagggugguggggguuggguggggguggagacugaagauuucaauauaguuaacugcaaaacauuuuaugaaauagaaaaaaagagaacauaauaauucauaagccgugcuaaauacaaaacauaaggagauuaguugugccuuguugcuaagagagauuuugacugccacauguguuaauauggaggcuguugauggccucuguugaacaaccugugagugagaauaggcgagaaagcuuuguaaggagaggaaacaccaagauuuugauaaaacacuaacuuuugauaaacaguaaagggguggucuuuuguuguuuuuuuauuaagagauaaauauuuugugacuugguaggaauaaucuaguagacauggaaaaacgauaauuuaacccagagaauaaaaugagaaacauauuucaaguagacuuaaaaugaguuuauagagaagcagaagaguuggacuuguguaagagacaugggagcacaguucguuuaccucagugaaaggaaaacuauauaaaaagaaauuaaauaagacuauauaaaaagaaacaaauggagaggaaggguuuuuuugggauagaaguuucuuuacugauugucucuuugugaaaaaauaaacaauguucuuaucuaagucagaguaagguaauagauauuugguggguuguuuuuuauuauuauuauuuugguuuggguugguuuuuaaguuuuuugggguuguuuguuuuacaguuucgguaugcaagcucuggccaggcucuaccucuuaaaugcuaagauuaaaggcaugcacugucccagcugacaaagguauuagagguuuaagagcaagaaaacuagcaugccuuuaauccuaucagggagcaaggggcagauggaucucugugaguucaaggcuaaccuguuuuacagaaugaguuccaaaagagccagagcuauaaagagaaacucugucucaggaaaaaagaaauaggaaaacuacaugacgaaguuaacuuagagaguagaaaaguauaaacacaccacccuuccaggaaaguuuaauagacuuacuagacagauagccuuguaaaauacagaccagcugguauuaucuaccaggaaguuuaccaagaaccuauuuggaacuuauaaauauuacucacauccaucauauuuccaaaacuuguaguaaauaguucacaaaauuugauuaugagaagugauggaauuagccaaagggaaaacaaagaaaaaaaagaugaagcaagagaacaagaaagccgggugugguggcgcaugccuguagucccagcacuugggaggcagaggcagguggauuucugaguucaaggccagccuggucuacagagugaguuccaggacagccagggcuacacagagaaacccugucucgaaaaaccaaaaaaacaaaaagagagaacaagaaaauaagaacaugaauauauagaccaugucaaauucaagguuugguaagauuugaccuauauuuuuaaaacucaaagucuucccucugucuuucuucuuuucuaugauuguugcaaauauuucuccuuuacuuuuugcuucauuuuuccauauuuguauaaccaguuugcccuccuuuacuguguauauuaguaugacauugaugucugaauauuacuucuuaagauuuauauuuauuuuaucaaugauuauguguguguacauguggauuuaugcacaagugaguguguaagccuucagaguccagaagaagcauaggaucucguggagguggagguacaggcccuugugagacacgagugcuggagucaaacccuggucuuugaacugcuuagcccucuuuucagccccugcaucuauauuuuaugucccuugccaggagcuuaaaaccugguuuaacugucuguuucuauauaaucuccaaacuuccauuuuuauaaccauguaauacauuauugacauuuucugauuuuuuucaauugguuaaauauuucccacuuuaucuuuaaauuuugugcuugaauguuaugguagauguuaaugauaaaucaauaugauuuuaauauucauaauauuaaccuauuauuuuauauuauucuagggaggaaaauuguaauuaaaagaagaugucuaugucaugaaaaauggaauuguugguacugugcuguuuguuauguguauguagugaauacucauugaagcuguuauuuuauuauuuuuaauaaauuuuuauauuuuaauauuuuaaagaaacacuucuaaaauauaacuauauuuguaguaaaaauuaagucaauuuauugauuauuuuggugaaaauuacuguuuucuucgucuuugucuuacauaacaauaaugacuaaaauauuuaaaaguacauuuaguauuugcacuuuuagucaugcuauuauauuucuugcuauuuuuaaaauauuuacuuguaacaacacuuuucugaauuuacaaauccuucugugauaaguucuuaagacuugauggguguuugcuguuuaucauuuacuauuuuagauucuuuauauuuugaaacucauuuaauccucaaaacagccuaaugaaguagauaugguauuauuuguguuuuuaaauagaauuauuuaacaugguagaacuauauguucuaaagaaaguuaaucacugcaaguauuuuuggguuggugacuccauuuauacaugguuagcauuaagcguugaacauugaggccuuaauauguuacuagucaucaugugagugcugagagucaaacagagguccucuggaagaggagccagugcucauggaaccaucucaccagcccuauccagucacaugucaguaguaccaucugaguaacaccaauuuagaaauucuagaaccaaaacauacauuugaaaguugaaaacacccagugugagcuuaacagaagcaaugacaauuggcaauggcagaaauauuaguugaccuaaagacagauaaauagaaaauauucagacugaggaaca

SEQ ID NO: 2577 - RNA, 1423 nt, Mus musculus
cguuccccgcggaccggccccggggugauucucccgggagucccugccuccucccgaacccaaagguccacggaauccccggcugauccauucgggagccucgcuuccggugccaccgagaguccccgcaccugccccgccaucucaggauuccaaguuugugcgccuugagccaggcgcaucuagcgcugcccagugucggugcaguauuuagcugcugguguuucugguguauuauuaguccuacucacuuccuccugguguuauggccccaguuuucugacaggacgacucugacagacucgggucuggggcaagccugcagauuaagcgauccugaugcgauuggcaaucagugagugugcuccccuucuuuggaaagcuguccucuggaaggaaccucuaaaccguagggggccacguguuugguaggcaaggucuuuccgcucuagaugcgggaauuuucccgggcucaugcaaugagacagaagccggucuuugaacagaguccaccccagccuugucuuccuuugugcacacucauucuccuugcggaccuugcuucuguaagucaaaagacccaaaccccuucucacgaacucuguuuuucuaggaagccaagaacaagauagagguuuugcugcuguuaaguuguaugaauuccuuaauaucuuggauagcaaccuuuauauuugauuuguaagcuaaauuuucaucuaguucauguuuuuuuuuuuucaguuuaccauaaucacacguacuuuuuuuuuuuuuuggugguaauucucugugaauuugguguuauauguuuaagggggaaaaaaagcaucaguuuuggugaaguuucuucucaccuuuuucuuauaggaguuuuauagcuucagauauuaaauuuuagugguuaacccauuuuuacuugauauuucuguauguauaaaggaaggguccaguuccauucuucugcauguuuacccaacaugagugguguuaaaaauauuaugucauggaucucugugacuuccaggcaaguuccaggacagcagcuacauagagaaacccugucugggggaggggggaagggaauaaaaauaaacaaacaaauaaauuguguguguguguguguagccuuugaauuuaucagugauuaguuaaugacauaguuuauuaauuagguguuuuuaugacaauaccacacugucuuauuaaaucaaaauaucaguaagacaguaccacaggaauauacaugcaugugcacauaaaauaucaguaaaguacauguagcaaguccugacaaaugaacguagaaauaggaaauagaagaacacuguuuagacacuuuaauauccuaguguugauaauggacagaacaacuaagcagaagagaaaaacaaaacaaaacacagaagacacgaacucuauuguc

SEQ ID NO: 2578 - RNA, 44194 nt, Mus musculus
cucucguuugcgaggugggagcugagccacacacugcgcaugcuccagccgcggcgcccccgacuccgcacucggcuggguucgggcauuuccgccucuuuguuuuaaacucugcacggcuuuuuucuccuccucuugggggggacccagagggagcggcgcccccucccccucccggcgagcccccgcgugcgcccgcucgcccgccgcccgagacgcaggucagugagcccgccccgccuggccuggcccgcgcgcccgcuccucaggccgcgggccucggcccaugggcggcagaaggcugcgagcccagcgcccccggcaggcccgggaggcgggacccuaaaagccugcgagaaggccaggacuucucgcaggucuggaccccgggagggcagaacccagggccaugcuggaucccggaacaaucuggacccagggaggacagggaccuuggaccagacagaacccggggaagagccugcacaaggcuggacccuugaccaggcuagaccggggugggcagaauccuagaccaggcagaacagcagccgagguggauuccgagcagucuggaccccgagaaaacaggaccuagggaagacaaggagcucaguccggcuagaccuggcaccaggcacgauuccagagaacaggaccccggaagaacaggagucugggccaggcuggauccagggggaucaggaccgcagaccaggcaggacccaggaccaggccagaauuacugagggcuacucacugaacaguccuuaggacugggcagcucucccauaguucugggaccccaggacagguggagccccgacucuuggaauggacacuugggggagggucaguauuagagaccugacaagagucuagaaaaggucauugaggaagaauggcucccaggaccuggcaggacuuagaaaauggcagaaucacuuagaugggccaacuaaugauagauuacagaggaggguuaagacccugagaccaccccacagagggccagggugcugggacaaggccauaggaaggucagaucucccagggacaaaucggcuguagagagcugggaaaucaaggcuggcucaaaggaaucuggaccacuguggcaguccuuugagcaguuugaggcccugagggugaacugugaggagaguucagaauauagauaggcuucaggacaaacaggaccaaaggugggucccuuuaaaaugaaagccuuggagcugaaccgugaggaugguccucagggauuacuuagauaauaguuggaacuuuaaggcagggagggccuaggacucuaguaauugacccccgaacucugcugaaaagacuacuaggcauugggagguuucgaucagcccagccacagggaaccuuugcuaugaagugcuuacacuccccacagguccccuagcuucuugauguuacagagugggugaggcucucagcacaguugcaaggcaaaguuggagcucagcugggcuccaaggacucagguaucaagggcaugcccugugcuugcugcuucaugccccaagccuccaaguugccuuucgucuggucuccccagcuccuacaggacugugccuuucccuagucuugaccccaggucaguggcuguaccuucacccuccuuccuccucucccagcaggucuugagggugugguguagagaggcuagaggcuagguguccaguggggaggaggccuuccaggaauagguaggaaggugagggcagugagcagagaggacugagggccuuuugaauagaugaacaccuagcacccacacuccuguuucucuccuagaaaggaaagaguuuuuguuucucugaaaucuucccagccagucugucauggagaacacaauauuuguggaaaagugagauguguuuuuacuguugugggagacacuagggcagguacugagauguucacugaaaaccugauauguuucaagauaagaaagcaaggcauucuagaguggccuagcucccacacagaccuggguggucaacaauggcuguguugcucuguggaaguucugcucugucaggcugcacuuaaaagugcuggagacagggugagagcaaacucugggcuguuuggauuccuaagagauauuugagcuggccaguucuauguuucauuuugagccacaucacgguuugguuucucagggaaaaacaagucuagguuucuuagcaugggugucaacugaguuguguucaaaguggaaaguuguuauuugccaaguguccucacacuugggaaucuuguaccgagcgcuuaccucugauuuuuuucuuugcugugcccuuuauuguauuuugcugugugaaauguuagacaagaacugagcauuuguuuagguuugauggugaucuucaauuuccuaugcuuggauuucugaacauagaaugguauugaaggguuauauuauuuauauguugcuauauaacaagcuaccuuagaauguagugcccuaagauaccuaagauauugguucugcuagaaggugacgagcccaggccugacuuuucagguuuccuggccagguuccuuggucaggguacuaguuaggucaguagaagguggaucaggcucugcaguauugcugucagccaggcacuuagcaaguuuuaaguaucauguggcccauacccuagaaaauuucauaaacaaauuaagaguuauguguagaugcaaacaugaucucucacaacuguaaucccagcucuugggagcugagacaguuucagugaguuugaguuugaagcaaaccugcacuacaguagugaauuccagaccgauuuggccuauagaguuagauucuaucucagaaaauuguuguauguagaaugguguguuagaauaaggccucuaaauaagguauauaagguuccuuugauguuacuauaaaaguucagaugauuguaaugcaugcauguauaccauuuaagaggcaucugcuauaaaagaaaagguuccugguaguuaacuuacuauuuggaaugcucuggcaagcagaccccuguggauaaagugggguggauauaggagcauagcaucuaaccucugagugaggguuuuccaguauucucagagccuuggcaaguuauucugaaagaaauuauaagccaacccucuagauuuucuuaaccaucuuaaauaauauggagaaagugucuuuucugauacauuaggucucaugcacuagguuauaagugacuuucaaaauaguaagaugugagguucugaaaaaguugggauuucuguuccuugugggaauacuaugcucagagaccugcagacaggagcccuuucucccagcccaggucugggguagggguggaauacuaaucagaguacuuauccaaggucguucuggauacucuugucccugauggccacuucccugucauugcuggacuuugggagguuccaccucagguuugcaaggucacacucacuagaaucauuuguguuuuaaaacaagauuuguuugggucuguguuauucuuuaauuaccuuuuaugguuugcugccuuguuuguuugauguucaaaauuggauuuaaaguugaagauguaauuuuuuuuuacuuaggaaauacauugagguugaaggucaguuuccuguugucuguuguuacccucacaaucucacugcucauaauggaaggaugcugcaaguacauuaugcuucaaaaacuggaacuauucauuaguucugugaguugauuaucauaaaauuuagcuagacauaguaauauaggcccauaauccuugcuauugcucgagaggcugaaacaagaucauuagagcucagaaauuagagaccagccuggguaacauagugugacccugcuucaaaaaaacaaacuaauuagucaaucacaaagauagaugaacccuuuaaaaaauaagaaaacauucuuuucucugccacauaccuucucucguagccaaaaggauagggaagggguaguaauaagcacaagccacuuuuguuguuguagacuacccacugaaucgagcaaacucccacuugcugauaggagcaguacuugcuggaggugcugucuccaucagcuguugggaguguguuguauuaaagauaaauucuacagugguuaguuggaccucaagaacggagauuaauugcacuuuuucugaaaguucauugacuuucaaaguguccuuacuuaagggcuuuuacuuuuuuuuuuuuuuuuucuuugagacaggguuucucuguguagcucuggcuguccuggaacucacuuuauagaccaggcuggccuugaacucagaaauccgccugccucugccuccugagugaagggcuuuuacuuuuuaaaaaauuuauaauuauguguguguuucugaauacagaaacccugaacacaucugggcguuagaagauaacuuuguggagucuuguuuucuguuaucuucuuuacguggguuccaggaauugaacuuaugucaucaggcuugguggcaaguaccuuuacacccugagccauuuuaccagccaccuuuugcuuuuuuaucuuaagugcuuaccaaaguaaacaacaacaaacucaaacagaaaauccuaauggagcacaaaagcaagaauuguuaugagugggcaucugcuauggucccaauguuuucauuccuccccccagaauuugagguugaaauccuacucaaagaugacugcaugacaagugaacuuucuauggaggaggcucuguccucaaagacagaauaagcgccuuaucaaaagucuugagagcucuuccauucucucugccccagaggacuuggcacggggguuaggucugaacaagccagucugcugugacacagaugucaguccugaggaguaaacuuggguugccuauaagccuuuuguuuguugugggugcuuugugacagcagccugcaguuuagaacagggcccccaugcccacuugcaggacacaguuuucuauugauaguaucuuuaucuuucauaccgcuuuugucauugaaguaucaaagaguaacuucagaugguagggccaccucuugcaggaaaugaggagaaacacccagcuuaaagcagaccuggcuuccaccccacagccccugcagggugguggggccuggcauaucccacaaauaguuacuuccaggaucuuacaguugucauaaggaagguucuuauaguguuuuucugaauagaucccuagggucuagugcuagguuaguucccauccugauauaacccagggaagucuggagcuguguugcuaugccuuguccugacacucaaagaggucuagcauuagauugaugucuguuccuauacacucaggaauucugguguugaguuuucuguccuucugacauccucagggugguagacuuuggaguaaaacauuucagguuggaguauuucugcuuagggacauauaucaguaacccauggucauaauacuuguggugaguugcuagugacuuauuccccugcuggcugguuuuguaaggugaaaugccuuaacacagucagccaaagacaaggcauguuaaugaggucauagaucuggauaggcucuguccucagcaucaguguuuggugacacauuggagauuaugcuuacccccaaggccuaugguuguggauaaagacugauaguauaagcacuucuauccaggugaguaccagaucauaggaagucauaguuucagcacaaauugaguggcauauaacugugggugucucagaggguacagcguucaaucucagcacaaagcugggaagguucuaauuuguguaggaaacugucuaccugccaagggcuagcuacacccuauugagugaaggauaaugaauauuccaucuguuaaauaugggaggaaccucugcaagacuuccacagauauugggaaguucugcaagaaacuggaguggcaaggaaggcaggcaagaagacaguagacguuacuuggauguaggagcuauaccagugguaacaaucggcuaccacagaagggucagcacagaagaaaagaggucuguuaacacagagcacacugaacagcaaguuguaggcagucacagagcagaaagagguccccuuugaaaugagaugggaagacaguuggcagccucugaacguuuguaacugccuuauuuggaaaagacucguuuuuuauguuuuuuuaauuguuagaaacuauuuauauugauaaaguuacuaucuucauuaauauguauuaggccuggacuguuuaggagacuaguuuggaaucugaucagaucaguggugccuaagacauagaucugaugcugucuccaccuagaucuuaucccuaggagaguggcuuguguuacugauuaaugaggacaccuuccuucccugcucucucccuuccuuuuguuuuuucagguagggucuuuuguaacccaggguggucuuaggcucuuauagcuaaggaugaccuugagccuauggucuuccugccuacaccucccaaguccugcgauuaaagauuuguaccaccaugccuggcucuaugggguacuuuuaccaccugagguaucucuagccaguuuuuccaucuuaauauacuuaaauuuuuuuuaacuuauuuuuuaguguuugcauuugugugggcaugcuaaagcacauguguggggguuggaagacagcuuuugagaauugguuuuucuugggcuggagaggugguuaagaguacugacugcucuucuagagguccugaguucaauuuucagcaaccacaugguggcucacaaccaucuguaaugggaucagaugcccucuucuggugugucccaagagagugacaguguacucacauacauuaaauaaauaaauaaauaaauaaauaaaucagaauuguuuuucuccugcaauguagguccuaaagaucaaguucaugccauccaggcuuggcagcaggcguauguaguucuuuauguguaguucuuuauauguaguucuuaugggccauguuuuucagcuuuaauuaucauccaaauuucugcauaucacaaagcugagauaaauugagauucuguggcaacuaggucuuaacuaaaguuagggcauaagaaccccagcucuguggagguuguuggguggacucuacaagcuaggcuaugugcugagugggaagacguguucugggcccaggccugucauaguagggacucuauucuacuuguuuguagaaauaugaauccccuguacucccauccccuauucauaagugugcacauggcaugucugucuuugguaauguagcacacugcucccacucuccuguagaugaagacuagugacaaccucuuugccagccugccugccugccagccuguauaguaguuucuaucccacugcuguuaugguuugccauguccacaugcuugucugcucuuguaaccacagaugugaugaugugcaguguaacgagcaacaaaaguaggcgaugcuaugccuuuaaucccagcacucgggaggcagaggcaggcagauuucugaguuugaggucagccuggucuacagagugaguuccaggacagccagagcuacacggagaaaccuugucucaaaaaacaaacaaacaaacaaacaaaaacaaaaacaaaaaaauaggcgauucuuagaagauuuggagaggacaccaggcuggccauuuggccauauggauaugguagagguucugagacuuagcugucuugagugcuggagccuucagaaaagaguuuggcaggguguauguguugccuuuaccacagaaugucagccuuuccccuuaaugcaucauggcacuuggugcauggcccacugcucaccagcacacuccacugucuccaaguaagucucacugggucuuuaauuuauacuuccuguuuaguaauaaaguugaucagaugaaauucacuuaauuuggguuuucuccuuagugauuuucuuuucaucaccuagagcagaagugggcaaaguuucucucuaaaaacccaaguaguauuuuggacguggcuggcccugugacguaagcagagcagcaacaccaccaucuugagagcuuugaauuugccaagccuuggucccauuauaauucuaauguguuguagauaugugcuucucaguucauaacagucacauaacucagugauguaguuaauuagaaaaaggcaugaauaccccugaccuacucagcaugugaauguggcaucacauacucuguugaauguuagcuuccuuaggggauuaugaauaggugugauccagugucacccuaccacuaggaguaugucugucacuuaguuuuaaaauauaaauagcuuuuuucaucauuuugcuguauaguagggacucaaguccucuuccagaaacccacgggcugcucuugcuggccagcccauagcaggcaguucacccuucuggaauuuuauaucccaugagaaugacgcuguuauguuccuugugggcaguuuucuucuccuauaaggagcccugcacagcuggaagcacccguuuuccuaacugccgaggaacagcuguugugugagggccuguuuucucaugggcugccagcugaugggcaucccaguccccuccguuugagacugugcauggagcuguaauuguucacuucugaguucuugagcagucauguuaguguuuccuuuaauaggguuauuuccuuacaguuguuuaggauuucugaaaauaucguugggugauuuaucaaaucauuuuuacgugucuuugagaagaguauacguuguucuaccuuuacuuuuugguguacgggauguuuuuccuacuguauuccugggagaggccuaacgugguccugagugacucucccuuugcauagugguugauaagguggcugaugcucagcuuagggucagggcaggucuguuaguuuccuuccagaucuugucuuguuagaguuugcuguauggcuaguaguuaguuucauaaaggggguuagagaucccuucuuugguuguacaugaugguacugggacucugaacucaggaccugguacaggauagacaaagcguguuccagcucuaaauacuuuuaccagcuggaaggguaauuugcucucagauaugguaggcuuacagagcuaguguuuuaauuuaggaaauuuuugugacuacuuaaucaguucccauaguagagaauaaggguuuuccuuacuagucucaauuuaguuuuucccuccuagggauuuauccauuucauacaaugucaguaaaaaaaaaaaaaaaaaaaaaaaaauguaaacaagguauggcacacaacuucagucccagcacuggaguuaaauacuauuagaaagccagguguaguggcuuauacuuauaagcccaacacuugagaggcuaaagcaagagaaucacugaaacuugaaagucagccuuggguccacagggaguuuuaggacaagacuacauaauggaacccuauuucaaagcagugauugauacacucugguucuucugucacaggagccaccaaguuucaagggacaggaauuucaagugguuguguccuccauucuaggcagggacuaguuuaagacagaccuggccuugaguugacuuccccucuuccucuaaauguuucagacauguaugucaguccucccuugguuuaucugguaggacauauuaacuccuuucuaucuucccauuucccuuccugauuuuguacaaggcuccugaguggguuuauuagucaguaagcaaaugcaguucugaggcuggagagaaggccuagugguuaagagugcacacuuguucuucucccagggucccgaguuccuuucuuagcacccaucaagcaguucauaacugccuguaacaucagcuucaggagauccaauucccucuucuggcaccuaugcacacauuuacauacauucccacagagagacaaacaggcagacagacaaaaaauucuuaaaaauuaaguuuggaaaguuuuuuaaaggugaaauuaucugaguugcauuuaagcacauguuaggguacaccaccuccagauuguauguaauuaguccuuaaacuacaaagaccugcagucuugguauuguucuaguuaagacucuaagcaccuuacugagcucuuagccagcaaugccugcucccaccccugaagucaagggcaguaccaaggaauccacagccaggauccuagggacccucagagcaccguagucaucaguauaucaggauuucucuagcugcugcccaucuccauauccuggcaugaauaccuggcucauuucccuuagcccacuggcccuagcaugguacagugcccacacaggcccagggcauauucacugaguggguggcaagucugugacuaggagagauaauggcuuagucugggugugaggauguagacaucucagguaucaaacuaagugagcagcacagugcugcuugucauccuugugagguuccucaggucaccccgagauccacugauacacuccugagauacauggagcuucuacagauacccauccugccucucgggcucuaaagcaaggaguggagccaccuucucuuucccuuauaccauuagcuaugcauuugcucuccauuaggccagggcucaggaaaucugggaggugucuccgcugaggugucuuuacuaucauucucacuugaugacuuacagcaaguaaauaagcagacauguuuaaccaaacaguccuugagaguugcuaggggguagagggugagacaagaucuucccauggugacaccugucucugcuucuccacagacuucacaauguagccccgauuccagacugucauucacagguaagugcagcugaagcuuaccuuccuuucuggcugccugucacucaauaugguggcuaccucauauucccuugacauuuguucucuagcagcuaucauuggaauuauuuguacuucuugauugucuuccagcauuucugguggguucugucccaugauuuaauauguagaacuuaucuaaaauguaguagggguuuaaugugggacugugugcaggacugguaucugugcuuugaaguaaguaacagugcuaucuuugugcuagaaaauggaaaaggaacaagggacagaaggaaggugcagaagccagccagaacucagagugaggagggaucaucgcauccacuugguggccugaagccuccaugccaccgagugaggaaggacacgcagacauccagaggaggugagggcagggauucuuccaagggucccugccaucuaggggagggaggucugggcucugucucaggagugaagaauuuagcccucuuuauacucuguacauacucucuagaguaccauuaguuuaaggugggauaggugucuaguauugaucggucaguugccuaggagaggugcaugguuagaagugguacuaugaucaggauggacuuuguuggggcuagugggccaugucuguucagcucugaguauagugccuaacaggcaguuggugagccuggagcaaagcaauaucuagguggugacuuggugauggacaucucauaaauugguuuccucgggcauugaguggacauuuaacuguucccucucacaaaaaguacaaagaugaggaugacuaaauuccugaagugggacuggacccagauaucaaaggccauaugcuagauucaugucaaaguaacuggugauuagguuggagccacaggaccuuaucuaaccuucuuuggggcucuguaucuucuugguagacacuguaguggcuguuggcagugccuugaguugagguucgaacuucacuaaccauugaggucugaggugggucacuauucagugauaggauaagaugagaugggaugggccauuuguccaacaaaaaggcuggauguaguaguccaucuacuacaucuguggguggaguaaaggcaaaguaggaaaggagccuaccuagagaaagagaacaaauagagagagggagagagagagaaaaggaggaggaaggggaggaggaagaggaagaggaggagagacuggaauucauuacaggcuauauaguuuagcuaguucaacaauggcugccucccaacagaaaguccaagaauccaguaguuguuuauagcccguggggcuggauggcucugcuggccaucaguauacacugacaucccaaagaaguagacuccaaugccagugaagggacaaauuugccagagagagcaagcagacaaagagcaagcuucuuucuuccacgucuuuuuguggcccagaguaauuuuccugucucaaaagauauagauuaaagguauaucuucccaccucaaaagaaccagauuaaaacugugucuucucacuucaaaugauuuaauuaagaaaaaaccaaaguacucagaguucuaucucagccacuuggguuuuauuuaauuccagaugugguuaguuuggcagcccagaucagucaucacaguuaccuccauguauuuauuuuucuugcagaagccaaagauguugaccaggaagauuaaacucugggauauaaaugcccacaucaccugccgccugugcagcggcuaccucauugacgcaaccacagugacugaguguuugcacacauguaaguauggccaguucuaccgugaucugaaugggguggggguugcucuagcacauuccuuagggccuuagccuggcacaugggcaacagggccaagagaagaacaaagaucuugaguggggaucagaaagcuuuccauaacuagggauguuguggguaacuucuggagggugguuucuccucucaggaaagcugagcagaggaaaacuacucuuuuuuuguuguuggucugucagucaagccggccacgaguggugcuugugcucucagaucucaagucaagucgguuuuuuuuuuuuuaacagucaaacaccugugagaugucaagggucagugcggugccuguugcauguuacuuauucugccuaucaggccuggaccgaucuaugcaggauguuuuuuguuguuuuagguuuuguuuucuuuuguuuuuuaaucuuugaguggccuguguguauguauauacuccucguacuugcagugcuugcagaagccagaagguguuggauccuguggaacuagaguugcaaacagcugugaaccaucaugugggugcuagaaaccaaaccuaggcccuccguagcagcaccuaagugcucuuaaccaccgagccauuucuccagccuccuaagauuuuuuuuuucuuauuuuuucucucucacuggaagacagauguucuguauggaucaccuggaggcgugagugcuguaaaaagagcaucuaaugaccacugagagguaguucaugaaguuaaaaacucacaacacauacaauuuccauccuauauguuuuacauuuuugaaaaugcuuucaacuuuugaagaauuuuugggcugagauuaauuguguuaggaauugguggcacaguuuugcuuucgccaguccacugaauguuaccuagcuuugaugugcaaggaacuguuguuaucuuuuaggccaaaaugcagauuuuuaaaauauuacuuauauucucaugcucuugccccuuagugacuuaaccacucuuugauguuuuuuuuuuaguuccuagguauauuaguuccuaggcuaggacuguguaacagaugguaauggcacagcgcaauccaagggcacucccuuuucagagguuguuuaugaaaguguccucuuagucaucuuggaguuggcugcacuaaccagaacuuuucuucuggguugcugucauccucuccccuuggauagucugcaggagcugccuggugaaguaucuggaggagaauaauaccugccccaccugcaggaucgugauccaucagagccacccauuacaguauaucgggugaguaagaacaugggcuggagcucccugaccaugguccauacauuugcaugguauuggcugccuuguucuugguccccagauaccacacugcaggugaccagggccauggcaguggauauccagcagcacuucccugggggaccaugagaacaaguggaaucuuauaaguuuucuuaaacugaaauuuugaagugaaugagaucccagaccugccuuuuuuagaguaguaacuugccucuaggcuggaacuuuagccaaagaagcaagggcauggaaguggaauuucugaguucaagagccacugggaaggaaaugaaaucacagauacauaugguaugagggcaucagagaaaagauaaacuaaaagaaagagaugcacagcuugaagucacauguccagcugggagcaguagcaguucaaguugaguugucggaccuuggaguccccccccccccccccaggccuccagauaacacugccaaugccacaguuucuauuuccuguguugaaaugagaguguguuuucuguguuccuaacuuuauugucaagucaucucuucacacaaucucuguauaaggccuguguggugggcauguggaaaugucuagcagcucuugguguuuaguacuauccagaguccuugccaguguccugucuguggaguggguggaugacaucugauuuagggaacuucuguccauauucccauuccccaaguuccugugcucuguguucuggucagugcuguauggugguagguuuuuaauucugucaccauggugucucuaggcacaccucagcccaccaccauaguuaugccuaagcuuugugcuuucccauacaucagcucucuguugggacuuucuugugauaccaccugucuuagagcucuguucugcuuuuucuguccucgugugcuucauaacagcauaagcugugccaccugcuuucauucuggcaugcacuucuguagagcucagaagcagguccccauuugagcugcugacgggguggugaggaggcuuccuuggggcugggaaugggaggcagaacacaaaagagcugucuugugggcagauccucucauagaagcuuagauugccaugcaaacacaggagagaaccgggagaggaacacagcagugggccaggcauuaauuagauaaguaaaggaagcaggguggcaucuuggccugagugcugugacuuacauuaugagcuggguagcagcuauugccugccauauaccuuugaccugagagaggcucuuagcaucuaugguuuaauugauagaggguuuuguguaaccuugagcuucucauccuccugcuuuuacacaaaugcugagaauauaaguguguucuauugcaccccauuuauggaaugcuggggaucaaacaaggagcuuugugaaugcaggcaagcauucugccgauugagcuauagcuccaacguucuuagcccaucucucacuggcagugucugggugccaucugaaauagucuaggguuguaccugugcuggugccauccucugcucugcuccugacuuggcuucaucugcccucaccucuugccugauucucuacuugcagaguauggugagcaccuguaggcgcuuugguauuauguaaagggguuuauuggcuucaguuuaauuuccggauuuaguguggaagauugggcagccaggacuagcagagauggucuaagccugugguagagaccuugcagagaauguugaaaaugccacugucagccuggagugugagcauguucauuuugaagaagcagauccauuuugagaaccuuucacucaagaaguucccuguguuaugugugccacuuacacacauuuccuagcccucuuacugggcucccaagguagacagagccuggugucauugccugguacccaaguguugggaguucuggucuugaccugugaguuccaacaaaagcuaggugggcgugguaguugucaaggucaucaaaugcauggaggguccugucauaguuuucuucucuguugccgugauaagacacuaacugaaaccagucuuggggaggagaggguuuguuuggcuuauacuuccaggucucauuucaucgcuguaagaaucagggcaggaacugaagcagaaccauagagaaaggcgcuuacuggcuuaaucuccauggccuggucacccugguuucucauacaaguuuugaucaccugcuuagggcugacauugcauacaguagguuaggcucuccaauauccgucacuaagaccccaccccaacccauggccacagacccagucuaaugggggcaguuccucaauugagggucccuuuucccagacuauccuaguuugugccaaguuggcaaaaaccagucagcacaagcuccagucuacaaaguccaaauuugcaccugagugcgugcauccuggucuagguguggaccaucuuccuuuguguggauagaggcaaggaggauuagagcucuauaugacucucauacaauauguagucgggccucauagccaagaguuugcagaaguuggugcaugcugugagugacguuaaauggcugcaguuacacuaggacuugccugugacuaagcccagguuggcuagauuccuguguauuuguugaaguguaaucauugguuccuggauucauauaggcuuauagaguaaggauuagaauuuaaaaucuuucgaaaauuaagaaauucucuaacacuuuuaucaagaauauaauuauauaauugacauaauuauacugaaugcuuaaaaguagcaaacuauaauaggaccauauguagauaaaguaguucugcacuuuuguguuugccuguguccaacaaguugagccuaacccuuuguccaacauacuagggaucagggcacuguucccagcaugaccuucucaucccaaauagcuggaaccuaaauuaaaugaugcaucaauucaaauccuagauauauuuuaguacauguuuuucauugcaugcuagaaggaaaauccaaccuugaguuguuaaauauguaaguaacuauaguauuuacauugguugaugcccccacuucucuuuugcagucaugacagaaccaugcaggacauuguuuacaagcuggugccaggccuccaggaaggugaguugaaacgcugcucagcuugagcucauagcugggguuuugccucuuggaccuagacccuuucccacgugucuuaguucuagauucuccauugucuuccugugauacauaggcuguguaagucuuaagaaacaaccagggcuggugagauggcucaguggguaagagcacccgacugcucuuccgaaggucaggaguucaaaucccagcaaccacaugguggcucacaaccauccauaacaagaucugacuccuucuucuggagugucugaggacagcuacaguauacuuacauauaauaaauaaauaaauauuaaaaaaaaaaagaaacaaccaagaauagcuugagauaaaacgcugagaucuucagaagcauucacaauagaauuguauaagcauauagccaaguacaaugauuuugcuaauuuuguauccuacuacuuugcucaaagugucagcuguaggaguuucugggaagaacuuuuaaggucaguuauguauauuaucauaucaucugcaaauaagaauuguugacuucuuuccuuguuuguauccccuugaucuccuucaguuaucuaaaugcucuagcuaagacuucccgcacaauauugacuaggcauggagagaacagacagccuugucuuauuccugauuuuaguagaaauguuuugaguuucucuccauuuagguugacauuggcugagggcuugcuauaaaucaccucuuuuauguuuggaugugucccuuguaucccuagacucaggacuuuuaucaugaaaggguauuggguuuugccaaaagccuuuucugcaucuacugagaugaucgugugguuuguguugaacauuccuguaccccucugggaugaagccugcuugaucgugguguaugguccuuuugauagguuuuugaauuugguuugcagguauuuuauugagaaacuugcauguucauaagggaagcuggucuguaauauucuuuauugguuuacauaucuggguaacuguagccucauaaauuugaagagaguauugguguuaacucuuccuugaaagucugguagaauuuugugcuaaaacaguuuggcccugugauuuugggggggaggggggcacgcagagauuuuaaugacugcauuuauuacaacaugguuuauauguuuguuuaaacuaucuggucuugauuugacuuugauagaugguauauaucaggaaaauuauccuauuaaauuuuuuuccaauuugguagaguauaaauuuuuaaaguauguccugugguucucugcauuuccuuggcuuuuguuguuaugccccacuuuuuauaucuaauuuuguuaauuugaaaugucucucucugccuuuuaguuaauuugaccaaggguuugacaaagaacuaacuccuuguuucauuuuuuuuuuuguacuguauuuuuguuuuuauuuuauugauuucaagccugaguuugauuauuucuugccaucuacuccuuuuggauauuauuccuucuuguucuagagcuucugcguaugccauuauguuaauaauauggaaucucuccaauuuuuuaauauagucgcuuagugcuauagacuugccucuuaaaauugccuuuauuguaucccauaaguuuggguauguuguauuuucauuuucacucuauucugaaauguuuuuaauuucugucuuggcccauuuuucauucaguagugaguuguugaguuuccaugaguuuguaaacucucugcuguuuccguuguagugacacccagcuuuaauccauggucagauaggaugccagaggguuauuucaguuuucuuguaucuguugaaacuugcuuuguguccaaauacguggucauuuuuagagguacuguguuugggugaaauguucuguaaauaucuguuaggucuguuugauuuuuaaaguuguuagcuugagugcaucuguuuaguuuuucucuggaugaccccucucuuggugagauuaagguauugaaauuacucauucucacugugagggucaguauaugauuuuaguuguugucauguuucuuucaugaacuuugccuuguuuuaucacauagauguuaagaacuguaauaucuucuuggaggacuuuuccuuggagucuauauaauucuucucugucucucuggauuaguuucgguuugaagucuguuuuauuggcuacauuggcuuguuuucuuggauccauuugcuuggaaucuucucauccuuuacccugagcugucugucugucugucugucugucuuugauguuaagcuauauuucuuggaugcagcaaaaggagugguccugcuuuuuucuuuuucuuuuuuuuuuuuuuuuuaaccuggucuguucaucugugucuuuauugggggaauugaagccauugauguugagaguuauuaaugagcaguguucauugauuccuguuauuuuguuguaguauagguugggggucuccccucccccccauuugauggucugagauuauauuuauauauauauauauauauauauuuuuuuuuuuuuucgagacaggguuucucuauagccaacucacuuuguagaccaggcuggccuugaacucagagauccaccugccucugccucccgagugcugggauuaaaggcaugugccaccacgcccggcuugagauuuuauauucuuuaugcuuucuuuggugugguuaacuucuucagguugaaaguuuuucuagugucuucugaagagcuggguuuauagaugauacaugcugcuuaaauuugguuuuauuguggaaugucuuucuugugauuguauuauuucuugugacuuaaaguuuugcuggauauuguagugugucuagucucuuaagaguuuguagaacaucuguccgagucuugcuggcuuuuagauucucuguugaauagucagguguuauucuagugguucugucuuuauaugucucuuuucccuuguagcuuuuuauauucuuucuuuguucuguauguuuaguauuuugauuauuguaugucauggaaaauuucucuucucauccagucuauuugauguucuguaugcuucuuuugccuccuucuuuagguuaagaaaaauuucuucuaugauuuuguugaaacuauuuucugugccuuugcccuggguuuccucuccuucuucuguuccuauuauauguagauuuggucuuuucauggcaucccagacuuccuggauguuuugugccuggaauuuuuuucaguuuaaauuuucuuuggccaagguauccauuucuucuaucuugucuucagugcaugagguucucucuuccgucucuuauagucuguuggugagguuugccuuugagguuccuguuuauaaauuuuucauuuccagcucccucaguuuggauuuucuuuuuucugcucucaugucuuaaacaguuuucuucauuucauucuaccauuugacuguauugucauagauuucauuaauagauuuauucauaucuuuaagauuguugagcauauucauaaaggcuauuuugaaauccuugugugugcuucagcauugcuccaggccuacuauaguagggugggugggcuuuaguggagacacauugucccacuauggauuaaagcugggcaagaacaauagaaacaauggagaguuuacaaacucauggaaacugcauaacucauuacugaaugaaaaaaauaagucaagcuagaaauuauuguuuuuaugcuuaugucuaggugcuagguguaucuggauuuggaauaauuguaauuuuagguguuggcaucuagucuuuguugaauggauuuuccauuucauucauucauucauucauucauucauucaguuucuguuucucucuguagaucuuaagggugugugugguuguggguuuucugguagggagugcuucugagacccugccaggugugaucacugggggucccuggguagaacuuguaaguggggaugggccaaaagggagggagcggcugagagggugcacaggaggaaggcugggucuaccaugaggagcuguaggcuccacagugaaugggagaagagaggaagacaugccccugcagguguucugcuacaggcuuggggaugagacugcagaauuggaauuggagggugccagggagagugaagauugccugccuguuucucuggccagcauagccuguggguuuccagggaaaagcugccucaaguguuggccagugagacaaagagauggagugagaaacugaaguaauaacuuuuaacuacaguugaagaagugccccccccaaaaggauuugauuuuucuuaucaguaggcuuucauuacaaagaacauacuucguugucauuacuguauuuugauugaugaguguucuguggcugaacuguagagccccagucuaucuccagucccuuguuacuaaauuuugaauuucaucuacaguaaguuguggaaauuuguucucucuuguuacugagcuggaaucagcauuucaguuuugcccuugggucacagagcuuuagguuugcuuugcuucuuuacauagaaaaccuauagcagccggagcuugaugcugaguggggcugguguucguagaaucugguuugcugguggugaguguaacucagccuuuccccauggguugcacccacugugggcccagcagacacaccuaauucagguugacucaauuggcagaguguugucacugggaaugguagagccggagccaguugugcucuauagucugucucuuccauaauccacaucauggcacauucuccuugccacugcacugcaccguuuacagcgguugcguaagauuccguggggugagugacccugcucuggucccaaggugcaccuguuggauuuacucugccuguugauuuuggacaaugcugaaauauucauggccucuguaggaauaucugcuggacagaggagacccacguacuaaagaccacacuuaaauggcucagcuccaaguguggucaugcagcaguuaaguuguuugugauucuucaguuuacaaguaagauauccuuacacauggaucugcuugccuuuagaauagauuacuaacaauggcuaaauucuaauguauuuuagauauauuuagauguauaaugcccaaacaauuccaauuaauguuucuguaucuguuuguuucuuuguuuuaguggguuuuuguuuguuuguuuguuuguuuguuuguuugauagggucuaacuauccagcuuuggcuggccuugaacucauugaguccaccuguaucagccuuccaagugcugggauuaauaggccugugccaacaugcuuggcaguguuucugugccuguauauaccuaauauugggcacauuagacuuuuuuucugugacaaacaaccgagagaagugauuuugucauagaguuuuaggauugucauagaguuuuaggauuuuaaguccaugguccuuuggucccauuauuugggggucauagugaagcagaagaggaucauggaagguuauggcagagcaaaguugcuuacaucaugguggccaggaaacacaggaguaaaagcagacaagaaggccuaggagcaguuacucuccagaagcaugcaggaaccuacuuccuacaguuaggcccugccuucuacgccucccaggaaugucaucagaccguccuaggaaguuaggacucuccugaucuagucaccucccaagaacccgccccagaguuggcaaccuuaaacaugagccuucagaggacauuuaacucagccauauacugguggguuuuuguuuuuguuuuuauccuuuuuaauuaaugcuaagugagaguuaaggaaguaggcaguaaucguggugucagaagcugaguuauuucugccuuuggugaguuccuuauuauugaucucugggcuuuugguguucaggucacaguuguuuuugaggccacuuuggguggcuucccuuugucagaaacuguuccaugcucugguuugggggcugccuuccauacaauuguauaugggaaccucucuuucuccauuuauuuauuuuguguauguauguguacauguggggaugcaugugucuguguccugguauauggugcugugguuggauauauaagucaggggacaacuugcaggaaucaguucucuccuuccacuugugggucacaguaucaaacucagauugucaggcuugguggcaggcauuucuaaccacugaaucauuucucuggccaaacacaucuuuagcugauacuuuugccaucuucuugauugagcccuugcuucccuccacuguagaaggguccuguucugaccagauacacagcuuauacagccucauacuuguacgguuaggguuuguaaagcaucuguucaggcuagaugcuaggguucuaaggguuccaggucuuuaggaaaaacagauaagcagaugaaaaguuuaauaaggcuuggcacgauggcacaugcuuuuaaucucagcguucagaagacaaaagcaagaucucugugaguuggagacuagccugguuuacacagugaguuccaggccagcuaguuaacccugucucaaaaaaaaguaagauuuagaaaaguuuaacaaagcauuucuuguuucacuacauguaaaguaucuuuuacagaguaacuuacagauauuugguuugaauaaaucauuuuaagcuucccuugccauugguauaugcugagcaauggcaggaucugguacaugcauaucacuugggucugaauguuagucucauggauggggcuuuugcuguuuaagucagaagcuguuuucaucucuuguaauugauuauuuccucuaaguacaaggugucagcuuggucuacccagugaggguaugcugaccaucugaggacaggucaugcggcuuuguuggcuaaugaucccuaggaacacagugaucugaagcccuggguagcuucaugacuaggugucugccuucaagaauaaacuuucucuguagguuggagguuucuguuuccucuuuuucuugcauuucuuucauggccacuacugcccacagccacugggggcagucuucacucaguacaagacagacauggccacuggauacugcuguagucugugaugugaccaagugaccuuggcacacaaauacagguuuucgguacaugguuguucuggaucuguucuugucauucagguguaucucccacccucagccuagugagaacucuucuuuacuugauggcagcuugugaccaucauggcuacagggacagugggagcacucggcagcauguguagaugucuaagcugccugugccaaaaugguaugugggauauaggaguuuacuagcagccacauugucacugaugaugcaugaaaaguaucggagcccccuccucagggucugccauauucugaagaguuccucaaacugccucccuaggaucuguccuccuccaggugaugaauauccccauaccauccuagagggcugaaaagguuaggucagaguccugagcaguaucccuacagcucaagagccugucuuguugcaccaguucuucccaccuucuugaauauguucuugaauaucugcagcauggucauuaagguucccauccugacuugugcuuauuuucugacuaguagcguccuucagacccaucaucucaucugcuaguuucuucaugugauguuagugagcaguuuuacuauuuaaguccuuuccuacugaauauuaaaauugucuccauucuuaauagcggaaaugaggaaacagagggaauucuaucacaaacugggcauggagguaccaggugacaucaagggggaggcgugcucagcaaaacagcacuuagauccccgaaauggugaguaguugcaucaggccaccauacaauccagagguucauuuaucaagcuuucccuuacagaacacuuuaccuuaggugguuuucccagaaagggaccauuuucugaugguugcugaaaagguucuucaucagcccugguuaauggaccuguuaguuaagaguacaagagagggggcuggugagauggcucaguggguaagagcacccgacuguucuuccaaagguccagaguucaaaucccagcaaccacaugguggcucacaaccaucuguaacgagaucugacgcccucuucuggugugucugaagacagcuacaguguacuuacauguaauaaauaaaucuaaaaauaaauaaauaaaauaaaaugggacaauguauauguuaggcuuuuuuuaaaaaaaaaaaaaaaaaaaaaaaaaagaguacaagagagggggcuggagagauggcucagcggguaagagcacugacugcucuuccagagguccugaguucaauucccagcaaccacaugguggcucacaaccaucuguaauggggucugauacccucuucuggugugucugaagacagcuaccguguacucacauaaauaaaguaaauaaaucuuaaaaaaaaaaaaaaagaguacaagagauacuagaaaaugucuagggcucauguggaagagaacagaauuagacagagggccuaagaaaaaacaugguggauagucuuaagauaaacaucuagcuuuguuugcuuuauaauaaaaauccaaaugccaguuggauuugagcguaaaguuaauuggugcuuuuaagucaguauuuaauaaauuauucaaaucuuuaaguauuggcacuuugcuaguggaaccauauaaguuccugagaaauauuaagaucacccuguauaugcuuaacagucuaaggaaaguuggugccuaguucccagugggaaccagaccaggcugggugggaguugguaaggcagauggaaaggggaguauguguccugaguauguguccaaaaguaagguuccaugagccaggcuucuuagagaagcuaugguaagugcugaaugguccugggagcuuaucucugccguccuuaccaauuuuggucacuuucuccaucuucugagccccuuaagacacacuaaucuaaaaucuacugagugcccuaagacacauaauccaaaaccugccugacccagcuguagcuagagagccucaucccccagaguuccuuaguuccucagcaaacaugcagaaugguuuuaauugcuaucacugagcuccucguauguaugcuuucaguagaguaaaugucaacgucauuuuuaguauacugccagguuucacaaauauuauaauacgguguuuucacaugugcuuugcuuagccaaaaugcuugggccacaaguguuucugaauuggauuccccacccccuuccccauuucagaaaaguugcauuuaauauuuuaauucugcauuuuagaacaguuuccacuuauaccucagaaaguuuuauauacuagaacuuuugaauuuuggguuagagauauuucaaccuguacauuuucuguuugugcuaaaaggugaaaccaaagcagacgacaauucaaauaaagagacagcagaggagaagcaggaggaggacaaugacuaccacaggagugacgagcaggugaacacacguccucuguggauuuucuggcaucaguuuaucccguguuugcguacuucauuugaaaauguaacaugaucaaacaccauaacguuuuccuccuauuaacuccuuaacuuuucuuuauguuccuuucauuuauuuguuuuaauuaucagagcaacacaugcugacuguaaaacauuucaaaccuuguggacagaacuacaguccacaauuagguuauguuuuuuacagcccacugcaaauacucacuauuacuaccuucucugcugugcccccaagggaagugacccaucagcaaagugaagggaaauaagcaugcaauguugaagacaacccacaucucauuugcuacauuaucagguuaaaauauauagaaggaucugauacaauuccguaucccugucuauagaacuuccuaguguauugucugaguugucaguucuaauaguugugaugcuuuugaugaaacagggagcaaugaaaugccaugacuguggcugucacugugcuuagauguucucucccagcagcagggaaacaagugagacacguaacggggaacaaagaugcugucauuccuaggugaugcugucuuacauacagccuaagacaguccucugaaaauggcuuacucuguuccaugggugauuggaccagugcauguuuggaguauguaaagaaccagugcacgcuaccaccaagaaaacuuggcaugauuuccuuggaagagaaaguuccuuuccccagucugacuucagucaucaugcaaaaguugaccagaaauagucagucuacagcuuccuggaagaugaaugugcacgaguagccaacugcaaacugugaggugaucuuggcccuaccagaagaaacaguaacugagacagacaguauauucaggcauggaauuccucuggugagaagaccacuuugacugccucugugggcaacaagcacugcagccaucuuggaguggcccagugcucaucugcuaugcugauucugagccuuaguaacagaggugacacugucuguaggugccuugaacaacucucgagcaauacuccuccacccauaacccaccccugacuacacagaccccgccuugugggccacguaccuacuagccuuucuggaggaaucgagucccuugucacacucagcacuaugcuuuuggaagccacugggucucuggaccucgccuagccagcauugcuuaugucaguuuucuguagguuggcauagaauugcguuuucuuuguuuuacaguuaaaaaaaaaucccuguuguugacugcuguaaauguuugcuuuuuccuucuuauaccaugcuacuuauucaaguuauuaaggcauauauaaggagugaauuuuguuuuuguguuaguuuagccuuuggagcuaagcucuguguauguucuugaucucacacaggcuauguacuuccugugugccauggguguaaucccuggcccugacaaguugugcccugugacccuuuguucuggagaggcauuaaggccaucacccugccuuuuuagaugaguguuucucaaguguucaccugagcacccugguuuggcucuaguacuucuacuccuuucacuguugaucagaggauccugccugugcugaucucugcauggaguccaugcuucuccaguguccagguucuccuuugcuuuucuguugcugugauaacauaaccaaaagcaacuuagggaggaaggaguuuguaucauuuuucacuuuauggucuaucaucaagagaagcuaagauaggaucucaaggcaggaacgaaagcagagaccacaggggacccuugcuuguugacuuccuucccugacuugcuuguguagcuuucuuauacaacucaggaccaccaucucuggguaacacuguccacacugggcugggccuauuuccaucaaucaacaaucaagaaaauacccuacagacguucccaaaggccauuuugaugcaggcaguuccucaguugagguucucucuucccauaugugucaaaaagacaaucaagauuagccauaauaagucuauucuuugucaacuggacauauaaacauuaucacuaugauaccauagcuuuuucuuuuuguuugucccaggaucucauauugauuaucagagaguauaaaauacagaauaacuuuaaaguuccacaguguuuaagaaguuucauuauuuaaaaguucacugucuuggggacuggagagauggcucagugagucuuuuuaaaagcccaaagucuuaaaucuggauuacuauaaaauuaaaguugagcuaaauacuuucuuguuucaaaagagaagaaccaggguuuaaaacagucacacuuaaggaaaaccaaaguccagcaguguagcucuaaaaucuuguaguucggugucuggaaucuggggcucaggcucuuguggguuccaaaagacuugggcaucuccucuucuuuggcucugcccucugcagcacacacagcuugucucauaggccaacuccauuccacacuugccacuguccuugguuaucuucccacagaccuggcaucuccaguuucaggucucuacuguaacugggguugcaccuucaccaauagcuccauuuggaagacuccaauccugucacagauaguuaacuuccucuaugacucugaaucuugggguuuccacuguaacagaggcugcaccuucaucagugaccccucccuucccugccccuccagccuagccugucuuuaggaagacuccaacucugcuaugcugugccaagccucaguuguccuuuaugacccuaaugugccugaaaaaacaguaucaugugggagagacuuccgcauuauaugcuaaauucugcugcuagcuuaaugugcagccuucaucccuccaguggacugugacuucugcauguuauccugaggaaguacuuggaggaagauaauuaccuucaugaugcugggucucuuacuaaucacagcugauguuuuuagccucagcugaccagcaucaguugucucaggaaaacagguuucaguucaguggaugcuggucuuguuaaucacaccugauucuucagcuccaacugaccggaaaucacagguuuuuuuuuucuucccuuucccucugccucucccuccugccccuccuucucccugucccccuucccucucccucccucucccucccucucccugaccuuucccuucucuugacucucccuuucucucucucucucucucucucucucucucucucucucucucucuuucucuuucacucacucucucuuucuucuugaauauuuuuccuccauuaauauauuuagucacuuuauaucccaauaguaacugccccuuuucucccagcaucccccuugcaagccacucccccaugccccuuucuccaagaagggggaccccccacccaguuaccaacuacccccuagcacaucaagucacugcaagauaugcacauccucucuaucugaggcuggacaaggcagcccaguuagagaaaugggagccacaggcagacaacagauucagggacagccacugcuccaguuaguccagcacauguaugcucuuugcuugguuguucagucucugggugcucccaagaguacaaauuaguugacucuguuguucuuccuguggauuuccuauuucuuugggacccuuaauccucccuccaacucuuccauaagacucccugucuuagucaggguuucuauuccugcacaaacaucaugaccaagaagcaaguuggggaggaaaggguuuauucagcuuacacuuccauacugcuguucaucaccaaggaagucaggacuggaacucaagcaggucaggaagcaggagcugaugcagaggccauggagggauguucuuuacuggcuugccuccccuggcuugcucagccugcucucuuauagaaccaagacuaccagcccugagauggucccacccacaaggggccuuucccccuugaucacuaauugagaaaaugccuuacaguuggaucucauggaggcauuuccucaacugaagcuccuuucucugugauaacuccagcugugccaaguugacacaaaacuagccaguacaauugaccccuugucaacuugacacacaaaaacaucacuaguaagccucaacccuuacaaucuuauucauccccauucuaaauaacuuuaaaagucccacagucuuuacauauucuuaaauuuucaaucucuuuaaaauauccaucucuuuuaaaauucaaagucuuuuuacaauuaaaagucucuuaacugugggcuccacuaaaacaguuucuuccuucaagagggaaaauaucagggcacagucacaaucaaaagcaaaagucaaucuccaaccguccaaugucugggauccaacuuacgaucuucugggcuccuccaagggcuugggucacuucuccagccaggcccuuuguagcacaggcgucauccucuaggcucaagaugccuguacuucacugcugcugcucuugguggucaucucaugguacuggcaucuccaaaacacugcaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacauauuaccaaguccugcugcagcagggguacaaccuuggacaucucuggaacacagccucuuugugcuuucagaaaacacuucccagaagaugucaccucaaugaugcuggucucuucuuaaucaccgcuaauuucuuagcuccagcuaaccagcaucaauagucccaguaaugcaaaguuuuugcuuugguaguucugguaucuuguuaaucacagcugauucuucagccccagcuaaccagaacuacagaaucuucacauucaaaacagcaauggcccugaaaagagucuuuaauuuucccucugaaauuucacaaaccagaccuccaucuucugcaguguucucaacauuaucuuccaagcuccuacacaacauccgacagagcucuuaacaacugaugguucuucaagcccaaaguuccaaaguccuuccacaguccuccccaaaacauggucagguugucgcaggaauaccccacacugcugguaccaauuugucuuagucaggguuucuauuccugcacaaacaucaugaccaagaagcaaguuggggaggaaaggguuuauucagcuuacacuuccauacugcuguucaucaccaaggaagucaggacuggaacucaagcaggucaggaagcaggagcugaugcagaggccauggagggauguucuuuacuggcuugccuccccuggcuugcucagccugcucucuuauagaaccaagacuaccagcccugagauggucccacccacaaggggccuuucccccuugaucacuaauugagaaaaugccuuacaguuggaucucauggaggcauuuccucaacugaagcuccuuucucugugauaacuccagcugugccaaguugacacaaaacuagccaguacacuccccaagcucuguacaauguuugaccauggugucugcaucuguuucaguuggcugcugaguggauguucucagaggacaguuaugcuagauuccugucuacaaguauaacaaaauaucauuauuagugucagguucuugcccacaggaugguucucaaguugagccagucauugguugguuauucccucagucuuugucccugcaauucuuguaggaaggacaaauuuuuggucaaagguuuuguggauuggcuaguguccuuaucccuccacugggaauccugacuggcuacaggaagucaaacugcauauccccuacugcuaaugaaaaauaucacauaaacauuaaaagcuuguacuccuugcacucaggaggcagaggcagguggaucucugugagugugaagccagucuggucuacauaaugaguuccaagacagccagagcuguauacauauuaagucagucagucucucugucugucugucugucugucugucucucucucucucuuucauagcuacuagaaaaggcagaggcaggcagaccucugugaguucaagagcagccugguuguacauaguuccagaccaaccagagcuauacguaaugaaacuaucucaagaaggaaggaaggagagaggaaagaaaauuugaaaccuaagaaagcugaggauguaguucaaugguagaacgcuugcuuagcaugcacaaggcccuacauuucacacacucucucugugucuugguuucaucucgacucgugucuucucuuccuccucuucucucccuccucccucucuuucucuuuuucuuuuuuucucucucuguaccaaaaaggaaggaaggaaaagaaaagacccaaugaaaagacaagcugccuagccuccuguauauguuccuggucugugcccucugaauucccugcuagcuuagguaggagaggagcaucuacuggcauucaaugacagaaaggucuuuaccucucugggaccacagcuaggcaaauccugaccacucugagccauggguugacucuagcucugagcaauuacuugggggaauugucccuaaucuagaucucuaaugcaagucuggcuauguguuccccacauacuuugcuguuugaaauucucuggguuauuucugcuccagcagucuggcauccuggggaggcauuucacucuggaacauaacugcugguccaucacgacugauggauccuuccuucucuaucugcacuccuuuucucuccccucuccuccaccccuggacccuaccuucaacccccauucugggaacucaaacuccaccucucucuauuccccccaggaauuggaugucaccaguuuuauuuaaccaguaguuuaaaauugcgaggugaggguuacacaauaaagacagguauaugugaggaucugcuagucuuggagcaaccagaccuugggguacagaauuuggugauggaauaccagcaucagcagaccaaccccuauaguaauuuccuuaagugauauuugagaaagguuuuugucuugagcuaagacuaaucuucaguuucaggcacccaugguguuuauagcuucagugaauguguuugcuguuuuuagaaguuauguuguguuuuuaugccuauauaauguuuuuuacucaguaacuuauguuuaauuuuuaccuuuguaucuacugggaucuuaugauacacaucuuggugaauuuccuuuuuaauucuuguaccugaauuuugagaagcuugaaugaaccuguguuagaggaggggcuuucucugcaguccuaagauaaagcuuugucucucugaagcagauucccauuugcauugcccuugaccugucugauucaacacuuaacuccacauguagguuucuaccccacaccauuacucugacccugagcauuggcacccacagagcacccucgugguaucaagccuucugggucaagagcacuccucugauuccuucacacaccuugcucaguacaggacuugucuggacaagggcagccauuugagaacaugaggggacucagugcccuuggcaaauacagauacauaacucucagaaugaccuacuaguuaagaagaugaaaauugacagucuagcguguuucuaagcuuuacaaagacuuugaggagguuuucaagaagguguaaaauaacugugguaaaacuuuuuguacaguguuguucugcagaccaguacucauagauguaggagcuagugcucauccaggaaaagucugagaguggcgguccugaccucugaccuuuucucuucuagguaagcaucugucuggaaugcaacagcagcaaacuacguggccucaagcggaaguggaucagaugcucagcccaagcaacugugcugcaccugaaaaaauuuaucgccaagaagcuuaaccucuccuccuuuaaugagguagccaucauccaaagagcugggguagaucauucuugccugucuuguuuauuagaaugacaacaccacacacacacacacaccuucuuuuuaacagccuuguucaaggguuguuuuguuuuuuaauuuuuaauuaacguguguguguguguguguguguguguguguaaaugugcagugaugcuugcaugaagaucagaagacagcuugcaaaagugagucgucucccuccacugugaggauccuggccauuaagcucaaagguuggcaggcuugguaacaaaggacucacugagccaucuugcuggccccuuguuuggaaauuuguuuuuauuauauauauuauauauacauauauauacauauacacauauauauauauacauacauacacacacacacauauauacauacauacauauacacacacacacauauauauauacauacauacacacacacacacauauauauauaugaauguuuuacccacauguauguauaccaugugcauaccaggugcccauagaggugaaaagagagcaucagacccccuggaacugaaguuacagacacuuuguuaggcaccauguggguguaggguuaggugcuccuaaucacuaagccauccuucuagucccagaaauguguguuuaaauuuaauaaugaguggguggaugagugaaugagagauggauaugacacuuagagguuaaauuaauaacugaaaauaaaguaaaccagagacccauagcuuauuguuggggcucgaggcacagucuuaugagcacguguucagaaauucagacuguguagcauuuggucaaaaacauaagcaggagcugauccugcuaaaucaaggaagggucagcgauuugaaguguugccucaaaagaguucugaggcuuucuggaaaaggacuugcagggcacauaaacccuuguuaaaacaagacaaagccgggcggugguggcacacgccuuuaaucccagcacuugggaggcagaggcaggcggauuucugaguucgaggccagccuggucuacaaagugaguuccaggacagcccgggcucuacagagaaacccuguauaaaaaaaaaaaaaacaaaaaaccccaaaacaagacaagcgccaguauguugcggcaggugcaugugaguggugauuagauaauuuggagagugguauauaaagcuguguuagccauugaaccaguaucccagcuggagccuauggguaugacccacgggaagagggucuuggcagauuguaacaucuuagauugucugccaaaccuaagccccaugagaagaauccuguauuaguauauuagcaauagaggaacauuuuagauauagauuugggggaagcuggauaagaaauaacagaagcagagugaucugaucacaagccccaagaaaucauggggcaagaggaucuuguuauagucaguauccuccagauccaugugcugaaaacuccauuucagcccaaugguacugggaggcagaaccuuggggaaacguuuaaaucacgaccuguaccggggaaucucucuucugcucuuauaacgugcacugacaacaaguaccuacacuauggccagccuuccagccuauagcacacacuaacuaacuguuagaucaguuauauuaacuauuaauucacucauauuaauauauguuaaugucuuauguuaacuguucaucagucgcccaaucuaugcuauuugauuauagccacacugcaagacauuccuggcaguccugccacagugcucucucagagcuguguaucagacccaggaaccaggguuuuagacugucaaggggcccaugcucagcccugagccaaccacacgaguggcuggggaggagguggaagacacagaaugaagacaugacuuuauacuagcuaccaggagcccacaggaaaaagcaagucuggauuuuguuuauuugggaaauaagguagagggggagaugggaaggucauuaggagccuuggauugugugaagguauaaguguccaucuugacuugaaguggcuucuaggcacugugcagagcuagagacaucaggaaguucaaggggagacugccuuccacaugcaggaacauucuccauggggaccaacaagaaauguggcauuuucauugcagguggaucucacacugcucucagagcucugcagucccuaugugugugacaugugggagcauugucauagacacugaacacuaagggccaguccugagagcugcuguagugugaggacaucaugccuugcugggcacaguagcuuauaagcagccuguguaucacacaguaaacaccauuuggugaagaugacagcagacaguugagcuucacggacccagaggcugcuuuucuacuuaucacucucucaacaagaaacacacucuuaagugguugugagaacaacauuuguccccugccuagggagauaauaagaccacuggagucauuacuucacacacucauggaaauacaaauuuaaaguaacagugagacaucaccaugcaccuccucaagcacccaugugcacacuguauaauggagggccagugcuggucagaugagccuggaacauggagggccagugcuggucagaugagccuggaacauggagggccagugcuggucagaugagccuguaagcacuaggcuucagacaagaagacacagaaccaugacuaggugcaauuaggaauaggccauugucaggaagaugacagccaaaccccucagaggcugaagcaccggagacaucauuuacaugcuauaacagucuagucucaaucgagcaugugcuguguaagaugagggugagggaaccuuaaacugccguguaguaaagucuguuaaauaagugagaaaaagucuaagggcacauuucccccacugcauuaagaacaggauggccagggguaagagauaguaggugggguugcacugugaaacccaggaugguguaggccagcgaguguacaguguacaucagucccugcaguuguauguaaagaaagcccuguaugcucugugcagauaagguccugugugcuauguuggaccaggauguguucugcguguuaagagaaacugucuuaugacuucuuuguugugccaucccacauuucugucuggauaacauggagucauugcuaugacuggccaaauuguugaugauaggcccuucaagggucaguagaugaacauacagacuuacuucuuagggaggacagugacuuaaaguacaggaaguggggacccagggagggggcucacacauaaugucuccagaacuucauuagagaaacccagaaccaggguagggacagggcagguaucagugaugcccugagcaaccagguuaagucucuucagaccacugcaacacagcuaugaaguaugcuacugccuuugaccucugaagaaauuuuggguuuaacagaaaugcucuuucuguuauaauuugugcuugcagcuggaugaugcaguuaaugaguaagcagacagccuauguucucacaugacuggggagggguuuguuucagaguauuguuuguauuauuacucucagccucaggugaaagguugaacgugcaccuaaucaaagccucucucccaccagcuggacauuuuaugcaaugaggagauccugggcaaggaccacacucucaaguucgugguuguuacaagauggagauucaaggugagacugggugguucuuuugaauaccagaguuuuagauagacucuugauccuuacuugcuguacaugucuuuuauuugcagacauugcuguggaacagcugucuuucuggauccacccacccagccagggucuuuaucaccacuccacucgauccccugaauccaggggaucagaugugguaguucccacgguuggaacaaacucucaaacuuuaggguaccuuucucugucaggaaacugguguggcaguccccguccaggacuggaaggcagcucuucuaccucuagccauguuguugcccagacgaaggggacagagacagcauggccagccaaagacaaggaugaccaguaguuggggcugauuagggcaaggguuggaaguguaagagacugcauaggagaaaccagggcuaguguagugggcaggaggaacaaguucagguucuggcuacaugggcccugucgugagccccaaacaccacagaggcgaucacugggucaccugggaccaaugauaguuacuccuugccauccagaacuaaauucaguuguaguauugccaguccaguugugugccuaagguuugaguacacauuacgggcuccuugcaccucccucagccaccuuuguuuuugucuugcagaaggcaccccuccugcuacacuacagacccaagauggacuugcuguaaguucagccagacucagcccacacccagcacucuacauggcaaaaugugcuguggaacguugccucugggugccaugcggaccagauuucugaauagagaauauuuauaacuuuuguaugagagaauccacucccaacaagacacuaccagcacgcguuuacagaggaugaaaacacuucgcaguuugcucgucucugcuucagguccacaggccagagaagaagugaaacauuagcacgucccacaccacgucugacacgcagcaccucugcuugcuuuccagggcuugagaaucuugaguuucaguuuaguucauggauuagguuucauaauaagccucaaaaauauuuguacuuuaaguccuuuguaaguuauugaaagucuuuucaugguaaauauuuauguugcuuuuagcuuccugaagacuuaagagauauauaaaauuuuaauuuaaaguauacccaaagaggcuugcagcaaugcuaugacuuagccgcgguguuuaauuucuaggguacucagaagcccauccccgagguugagucugagacugugcauccugagauggccuguguugguugggcaagacaagaacccuuccaucacuccccagugucauguggcuguaaucuggcucccccaguaaggcaaacuagaggugguguggccagugcagcacuggcuuguugaaaaguucuuggaaagacaguuuuccuuagagaggccaucacugaagcuccugccuuuuccauucuguuuuccuucugcuggaaaaauguagugguggcuguguuugucacuuaccaaccagcacaugccauccaguggggagacuuuauaaagacacuuaggagguagccucuagccuccauguuccugguagaucaugggguuaacaugcguucuuugggucuuuuucaugaaagguaacugagcgaccugcucacuugaggaaacagcucgcuucagcagaaguggcuuuuucagucauagagaggauaguauuuguuaacacacacaccuuucucacauacaauuuauugcuuuguuagguuagagaaugaauaagacacuagcauauccaacuucauucccucugcagggguaugagggcaagaguaaggagaacggguccugaccuggggucccagggaccucucagccugggugcccuuccagguccagugagaauuguaggauccuauaaucccagcaguaccucugcucuuggugagcauaugagaucuuaguguaucccugggggucaggcuuucugagucuucaccuuagcaacuggaauauuuucuugaguuugcuuugacaguuggaauugaguuuaucaacacccacuuuuucuucuacuuccucuuucacauacacagugucagaagcagcgauuagugagacuuaauguugguaaguaagaaaaaaaacauccaaauuaacucaaucuuuaaugucugaccuucuaaaacaaaagcaagcucuuuuuguuuugaauuaaucaaaauucaccuuucuauguaagccaguuuggauuauucaguuuccugaguuugcuguccauucaaaucauuucuagaguuacuauacaaggguuuaugcguaaauauuaccuuucuaccucagaacacacgugcugcugaagcauucugcaagaccguguucucacaaugcaguuacauuagaacuuagguauuuucccauguggugaaauuaagcaguuacaaaccuccaaauucaaguaaaguuaauuuacagaucagaucaaacuuaguauggcuguauaaucucaugauauauauuuguaacuuuguagcuacuuuuagaaucacuugacucugcuauggugcuaaguugauagaucuaaguauucagcgagguggacauugcaaccgaugucuuagcugggcgccaccgccccaacagcccugcuucugucaccacguuaaccuguuaaaccucagcagcaaaauaccuauuuuucuaagauuccauccccgccugugugcacugcagacggucuccugaugcccuucugcccuuuggucugaccuguagccuuaccucgcucagagaugaagcagagugagcuggcguccgauggaagcuuccgggcgccuuauuucacuccugccaagcuccacgugacauccaaggccgaauuuuauuuuuccagcaugaacacuaggaucaguuagcgauugguccugucaagcuuucucagcaggcggagcuccugcgaaguuguuuucauagcugccgaugcuagaaaucgggugcggccggccggcagcucugagaccagccucccagcacguggucucgcucaacaccauuuucacaaaaauagaaaacucagauagaauauauaauauugaauuuaagauuugggggguuaaaaaaaagaaaacuuaacuuuauaaaauuauuuauucuauuuuaagccuucuaucauauuuucccauccaauuguuugguuuccgugguccagcuuuauuuacaggcauauaagauaaaauugugagauguuuugcaagcuucuuuuacuuuuuguagccuuugguuuguauguuuuuauagggaugaagaggcauuuuuaugcuuuugugcaauagguuccaacaugcguuuauuaguguuuaaauugugaucuagcaucuacuaaauugaaagggaauauagguggaauuucaaaaucugugcguucagcuauuugguuuugccuuuuucacuguuauuauaagaaugcuguuaccgggauuaugugcgugcaagagugaguguguguguguuugcguguguguguguuugcguuuguguguguguguguguguacguacuuucuaucaauauuaaaagauaaacagccaggcaggaagugacgagguuagcaccaucuuaggcuugcaucucugugggugcacccaaguccucgagcuaaaucugugacuaagccacccuggguguugggguuucacuguccccaccugguagugcuacccuccacuggccugcagcuccugacaccugcccuggccagcagagacuuggaggcugguguguuuccuuucuaagggcauacagggugguguauuacagugcucugaaauguaucauuagauuuaauguuccaguaaugagccaacugaguucuacuuuguauauggauauguuccuaaaacauugacaguaaauugagugcagauagugaaauucccacacacacaccuacacacacacacacacacacacacacacacacaacacacgugucuguuuccucaggaaaucauuuaagccccaacacaucacaugugaccuuaacaugaaaacaaaaguuuucucugccuugauauuaaauacacuaaguaaauaaacugagaugcguagauuaggaaaucacuuaauuguaccacagucugcauaucuuugcauuccugcaggcagggauuagaccauggucucacacccaguguuccuguugucauuuacuuccauccaagagcacauuuggagaaagaacuaaggugugccugugagauggaacugaggugugccugugugucacuuuagccagugacucacacucacuguuuaguuccagcucucaacuugugccagacacgguuuucccaagcgaagguaacaucagguuacggacagcagcgccaccugagcucucacgcuggagcgcagccacagcuagcaacggucacgguguaugaaaugcugcagauacagaguuuuugacuguuuaauuugaaaguuuacauuuuuuaugauugcguuaguguguaauuuuuguaccaucaguggcuaguuuuugucuaaaaucuuuuuuggaauauugcuuaauguuuugauuuuaugauagugaagcuuguauucaguguuuugccaauuaauauuauaugcuuguaauaaaagcagaagaaaaacuuaacuaaaaucucccagucuggcaauguuuuuaccuaagguauauguuaagaguuugacagauaauguguuacagaacaugaucagcccccuccagcuuccaggcucagccaucuggggauagaaaguauccaggaaaaccaaccaaccaaccaaaauccuccaaacaagguuuuguuuguuuuauuuuucuguucauagucccuaacuauaguauaauaauugcuucuauagcauuugcuuuguuuucauugguuuugguuuuugagauugagucucuguguagucuugauaucuuggaacucacuuuguagaccagacaagccuuaaacucuagaucugccugacucugccuccugagugcugggaugaaagguguaugccaccauguuuggccacacuguauaauuuacuauaagucaucuagagauaauuucaaaggauucaggaaugguguacuauuaaaaaaaaaaaaaagcuguuuuauuaaagggcuugagcauccucagauucugaugucuacaggagaucugaccucaaggacacuaaggagccugugcagugaacugcucuagaugcucuccacugagucaggccucacucucucaggaacacaugcccacugugucacagucauggaaguggguggaguggggggugccugcuggaaaaacccccuuaucaaccccauccccaccuaacacuagcauuuccucuuaaguuugaucucuggaagcagccuucccccacgccccuuuguggcuuaaaagaauaccuggacuuucagacaggauagcaauaaauucacaguuacagaaagcccacauuuccccaagacaaaagaaguuguuucucuugaggucuuccugaaguuuugucuguucuuugggcagaggcuguguguggcucaugcuuuuguuguaugugaguauguagaaaaauccacugauuuccauacugaaucuggcaggcauuuucuggauuuccguggaaaccucuaagcccuggcugaagagcaggagugagcaagauagcaaguagguuguagagucucagaguucgugauugaaagauuuug

SEQ ID NO: 2579 - RNA, 3570 nt, Mus musculus
cagaaggcaccccuccugcuacacuacagacccaagauggacuugcuguaaguucagccagacucagcccacacccagcacucuacauggcaaaaugugcuguggaacguugccucugggugccaugcggaccagauuucugaauagagaauauuuauaacuuuuguaugagagaauccacucccaacaagacacuaccagcacgcguuuacagaggaugaaaacacuucgcaguuugcucgucucugcuucagguccacaggccagagaagaagugaaacauuagcacgucccacaccacgucugacacgcagcaccucugcuugcuuuccagggcuugagaaucuugaguuucaguuuaguucauggauuagguuucauaauaagccucaaaaauauuuguacuuuaaguccuuuguaaguuauugaaagucuuuucaugguaaauauuuauguugcuuuuagcuuccugaagacuuaagagauauauaaaauuuuaauuuaaaguauacccaaagaggcuugcagcaaugcuaugacuuagccgcgguguuuaauuucuaggguacucagaagcccauccccgagguugagucugagacugugcauccugagauggccuguguugguugggcaagacaagaacccuuccaucacuccccagugucauguggcuguaaucuggcucccccaguaaggcaaacuagaggugguguggccagugcagcacuggcuuguugaaaaguucuuggaaagacaguuuuccuuagagaggccaucacugaagcuccugccuuuuccauucuguuuuccuucugcuggaaaaauguagugguggcuguguuugucacuuaccaaccagcacaugccauccaguggggagacuuuauaaagacacuuaggagguagccucuagccuccauguuccugguagaucaugggguuaacaugcguucuuugggucuuuuucaugaaagguaacugagcgaccugcucacuugaggaaacagcucgcuucagcagaaguggcuuuuucagucauagagaggauaguauuuguuaacacacacaccuuucucacauacaauuuauugcuuuguuagguuagagaaugaauaagacacuagcauauccaacuucauucccucugcagggguaugagggcaagaguaaggagaacggguccugaccuggggucccagggaccucucagccugggugcccuuccagguccagugagaauuguaggauccuauaaucccagcaguaccucugcucuuggugagcauaugagaucuuaguguaucccugggggucaggcuuucugagucuucaccuuagcaacuggaauauuuucuugaguuugcuuugacaguuggaauugaguuuaucaacacccacuuuuucuucuacuuccucuuucacauacacagugucagaagcagcgauuagugagacuuaauguugguaaguaagaaaaaaaacauccaaauuaacucaaucuuuaaugucugaccuucuaaaacaaaagcaagcucuuuuuguuuugaauuaaucaaaauucaccuuucuauguaagccaguuuggauuauucaguuuccugaguuugcuguccauucaaaucauuucuagaguuacuauacaaggguuuaugcguaaauauuaccuuucuaccucagaacacacgugcugcugaagcauucugcaagaccguguucucacaaugcaguuacauuagaacuuagguauuuucccauguggugaaauuaagcaguuacaaaccuccaaauucaaguaaaguuaauuuacagaucagaucaaacuuaguauggcuguauaaucucaugauauauauuuguaacuuuguagcuacuuuuagaaucacuugacucugcuauggugcuaaguugauagaucuaaguauucagcgagguggacauugcaaccgaugucuuagcugggcgccaccgccccaacagcccugcuucugucaccacguuaaccuguuaaaccucagcagcaaaauaccuauuuuucuaagauuccauccccgccugugugcacugcagacggucuccugaugcccuucugcccuuuggucugaccuguagccuuaccucgcucagagaugaagcagagugagcuggcguccgauggaagcuuccgggcgccuuauuucacuccugccaagcuccacgugacauccaaggccgaauuuuauuuuuccagcaugaacacuaggaucaguuagcgauugguccugucaagcuuucucagcaggcggagcuccugcgaaguuguuuucauagcugccgaugcuagaaaucgggugcggccggccggcagcucugagaccagccucccagcacguggucucgcucaacaccauuuucacaaaaauagaaaacucagauagaauauauaauauugaauuuaagauuugggggguuaaaaaaaagaaaacuuaacuuuauaaaauuauuuauucuauuuuaagccuucuaucauauuuucccauccaauuguuugguuuccgugguccagcuuuauuuacaggcauauaagauaaaauugugagauguuuugcaagcuucuuuuacuuuuuguagccuuugguuuguauguuuuuauagggaugaagaggcauuuuuaugcuuuugugcaauagguuccaacaugcguuuauuaguguuuaaauugugaucuagcaucuacuaaauugaaagggaauauagguggaauuucaaaaucugugcguucagcuauuugguuuugccuuuuucacuguuauuauaagaaugcuguuaccgggauuaugugcgugcaagagugaguguguguguguuugcguguguguguguuugcguuuguguguguguguguguguacguacuuucuaucaauauuaaaagauaaacagccaggcaggaagugacgagguuagcaccaucuuaggcuugcaucucugugggugcacccaaguccucgagcuaaaucugugacuaagccacccuggguguugggguuucacuguccccaccugguagugcuacccuccacuggccugcagcuccugacaccugcccuggccagcagagacuuggaggcugguguguuuccuuucuaagggcauacagggugguguauuacagugcucugaaauguaucauuagauuuaauguuccaguaaugagccaacugaguucuacuuuguauauggauauguuccuaaaacauugacaguaaauugagugcagauagugaaauucccacacacacaccuacacacacacacacacacacacacacacacacaacacacgugucuguuuccucaggaaaucauuuaagccccaacacaucacaugugaccuuaacaugaaaacaaaaguuuucucugccuugauauuaaauacacuaaguaaauaaacugagaugcguagauuaggaaaucacuuaauuguaccacagucugcauaucuuugcauuccugcaggcagggauuagaccauggucucacacccaguguuccuguugucauuuacuuccauccaagagcacauuuggag

SEQ ID NO: 2580 - RNA, 468 nt, Mus musculus
cucacccgccccuuccuuuuccucuuccggggacguugcucagaggcacucaggaugguccagcguuugacauaccgccguaggcuuuccuacaacacagccucuaacaaaacuaggcugucucgaacccuuggcaacaggauuguuuaccucuacaccaagaagguugggaaagcaccuaaauccgcauguggcgugugcccaggcagacugcgagggguucgugcugugcggcccaaaguccuuaugagacugucuaagacacagaagcacgucagcagggccuaugguggguccaugugugccaagugugucugugacaggaucaagcaggcuuuccuuauugaggagcagaaaaucguugugaaaguguugaaggcacaagcacagagucagaaagcaaaauagauaugcacauuuuuuaaguaauaaaaaucaagacuugaaaaaaaaagaaauauugggaua

SEQ ID NO: 2581 - RNA, 836 nt, Mus musculus
cugccaccgcuugccuccccucaccucgccuccccgaccccugccugccguccccaccccagccccacccaagaugucagaggaucuagcaaaacaguuggcuagcuacaaagcucaacuccagcaaguagaagcugcucuuucuggaaauggagaaaaugaagaucuauugaaacugaaaaaggcuuugaaagaaguaauagaacugaccaaagaccuucugucaacucagccuucagagacgcuugcaaguucagacaguuuugcuucuacucagcccacucauucauggaaaguaggggacaagugcauggccauguggaaugaagacggacaguguuacgaaguggagauugaagagauagaugaagaaaauggcaccccugcaaucaccuuugcuguuuacagcaaugccgaagugacgccauugcugaaccucaagccuauagaagaaggaaggaaggcgaaagaggacagcggcaacaaacccaugucaaaaaaagaaaugaucgcccagcagagugaauauagaaagaaaaaaagcuuugaaaaaagcacagagaauaaaagagcuggagcaggagcgagaggaccagaaggugaaauggcagcaguucaacaacaggccguacucgaagaacaagaaaggccagguaaagaagaguauuuuugcuucuccggaaaguguaacgggcaaaguuggaguaggaacuuguggaauugcugacaagcccaugacacaguaucaagauacauccaaguacaauaucaggcauuugaugccucaguaaccagaaaaacugcugcguuucaugugcagggcuuuacauuuuacc

SEQ ID NO: 2582 - RNA, 1922 nt, Mus musculus
ccaggaugugggagggcgcguguccugggcuuggguaucuuggaggcccucugugacagccaugagugaaggggaucagcgaggggggaugccuggggcgucuuugggcgguggguggcuccuaagggcuggagggccgggccugagagccggcucuaggcaggccaucugaccccgugucuugcccgaacucgcagaggugcggguucuguccucaccaugaggccgcagcaggcgccuguguccaggaagguguucauuaagacuacagcaguggcacacgcugccaguuccagaccaaguuccccgcggagcuggagaacaggauugacagacagcaguuugaagaaacaguucgaacucuaaauaaccuuuaugcagaagcagagaaacuugggggccagucauaucuugaaggcuguuuggcuuguuuaacagcauacacuaucuucuuaugcauggaaacucauuaugagaaggucuugaagaaagucuccaaauacauucaagaacagaaugcgaagauauaugcuccccaaggccuccuccuaacagaccccauugagagaggacuucgaguuauugaaaucaccaucuaugaagacagaggugugagcaguggaagauaaaacacagaguuacagguccugccuccagcuggaaccuucgucuauccacuggccgauggcagagugucccuaccuccucuccagagcguuauucucuugucucugcugccagagccacggugccacaccuggagugaccgcucgucacucagcauccacuuugucucccaauuguguaggacucugugaucuuuugauuuguuuccaagaaaauaaaggaagcaauucucuuuauaaauucaaagccauuuaaaacacaggcaguuggccagcccaagauagagucguuuucuuacccgauaccagugucacugguucuccuugucccuugggucaguuuccuaggugguuuuaugaucccacaagucaugucuuagcucagucccucccccagauuaguaacaggcuuugagggugugugugucugugguccgguugauccgccgcccgaguccccaagcuacuagccuugacuugaucuucagauugauuucugcuguucaacuucagaugcuccuugagagaauaauauauguuacuuguuuuaguguugcaguuauuauuaaggcaguauuuaaugcaauuccgguuguuucuuugaaagcauuucuguuaaugugcguuaccucuugauguuggggagauguugugcguguugcuuguucauuccacagauaaguaaacagcuccgccugccccagcucugcccggguguggaggaagcaaguguccuaagcaccuaacucuaguuuuguuacaaguauaacuuaggagaaaaaauugguagaaauaaugcaguauguugcuaauuuguaaccuacuuauaaacucugauuuauaaccucacauacaguauucagggcacagaaaucuuuugauugacucaguaaguuuuggcuuccguguaacuugcaaguuaaaguuaauuuuuccagcucuucuuuaucucuauacucucuuaguauuggaauuucuuauguucuuucuuuuaggaauuugagagcacuguguuugggagaaguuaggaaacauaaggaaugaaugaagcuguugaacuuggagauacuguaggugcuaauacuggaucuaaucuuucagauuuaauuuguuuucugggccuuguaguuacucaguaaaccccuuagaucuguguaauaauuuaauuguauaacccucauuuguuccuuuaaagccuauucuagucugucugccuuuaaaacuuguugaaauaaugucgccaagauauaaacacauuaguaaaacuuuucuuaaauaaaaaaaagagagagagag

SEQ ID NO: 2583 - RNA, 10150 nt, Mus musculus
aggcuugaaaggucccuuaagcuguguucucuguccugccgcuggaugcuguggagggugcucaggcaagcuccgaaguugcggcauggugaguacagggucauugaaaacaauggggagaagcaggggucugagcagcgcgagcugcuguggugggucuuuccugggacucagugggaauccgcagccaugugcgauguccccugagguccuagccacuugcgagacccagcuguagcgucugaauaacuucgcucugggggcugcaucugugcagaacauuuggcuuguguguagagagaucuuuggcgugaucccaaacucagagaguccgacuuucuacaaguucuguucuuagcauuugacauuaagguggacaaugcauuuggaguuaauuuuguggaggcuguaaaaggcaucucuugugcuggguagcaauucaaugucaagcugugauguuaaagaguaaaacugaugauguaaaggauuuaguaaagcuuaggaaauaguaaggcacaccaaguagaauuuagcugagggaggacugccgcacaccucacagauaaguacuaugccagccagggcaguuagagguuaggaugcuaggguacacaugcuuguucaccagcauuguccagaaaucauaacaaaggaaacaaacuugauuuauaaucugccacuaggcccauccccuuaucaaagagcaggccucuaaccagcugcuuaauggggcauucauuacaggaucacaaccaaaagcaaggccucuugugccauaaggcgcaguuuucuucuugagaaaagcauaguucugccacaauggcuagaugacaucuagugacaaccauuugaaaacuuaaaaaaacaaaacaaaacaaaacagaaaaacccacaaccauugcauugaguguaggccugauccagcuaugcuuucccugaaguccccaugucuggagaaggacacaccuccuucugaaacccaggaacacucuuggcagagccagucacagccugggccuaguccuuaggagcuuucccugaggcccuggguauagagagaaaacagggcuccuuuacuucguuuuuuguuuuuguuuuguagaacaugauuuuaauauuuucaauuguuaauauuuuuuaaagagaguaauuauuuuaagauauauuucauuguuauauccuccuuuucauuucugauuuuauuaauuaggauacugucucugugcccucugguuagucugguuuaucuaguugauuuucucaaagaaacagguccugguuuuguugauucuguauauaguucuauuuguuucuauugcuugauuucagccccgagucugacucuuuccugacaucuccuccucuugggugcauuugcagagcuccuucucuaaaaccuggaaugugcuugggagcugggaauggucuggggcagggccuuugggaggggucgaaucagauucugagaguacaacuucccaccauauggggcugugguuaucaguuccaaggccacuagacauuuggucagaaauguuuuugagaaccauugaguuuucccuugugcagcaguguuugauuagccuucuccugaaugugucccauugucugauguuucugcggacuucauacuuucuuaaucuuucugcugacuucagaggugucucccaucuccuuccuuuucccucaugucaaucguguacaagaugguauucuuaagaagcugacuuagcauaagccauagcuuguguaagaccuccccaccccagcuuuuauacucucuaccuuuuccuuuucugauguuuuucaucaucuggaaccuuccacuuaggacacugucacuaaccugcuguguuaggacacugguguccuuaagaaaugauccuggaauaugcuugcugugccaauuucccaugugacuuaguggcuagacuugcagucuccagucuguauuuaaguuguucaaaacuuaaccuggaaccugaaucuaaaagagacuuaaggguggcagcauauguggaaggcaaaauccauccuugucuggcuccucuuuuagccuuaaucaguguagcuggucuuugcuacuuuaugguuucuucgagcauuuaacuuuuuauacagaagaauaacaagaaaccaggcaagauauaucugcugaguuacagugacgcaauacaaaaggaauguauacaucaaaugaagggggggaccaggccacugccacuaagaagacagucagguguaaugcuagucuauuguuaagcccaccaccagggguucuuaguaaaugccugauuuaugcuguuucuuugggccuaaugaagaaaccugucucagggggauucccuaacucuuuucaugguaaacccaccuauucacuaggccauugugaauuccuuugucuggguaagacuguccauugucucaaggaaacccucugcagaccagcccugagcuauucuugcuccuuucuuugaaaugugucucuacuagaaguaaacuugaauguuacugaauagauaaccuucucacugaauuccuauugaauuccaaguuuguuggccucaaggauuuucugggauguuggaacacuggcgaaggcuuagcuaugccagaauucaaucuuuaaaggcacuuacaauaaaauaauaguaaaagaaagcacgcggauccauacaccagacuaauggggguaugaguauauggguuaugagaaugccaggguucuaggagguugaguuucugugaaacucuuugccucgugagugcuuccaggccucuccgccugccaagcaggcuucacuggagugugcauagcagcaaccugauaggaggaagucucaagaucaagcaaaagaaucagaguuacaccugcucccacuguuaggagucccacaaaaacaucaagcuaacaaccauaacaugucagcagaggaccugacacagacccaugcugucucuaugcuugccguuuaagucucuguaagguuccuagaaauccagucaguguuagucauggguucccucucaugucaagggucucagguuaaaccaaacauugguuggccacucaaacaaguuucuuaccaucaugccccagcacaucuuguaggaaggaccaguuguagggauguguguguguguguguguguguguguguguguuuguguguaagggauagugguccugguuucucuuucuguagccuucucuccucuaagagacuagaacauagagguuaagguuccaagccugcaccagcuugauuucugcauucagugaaauguguggaauuuguccugauggggcccugcugucaguuaucugagagcagagguuuguccuagcaucagcauggauuguuuaaggaucucuaaaaccaccuuggcuaauagcucaaccaaauguaacccauuuccaacacugaagcccuggcuggcuacaaggauagucaguucagacuccauauucuccauuacucggcgucuucauuagggucacccuauagcauccaggacgcuucuaucauacuugguuuuuacucuaaccccugaauaccccguaauuccagcugcauuguacuuuaccccugcauuccucuaacugaucccuccuacuccucuucccaucaaacuccaguccucucacagaaacuacucuauuuccccuuuagaaggagaucugugcuucccucuauagcccaucucuaccuagccucucuggguuuguggaguacagcuugauuauuauuuaccuaguagguaauauccacuuauaagugaaugaaugccaugugugucauucuggguguggguuacuucaguuaggguggguuuuuuguguguguguguguuuuguuguuguuguuguugcauucauuggacuguaacuucacuaugucauuuuuuuuaaacaccugagugauacuccauuguauaaacauaccucaucuuuuguuuauccauucugcauuugagguaccucuaggauguuuccaguuucuggcuaguaugaauaaauaugcuaggaacauaguugagcaaauguucuugugguacaguggagcaccguuuggauagauucccaagagcaguguagcuggguuuuggcuacagggauucucacuguugugaggaacuaugauucuaaggaaauagugauuucucuagugacaguauuaguuuguaucccacaaggaguuguguuuugguccccuuucuccacauccuugucagcaugcccugccacuuuuauuauugacuuguaaaagauagauacucaaaguaguucugauuugcauuccccucauggcuaagauggcgauuauuucauuaaguauuuuucagcuuuuugagacuugucuguugagaauucucuguuuagaucuauaccccacuauaaauggaauuuuuuacuuuggaaagccuaguuucuugagguuguuauauauuuuguauauuaggccuuuguaagauguggauuugguaaaaaaaaaaaaaaaucuuuucccauuccuuaggcuaccucuauauccaauugaccagguuuuugccacuuuuaaucuauuuucuauuauuggcaaagagaagaaacagaauacacaggaugaguauuggccuguaauuucuuaauuuuuuucauuauacucuuguacuucauuuuuaaaacacuuauaugucugucagucuuucugucucuuuuuauuuguggugcucuuuauguugugugauauuuuuuuuucauuaucaucuaauuauauuguuguuucucugggaaaugauagaccuuuaccuacuuuugucuuuuaaaaauuuacuaugaguuucuugaguuuuugauaguuugggaaacaguuuuaauuuccucuucuugauucugaaggcuugccucuccucauuucuuggcaacucuggcuuucagucgcugcaaugagcuauuuuugggguuuugcuacuuaagugauugauauaguuaacaaauuagauuaggguuuuugaaacuuucugauauauuauugucuguguguuccaauuagcuuaaguugucgacguuuuggagccuacagguaucugagggagauuuacuugagcucaugcccucauuaaaaugacuggaugccauguuaguaagagauugugaugacugaugugggaagggucuuccacugaggguggcaggaucccuaagcaagagggccuggguuacaugagagagcuagcugagcaugagacagugaccaagucagagggcaaggcaagaaacaauguucguccuugguuuuucccuuauuuuauuuuauuuuauuuuauuuuauuuuauuuuuugguuuuuuucaagacaggguuucucuguauagcccuggcuguccuggaacucacuuuguagaccaggcuggucuggaacucagaaaucugccugccuuugccucccuaaugcugggauuaaaggggugccccaccacaccgggcuuacuuuuugauuuuacaagauugugccccaccacacccggcuuacuuuuugauuuuacaagauguagcaaucaagaguaucagaagagggcaugaagagauggcucaguccuuaagagcacugucugcuuauucuuccuuuaauccugaguucaauucucagcaaccacaugguggcuuacaaccaucuguaaugggaucugaugcacuccucuggugugucugaggauagauacaguguacucauauaaaugaaauaaauaaaucuugauuuuaaaaaagagagucauaauagacuuuggacauuugaagaauguaugggcugcugcagauuauuagggucauugaaguuaaaucagugcauuuucaucaugaaugucugugaccagaauguaguugauuugagucaaaaagcucccagauagagugaugucuuugaacacuuauuuuucuauuguagcuuucuuugggagagcuuauaauguuaggguccaagaaucacugaaggaagcccccaacucaaauaguaugcaaaauuguuuuauucugcagaauucuaucauacaggggucugucauucacugggauggagacagacaugagcuuugcaagcuccauuuaaagccaguuaggggaguucuagggagcaguacgugaacuuaauucugauugguugacucaauuuacagggguauggguuucuuugggauugguuuagguucuggggaauuugggagacuuuccggaaacaaggcuaaguaaucuugguuuagauuugccucaggccugguggcagaggcagcuccuggaagcuccugauuggcagucuaugagggugguuuuccugaauugacuuguuuggacuuuucuaguucugggaaacaaacuuaagccuagucucccaaauugucaguuugcagcuugucauagauuuagcuuggcuuuggccaacucagucuuagucguuugguaggaggaaccuuucuagauugcuuauuggggaugaaauuugagugucuauagacucaacccauuuccuguguguguguguuugaacugugugguuguuggagugauuagucagcuuguuucuuauguuguccugccuucaccauuauagacuuuauccccuaaauuacauaggaugcaguugaagcaguuguaauucagugcuaaguuauuuuguaagcucaguguuuuuauaauuuuaaauuuguuguuuuugucuuugaggacaucauuuuucuguguagguguauagcacauguggccucaagcuuacaaguccaccugagucugacuccagagugcugggauuuaaugugggccaacaugccuagcuuuuuucuuuguuuguuuguuuuuauaucauugacugauggucuugcaauguagauguugguacaugucaagcauaugcuguuguguugauguucauacacguuuugaaauuugaaauuuaguagagagaauauucuguuucucaggauggcguguauucaugacauugauacugccugagcuuucugagucauuggauuguaggugcauagcauucuuucuaccuuuuguguuuguuuugauuuuuaaaauaaauaugaauauuugagucuaugcaugaauaugcacaucauguauaccugguccccauaguagugagaagauggguucagaauuccugaacuugaaguaauugaucguugugaagucccauugaagguacuggcaauugagcccaauuauuugcaagaccagcaagagcucuucacugcugagccaucuccugucccauguagaaucaauauugacauugccaauauuuucaucugucuauuuguauguguuuaaagaugcaucccuuuuuaguaagaucuuguuacuguuacagauuaaacugggacacuuuaggaugcugcaagaugaauagagaaauggagugaaugugcaauucuuucuaagaacuccaguuaaaaauaucugaguccuuucuaucuuucuuguuuguuugauugauuauuacaggugagacagggucuuaauauguaccucuggcuguccugaauagaccagagauaugauauacuugcuucugucuccugagugcugcgauuaaagacaugaacuaauaugcucagcuugcccaauuucucugaugugugcucaauauugccucucucucucucucucucucuguuaauuagcauuucucuaguaagguuaaacauuauucaaaaagcaaagaaaugacagaauugaaccuuauuacucaguuuccuucuaagaugacuugguaauuacauuagaacuuuuuggucaugaaauaaguaggggaaacaccagaaucauacacacauauugucaaugaagcauacauuuacagugaugucgguaucaugguuucuguuguacacauguguggaauauuuuaggaugcauugaccuaugaugauguguaugugaacuucacucgagaagaaugggcuuugcugaauccuucacagaagagucucuacaaagaugugauguuggagaccuacaggaaccucaaugcuguagguaagacugaguuuucuuucacuuuuuaaaauaagggaacaacuguuuccuuguuguugaugcuuuucuguaauuucacuugagaaugaggaagaaugaggugaauaaaucagguuuacuaaagauaguaacuuaaauuugccuaauuuccaauaauauaucauacauuuucugguacuauguuuuaggcuacaauugggaagaccauaauauugaagaacauugucaaaguuccagaagacauggaagguaauuuucauguucaaguugguauggauaugcuuauaaagaaaaguuaauguguccuggaacuuuuaaagaaaagcaacaguguuuaaaaaaauaaaauaaaaaaagcauucuuuaaguguguugauuaaauucucacagauccccauaccucaaugucaggugucugauuuguguuuucaaggcauuucucugaaagagaagacgaggaaacaaugcuuucacaaauauuaccauuugaaucauagccacauuccagcugcucuguggaaaugcgaaucuagucucauaucauucaaauauugcuaagauauauauuaggugauaaguguauguuuguaauaagcaaauauuucauagugaagcugauuacuccuagacuaacauugcuaaguuuaagcgaguggggccguuuaugagagucaggaauguuguugaggaggaaacuuaaugccuauaccauauguccaugauggauaaacaaccaaacuucaugaauguaacguggaaaucuuucauuuguuauuccuuuuuaaauagguauauccuguauuacaauggauacaagccgugugagcauagggauacugaaauaagcuauguaacucucucacccacagaacaauugaaauguauguaguaguccacauuugagcaaacuuucucagugugcuacaaguuuacaauuaguuuguuuuccaauuucagugguaauauauccccaaacucacacugcagaaaauccguaugaguacuaggauuguagaaauucuuuucuguuuguccagguuuacuuugccaaaguagugugaaaauguaguguauuucacaauauagaaaguuuaugaauguacucagugugguaaagcucugagcucuuccauuucucaucaaauuugugaaaaauauuauagagaagaaggauucuacaaauguaagccauguaauaacacucuuaccauuacaggcaugcaaaacaacacauaaugaaggggaacccaugaauguaaacaaagugauaaaaaucuuaagaugugauucuucuuuccaauuagaccaaauuguaaaauuaauuccuacagauaaaaaauauucauuggucuagugaaugugguaaaguuuucacaugugccaauuaccuuugcaggaaugaaagaaguuuuacuggagagaaucccuaugaaggcauucagugcagugaagccuuuguucaucauaguaguuuccgaauuuggaaaauaacacacacuggagagaaacgcuacaaaugcaaucaaugugguaaagccuaugcaggaccccauacucuccaaauacaugaaagaacacauaguggagagaaaccguaugaauguaagcaauguaguaaauccuuugcuucucauggucaacuucgaaaacaugaaagaauucauacucgagggaaaucuuacaaauguaaucaauguucuaaagccuuuguauacccugguaaucuucgaaugcauaaaagaaugcauacugaacacaaacccuaugaauguaaucaauguaguaaauccuuugcuuguccuggucaacuucgaaugcaugaaagaauucauacugaagagaaacccuaugaauguaaucaauguaguaaaaccuuugcuugucauggucaacuucgaauacaugaaagaacacauacuagagagaaacccuaugaauguaaucaauguaguaaaaccuuugcuucucauggucaacuucgaauacaugaaagaauucauacuggagagaaaccuuacaaaugugaucaguguggcaaagccuuuucacuccaagguaaucucaaagugcauaaaauaacaacacauacugaagagaaaccuuacaaaugugaucagugugguaaa

SEQ ID NO: 2584 - RNA, 706 nt, Mus musculus
uaggugggcaguaacccugugcugaccaggucuugacuucagccugagcuucccucccucuguaggcuguuugucuucuuacuccuggaaucaagguagggagcuugcauagcccacuacuugaauugcagggaaauuaucaaucugucccacaagcggaagggugcacaagauauuaacaauccaagacagauuuuggguaacaauaguuuauagaaauuaauaggcuuauuaaucuaucacccccgccccccaguucugacacuucucuuuguccucagcccuuaaacaccuuucagcauacaugaucacauguuaaaaaguucaucaaaguuuacacagaaaguuaaaucauaaacugaaauagaaguuuacaacagagaauguuuacaggcaugugaggagcggcccgggacugcagcuaagucuuaugacuugcaccugacuuccucauacaccugaaaauaagccaggaccaucaugagagcugcgcaggugcaccauaaugcuggcgguguaaacaaguccauauuugguggaggcaugccccugccgcccugauuggcugaagcugcaugccuggugagguggcuuggccugccuugaguggaugggggcugagaguauauaagcagaccuuccuggguucccggggucccaguagcagcauugagguguuccugcaauaaaggcuguugggaagaau

SEQ ID NO: 2585 - RNA, 897 nt, Mus musculus
ggauucuucccaacagccuuuauugcaggaacaccucgaugcugcuaaggggaccuugggaacccagggaggucugcuuauauacucucagcccccauccacucaaggcaggccaagccaccucaccaggcaugcagcuucagccaaugggggcagcaggggcacgccuccaccaaauauggacuuguuuacaccgccagcauuauggugcaccugcucucacgauggucgauggucauggcuuauuuucagguguaugaggaagucaggugcaagucauaagacuuagcugcagucccgggccgcuccucacaugccuguaaacauucucuguuguaaacuucuauuucaguuuaugauuuaauuuucuguguaaacuuuugaugaacuuuuuaacaagugaucauguaugcugaaagauguuuaggggcugaggacaaagcgaagugucagaacuggggggcgcgggugauaaauuaguaagccuauuaauuucuauaaacuauuguuacccaaaaucugucuuggauuguuaguaucuugugcacccuuccgcuuaugggacagauugauaacuccccugcaaguugaguaaugggcuaugcaagcucccuaccuugauuccaggaguaagaaggcaaacagccuacagagggagggaagcucaggcugaagucaagaccuggugaucacaggguuacugcccaccuaggggagaagcaagcggcugagcagcggcagguggaguaguggagccucccuggggcugcgcggggagacagauggguaggcuaucggaggacaggcacaaauacuacagaaauacaaaucccuguagaucuggaaaaagucaggcacuggacuugaagcuagggcugagaaccucugcacugugua

SEQ ID NO: 2586 - RNA, 897 nt, Mus musculus
uacacagugcagagguucucagcccuagcuucaaguccagugccugacuuuuuccagaucuacagggauuuguauuucuguaguauuugugccuguccuccgauagccuacccaucugucuccccgcgcagccccagggaggcuccacuacuccaccugccgcugcucagccgcuugcuucuccccuaggugggcaguaacccugugaucaccaggucuugacuucagccugagcuucccucccucuguaggcuguuugccuucuuacuccuggaaucaagguagggagcuugcauagcccauuacucaacuugcaggggaguuaucaaucugucccauaagcggaagggugcacaagauacuaacaauccaagacagauuuuggguaacaauaguuuauagaaauuaauaggcuuacuaauuuaucacccgcgccccccaguucugacacuucgcuuuguccucagccccuaaacaucuuucagcauacaugaucacuuguuaaaaaguucaucaaaaguuuacacagaaaauuaaaucauaaacugaaauagaaguuuacaacagagaauguuuacaggcaugugaggagcggcccgggacugcagcuaagucuuaugacuugcaccugacuuccucauacaccugaaaauaagccaugaccaucgaccaucgugagagcaggugcaccauaaugcuggcgguguaaacaaguccauauuugguggaggcgugccccugcugcccccauuggcugaagcugcaugccuggugagguggcuuggccugccuugaguggaugggggcugagaguauauaagcagaccucccuggguucccaagguccccuuagcagcaucgagguguuccugcaauaaaggcuguugggaagaaucc

SEQ ID NO: 2587 - RNA, 238 nt, Mus musculus
caaauguaaucaaugugguaaagccuuugcacgacacggucaucucaaaaugcauaaaaucacacauacuggagagaaaccuuacaaauguaaucagugugguaaaggcuuugccuaucauagaacuuuccaaguacauaaaagaacacauacuggagagaagcccuaugagugugagcaauguggcaaagccuuugcauaucaaaauuauuuccaaguacauaaaagaauacauacu

SEQ ID NO: 2588 - RNA, 15149 nt, Mus musculus
ccucuuaguagcugagcaggcuugaaugguccucuguucugacucuggaugcugugacucgcgcucuggcaagcuuuaaaguugcggcauggugagcacagggucacugccaacaaccgggaggagcaaggggcugggcagugggagcugcuguguggguucccgccucccugcccccccucccccccgcccgggccgccagauggggccaccuaugaggucaggugcggccaccuaugaggucccuugugguccuagacaauugcuagaccaagccucugaauaacuucauuguggggacugcaucugcgaagagcauuugaaauaguggcuuguguguaaaaagaucuuuagcuugaucccaaacucagagaguccuaguuucuacaaguucuguuguuagcauuugacauuaagguggacaauccauuuggaguuaauuuuguggagguugugugcuggguagcaauccaauaucaaucugugauguaaaaguacaggauugaugauguaaaggauuuacuaaagcuuaggagauaguaaggcacucuaaguagaauuuaucuaaggguggacugcauuuaacacaucccauagaugaauaauaugcuaaccaggccuguuagaaauuaggauguuaggauacacauguuuauucaccaggauuguccagaaauauggcuccaaaccauaauaaaggaaacaacccugauuuacaaccagccaccaaucccauccccauaucaaagagcaggccucuaaccagcugcuuaauggggcauuacaggaucauaaccaauguuaauuagggccuagugugccauaaaguuucaguuuuuuucuugagaaaagcauaguuuugccacaugggcaagaugacaccuggugacagacauuugaaaaguuuaagaaacaaacucaggaggcagaggcaggcccauuucugaguucaaggccaaccuggucuacaaagugaauuccaggacagccagggcuacacagagaaacccugucucgaaaaccaaaaaaacaaaaacaaacaaacaaacaaacaccacuguuguguugaaugcuggccugaucaaguaaggcuuucuuucucugaaguccacguguacggagaaugacacaacuccuucugaaacccaggaacaugcuuggcagagccagucacaauuuaaggccuaguccuugggagcuuucccugaggcccuggguauagagaaaacagggcuccuucucuaaaaccuggaaugugcuuaggagcuggugguaaugguguggggcagggccuuugggagggguugaaucagauucugagagcacaacuucccaccauauggggcugugguuaucaauuccaaggccacuagaggcuuggucaguaguguuucugauuuacauugaguuccccucgcgcagcaguguuuguuuagacuucaccugagugcgucccauucgaugaugcuucugcugacuucacagaagucuccuguuuccuuccauuucccccauguaaguaggguauucuuuuuucuuuuaaaaacguauuuauuuaauauacauuuguacacuauagcugucucagacacacaccagaagaggauaucagauucuauuauggaugguugugagccaccacgugguugcugggaauugaacucagggccuuuggaagagcagucagugcucuuaaccucugagccaucucuccagccugauguuauucuucuuaggaagcuuacuuagcauaagacacagcuugugcaagaccuccccaccccagcuuuuauacuuucuacguucuucuccuauguuuuucaucgucugggaccuuccucuugcuguguaaauuucccaugugucuuaguggcuagacuugcagucuccagucuguauuuaaguuguucaaaaccuaaccuggaaccugaaccuaaaagagacuuaagggugacagcauauguggaaugcaaaaucuguccuaggcuggcuccucuauuagcauuaaccaaccuagcuggucauugcuacuuuaugguuucuuuuuuuuucuccacccuuaauccacccccaauggcccuuaguuucaaccccccuaccacuagauaggagagaaacaaggauggaguagaaagagauccuugaaucuaauuucuuuccuuguacuugacccaccagcacacguugaacaggggaacaugcuucugaagggaagcgaggaugaaagauaggaagggcagaaagaagauggaaagccaagaguuagauuuaggaggacugcugcggcagcaaccagcauccucaaguuuauuuuucuuucuuuuuuuuuuuuaaagauuuauuuauuuuuauuauauauaaguacacuguagcugucuucagacacuccagaagagggagucagaucucauuuuggaugguugugagccacccugugguugcugggauuugaacuucggaccuucggaagagcagucaggugcucuuacccacugagccaucucaccagcccgaguuuauuuuuuauagucuuuuuauacccccacaguaccuuaggaagcaaagccacaagcuaacagaaagaaauugcagaaguauacacaggacaccuguucuuucuuauucagaggggccucccucuuccuuccaccaagaucaauagaacuuucagcuccucugcaccuugagccccaggugcaccuccucucauugguccauggcucagcaggcugggaagucugccaacagacacugacagaguucccccggacagccagggcuauacagaggaacccugucuugacaaccccccccaccccccaaauaguuaagcuuaacuuauguaaguguggcaaaaauccuccaggacacuuuaagaaucauuuucuuccauuuauauguauaauuaagagacucaugaguuaaggguaauuuccucuguuuuuaaaacaauguauuucaugugugaguguguggaagacacacaucuguggguccuugucuucugugcugcauagaacaucuagucaacaggaccccaggcuugcacacacucugcacugccccagucccagccaacugaccuucucaagcuuaagugaaaaaaguagugcacaacacauauaacaaaugugccuuuaagauaaaugaggagacuucuuauauaaucacuguauagaaaaggaaugaugaagaccucuauaggauuuacaguugagugaaaggagcuaguaugcuuucuaugaaaauaacaucauuagccaaauauaaugaccugaaaguugcaucuuagacauauacauaagcgucguacaccaaaagggcuaugguuccuauaaaucaaagguagaaaucaucugacuuuaagaacaguauaugauuuuaauggaaagucuuacaauacgagcugaguggcuccucuggcuuuucugucugugauuuuuuuuauuuaaauauuucguaguaugaauaagauugcauuuuuaaguauaaauuguguuuacuauuuuuuaauuuuuaaaauuauuuauuuauuuauuuauuuuacuuauaugaauacacuguagcugucuucagacacauaccagaagagggcaucaggucccauuacagaugguuuugaaccaccaugugguugcuggaauugaacucaggaccucuggaagagcagccagugcucuuaacugcugaggcaucucuccagucccguauuuacaaauuuuuaucuucuugaauucaggggcuuuuucgcaagaccauguauuccuuaccuaucuaugagguugugucuuuugaggguucuggguaccuaaauuucauauuacaaacugaaaauauccuucaccauucccugaaucuugcugaccauuguccugucugcugcuguuucuuuuuuuuuuuuuuuuuuuuuaaaguauucuuuuuuuuuuuaagauuuauuuauuuauuauauguaaguacacuguagcugucuucagacacuccagaagagggagucagaucuuguuacagaugguugugagccaccaugugguugcugggauuugaacuccggaccuucggaagagcagucgggugcucuuacccacugagccaucucaccagcccccucugcugcuguuucuaugcuaguaaauagcagguggugagcugcauugagacccugacagggaaggacuccaacccucuuucaaagcacugaccugccacuaaggucugucuuuaacucaugucucauucuggggaaaacagauuccuuuaugacauuaguauucauacaauagcauuuuacuuauuuuauuguacuguggaaaaccaguaagugucacuaucucauguggacauuagaucauguuauaauguaacuuggugcagauagccuaccuguaugcaggauacugucgugggguagaaucugaaguacaauuuagacguuguugugccugccaauuggugucccuuaaaaaagauggucguguuuguuucucuuccccuuuuaacccuuuaaaagugauuugugcugggugugguggcgcacaucuaggccagccuggucuacagagugaguuccaggacagccagggcuacacagaaaaacacugagcuuuuucuuaggcuguuuucuuuccaguucugucuccauggucaucuaccuuacaguugucuauguggucguguucaguggcccuuucccccaaucauuuccccaacgcuucugguguuuguuucuucuuuuagaagaaauagaauaauuuuuauuauuuaugauuugguaaugucauuauacauuuuaccauauagcuauaaacugcccaauauauaaugugaaguaaaauuaagcaauuuuuuucuauuugaugguguuuaaugauuuagguucucaauaacuucgguuugccuacuagcuauuuacugacaaacagaaaaaggggucuuaaauguacuguuagggcucaaaauuuuuagguaggguaagguaauuucuuuuacauaaggcauucuuugugauauuaaaagucauguaauucccuuuuuuaaaaaggaaagauuauuuauuuauuuauuauaugaagguacacugucacugucuucagacaccccagaagauggcaucagaucucauuauggaugguugugagccaccaugugguugcugggauuugaacucaggaccuuuggaagagcagucggugcucuuacgcucuaacccaucucaccagccccuuaauucccuuuuuugcaaaauuuaacaaauauaugaugguuguaaucagcacuguaaacaauaccauauugaggauguugauucacauucuucuacucuagacgaaaguaaaaucuuuucauuucuuauuuauagcuaaugauggugugaggagcagaguaaauaugaagauauuuaauugauaaauauuaaguaguuccuccuuuuucuucauccauaugcuguaauguguaaggacagaguuguuuugcaaaaaaauauuccaaacaugaaacauuccaccuucuuaucuucagaaaauauauaaagaauaaaauuaaagaaaaauauggcauaaguuucuguacucagaguaacuugcugccaagacauggaaggaagcagagcacgaacacaguggaucacagaacaugcuaucuuacguaaaucauuuaagauuucaaagugaaaauuuguuuaguucuuagaaaacaugaaaauaauguuuugucccaaggaaaaacgacuaccucauaucuuuaagggaaaagaaagauuaaagguaauuccauuuuaaaaaacaguauauuuuguuugagagcaaagaugugcuaguacacaucugcagugcuguagaguauagagauaaggggaucuuaucuggauagcuuugugcauguccuggaccucuuauacaacuucaguccccacugugucaggagccauaaugggacaagcuaauaaauagcaggugaucacccugaaguggccugccucggauuauuauauaaucuuugacaggugaggccucacuaagcaacgcucugagguacuuauuuuaggaaaguuuccugcuauuaauaugcuuuuccuguuauuaauaaacauauauaacuaccacuaaguagcagcacaucccuuuggagcagaucucuguagauccacagagaugcacuaucuuguagugaugcuauauagacaaaaagaugacuuaagucuuuuuuuuuuuuuuuuuuuuugguuuuuugagacagaguuucucuguauaguccuggcugucuuggaacucacuuuuuagaccaggcuggccucgaacucagaaauccgccugccucugccucccgagugcugggauaaaggugugcgccaccacacccagcuugaugaacuuuuugacacgugaucauguauucugaaugauguuuuaagugcugaggacaaagagaagagucagaacugagggacagggugagaguuacggaggugagaagaacugagcugagagaggaacugagcugaggcgaaauuuuuagacagaacacuuuuuagauuaggacaauggagaguggaguagcuuagaaauuauaggcaacauaaaauacuaagagaacaaugugcagaaugcagagggaaagaggagaaaagaagaugucgcagggagcagaaggagcaggcagacuucuccuaaccuugggacagaucaggugccauaguaaggacaaggcagguuuaaucuuacuaaaagaaacaaagcuuuuuuucuuacaaacauggguuuaaaucauuuagcauuaaaaagguagaagccuuuucuuucucuaaguaauaaagauuggagcacauuuuuuuuuuuuuuuuaauccagaaugagugaauccuugcugcacccauccuuggucuuuugcuccauaugcauauguaaguauggauguguguauguauguaauugugagaaugucugcuuguguguguguaaguauguuugaauggaaaugaauaaaugagcaugaaugaagcugaauaugaauuuaugugagauuaugcauauuugcuuauguaaaaguuuuuucuucugggaguguuuucucuucuccugacucaauagaagucuauugcucuaaacucccuccuagaccaacaaagcaggaggcaucuggacaauaggggaaagagucuagcaauuaauccuuuacuuaaucuccugcuguuuuagggugaggugcugagugccagaaacugcgauuucugaccucagaggaucacagaaggcaggucagcuacaacagcauaguaacuuagacuuagauaaguaaacuuuuuauuauucagcaacccuaaauuuuugguaagacuuugucuuaccccagaaucuccuaagacaaagucuuacccucugccuaugcucuucccccuccucugccucaagaagaaccaacaagaaggaacgaacaaucacccaacgcuggggcuuagccacggcacaacuguauccuucuuaacugaucauuaaagauguaagugaaaauaaauuauacuaugaauauaacaaaccagaaauuaauaagcgcauucauuucuauaaauuauuguuuuccaaaaucugucuuuaauuguuaaaauccugggcacccuuccucuuaugggacagauugauaacuccccugcaaguugaguaaugggcuaugcaagcucccuaccuuaauuccaggagggagaaggcaaacagccuagugaguaagggaagcucaggcugaagucaggcccuggugaugacagggucacugcccaccuaggggaggagcaaguggcuaagcaguggcagguggagugguggggccucccuggggcugcgcggggagacagauggguaggauaucagaggacucgcaccaguacuacagaaaugcaaaaucccuguagaucuggaagacguugagcccuggucuugaagcuugggcugagaaccuacaccauguacuuucagcacccucuagcuuuaagggaggugcucgagacuuacuggccaaucagagcguuuaggcggaccugccaaucagaagggaaggcggguuuuuccggaugccuugacuuaguugcugagcaggcuuaaauggaccugugugcugugcuccuuguccugccgcuggaugcuguggaucuugcucaggcaaacuccgaacuugcgacauggugaacagagucacugccaacaauggggagaagcaggggucugagcagugcgagcugcuguggugcgagcugcuguggugggucuuuccugggacugagugggauuuggcggccacgugugaggucccgugagagccuagccacuugcuggacacaguuguagccucugaauaacuucacugugggggcugcaucugugcagagcauuuggccuguguguagagagaucuuuggcgugaucccaaacucagagaguccuaguuucuacaaguucuguucuuagcauuugacauuaaggcugacaauccauuuggaguuaauuuuguggagguuguaaaaggcaucucaugugcuggguagcaauucaaugucaagcugugauguaaaagauuagaauugaugauauaaggauuuacuaaaguuuagcggauagaaagacacagcaaguagaauuuagcugagggugcacugccuguaacacaucccacugauaaguaaugugccaaccagggcaguuagaguuuaggaugcuaggauacacaugcuuguucaccaggauugucuagaaauauggcuccuaaccauaacaaaggaaacaaacuugauuuacaaccagccacuaggcccaucuccuuaucaaagagcaggccucuaacaaucugcuuaauggggcuuuacaggaucacaaugaacaauaagaccugguguaccauaaagguucaguuuucuuuuugagaaaagcauaguucugccacacuggcuagaugacaucuagugacaaccauuugaaaacuuaaaaaaacaaaacaaaacaaaacaaaaaacccacaaccauugcacugagugcaggacugauccagcuacacuuucccugagguccccaugucuggagaaggacacagcuccuucugaaacccaggaacaugcuuggcagagccagucacagccugggccuaguccuugggagcuuucccugaggcccuggguguagagagaaaacagggcuccuugacuuccuuuuuuuuuuuuugaggacauguuuuaauauuuuaaacuguuaauauucaacaaacaauaauuauuuaagauauauuucauuguuauguuucccuuuuuuuuuuuuuuuuuuuagacaggguuucucuguauagcccuggauguccuggaacucacuguguagaccagguuggccucgaacucagaaacccgccugccucugccuccugagugcugggauuaaaggcgugugccaccaaguccggcuaugucucccuuuucauuucugauuuuauuaauuuugauauugucucugugcccucugguuacucuggcuacaguuuuaucuaguugauuuucucaaagaaacagguccuggucuuguugauucuguauagaguucuuuuuguuucuauuguuugauuucagccccgagucugacucuuuccugacaucuccuccucuugggugcauuugcagagcuccuucucuaaaaccuggaaugugcuuggggucuggggcucagggccuuuaaggaggcguugaaucagauacugagagcacaacuucccaccauauggggcugugguuaucaguuguaaggccauuagaaguuuggucagaaauguuuuugagaaacacugaguuuucccuugugcaccacuguuagauuagacuucugaaugugucccauuguaugauguuucugcugacuuaauaguuucuuuaucuuucggcugacuucauagaugcccucaucuuccuuuucccucguguaaaucauguacaagaugguauucuuaagaaucuuacuuagccagcgcuugggaggcagaggcaggcggauuucugaguucaaggccagccuggucuacaaagugaguuccaggacagccaggccuauacagagaaaaaaaaaagccuaagaagguguccuaagggaagcacacccuccugcuaagccuucaaccaauggaagaaguaggcaaagugauuccuagauccaggaaggaaauucauauaaaaccugcuacaacuguaguccaagguggcaugguccaucccaauuuagaacccaaaccuugcaggaucacccaaguucuggaaacaagauguaagguccuagauucuuccccugugguuucaguucaucacuguuucagccaucuauguuuagcagagucaaagucccagugagggaggaugcugugagagugcguuguaugaaucugugaggauaaagccugaguugcauucugacaccaggacauauugagauaccuaagcuaggagacaccugccauggagagcggcauagagagagugcaaguaacuaaacugagagauguaugagaaguuucagggauagggccaucuaagccuuuugagacugaguccccuugugucugagacagagcuacaggaugugguguguguccugcuggguuuucugccuugguccagucuucccacacuauguacacauuccucucuauuggaugggagggggcauucugugccuuuguauguugggaagauauaacuuacguuuugauuuuuuacaagauguggcaaucaagagugucagaagagacuuuggacaucugaacaguguauggguugcugcagacucuuaagaucauugaaguuaaacgaaauacauuuucaucauggauggccaugagccuauagugaccaggguuagaauguagcugauugagucagagagcucccagauauaauguugucuaugaacacuugucucuuuuuuuuguggcuuucuuugaggagcuuauaauguuaggguccaagaaucacugaaggaagaccccagacucaaauaguaugcaaaagcaaagagcauuuuauucugcagaauucuaucaugcaggauggggacagacuugugagcuuugcaagcuccauuuaaacccgauuaggggaauuccagggaggaguaggugacuuuuaucccgauuguuugacucaauccccagggggugugugugucuuugggauuggucaagguucuagagaauuuaggggauguucuggaaccauugcucguuaacuauucuuggcucaggcuuggcucaugccugauggcaggggcagcuccuggcugcucaugauugggggaggggucguuuuccuggaauugacuuguuuggacuuuuccaguucugggaagcagaaacuuaggccuagucucccaaauugucaguuugcagccugucauggagucagccuggcucuggccaauacagucuuuucauuagaagcuuuccuaggagccaggugugguggcgcacgccuuuaaucccagcacuugggaggcagaggcaggcggauuucugaguucgaggccagccuggucuacaaagugaguuccaggacagccagagguacgcagagaaaccaaaaaaaaaaaaaaaaaaaaaaaaagaagcuuuccuaggagggaccuuuguagauucuuuauuggggaugagauuugagugucuauaguuucaacccauuuccugguguguguguguguguguaugcgcgugcaugugcguccguacuguguugugguugaaccugaucagucagcuucauucucauguugucuugcuuuuaccauuauagacucuaucccuaaauuuacaugagaugcaguugaagcaguuguuauucaaugcuaaacuauuuugugaaccugguguuuuuauauuuuuaauuuuguuguuuuggcuuugguuuuuaaagacaaaguuucucuauguagcccuggcuguccugaaaguagauguguagaacaaucaaggcucaaacuuaaagguccaccugacucuggcuccuaagugcugggauuaaaugugggccaacaugccuggcuuuuucuuucuuuguuuguuuuuauaucauuaacugaugggcuugcaauguagauuuugguacaugucaagcaugugcuguuguguugaucuucaugcacguugugaauuuugacauuuggcagagagaauuuucuguuucucaggauggggaguauucaugacauugauacugccugagcuuuacugccugagcuuucugagucauuggauugcaggugcauagcauucuuccuaccuguugugguuguuuugauuuuuuugaaugaaugaguauuuugccugugugcaugaauaugcacauuauguauaccugguccccauaauagucagaaaauggcuucagaauuucugaacuuggauaguugugaagcccuggcacacaaguacugguaauugaguucaguuauuugcaagaccaguaagagcucuucacuggugagccaucucuucucccauauauugcugauuuaggaucaauguuuacauugccaauauuuuccuuuuuuuuuuuuuuuuuuuuuuuuuuuuuuuugagacaggguuucucuguauagcccuggcuguccuggaacucacuuuguagaccaggcuggccucgaacucagaaaucugccugccucugccucccaacugcugggauuaaagauagggccaccaccgcccggccaauauuuccaucuguccuuuuuuuuuuuuuuuuuugucuuuuugagacaggguuucucuguagccuuggcuguccugucacuuuguagaccaggucacuuuguagaccaggcuggccuugaacucagagauccaccugccucugccucccaagugcugggauuaaagguguggccagcaccgcccggccaauauuuucaucuguccauuuuuaaugguuuaaagaugcauucucuuuuaguaagaucucacuacuguuauauuuuaaucugggagcacuucaggauucuggaacaugaauacagaacuggagugaauguguaauucuuuguaggaacuccaguaaaaaccucugaguucuuucuauuuuucuuguuugauugaucuuuauagggaagacagggucuuucuauguaccucuggcugucugggauagaccaggcuggcauagaacucaaugagauacaccugcaucugccuccugacugcugggauucaaggcaugcaugaggcauacacuaagcuugcccaucauuuucuguaguuaguaauuguucauacaauuucucugaugugugcucaguucuguuugccuucuccucuguuagucagcauuucucuuguaaggcuguauccuauucaaagagcaaagaaaugacagaggugaaccuuauuauucaauuuccuucuaagaugacuugguaauuacauuagaacuucugggucaagaaauaaguggaagaagcuucagaauuauauaaauauauugucauugaagcauacauuuacaaugaugucgguaucauguuuucuguuguacacauguaugggauauuuuaggaugcauugacuuaugaugaugugcaugugaacuucacucaagaagaauggauuuugcugaauccuucacagaagaaucucuacaaggaugugaugcuggagaccuauaggaaccucacugcuauagguaaaauagugaauuuucuuucacuuuuuaaaauacgggaauaacuguuuuuuuuuguuacugaugcuuuucuguaauuucaauugagaaugaggaacaaugacguaauaaaucagguucacuaaggauaguaacuuaaauuuugucuaauuuucaauaauauauuuauacauuuucugguacuauaucuuagguuauaauuggaaagaccauaauauugaagaacauugucaaaguugcagaagacauggaagguaauuuucaugugcaaguugcuaugaauaugccucugaagaaauguucauguguccuggaacuuuuaaagaaaagcaaaaguguaaaaagaaagcacuucuuuaaguguaucgauuauuauuaaauucucacaaaucuauguaccucaaugucaggugucugaauuguguuugcaaggcauuccucuaugaaagaagacaaggaaacaaugccuuucacauauuaccauuugaaccauagccacauuacagcuacucuguagaacugccaauauauuuagucucacuucaguuauacauugcaaaagauauauaucuauauuacauauauauauguauauauacacacauauauauaauauguuuuuaauaagcaaauauuauauaguaaaacugauuucucauauaguaacauugcuaaguuuaagugagagggacaguuuaugggagucaaaaguguuguuggggagaaacuuuaaucccuauacuacaugucuuugaugaacaaaauacaaacugugugaaugcaauguggaaaucuuucauuucuuauucuuuuaauagguauaucaugugucacaaugugacaaaccaugugagcauagggauauugaaauaagcaauguaccucucucucucccagaacaauugaaauguauguaguaguccacauuugagcaaacuuucucagugugauacaagauuacaauuaguuaguuuuccaacuucagugggaauauauccauaaacucgcacugcagaaaauccgugugaguacuaggauuauggaaauucuuuucuguuuguccugguuuacuuugccaauguaguguggaaauguaguguauuucacaauauaggaaaauuuauguauguacuuagugugguaaagcucugagcucuuccauuucccuucaaauuugugaaaaaucucauagagaaaaaggauguuacaaaugagagccauguaauaacacucuuaccauuacagguaugcaaaacaaccuauaaugaaggcgaaaccaugaauguaaacaaaaugauaaaaguucauugguauauagaauguggcaaagcuucacaugugccaauuaucuuugcaggcauaaaagaaguccaacuggagagaaacccaaugaauauacucagugugguaaagccuuugcaugucauaguuauccucaaagguauggaagaauucauauuggaga

SEQ ID NO: 2589 - RNA, 4340 nt, Mus musculus
guuuuucgcugcggguaagcgaucugcucucgauccucccagagccacccuucgcggcacgcacaugcgcccuguuguucuucccgucccucccugcucucccucccccgcccccgcagucucucgcugcgcgcgcacgcgccaugcuuuuucugcgcgccgccgugcucccgggguucuggcucccgcgugugcgccgcguacaacucguucggagccccgcggugacccugccaagucccguccgcacuguccacgccgggagccgggucugggggagcgcgugggcggggggcggucccguccguggugggggcgaggaggacccccgugaggacgaagaggaagaggaggaugagcugcuccgcgccccaccccuccugcccuuggauacacagcgcguuugcguccugcauccugacgucaaacgcccggccggaaaaaagccucgaagcacagguaucggguagggcgagaguggggauugagcagggaagccggaaggggcgaggaccugaaggccgaaacuuacuagugcuauacaggaaggccacggggaauuggggcggcggugacgccuaguucuggaaggggcggagucacgagaaaggaaggagaagccgagggaggagcacugggggcaggguacuaugauggacaucgggcguacgguagagaguguggauagucugggaugugcuggguucguggcugcucuccugguggagucggagucuggcgagcuugcgugcugggggcgugaucuggcugagcaugugaugguaccugggccugcccgaugggugaggcugcgcgugcuccgggugggaccuuggggcgggacuauccuaaauuuguaggcggagucuggggggggggaacauugggcgcugggggcgaguccuagagguucugccuuucccugguagagcuuuggaucauggccuggcgagcuucuuaggguugugaugugagcugcaggguggggacauggugugggcgggggaugcggacucugcgcgggcgcgguuucaucccagagcuaacccuguccaccgccgugguccgaggucuucccgcucggcccuugacuggauggacccuuguguccucacagcggaguggcagguggcagaggcggccgcccuggugcgcgcacuuccaggauggucggucgcgaguacccugguggugcccagcgcagcgccuggcagcaggcugguguucggcaagggcaacuuucaggacgugacaggugagcgguaccucaccuuuggccgcugggcaugcgccucaccugcgcugguguaggaugggucagacugccucccguccuccuccuaaccccaugacgggccacucccugugcuccagaaaagaucaagggaugccaggacaucacguccguguuccugaacguggagaggauggcgccaccgaccaagguucccuuguguccccccugauccucacaugacccaugacaccaugugaccccugacugaucccugcguggcccccaucuccucagaaggagcuggaguccgcuugggguuugcguguguucgacagauucacccuaguucugcauaucuuccguuguaacgcacgcacgagggaggcccggaugcagcuggcgcuggcagagaucccgcuccucagguucgcgggugauguuccccgcauguccuccccucguguuuuuaccaccugcccucucagggagucugugggugaugcagcauguagugcuccccacauguucucuucacauguccuuggguacucuccguauguccucccuacauguccuccuugcguauccucucgcgugacuguagaugcugcaacagguggcagguggugcucuccgcaguuccuccccgcauguccucugcacauauccuuggacgcugugacaggggugcucccuguguccuccccuccccucaugcgcuaccuaccugccucccuccagguccucugugaauaccgacucugggcagcaagaccagcaaggcuggggcucccgguacaucauggggucagguaagggccagagguguguagaggggauauuggggagaagggggacauggaggggaacacaggccugugaugcggggcugugacuggggucuaauguaaugacugagcccugggaucacagcaggagggacugcaagguauggagaguucacaugaccccugaccuuuacauggcccccuugugcucacuucaugaccucuccugaucccggaguucauuguguacccgucgcagccacacaaacuggguuccugagugggagguuggagcuguaagggaggaaacgaaagaagaaacgagaccaagacaaauuucugaucauggcccaauguuuacuaagagucugugcuuauaaagggggaaagcccauuucccugccacccagacuucuugaugcuuuguugccaaguuguuagcacuuagucugcuagagcugcuagcauuaggucgccaauucgacagauugucagcuaucccaggaauaucucaggaagacagguucagccuuuuggguuauuggcaucuuggagaagagcagcacaggugacagaauagaccuaucuaggucuggaagacuccaccguagguggucucauccacagugucagaauaacaggucugagucagccugcucaaggcuggggaugcuauacauugaccuacacaagaaucugcucagagcccaacugcuucauggaugugugacaggccggcugacuaugucuuucugugaaugacuggugugaucccccaugggaggaucugcucaugcguugccugucuggggcaaggucaggcgggauucccccaagaaugugauguucaugcccacagaagacccugaaguucugcaccgggccacaguucuccuuccccugcccccauacugugucucuuguccucccaggagagucacccacggagcugcgggcccgcgcacucagggaccgggagcugcggcuccgucguguccuugagcggcuucgggauaagcggaggcugaugcggaaggagcgggugcggcgagaguucccuguggugucaguggugggauacaccaacuguggugaggagggaggggcccucaugggaggccggggugcaccaguguaggcauggcaagagcuggggcugacagugccacguucucaccugcucccucccagggaagaccacacucauccaggcucugacgggugaggcugcuuugcagccgcgggaccaaccguuugcuacucuugaugucaccguacacgcgggguugcuccccucacgccugcgcaucuuguacguggacacuauuggcuuccugucccagcugccgcacagccugauccaugcguucucugccacacuggaggacguggcuuacucgguggguuucagggaccugacgguuggagccuguccucugugcgguccucugugggugucaggucacucuccuuguaggccugggugugacaugauaccccggcaguuucugucugcagacugcuucuguccucuggccacaccccuagaccacacuccucaucucccaccucugaccacaccccuucaugaugccugaucuugcuccuauccccaaccacgccccauacaggauguccuggugcacgugacugaugugagccacccugaugcagagcugcagaaggccacuguccuguccacauugcggggccugcaucugccucccgcacuguuggagucagcguuggagguucacagcaagguggaccuggugccggggugagugugguacgaugggcagggugguggcccacaccgcccucccggccaaccccacaugagaucaccuaagucccccgccccugcagguacacuccaccaugcucuggagcccuggccgugucugcaaucucagggcgugggcuagacgagcugaaggccgcacuggaggcgucagugcugcgugccacaggcaggcagguccucacgcuaugugugcgccuugggggaccccaacuugggugagucgugugggggugcccacccgugccuguaccaucucucagcacgcccugagaccucccagcaugccugguggugauuuuugugugucccugcagcuggcucuauaaggaggcgguggugcagcaggugcaggagcugccagagggugaugcggcccacgugaccgucgucaucacccaggcugccuauggccgguucaggaaacuguuccccauugacgccccuucugcccucccacauugacugacaguaacuuauuaaagcaggauauguccugugucucccucac

SEQ ID NO: 2590 - RNA, 36136 nt, Mus musculus
cucgccucccguggaucagcugggguacccgagaugucuguugacagcgguggcggcgacuguaaggccgguuccgggauccgcgcagggcgugggguaagcuggccggcgggugggguccuggcuggggaggcaggcggcggccaggcuauagcagcggugcugagcguuuuuuaaguagucccugagccggcguuucugggucucuguagaugugaguccuauggagcuacacggggaagagcagccgccgccgccgcaggaacccugggggaggcuucuucgucuaggcgcagaggaggacgaaccccagauccuucuuuggaaacgcgaguggaccaucggaaggaggagaggugcgguggccagaguggagugaggacgaggauaaaggcuaaagggguagacagggaugaagcauagggaccuaaaguggguacccaacugagaggagaccgagggccuagaacaggaucgaagaccuagucagaguggguuuagauggggaaaccgacaggggguuugaagugggaaaaguacccggcuggcgauacagaagcuacuggaauucggggggugugugugugugcacuguuuuucaacccccccccccccccauaaaaugggcuuauuuauuugugcaguugcucuucuggaugcuugaugauggauaucagucaguucucaguacaacuuugugaaauagaucuguaaauauauccuucgaaauacgaucuuguccucauuacuguacacuucucuuucucaaugaaaugcaauuagaaauuauuaacaaaaggaaaacugaaaaaagguauguagaaauuugacaccacuguuaaaagguugacgggugaaaaaaaauaaaccacagggacuuuagaaaaaauguuuugugacaaaugagaacaaagaauaugcuggaagacuaggacacuguuaaaccagugcucugagggcaacuuauaauggcaggguuucuauuugaaaagaucucaaagucccaggaaauagaauaauuuauuuaaugaacuuaggaaacugagaauuugaacaaaguuauacacagaucccaacaucgauugcuuugggucaaggacauacauuucuuuuuuucguuuguuuuuguuuuuguuuuuuuugggggggcgguuaugaggcaggguuucuauguauagccuuggcuguccuggaacucacucuguagaccaggcuggccucaagcucagaaauccaccugccugugccucccgagugcugggauuaggacauagauuucuauaacuuguguccaccuuauuuugcuaggaggauugauaaaaucuuacaugaacugcuuguguguaaccuagcuuuggacucggagagagcuuagaugguaaagugcuugaggaccugaguucaaauccccagagccuauguaaaaaacuaaguguggugguacaugacuaguccuaguugugaggaggcagagacagaaggagccacguuugcuugcugggacuacuuuugcagacuucuugagcucuaggcucucauugagagacccugucugccucugcaaacaugaucaugugcacaugcauacacauacauuagagagccucucaccauaauacacauaucaagacacugcauugcauguuaaaacaaaaaacaaaaaccugcuuucuaauagaaaugcuuuuaauaauuacuuucacuaacaauguaaaggucacugcacuaguuugcugauacuauguggaaggcuaaaacuaaccccuggagguuguucucugaucuucacacuaaaaguuuuacgggauuuuaaauggaauugacuuugaaugccagaggagaagaaaaguagugucuuuuuuuuuuuuuuuuucuuacuuuuuuucuuuuuugguuuuuugaggcaagguuuuccuguauaacagcccuggcugucuuggaacuuccuuuguagaccaugcuggccucaaagucauagagaucugccugcuucugccucucaagugcugggauuaaaggcgugcgccaccacagcacagaaucuucuaacuccugcuuuuuucugucuccucaagccagugucacuggcagauacccucaccaugacuuucuacagcuuccacuaguugucaguuacuuccucuuucaggggccuggguagaaccugugaacccagcauccauggggccuucccuagcugggccaugucugugucuuaccuuuucauguacucaucuucuucuuuggugccuaaguugugucugcguguuggcugggucuguugagcuauuggcagggaaugcaaagaucacuauguagaaacucagugacugucagaccagagugagcagaaggcuaauaauaguagcaggggcuugaggccuucugugacccaucaaccacuacugcaagaccauggagggcuuuagaacaagauucuugcugccuuuauuggcagcucuagauuugagcacagauggguaauacccaucuagcugcuggugaugucugaaucgguguuugauguaucagaacagacccugugucuaagucugaaaaccaguaucacuuaacugaccgugaacaaccuggagauguagguuauaaaccuugaagaaaagccgaugugccugcagaaucacaaagcaucugcacagacuggcagggacgugacguguauuucgccuugggcauugaccuauacgugaucuuaaaaaagacaagacaguaugagauuguggcagagaagaacuggugaguagcugacacugaaucaaacugaggagcuggacucucagguggucaccacauggaguaacuuaacucuacacaagcaagucuuagguuauggaccuacaacauauccuuuacaguccugaaauacagcuuccauuguagcuugacaugcaagcauuccuggaaggcaugcuaacagaggaguccacuuuagagaccaguuauagagcccaguuggcacaaaccuaggcaaugaucagcugcaucuaagccuaucuggguaccauguaugcuggagugccagcaacucguggacaucagcuaguggcugggggaggauagccaacuaugcagccugguuacuguccaaacacucauccccagguucucugagcuauuagauaucuagacuuuuuuucuuacagagagcuucaucugguaaaugaagggagggauccuggccuuggcucauucccuuuccugccaauaaaguuggugguucaaggagggggaaaugcugugucuucugauccaccaacauauauacaguggcaauuuuggaauuuuugauucuuuagaaaacaggaauauuguaagaauauaguauggagauguggagcugcuucagacuguccacagcagcugaccaugauuugcuucaugcucuggcaggagucugauuuugccaguggcaaauaguuucuacaauugugugacauuugguuugaauucuggggaauuuucaaaggguauaugagugguaggguccuaagaggcaggguggguuguugguuguugguugguuguuguuguucguaguuuguuaagugguuguguccaaagaagaaacaagaagagaaaauuagauauccugauggcaaagaucaaauuugccucaaggaacuggaugccccuaaugagcaggaaauaguuuaaagauaaugccagucccucucuucuguaucuuuuuuuuccucucuuaucuaucauuaggggguugaaaggguggaacaaagaagagcccacaaaguagccaaacacagcuacauccauaggucagugaugaagucaaacauagguccaaacagaauaaggcugugaucgcauguggaacguaguguccccuuacccuuauuuugagacagucuuaugauauauagcccaggcuagccucaagcuaccuuagccugggguaccucaguaugagauucuugccuagcuguuauuuucauuaaaagacaggagcucuaguggugcagucugucagcacauauacuuccauaauuuaaagaaagcacuaauuucuuuuuaguauuuuccacuuugcauuuaauaaagauucuuuucuguuuuauauuuucucauauaugcccuaugguacuuuacuuagccauauuuucuguguuuguccuuacuucaguuuuaugauuuauguaacccaaaucuccauagaggaaaaacuuaagaauuauuuuaaaauauuaaaaaaauuaauuaagcccuuuuaguuuaguuuuuuuguuuguuuguuuuacaauuuagauacuguuaucuguugagccguuugugagauaaacuaucgugacaaagcugcugauacgaugagaucucccaggugacuggggugaagaagguuggggcaaacuucuaucccuuuacuucaggcuaacacuucaguauucaaauguugcucguguccacgggcacaguuggucaccgacuggaaaagcaauaaugaacccacaguaauguccagugucuucuugccaucuguuuuaggcugugaccucucuuuccccagcaauaaacuggucucuggagaucacuguaaacuuacaguggaugaaauaucuggugaggugacacuggaagacaccaggugagcgcuuugucuucucguuagggagguagggagcuggcagugcguuauaugucucaaaaacaagguuuaaaauauaucgcuuguuuuuuucuuuuuucuccugcuuaugguuuucucagccuguacuucucccgguuccucuuuaccucccucccaucugaagccacaucuaaucugucucauuagaaaacaaacagucauaggcaaaacagauaaaggaagagagcccgagaaaaaacacaggacaaagauacagacagagcgacauagucauucacacacucaggagucccauaaaagcacagaaucagaaaccaugauauauauguaaaaggcauguaggguaaaaguaaauaaauuaaaaaugaaaaguaaaaauugaauuuuuaaaaaaggccugacacaacauuuugaggcaaggaaccuucaaaaaugacaacaaaaacacugaguucauuuucuguggcuuccacugaugggcaugugcccuacccuggagaguggcuuguuucccagugaagccuccuuggagaaaacuaauuuuuucauuugcaagugguuaucaguuggagcuagcuguuagggauggggacauguguccacuuucuuguucaggucuguuccugcuccuucaguuucugugaguuugugugaaggccuuguuuucuuggugucuuccauccccucuggcucuuacacacuuuuuaacuccucuucugcaggguucucugauccucgagaaggauuugauggaggcaucccaucuaauucaugaaagcuuaugauuucccuccugauuuuuuuucucacuauaagugacacuguuguagaucuccuaacuguauuuacaucugauuaucuuuuuuuuuaaagauuuauuuauuuauuauauguaaaguacacuguagcugucuucagacacuccagaagagggugucagaucucguuacagaugguugugagccaccaugugguugcugggauuugaacucuggaccuucggaagagcagucggguacucuuaccaacugagccaucucaccagccccccugauuaucuuuugaagggacacauugcuucagaaugugcuuguuuuaaauuuggcacaagcaauagguagccuggcaguacacugaguuguacaccaacuggauaagucuuagggacuugguuuuguuuguuuguuuguuuucagacaauagcacuguucuguggaacucggggccacccagaagucaugauccuccugccacaagccuuccugaguccucagauuucagauguguauacuugcagggacuaggcgccaugauggcaaggcauagaagcugggaagaaguuuuucuaagaagaacuaauggucuuuuucuguuuuaguugauaguagauugaauuuuuuuuaacuccuuuuuuuuuuuuuuucugagacaggguuucucugugcagcucuggcuguccuggaacucacuuuguagaccaggcuggccucgaacucagaaaucugccugccucugccucccaagugcugggauuaaaggcgugcgccaccacugcccagcuuuuuuaacucuuaacacuguaaaauggugcuaguucuaaagccaucuucuguggcaacaaacugccacagacuuaguagcuuaugagaauggugacuuacuuuugacagcuguagagguucagaauccaauguggaucuuggugggcugauuccuuguggaugcucaugggauaaucucuuuccugucagagguguugccuucugggguagagguggucuagaggagaagcagguagucaaggcagaggcaaaacaaccuguggggucaggucaggagauaagcagaaaucauagcagggcauuugggcuucagccuaagagcugggguucauuugucugaguaugaagaugacaguuggaggguaccuggcugcuggaagccagucaagauugugucaagauugaagucugcaugcuguuuugucaguuacuaggacaugggcgugccugcauauuuaaguccugcccuuggcugcugucaugcugcaguggcaaagcugaguaguugcagugagacuuggugaccacagaauuugaacuagugccaugugcuuuauggaaaauuuuugcuauuccuugacccgagagaauuauugugcaagcuugaaauacaaauuccuuucagugcuggaccuuucaggaaugaggcugcagcaccaagcuugguccagcugaaauuuauuuuauguucaguguacugaauucuuuggccaucaugugcuuaucaucugauuuuccaaucgguugccaccaaaaaguucuuucgggagaaucuuuccuguccccacacucuggaccuagagcauguacugcgguuccccaucuagcagugugauuauaauuggguuauaaagcacagcuuuugagcacaggagccacaccacugucaguggaaaacccacaauuuguuuuacuuuuguccugaaugcaucuuuugggagcgaucaguacucaguaaggaaugaacugacagaggagacugagaggggaagagaaugaacuggauuuuggagagaaggggcagcuguaucaacagcgcaggaaggaaggaaaugacagcacugugcugccucaggguccaccuugaggcaugccagaaagaccugcauuggaauugcaggugacccgcaugaccauucaaaaccauauguaauuccaguuccaagaguuccagugcccucuucuggccuacacacaugcaugcacgcgcacgugcaaaauaaucauacacuuaaaaaaauagagcaggaguaacaaguaaaaaguaauuuuuacagaaaaagaaaaagagaaaaccacucuuagaaaauuggguugcugauuuguuauaaguggguagugacaggcaaccuuuuugucuagaucauacuugcauguauaaaugguuaguuuuuuuucccucugaguauguucagaauaguaaugcugggcaaauuucuuaauaugguagaaaaauguuuauccuauuuaguuauuuugagugggguaacuuacacuuuuguucugucuuguuuguuuguuuguuuuaacagcaccaauggaacagugaucaauaagcugcaaguuguuaagaagcagacuuacccuuuacagagcggggauaucaucuauuugguguacaggaagaaugagccagaacacaguaagagggacaguuaacugggguagauacuuuccccagguguugcaccaagaagccaucuagcugaggcuggacacacccucagaaagaguauguguagaaggagacaucuccauacaaagugacagucguggggguucuugguguaaggacuuggguggagugcugacccuucagcugggccuuucuaaaggcaagaaagccaucaggagcugcacaccucacaguggcagccauggggaggaaaugggcugggcugggcuggacaguagaauuggagugugggagcaaaacccagauaggggcccagaagccacuggcagugcugcuuuuggauacuuugcaagagacuguaaagguuagacuggaucuagcuccaugaggguacccugaaauacuugaagaccaccauaaaguuauucuuggcaaggaguacaaagaggacacuaguauuccuuaaguccugccacaaagaaggaccguguaucuuuucuuccuagugguuauuacacaguuauuagugaagugugucuuuuuugcccuugacuccccuaugagaccauuuuccccuuugguugcuuccguauacuuagguugguaacugugguucacuuuuuuuuuuuuuuuuuuuccccgagacacaguuacucuguguagcccuggcuguccuggaacucacucuguagaccaggcuggccucgaacucagaaauccugccucugccuacagagugcugggauuaaaggugugcgccaccacugcccagcgugguucacuuuuauuagaaucacuuacacugguaaaaguuguuaccagaugguaaaugaagauaaucaaaagacagguugugaugugaucacaggauggggagaguugacuucgcacuucccauggggccacggcucccugacuuguuuaauuuccuuuuagauguggcauaccucuaugaaucuuuaaguggcaaacagagcuuaacucaagacucccuugguaaguggaaggauggcagaggccuggaugcuguacagggcuuuguguucuaggauggcccuucagcuccuuggugucuuucugaguugugaguguacccccuuuguuuuugugccuauagaagccaauaaggaaaauauguuccaugugaccaaagauugcucagguccagggcagggugaugauccccagguuccacuauugucacccauggcucagacaugcuuagaggaaccacagccaucaacaucgacaucagaccuccuccccacggccucuaccucuucuacggagccagagcugaccucugcagggcaaaagcauucuucuagcucuggugagacgggaucacaaugacagucacaguuuuuguuuuuugagauacaguaaauccauucaucagugaguguucuguagcccuguaugcugacuuauucccaagaaaaagacuaagcauuaaggaccaugguaacauaauauuuuuauaauuuuaucuaaauacaauucauacacuauaaauauuauucacucauuugaaguguauucauaagguuauauggccgucacuauuaauuacagaacacugucagcuaaaaggaaacucacguaucucugcauuugcauguucugaacauuuguguucauagucauacaguaugugguguuaugacugacuccuucauguaucauaauguuuucaaggcugcguguugcuuagaaccaguuuuacaggccuuguuccccauggcuuguccuuccuucuuacuuugucauuguauuugucuucuguuccaucuauccauaugcacagcauggagucugacaaggcuuuauuaaccuucugauaaucagauugccugaaauggguaaacgcauucauaccuugcguaauuuuuuuaaaugaaaaaugucuccaucuguaugucauccuaacacaguuauagguaguacuuagcacaguuauagguaguacuuauugucugccagaugcgaggcgguguaauaagugccuguguauacucagucccugugggcacccuccauagcagugcuagcacauaaccuuuauucucaaaagacucugaagaucagaggacgaguaguuccaggaccaggagguagccugggaagcuuguucuguuuuuaguauaugaguucuaugugguauaugaguauuauuuguuccuaaaauaacuuuauugcuucuccuugcuccccuuugucaauuuagauaguauaaaccaguuuuuucuuuuucaaguacuaguacuuaucauuugaauauuauaaagcauauauguauuauacuauaacauuaugaauaaaauagaggguaaugaaaacuuuccugacuuuuuagccagguucauuccauuugcaugugaugcuugagcuucugucuguuuaggucagagcucuaccacuuaguuccuugacaguacuccucacuccugucagacgugucugcuucguaccuuuuguggguauuuacuauguaacgugcauuuugugauugcaggacuguuggguuguacaucagaaucaccccuaaauacuguugacgcaguauuuaggggugauucuguuguggaccucccugcuugucuucacaugugaacgcaccgcuugccucuagcuuccuuagcacagugaugggcucuagugcacuuacagcaugacucauggaugaguagauaagacgugcaucauucuuaagcugagauuucugaucacaaacugcacuugauuuaaauaauuaacucucuccugacuuuauucuaaagcagauaaaucagcaucuuucuuauuugucccaaaggaccugggaacacaagcaucuccccaaaaggacgcaguucacuuguugcaaauggcgaacucucuagccuuucuccaguuuuccaagacaaagaagcauccuuuucuuugcuggaaaguaaagaccaugaggaauuggagccugccaaaaaaaagaugaaaggagguuagacucuacuguucuguguauccuuuggccucuugugcucugugcugugcuggcuguugccugcacuagguucccacuuuuugcagaagaacguggaucugccucaggguuaguaacaacuugcauuuuguguaugaaugucuagaauuuuuucuguuugcauaauuuaaauagaaguguucauuacuaggucaugcuauuguucugaaaacugcaguuuucaacuacaaaugggugucaaaguccucuaucuuuaauaggauaguaauuucucuaaaaagaaaguugucuuaagcaggauaguauguguugguucuugggagacauaggcaggagggucagaguuuaaggccagcuuacugaccagaauagggugggaacagagagauagaagagcucuaagaaugguguccugggggaaaacuagauuaccugaacauuugugguaaauuaauuaauuggcuuguggcagguaugaugugaaucacaacaguuccauagggaagaguaagcauagggcugugacauggcucagccagugaaggcauuuguugugcaagcccggcaaccugaguucucucgguggcacccgcauaaaggugaaagcagagaacuacuaggucuacagagguaaccucugaccucugcacguguaccaaggcacacucgagugcgugcgcgcgcgcacacacacacacacacacacaaacacacucacuaauaauaguaauuuccuuaagagaaaacaguaucaagccaggcauagccacacauucaacuucagccuugggagauagucagguggauuucucgagucugaggccagccuugucuacagcgugaguucuaggacagcaugggcaacacagagaaacccugucuugggggaaaaaaaguauugauaagaggugacuuuuuuuuaaagauuuauuuauuuauuauaugugaguacacuguagcugucuucagacacuccagaagagggcauccgaucucuuuacggauauuugugagucaccgugugguugcugggauuugaacucaggaccuuuggaagagcagugagugcucuuaccaacugagccaccucuccagccuccaagaggugauuuuuuuuuuuuuuugguuuuucgagacaggguuucucuguacagcccuggcuguccuggaacucacuuuguagaccaggcuggccucguacucagaaaucugccugccucugccucccgagugcugggauuaaaggcgugugccaccacgcccagcaagaggugacuuuuaacuuaaacaaaaauggagaauuagaggcuauaagaaauggcuuggugguucagagccuuuacucuugcacaggaccugaguuuguaucccagcacccaccugauggcuuacaaucaccuaaaauuccaguuucaggggaccuagugaccaauuccuguaaucuugggcuuuuccucucggccacuuaguucccagaaauaaugacuuugagacuaaauuauuaugaacaacugcuuaggccaaaagcuagagcccguucuccaaguagcucauuacuuaucuguccuguuucauucuaugaguaccacauggcugguucucucuccucagguuaugccacgccugagcuccuccucagaguuccaggcgaaucuccuaugcuccugacucccacaauucucucucucccugcuggaugucccaccuuccaguccuguucauuguccauuggcuuuuuuauugacuggugaugcuuaagagauucucucuggggcuggcucagcgguuaagaccacuggcuguucuuccagagguccugaguucaauucccagcagccacaugguggcucacgaccauuuguaaugugaucccauguccucuucuggugugucugaagagaacgacaguguauucacacauauauaaaauaaauaaaacuuaaaaaaaauauauuguacaaaauucucaaaggacuaauuaaaaaaauauaaaaaauguuuuaaaaaaaguucaguuucuuaauaaaaacauaugcuuuuaaaaaaagaaagaaagaaagaaaagagaaaaaaugagauucucucuguaaagucaggcuuuggcaggcaccaggcauguucaugguacacauacauacauacaggcauucacagauacauaaaaaauguuuuuagcuggguggugguggcagcagcgcacgccuuuaaucccagcacuugggaggcagaggcaggcagauuucugaguucgaggccagccuggucuacagagugaguuccaggacagccaggacugcacagagaaacccucgaacccccccuccccaaaaauguuuuuaaaaauagaaaauuauguaagauagaaaauuuaaauuugcuaggcuauuuggcuuagcagugaauucuuaauauauuuauaaugauggccauaaaauauaguuuaagcaagcaauauuugcucaguaauuuuaagaacaucuucaaaauugauaaaucaguugaggguaacucagugguugagccaaauguacaaggcccuagauuuuauucuaauacgguaaacaaaguaaguugacugaaguauuauaauacagacacauagcaaaaaaacugacuaauuuccuuagaugagggaacuagguaaggaaaggccaagguggagaaugacugcguuuauuucccucugugugacuuuuaaaguuguaugcuuuucaugccugccuuucuuccuuucucucuuuucuuuuccuuccuuucuuccuuccuuccuucuuucuuucuuucuuucuuucuuucuuucuuucuuucuuucuuccuuccuuucuuccuuucuuccuuucuuccuuucuuccuuucuuccuuucuuccuuucuuccuuucuucuuucuuucuuucuuucuuucuuucuuucuuucuuucuuucuuuucccucccucccucccucccucccucccucccucccuuccucccuucuuucuuuucagacaugcuuuugguauguagaacuuguuauauguguaguccaggcuguuagcaaagucacagagaucugccugcuucagcccccaaugcugugauuaagcauuugggaagaaaggugugcaccaucauguuuggcuucuuucuuucuuucuuucuuucuuucuuuuuuuguuuuuuguuuuuuuuuuuuuuuguuuuuugagacaggguuucucuguguagcccuggauguccuggaacucacucuguagaccaggcuggccucgaacucagaaaucugccugccucugccucccaagugcugggauuaaaggcaugugccaccaugcccggcugcuuuucuuucuuucuucuucuucuucuucuuuuuuuaauggguaacugcauaugaagaacagagaggauaccagcucucuggagauaguguuagaggugguuaugagcugagcacugaaagagcaacaaguucuccagcccuaagcaucucuuuaauuaaaaauaaaaauggaggacuauugagauguuucugugaguaaaggagcugcugcuaagccugaagaccugaguucaguucaccaggaccugcaggguggaggggaaggacuagguaaguccugcaaguugucuucucaccuccaaguacaucccugugcccucccugcaaaucaacaagcaaaauguaacaaauccaacguuuuguuugagaucuaucugucugucucagaauucacucuguagucuaggcuggccuuagagaucucucugccucugacucccuagugugucaucaugcccagccuuuuaaaaauaaauuaaaacugaacaagcuaugauauugcaugccuauaaucccagucuuggggaaacggaagcagguggagcagaucuuuaagguaacucucagcuacauaaugaguuugagauuaaucagggcagaaugaggaaaucccccaaaauuguaauaauuauaauaauagcaggaguaguuuauguauguauauaaauguaucagaagaaaggguuuuuuuuuguuuguuugguugguugguuuuuugguuuuucaagacaggguuucugggggcugaagaaauggcucagcgguuaagagcacugacuguucuuuugaagguccugaguucaaaucccagcaaccacaugguggcuuacaaccauccauaauaacaucugacacccucuacuggugugucugaagacagcuacaguguacuuacauauaaauaauaaauaaaucaaaaaagaaaaagaaaaaaagacgguuucuguguagcccugacuguccuagaacucacuuuguagucuaggcugaccucaaacucagagauucaccugccucugcuuucugagugcuaggauuaaagacaugugcaacuaccaccuggcaaaaggacauuuucaaaagcuuccagugcaccuuagaguuuuuuuuuuuucaagcaguuccuuuuguucauaggguuauauuuauuuguuuaaacaaagugacauuuauaacaauacuauacagcugaucucuccuucuacuugucauccuuaugucuuaugggucaacaccucuucuuuuaaaccagaauugaggcacauaggaacaugugacuuauuugggaccuuuaaaaauagucuuuauauccaggcaugguggcacaugccuugaaauccagcacucaggaagcugaggcaggcagaucucuugaguucuagggcagucuggucuacacagugaguuccuggacagccagggcuauguagugagauccugucugaagaauaagaaaagucuuuuaaguggcuuuguuuccucugcuauugguagacaagagaaaugugaggucgucggugucuucagguuaaguggcugugacuacugggacuugucuuuugucuuauagauggggaacuugacacgaaccuccaguuauuaguuucaggccagcguggaaaugcccaaaccucaagugaagaugucaaagaugccucugugaagccagacaagauggaggagacacuaaccuguaucaucugccaggaccuucugcacgauugugugaggugugcugcuuccuauccuaggguggcuucagcaguacuggcucccuugacaagugugaagaagaccauaaauaaaacagacuuugaucuucuuugccuuggcgucugcucagguucccagagagcagggccacagauucuaugagaugagaucucuugguuuugacugacacaggccauggguaacccaacagaccuggucuuugccuuguaggugaaucgugugaaguauacuggguuuuaaacacuuccugccuaaagacauaauacuuacaguagaacgaaguucccaggauucccuuugggauaaacuuaucuuuguuuuuguuuggaaacuugggagguagaucccacccaacuuucaguacccaaacacuuggugcuugaucuaugauuuguucucccugaaaacaggcauauaccucugauuuuuuuuauuacuauuuuuuuauuuugugucuucuaacacugagcuuuaaguauuuuuagguuaggugauacaauucuccacaguuggcccaugguuggggauccagcuugcauuccuguuugggucagcccgcaacggauuuuguuugagugucacaguggcagaucuuuggacgauuuugucaagaaauguguucuuuauuccuucguauucugccaguuugcagccuuguaugcacacauuuugugcggcuugcuacucugguuggauggagcguucaucucugugcccuaccugccgauguccaguggagcggauuugcaaaaaccacauccugaacaaccuaguggaagcauaccuuauccagcacccaggucggcuccgcuaacuuuucugucguagggaccuggggcugaagcuaugcccugagccaucaucucucuaguccuguccuguaguaaaaaguauuaaagucccagugcacggcuucuuccccaccuucgaccauucauguuccuggauguaaggcacacacagccuuagguagcacaacagcgaggcagcugccuacccuucgugcuguuagaauuuacguuuuccauugauaaccccgaguuaucacuuauuauuuacuauguuccguuugggcuguuguuaacucuaauuggccagcccucugggccacguucucuuggcacguagcccauggcagcucucuuauaucccuccuguauguucuucauccaugguggcuucuugccuuucuuccucuccaaguccgugaaacuucaacccugccuaugucucuucugccguuguucagcuauuggccguuggcaucuuuauucaccaaucagaauuaacuugggggcagggucccaggugcuaagugcagacucugaaaucuuaggggccagcacauagcauuacaauagacaguaaaaggcaaaaccucaacacuguccuuugccagugacugcugcuaugcccuuuaugucuagauaaaagucgcagugaagaagaugugagaaguauggaugcaaggaauaaaaucacucaagauaugcugcaacccaaagucaggaggucuuucucugaugaagaggggaguucagaggaccugcuagagcugucugaugucgacagugaauccucagauaucagguuagaccugugccuggcugaaaauggggaucuggggauaagaaguacguuagugcugugcuucacugugcuauggggugugcagcuauaggacuucaguaagucagauuccuuagagccuuucguuuauuuccucaaaccagaguauggccagaacucaauggacccagagcagcagugaacaccguuaagaaccacagacagccuugaaggacucuuacuucaauuuuaauuaauuaauuuugagacaaggucucuuuauguacucuuggcuaucuuggaacucaccaucuaggccgggcuggucuugaucacucagugauccuuccacagucuccugagugcugggauuaaaggccugugccaccaccucuagcuuaguugucgcucucuguauguagcccuggcugccccggacuuacuaucuagaccaagcuguccuugaacucgcagagaugugccuauuucugccuacugagcagcgaaauuaaaggcaugcaccaccauuccaaggcucuucaguggguuuugaacuucccccaaaauacccuccauuuucuuaggccccucaucauucacuggcuauagcagaaaauuccuauguauugguuuacccacauaagcacauguaauuccuauacuuagacacugcgaguccuuggcuguaaaugaguguuauaauuucuuaagaguaguaucacaggagaggcauaauacccaggcugagaggagauggcccuuugagaccuaauuuuacuuggugacacguugguuuuaggucuccauuuugggccaaggccaugcaugauauuuuuuaaaaaauaaauaguaaauuaccuccucuggcuuacagagugaguucaaagcuagccugagaagcauaggcacuugucucaaaacaaaacuauuuuaaaaggucuagaacuguaguugaaugguggagugauugccuagcaugugagaaguucgggucaaucuggcacacuaaauuggguguggcugcugaccccuuucauccuagcucacuaggguccucgugccucagucuugacagugcugggauugcaacugugcuguucuaacaaggcaagaacauacauguauugagagaacuagcaggacuggcaguguaguuuucucucaugaaccugaauuuucuuggccuuggagccuaugaguuuauguccacugaguagguacuaagugguccaagguagaguguccuagagcauggggugugagggauugagcaggaaaguagcugaguacagaacagcuauuuugugguagaugugauccucacuuucagacuccuguuccagggaguuauggguagugucaucccuguaguaggagcugggcagaaaagugggguucauugccuucuucacaguugcugaaguggugcugcaggugagcagagguagagcagaggucuugaaggguagaagcccaacaccuggagcuagggguuggugaugauguaacgaugauaucugcaugucugccuggagccuguuccuuuguaacuauagcucugcuucuuuuccucgcagucagccauacauugucugcagacaguguccugaauacagaaggcaagcggugcagucucuuccuugcccagucccagagagugagcugggagcuacacuggcccuugguggggaggcaccuucaacaucugccagcuugccaacagguaagacagugauaucuaaccaugaucucuuccauccacuaugucacauccuugugauuguuguucuauuuuccuauggugugauuccucuaugaugucuuucuuguccucuauuccuuugcuucagcuauccuuuugccucucguagccucuugcuuggcauagccauuaauggaaagaaauuaggggagccagguagagauaggaggaucucugugaguucgaggcuucccuggucuuuauauugaguucugucucagaaaaaaaagacacagagagaggagagagaauuaauuaauuaggugaacauuguuuauuugagggucuccccuuuuggacauaccuaauaauugacaguucugguuuuaacuuuggucuuucucuagccuacugcuucagggaguuugcuuagugggguuuuccaaagccaaaaugaucguucuguaucuguuacccaaauuuaagagacuggcuugcuugcuugcuuccuuccuuacucucucucucucucucucuuuucccuucucuuaauuauuauuuucuuuauuuacauuuuaaauguuauacccuuucuugguuuccccuccaaaaacccccuauccccuacccccuccuccugcucaccaacccacucacucccacuuccuggcccuggcauucuccuacacuggggaauccagccuucacaggaccaagggccucuccucccauugaugaccaaaaggccauccucugcuacauauguggcuggagccaugggucccuccaugugugcucuuugguuggugguuuagucccugggagcucuggggguacugguugguucauauuguuguuccuccuauagggcugcaaaccccuucagcuccuuggguccuuucucuagcuccuauauugggagggaguaaucauccaucuguuggaugcauccaucugauggaguaucagucuacugguuggcugagagcauccaccucuguauuugucaggcagacacugguagagccucucaggagacagcuauaucaggcuccuaucagugagcacuucuuggcauccacaauagugucuagguuuggugacuguauaugggauagauccccagguggggcagucucuggauggccuuucuuuccuucagucucugcuccacacuuugucucuguauuuccucccauggauauuuuguucccccuucuucuucuuuuuuguuuuguuuugggacaggauuucucuguguagcccugacuguccuggaacucacucuguagaccaggcuggccucaaacucagaaaucugcuugccucugccucccaagugcugggauuaaaggcacguaccauuauugcccggcuuguucccccuucuaagaaggaccgaaguauccacacuuuggucuucuuucuucuugagcuucauguggucugugaauuguaucuuggguauuccgagcaucugggcuaauuucgacuuaucagugagugcauaccauguguauuauuuugugauugcauuaccuugcucaggaugauauuuaguuccauccauuugccuaagaacuucauaaauucauuaauagcugaguaguacucuauuguguaaauguaccacauuuucuguauccauuccucuguugagggacaucuggguucuuuccagcuucuagcuguuauaaguaugguuguuaugaacauaguagagcgugugucuuuauuacauguuggagcaucuucuggguauaugcccagaaaugguauaucugggcccucagguaauacuauguccaauuuucugagguaacaccaaacugauuucuggagugguuauacuagcuugcaauaccaccaacaauggaggaguguucuuucucuacaucuucacuagcaucugcugucaccugaguuuuugaucuuagccauucugacuggugugagguggaaucucaggguuauuuugauuugcauuucccugaugacuaaggauguugaacauuucuuuaggugcuucucagccauucgguauuccucagucgagaaacuuuguuuagcuuguaccccauuuuuuaauaggguuauuugguucucuggaaucuaacuucuugaguucuuuguauauauuguauauauauuauauauuggauauuagcccucuaucagauguaggauugguaaagaucuuuucccaaucuguugguugccuuuuuguccuauugacaguguccuuugccuuauaggagcuuugcaauuuuaugaggucccauuugucaauucuugaucuuagagcauaagcuacugguguucuguucaggaaauuuucccuugugcccaugugcucgaggcuuuucuuucuucgcuguuaguuucagugucucugguuuuauguggagguccuugaucuacuuggacuugagcuuuguacaaggagauaagaauggcucgauuugcauucuucuacaugcuaaccgccaguugaaccagcaccauuuguugaaaugcugucuuuucucuacuggaugguuuuagcuucuuugucaaagaucaagugaccacagguguguggguucauuucugggucuucaguucuauuccauuauucuaccugccugucacuguaccaguaccaugcaguuuucaucacaauuggucuguagugcagcuugaagucagggauugugauuccaccagaaguucuuuuauuguugagaauaguuuuugcuauccuagguuuuuuguuauuccagaugaauuugcaaauugcucuuucuaacucuguaaagaauugaguuggaaguuugauggggauugcauugaaugacuggcuucuuucuacaguaugcugaauucccauuggcugucuugcaugcccauagaguauuuccaguagauaggcaucuagaugcacugggaaaugcaaaagacagacugagauguagcucaccaauagagggcaugcugagcauuuauuuguaaggcauuggguucuacuccaacuuaaaaggaaaacagaaaagaugaagggaagggaaaagagagcugacuacuugcuuguagcaugcuguucuuagcucuaaggguugaacuggcuacagguagcauuccagugcuuccugccugaggcuggccacucuaguucuagcucuuccuguucuuaguacugucaacacuguaaucauuaucaaacugaagauagccuuaggagcccugccccuuagcuguuauuuagccugaguguguuagaaggccgcuaaccuaggauuguaguuaggaggcacauucuuggcuaaccuacucucuuuugguucucugggucacuuguagaacccauaguuggaaaagcaaagcagugcucagcaacuggagguagauacuugaccacagcccaggacagccuuuuugcucuuuugaaacagggucuuaauuuauaacucaggcuagccuugaacuugaucuucugccucaagcuagcauuauagguguauccacccaggccugacuugaacuaccuuaguccauuuacuuuuuuucuucaauuuuauuuguauauauguuaauguaugcaugcaugcauuguguauuuuuggugcuguggauucucaaaugcuagacaaauauacucacugagcuauagcuggccugaauucuuguguuucaaauagcagaauaucauuuggccacuuaggaaguaguuugaauuccuccuggguucugacgcucuucccauguacuucauaguugccucucucauuguaaauuuuugucugcugucuuucaccugauaucuagacauacucugaccuccauaugucuguacuucagcagccccggauuacaugugcccucuucaaggaagccaugccauaugcaccugcugcuuccagccuaugccugaccggagagcugaacgggagcaggauccccgcgucgccccucagcagugugaguaauguguuauuuauaaauccaauaggugaaauaucuuguuuuaacuuauauuucuuaccauuaaaagaggucuuuggauagagacguagcugagugguacaagaguuguuuggauguauaagcuccuggguuucauuccuagugcugcaaaacaucagcaacacacauggagcucuucuuuacuuaauggcuguuugaauuuacuuuugcuugaaaugcuuguuuguaucuauugccuuuuaaaaaucuuucucaacuugagaguuccuugaauauuacugcuguuaaaugaagaaaggcauaaacucauguggccauaucaacaagucgcuacaguaccugagccccucuacuggauaucaagggcacagugucugauacaguacaagcucuccacuugagugauguagauguaguguguucugugugcucaagagacugcuucuggggagaucgcucuccuaucuugcacuuagugcagcacagaagaaacaguagcucagcaggggugugcauccugggauaggcagcuaacaagucccaggcauaccagggugacuucuaggcauguugaaaagaauccauggaagaguccuggaaauaccuuauaucugagaaauacagaucagcaaguggcagcugagguuauguucuuaaauuuuugcuaagagggcagucuuuacuuuuggcuaauucuguagagauugcuuuuauagauacaagcuuuuacaaaaugaucacucccuuuaaaagauuuauuuacucaguccuguaagaauuucagcuaggguuuaguuaguaccauaaucaaugaaacugcauuguagagaauauuaaacauuaaaaaccuuuucuacaaaggcaagcacaguaacaauguaaaaacaguauuuaugggucgguggaaaaguucucugcagacaugaaugugcaguuacuucaaguguaucacauauccagauuggggagacaaugaacuagggcuguuugggugcuggggucagagagcaagcuguuuuuaagaucacaauuuuaagauaacucugaauuuucauaauaauuuuauuucagauguuacuugacauguugucucugcucccuaguuccacgaaaacaccucagaaauacuguuuucaaagagaguugcgcucuugagucuggugcuaaauguccucagguaugagaacagccagaguucuaggucucaguugaccaacuguccucuacccacaggugcggugugccugcagcccuucugccaccuguacuggggcugcacgaggacuggcugcuuuggcugcuuggccccauucugugguaaugucaacucuucagcccuuaguugcuuugacauuuguguguucucuuaguaaauuuggggccggugguguuggauuguguuaagagaaaagaggcuucuaugagccaucaagugauuaccuaccccuuuucugcuacauugcagagguuucucaccuugaaauucucaaacccacauugcuuuaaaagcaagcaguaacaaaauaagaaaaauccugguuuuccuauacuggagaaauacuuauucacauaaaccacuucugcuauaaucccagcccuccagaggcuuaggcaggaggauaacaggugugugguauugcauaauuuaaucccuacacucagggagggaggcagagacagguggaucucuggaaguucuaggccacccuagucuagaaagaguuccaggccagucaggucuauauagugagauccugccucaaagaaaaaaaguucaaguuuagucuacagucgaugcagaccccguuucauucaguagugcgauggagaucaauuuuaccuguucucuauuuaagauugcauuuuaguuugaguaugauggugcucuguguguguguguguguguguguguauguauguauguguagcauagauguauauuugaguuuuucugugugugugaacaugugugcagauagaggacaaaagucaacauuaaguguucucuacugauuucugccuuacuuuuaaagaauuacucacuuauuuuguaugcgcacacacgugccaugacacauacauagucagaggaguuugugggagucaauucucucuucucaccacaugcaucucagauugucagauuuagaggcaaaugcuuuuacaucgccauggcucuccacuuuaaaauuuuuauuuuuuuuuuuauuugcuuguuuuugucagugauacuguuuuuuaaauuuucuugauuuuaaaauuuuuuucauguaauguagguugaucuuauucuuuccccucuuccaacucccagaucucccacuaccaaccccauuucauauuaauccucucugugugucaagaaacaaaacaaaaagacaaaaacaacccauggaauccguucugaauuagccaucuacucuugaguaagaaaucugccccucuaguguggcugauagacccacuauccuuccauugaagagaagugauucccuuucccggcagcugucacuugcaaauagcuucuugauuagaaaugagacuuugugccuucuuagugcugggaauuuguguggcuugaacuuguucaggucuuaugcaugcugucacagucuuugugaguucacaugugcaucagcucuguugugucugaaaagucuuccaucuuagaggcuuccacugcguuugugcucuuacaaucucugugccuccuugaugcuccuagccuugagggagagugugacaaugacaucccauuuagagcugaguacucaaaaguccaguugagggucugucucuauguuaauuuagcagcuacuguagcaagaagcuucucugaagaggguugagcagugcacugagcgaugggaacaauaaugugucgugagcaagcauuuuauugcuaugcuccuguaguagaauauuuucuugugcagguucuugaccuccuuaacaguucggguaugugcuccaucucauggagagagccugaaagcuaauuucuaaaaguguuugguuacuuucauuacauuuguaccacuacugcaccaguggguauaucuugcagacaggucacuauuacagcacacaggguucugagcuggguggggcuggugauuacuuucugccucuggaagcauuuaagcacuuggaaugcugcuuaguacgggugaagugucugcuugaauaccaacuugauuuuuccacguuuggugacauaaguaugugaugauuucagccguagugucuuaucucagauuguggacgguaaccaguaauauuggcaauaaccuguacugucugggaguggucuaugggacuccuucagcuaaugacuaaaaaagauguaacuuuuuccugguacuguagcuuuugguaguuuaugaugucuaguugggacauugacuccauuuauuauauuucauccuuauuuugagucuucccguugaacccuaaugcuuacuuaccacuuggcuaggacuaguugggucagcagucuccagggauccacuugucuccucuuuccccgaccagugcuaguguugcagacaugcccugcuacacuuggcuuggcucuucuuuucuuuucuauauugaugcaggggcugaaacuugggucugcuugcuugcauggcaggcauuuuacagaacgaggcauuuccucaccuuguuugcuuuuuauaaucuaugauggaaagagauuugauuauccugucaggcaaacaaguuugauaagaugcuacgucauccuuauaaaacagauaauguucuuccuuccucuggcagagcucaaccugggggacaagugcuuggauggagugcugaacaauaacaauuaugaaucggacauccugaagguaucaccuccauacuuguccuggggauccgaggaaacugugaagcuuuccuauaacuugugugguuucuguuaggacacacguuuucucuagcauuugccugcaaauguauacugucaaaaccacacacuguauuuucugaccaauacaaucaguuccaugauucuaauauaucagguuuuccauauguuccaaaaugaggagauuccuguuuguucaucaugcugucagauuguagaaaccggugaauacaucuuacagagaugguuucuaaauucuggcuugcuguggcuccuuuuucugaauauuuuuucccgugcuugaggaagcuagcucagaauuguaauauguucaguucugcacccucugcacuccuguugaguacuuugcuucccuuugagaccauucauuuacuugaacacaucaccagacguacuuagcuacgcaccacuacacccuacuuuuauguacauuaaaagaccuuucaguaacagccuugaacugugucaggaaaaaugaaggccuagcauucagcuauacuugucacccuugguggggagguuggagggcaaauguagaagggagaaacuuaauaauacuuagagauagaaaggagaaauucucuuuggugugugcuacugaaaccucuagcuucuauucagggagauuuagcuucuaccagaagucuuccguagcuuauauaggccaggcagggucuaagcagacacuggagauuguaccuucucaagagcauaugucugcagucugccuuuucagaaaauaaaagaagggggauccugucuacaaaaagcagauguuggcaaugcaaugauuugauuugaaguauguuagaagcaacacugugacuaacagucuguuuuuuuauuucucugucccuuuuaauaguauuuaauguuaaagcuugcuauuuuccuucuccccuucagugucuuaucuguccuugugcugugaaggccuuuguggaauuuuuugagagaaucgugacucuucuucagguccagaagcaaaagagccucuuggcaaagagcuugugaaacauaugagggaacugacuguaguuuauccacuggcucugugcaaaagccacucaaggacagcuguguucuggcugugucugcucucggagccuuguaugaaguaucccugacuaguugagugguucaucuaaacuggaauuucuuuucacccuuuuucucaucacagaauuaccuggcaaccaggggucugacauggaaaaguguguugacagagagucuccuggcucugcagcgagguguauuuaugcugucugguaagcaguguuucgcuagcccugcccugcagauugggcaucaauuuuuaagggugucuuaguuuccuaugaagugguaagaacguggcaggccacacuuggcaguauaccuaucuguuuuacuauagaucuaugucuuugacucugacccuuccuaagaagauagaggaaggucuagauuuguuuuggcagaguccuacaguguagccuaggcugucccugaacuccugauccaucuaucuuccucacuagugcuaggaugacagguaugagcugccauaccugucgaaucacuuuaaaaaaagguauuuauuuuauguauaugaguacacugucacuguccucagacacacuggaagagggcaucagaucucauuacagaugguugugaaccaccaugugguugcuggaagagcagucagugcucuuaacuacuaagccaucucuccagcccaugccuaaucacuuuugauguuuuaaaauuuuguuuuuuuaaaaacuuggugcacuugaaaccuguaugucauguuccagcaccuucucucccuauuagggaaggaugggagcauggcuaagggagccuccacaacuuugucacuuaacuuguuggcacucaguuggcagauaaagucagguauugugcuuucucccacaggagugcauggugugggaggcuacagaaaucguaacaguuuuuuuuuuuuuuucccccuaagacuuaaauguuuauuaagagaaaugugagcaauuugcuuaaaaccccuugaguuauuucuuucuggugauuauguucuggugugucuugucuguaguugcagcccauccaacuucuaugaacacccuggauuucuuuuuuuuuuuuuuuuuuuuuuuuaauuuuauguaaguacacuguagcugccuucagacaauccagaagagggagucagaucucguuacggaugguugugagccaccaugugguugcugggauuugaacugcggaccuucggaagaguagucgggugcucuuacccacugagccaucuuaccagcccccacccuggauuucuugauuuuguacuguaauaggaguagcucauacagaaaguaugagugacuuccuguucucccaguacacucagacaaaucccagcacccacuuacuggugcauagccaccugucaguccagcugcagagaauuuggcauccucuacuggccuccauggguuacacucuagcacaacuauaaguaaaauaaagaagaaaggaaggaaggaaagaaagaaagaaaaagagagaaagauaagacugggugcugaagagauggcacauuuguuaagagcaauaacugcgcuuacagagguucugaggucaacucccagcaagcacaugguggcucacaaccaucuauacagggaucugaugcccucuucuggugugucuaaagacagcuacaguguacucacaugaaagaaagggguugggggaugggggaaagaaaagaaaaggcugggcaugguaguguacaccuauaaucucagcacuccagaguuagagacaggaagaucucugugaguuugaggccagauggccagccuagucuacauugcgaggccuuugcagagagacccugucucauaauaaauuaauuaauuaauuaauuaaaaaaagggaaauagaaguaauauauaggaugaaguaagacucacuugaaaucccacagcuaaaccacuggcugagugcccuggggcagugcuuauauacacacugaguggcaugggguagugcacugcuuacugagcauuugugaugcccuggguuuuguccccaauauuggaaaucauaagcaaagaauaaaacaaauguggaaauaguguuuucaugugcauccaagcucuuccaaaaggucccuacuugcagguuacauugaagauggugcccuauuauugaagguccuguuugugcucagcaucuaucacacacucccuucugccaacaaauuccaggcauuguuugugagguaguggaaccuggucagagcucuuguguauacucuacugcugaacuaaauucccagucuugccuugguuucuuauuauuacauagagaguuuugggaggggacaggcuuagagaaaaugaucaugacccugaguaggcucagacuugcuguauauccagggcugaccuugaacuccuaauuuucccucccagaugcuggcagaagccagccuauacuacuguucccaguuuuauauaguguuaagggucaaacccagggcuucaagcaggcauucuauaaacuaagcuacauugccagcucuccauuaaguuuccaucucauaacuuauuuagcuacuucauuaaaugacauaucuuucuuguuuuccacuacauuaacaccacagcuguugagcgugcaaugcuguacaccuacaaguuuucauuuuagaauaaguaguggggauuuuguuuaaugacugugguaugcacagcugagucugccuugugaacacacaaccuucccgagguugugcaggucccacuucaugucugagccaucaccugccucuuggcuuugcauuuggcauugaauuuugugacuaugugagaagcugacagggacuuauucuuugaaugccucugugugaguguuaacaaaauugaaggccuuuuugcaucuauccaugcuuauuuaugauccuggacuuuacauaugguuuuuuugguggugguggugguggugguggugugggguccuuuagcagcauugauauauuaucuuuguuaaaguauguaguauugcccuuuguguuguagauauguucuuacuguagcauuacuauuucacaguuuauguuuuuuguauuuccauuucaaaguuuaaauuguagguagucaaauguacaagucauuucuuguaugugauuucuauucugaacacauguagguuuagcaucccaaauuugaaaaugccuucagcacuguaacugauagagugccaaagacaggacaccacaagaaaacucguaucuaugccagaccuguagugagggucacuguauuaaaucaccuucaggcaauaugugugagauguguagaaaaugugaaugauucuguggugagaauuucauccuccaguucucauuacauacaaaucaccagggauggcgccacacauccuuaauuucaguacuggggaaacaggcagguagaucuaucugaguucaauaucagccugguccuaucucaaaaacgauguagggaagcuggagagaugacccagcaauuaagaguacuggcuguucuuacaaaggauccaaguuugguuccucaaacccacauaaugguuuacagcuauccauaauuccauuucaauggaauucaaugccuucugacuucugcaaguacugacuacacaugugguacauacaggcaaaacacuuauacacacaauuuauuuuaauccuugggaacauaaacgcaaauauguucaaaucugaaaaaucaaucuaagccagaauaccagugaccuacauguucuagauaaggaauaauuaaccauauuaaauaccucugacccauguauuucagauaaggaauuacuaauuuaauuuacuuuagcacaagagaauacucucuccaaucuuaaaacuuuuggggggauuuuuaaauauuuaaaauuuuaauccacgggugauuauuuuaguagcugugagcaugcguugcucuuggagaggaccaggguucccagcgccuacaugguggcucaugacuaucuguaacucuggugccagaggauccaucuuugcaccuacugcacacauaugaugcccagacauuaaugcacauaaacacugauaaaauaaaaauaaauaaaaauccagcuaaauugguauuuagauugguuuugggauuauuuuccaaaugucuaaccuauugaguugauguguuaguuuccuacuaguuugaagugugucuauuuugguguuagaaaaugacauugcuugauaaauggcuguguccagauauggcuguguucccccagauuacagaaucacuggaaauacugugcuguguuacugcuguggucugcguagcuuccgagagcugaccuaccaguaucgucagaacauuccugcuucugaguugccagguaaggagcccgcgaaccauuucugucuguauuggugucaccacucaguucuaacaggcacuugggauggcaugaugcuccacacuuagcagaagucagacacacagcaugguugagcucgaacuugcuucucagaguuggucaagacaaauaaagacauuauagauaccacuggagcagcaucauuuccuucacuugguuuucagauagauuuguuuuucuugucugacaaucuuggcaugggcuaugaaaacugaucauaagaagagauaagauggaaguuagcaugagagcuuaguaaagggcuugcuguacugguaugaagaccugaguucaguccucauguuuuauuuguaaaaaaaggguuaugugggucuuacagaggucccagguucaguuccaagaaccuacguggcaacuuaucugacaccuuuucaaacacauacacaguauacguauguauaugcaggcaaagcauuaguacacauaaaauaaguaaaccuauuuuaaaaacaaagaaggcuggcuggugguaacacacaccuuuaaucccaguacuugggagguauaggcaggugggucucugaguucaaggcuagcaugaacuauagggcagaaacugcagcaacugccagaagccagguguagcaucucguguuuguaauucuagaacuagggacaaaaccaagcagaucccuagguuugccuagguggcaagucccaggcgagugaaagaccuugucucaaaaaaaucaagggagaugacgcccaacauugaccucuacacauacauuucuacccacacauuugcaccuguaugaacauacaugaacacacacacacagauuccuuuagcuacaugaaaggaauaugaugccaucugauguagacaugcauuucucuuuuccagugacuguaacaucccguccugacugcuacuggggccguaacugucgcacucaggugaaggcucaccaugcaaugugagugaggcuggggaaugugugggucaacugcaagucuuucaggcuuagggcuugugaagacaagaguaauauaaguuauaugcuuaaaagaugcacugauuugggaacuuuagguauacuucaguaguagaaaugcaaaguucuggcuucaguucucagaauccuacuccaucccccaaauacacauacguaugcuaauuuaauccuuauacuucuauaaaaucaugcaguauguaaaauaguguuuucaaguagaaauugugcuucuguuacgguguuucuuaaaccgcuucucugcaaguguccuccucugucuuucaucugugucuuuguggaugagucacauuaugccucgacugacagccuccagagcccacaggcagauucuagugccagcucucucugggccagcagcugugggcuaagcacaugucucccaauuacuggcccaauuugugugauagaguaauaccuggguuuuucuucaucuugugugaguggagguuguguuguaacuuaaccacaccugucuuagguuuuuacugcugugaagagaugcuauguccaaggcagcauuuaauuggggcuggcuuacagguucagagguucaguccauuaucaugaaggcaguaacaaggcagcauccaagcagacauggugcaggaggaacugagaguucuacaucuucaucugaaggcacucagguggcagagguggaucucugugaauucagaccagccuggucuacagagugaauuccaggacagccagggcugcacagagaaacucuguccugaaaacacaaaaauacaagcaagcaaacaaacaaaagagugcaugcugcucuugcagaggaucugaguucaguucccagcacccacacugggcauuaguaaccaccuauuccucucuugucagaggauuagacauugguagccuccucaagaacccacaugcaggugugcauaccuccaaacagacauauaccuaccacuaaaaauaauaaaaauaaauuuagaaaaagggugggggaacauuugaucaccuguucuccuuuguucauugcuguauggaugugaguagcaaagacagaugccacuuucugcaucaucuccaauguugcuccuggucuguggagaggggagaguggccuccguuaccucaggaccugucuccaccuugcuggcuaaagugcaggcaaaggaacacacuaagggggcacagcucuuguucuaugauaaauuaucauaguguuuuuauuuuuauuuuaaaauuuaaaaagagaaaaagaagaaauacuuaguggagcuggagagauggcacagugguuaaaagcacuugcaguucuuccagacaacuuaguuuggcucccagcacccaugucaaauagcacacaaccaucuguaauuuuagcuccgggggauuugauucccucuucuggccacccuggucaccucugcacacauggcauauacucauacagguacauauaaauacacauaaauuuaaauuuuuaaagaacacaaucuuuuuuuaagcauaaacauuauugagugagcucacaugauucacacauucucauggggcaauuacagugugcaguuucacaguuugaauagucuuugauguuuucucucucugcaggaaauucaaucacaucugugagcaaacaagguucaagaacugaauauuggaagagacacgugaaacaguuacagagcacaggaggcaauguuuuuuaaaaggccccauacaaacacuugaagggcauuuuuacaguuuucccuacgcagcacuggggguucuggucaggcacugggguguggauuuucccuuuguggagcgucaucgucagugacacacacaccacgugccccaguaaccugggaggccuccuggccacaccagccuucuagucgguguaagaggaucaguagacugaguucucccucccucccacuggaccgcucucccuccugugugcugaggcagugacagugcagguuuguacuuuuguaucuuuucuaccuuguaccuugacuaugguuaaaaugggaagcucauaggaaaaguugucagcugugucagacgcauucuccggaaggaaaggaagcauacguuuacagccuccagggguacauaggauagucuccugucuggaaagacacagccuuuuguauauuuuuuauuuuaauaaguuuggugcuuaucuucuaauaagauuuaaauauuaaaaacuguagcacaaauacuauaauuuauaauuuacaaauugacuaaaauuaggaauagccucauauuuggaagaaugagcauauguuucuguuuauuuaaaaaaaauuaucaacuguccgaaacugcuaauccugggaaggaagucuugaguguccagguccucgacccagggcuggcugagcccuuagcccuccagucccugagagcaacucccugcugaaacuccagauggcuccagacugacagggccuuugcuuuccaagcccucaucugguacauuagguuugccaugucaucuggaauaauacuugaaauuuuguuuuuagguuuuuuaaaacuuuuuuaucuuuuauugaaaucaccuguuauauuuguuugaaaacugguaacuuuuugcuucucaggaaaaaaauuuucaacuguugucuugcucuugauacagacugagaggcaguacucuguguuugugggagaugguucuuuuuuugauucuaauaaaugagcuguguuuguuucucuucu

SEQ ID NO: 2591 - RNA, 1843 nt, Mus musculus
cagacgcgcugggcggagaggagagcgucccgcaacgguucaggucccgcggccgcuucucuagccggcggaccagccagcgcacggcgaugaacagcaccgaggcgcccaggagcucccaggccagggccgcccacuccaccacagccagccgcugccacagcaucgccaccgccggcgccgaggccuugagcgcggccgcugcaaaugcagcccgcgucgcucccgccuccggcccucagaagaccgcucgccucgccacgggagucgcgccugccccaagccuccuccuccgcccggccgugguuagaccaggcgggcugcgcgcgcagugcgggccgucccguuucccaacgaucaggcuagaacgcggcccggaacgcagccucaggcggcuccggaggcagcccgggguccugauuaacgcgagcgcagcccggcaguggcgcgggcagcuuggucgggguccugagucggacucggcgcgcugccuggcgcggcucgcucuucaggugcgccgccccgaguugucgcugcuggagagcgcgagcgggcuccugggucacccagacugugugucaucccgaagccagcagagcuggggccauagugcuugacugauaggggcugaggaugaauacggcggccagaaagcccagcucugccuccuguuguuaaugaagauuuucucuggaauacaggcagaaugccuauaccauuccgacggauaacgcgaaagccuaccuagcacugggauuaaagaugugagccaccaugccaggcugcugauuuuaauuuuugaaguccuuuucuaaccuuuguuuuucuuuuuugagucuuaacuauauauccccaaacuggccuuaugcuggagaucugccuccuugagcucgcagaaaugugauuacaagcaugucacauuaauuucugcccacagaucaugagcuauggaagcccgugaugguguagaggcuucucacauguacucugaguggucuuuagaaggcagaguggaggauggaggccuguucuguucaaauguguauccuaccuccugccagugagaacuugguaagaccaauucucacuauccggagaggguggccugaggaauggccuaaaaaggccugaguggaggccccgacacguucaauuuacagguuaccagccaagagucagauauacauacccuucaggucauaucuucaguuaaagauguuacuuacuccucagaacagucucagggaagccaaacuagaugacuugagaaaugcuaagaugaauuuccaguuauuuuuauagccccaggauuagaaagcuaauuuagauguauuucaguauuuagcugggcgugguggugcacaucuuuaauuccagacagaagcauguggauaucuguguucgaggccacccuggucuauagauccagcccaagaggcauccaagacuaaguagcaaaaccuugucucaaaaaaaccaagauaaauaaguuaaauuuaauuauaggcagauggguaaaguaguauuaauuccuuaaagaaacagguacaggaauaugucauagagcaguggagaacaacuuuuaauguuuugucuuuugcuucauaauuguguuuauuuaaagagaccaugugggguggggggcugaaaagauggcucagcgguuaagaucacugacugcucuuccagagguccugaguucaauucccagcaaccauaugguggcucacaaccaucuguaauggguucugaugcccucuucuggugugucugaagacagcaaugguguacuuucauacauaaaaugaauaaaucuuuuaauaaauaaauaaccauuguucau

SEQ ID NO: 2592 - RNA, 26251 nt, Mus musculus
uggcucacaucuuuaaucccagugcuagguaggcuuucgcguuauccgucggaaugguauaggcauucugccuguauuccagagaaaaucuucauuaacaacaggaggcagagcugggcuuucuggccgccguauucauccucagccccuaucagucaagcacuauggccccagcucugcuggcuucgggaugacacacagucugggugacccaggagcccgcucgcgcucuccagcagcgacaacucggggcggcgcaccugaagagcgagccgcgccaggcagcgcgccgaguccgacucaggaccccgaccaagcugcccgcgccacugccgggcugcgcucgcguuaaucaggaccccgggcugccuccggagccgccugaggcugcguuccgggccgcguucuagccugaucguugggaaacgggacggcccgcacugcgcgcgcagcccgccuggucuaaccacggccgggcggaggaggaggcuuggggcaggcgcgacucccguggcgaggcgagcggucuucugagggccggaggcgggagcgacgcgggcugcauuugcagcggccgcgcucaaggccucggcgccggcgguggcgaugcuguggcagcggcuggcugugguggagugggcggcccuggccugggagcuccugggcgccucggugcuguucaucgccgugcgcuggcugguccgccggcuagagaagcggccgcgggaccugaaccguugcgggacgcucuccucuccgcccagcgcgucugaagcgguggccgcacagccagguaaggcagcgucagucgugggaggaaaaccucacucuccacgcccccuggauacgguaagacccuaucgcggauauuuuggaaacuuuugaugagaacccacagcccuguuagcacuucuucucuccaccucucuaaacuguaaucccauguuuacgagguauguguuuuguuuuuguuuuguuuuuuaagauuucuuuagaauuuuuuaaauuuauuuuuaagauuuacuuauuuuaugucuaugaguauacacuguagcugugcagauaguugugagccuucaucugguuguugggaauugaauuuaggaccucuguucgcucgggucaacccugcucgcucacuccgaucggccccccgcccaaagauuuauuuauuguuauaaauaaguacacuguagcugucuucagacgcaccagaagagggcgucaggucucuuguugugagcuaccaugugguugugagauuugaacucaggaccuucggaaagagcagucggugugcucuuucaccagcccgagguauguguucguaugaagccacuuuucacuaacgcucacuuucuccuaaaucuaguucuuaguggaagaugaaaaguaauucuucuagaaggaaaaugacauuuuaagccauuaacucaacuuuagaacuuuagagauaacccaacccuaacaagaucuuacggguaacagaggcuccauuugcuacuaugaacuuaaacacaauuucauuuuuuaauuacuuagggcuggguauaaaacucaaggcguggcacaucuugacaagucuucuaccacugacauacauaucaacccuuucuuagcagucguugguuucuuggggguuuuguuuucguguuuuuguuuuuguuuguuuguuuuuugcuuaagaaaugggaacaggaaggucaggguaaugcugguuauuuuuacauggccguggagaaaugaaauguuuguguugugacaacagggccaaugcuugucuuuuggguuuuacauucucuugaccccgcuaagaaaauagcauggucuuauugcaacuugaugugccagggcugguugaugggguggagaggaacugagaggagagggagggcaaacuuuggucaggauguaaaacaaacaguugaguguuaaaaaaggaaguggcaccgaaagagacuagucuccgacuuggaaauacacacacauauacacuuguaggugcaguuacaggaaagcacaaagcaguaagggcaacuuuaauaaauauagugugcacuagcccguuuacucagugaacacuguacgaaaaacucaagagcaggucacagugaaaaucacccagugcauguggcuaaaaggguauagagagagccaagaccaguguuugcggcaucuuguuucacugaaagauucuuuucaguuuuuaguuuuucauuuugaagucauuuuagguguauaaagguuuauaaaacaauacagaacaguucaacucauguacuaagauccucuaccagcugaucggggggaaggaguucagccuaaagugaguaucaauguauauaucuauuagauugaagauuuaaaaauccugaugucugcaaacgucugcagaugcugagaagauggcucucccgcauugcuggugugucuguuaaugguauagucccucuggagacuauagucuagucucaaggaaguuaagccugcccuguacccauaagcuuuuguucuagagaaacgaaacucuuacuuguuuaauguucuugcuauguaccuuaggcuggccuuaagcucgugauccugccuuaugggcuaggauugcaaaauaggcaguauguuggcugugaaaauguauugucucacccaggggagcuggguggcuggguggguagguagguagguagguaaaugggugggugggugcauggaugggugggugcagggauugguggauggaugugguaugcugcuauaaucuuguacaucaagacucaaaaaagaauagaaccuaaugaauuagcaaagcuacgucugcucacugaauuguuauaugaagucauuuuucuguuuuugaugaugugcuaucauuauaaaaagugucaaccuuuagggaaagcugaugauuggcuaauuacagaguuuaucauuucuugagucuacaaaauauuucaaaauagaaagguaaaagaauucuauauacuauugacuuagauucuuuacauuuucuauacuacauaaucacaccacaaguauggcaaagaaauuaacaguggcaaaacacuguugucuaaucugcagaccuaauucaacuucucauaucucuaucaaucuauccaucuuucuaagaauacaaaguuugugcuaauacuucacauuccaaugcauuuggugagcuauugcccucaccuguuuuuuaguagaggcauuuuggagagcagcuguggccucuugugucagagguggcugcccuugaaugucuaggaggguuuuguucuugcuguuguuuguuuuuaauuuuaauuaacuuuccaguaugcuauuccucauucugaggauuaacaagccugucccucaacaguucaauagcuguagcagacauuuauggguauuuaucagugucagacccagugguacagaauuuauguucauuauuuuaucugugucucauuauaacucaagacuggaccuauuauuauuuccauuuuguagguaaggaaacugggguuugggguuucaauaauuauccuaagguugaaguuagugauguauaaaguccuguuuauauguuaaguugcagggacaaaaccuucuuugaacaacuaaaguuaaaagcauagcuugauccugugaggaaacggagcacucuuaagcuugugcuuaacuacugagcuccauuccuggguucacgugcauguuugcuuucuugaauuuaggugaagugacaauggaugccaugauggcucgacugaaacucuugaauccagaugaccuuagaaaagaaguuaugaaagcuggacuuaaauguggacccauuacaucaacaacaagauuuauuuuugagaagaaauuagcucaggccuuacuggaacaagguggauugcugaccucuucccuucccaagcccagcgcgguuacugccauggcauuuauccagggcaccucaaggacuccuccaucuguggacgggaaacaaacucagcaggccuguuuuucugaagacagagauuuugguuacagugugggcuugaacccuccagaagaggaagcgguagcauccaguguccacccaguacccuucagugccucuaccaggaaugacaaccacaaggcuggagugacagcuccuaaggagccacuuguguacuauggaguguguccaguauaugaggauggcccugugagacaugguaacgugcuguguagugucuccuuacccaaacugggaaacuauaaucuuaccacccaagauuaauuuuauuauucauauuuguuacccucugauucuuaacuguaaggaauacuauuuuuuguuuuuugguuuguuuuuuuuuucaagauaggguuucucuguguaguccuggcuguccuggaacucacuuuguagaccaggcuggccucgaacucagaaauccaccugccucugccucccaggugcuguguuuaaaggugugugccaccacacccggcuaggaauacuacuuuuuaauuacuaggaaaauggauucuaucagauagaugugaccggcaaaugauuggcuaacuuccauuuguuaauaacugcugauuagucaucuuccuucucccucuuaaauucauuacagccugagcagcuuuuagguuaauacuguauuauguaccaguaauaaauguaaaugugccaguugugcaacuguaaucuuguacaaggaauuguacauuuugggcuagaaaucuauuuuaguggguagaggauuugccaagcaugcauggcgcccugcauuuaauccccagagacauauaaaccuguugugguggcacauaacuauuaccccaacacuuggguagaugcuagcauguagaaauucugucucuugaaaaaaaggaagaagaaacuuguaauuuuauuuuagucaggauuauaaugugugcuuaggccuggaucuuucuguauggccuagggugggcuucaaaucucaacccuucugacuuuuccuuaugacuguugagaucguaggaauaagccaugugucugauccaacaauuuuaaauuuaaguuugaauuuuuuuauuuauaucuuuaauccacuuaaaauucaauuuuaguaaguuaauuuacuuuuuaucauauuucucaugaguuuaucacauuuuguaaguuauuguaccuuugaauaugaaauuaacacagguauauaugguaucauugcuugcuuauauacauacaaacguacauugucaaguguauucaugugaaguuuuggauagccaaggaucucuuuaagauaaaaaaugggaagugggcggagugacggcucagugauuaagagcacuugauaaucuucuugcauaucccagcucacauguuagaugguucauaaccuacguauaacuccagcuccagggggucugauucucuuuaggccuccaaagguacucacacacacacacauuauaugcauacaguuauaaaaaacaacuuauacacuuuuuuauccuaaaaaauauuuuuauauaagauugaaaaucugaacugugaacaugagagagggaaaccaagagacuuguuaacaaauguaaauugacugcugaacucuggguacaguuaaugcauggcuccaccuauucagcucuuaauuuucccuugguacuuugauacccagagaggauccauguuuacgaagauaaaaaggaagcuuuacaagcugccaaguugaucaaagggucccgguuuaaagcuuuucgaacaagagaagaugcugagaaauuugcuagagggauaugugauuauuuaccuucucccaacaaaacuacgcccuuacugucuccugugaaggcagugccccucgguggcagugaugggcugaaagguaaggauucucuaccucuuucuuaccuuggcauucaugacugucaguuaccucucuauggcaggugccucgauuucuucaucaaugagauaaaccugguguaggaagagguaucgagcugaaguguccuacaauggaacaaccaaagagaagggggcugggggcugcccugggaagguuugaaggcauaaggguggguggagcuggugcuaguagacccugaagcugaugagccaaguauuggcaugugggccacagaagcagcagagggaacacuugcauuuucuuggggcuauagugugaguuauggguauuuugaugcugacaaucuauaaucccaccugaagggacaccuuuuucuaggaugugcaagaaucagucucccuauagaagcuagaaaucugacuaggcccuuuguaugacucaaaaccagaggccuauuuggagaggcuugacuuugguucacauccuuuguagggaagucccuucaguuguuugagguggaccucugaccuuguguugagagucugucuguugccuucuacucuucccuuacucagguuucucugcuuucagcuugggaaagugccccgcaggaaauuguuuuacgaagcuuucagguuuugauuaaaccauuagaagcuguguguggaacucuuuuucucuaaggguguauuacaguuggguuuuugagacaaggucucaaucauguuaauccacacuggccuugagcuugcaauccuccuaucucaaccccccgaauaauauagguuauaggauacagauuauauuauuauauuacauucguauauguuacguuaauaauauagauuauauuauuauagaauauagauuguagguuauaucuuggcuuaucuucaaaguacacuaaauggccagacaugguugugcaugcccuuaaugccagcacucaggaggcacauguauguagaucucuguaaguuugagaccuucucaaaaaaaaaguucacaaaaugaacuuucucucagucuucagccaucugauuggacuuggcucugcauuagugcuguagugugcucuguaucaugugacuuccuaccugucauucccaagagcugcucauccucugaagggaggcugcagccuucgccacaguagacuauguaagaagaaaauguuugucucuugacagcagauggcuugugccuggcugaaucagaaacaguaaacaaagaacgagcaaacaguuacaaaaacccccguacccaggaccucacggccaagcugcggaaagcugucgaaaacggggaggaacacaccuuuucugaucuuaucuggaguaauccucgauaucuaauugguucuggggacaacccaaccauuguacaaguaaguaugcuucuaacaccacuccuggucacuuugucccugaccagugacggcgcuuuaacaaauaugaagcucaacauguggucuccuuucaggaaggauguagguacaaugucaugcauguugcugccaaagagaaccaggcuuccaugugccagcugacauuagagacucuggagaacccugaguuuaugcgucugauguacccagaugacaacauggacaugcuacagaagcgcauccucuacguuguugaccuguaucuuaauacuccugacaaagugguaaguacuccucauuagucugucggauaaaggcuugaguuccugacauuugagaguauuucuuuuucugugcuacaucaacaugcaaggcuuauggaauacuaggaagacaugaacacucauggacuuagaaagauguuuaugaagguguuacauaacaaaacuuaucuuggggagacauagcauacacauugggaacuccauauggggaacucaugaccgaccaaaguacagauaccaccagagcccaacaugguguuacuuacaggaauaugggugaggggucacuuacaggagcagaagugacucaaagacacuugcaucaccagggcccacccuagcuagcaugggugacaguuuacaaugaacugggaaccuggaacacacuacacagccuacagacagcugaacagacuagagaguauucuuuccagguuccucaguuagucuaacccuuuucuaggcagcuggucugucuuaaaguuccauugcugugaagagacaguguggaccacaacaacucuuuuuuuuuuuuuucuuuuuuuuuuaauuuauuuuuauaugagugcacucuguuuucagacacaccggaagagggcgucagaucucaucacugacgguugugagccaucacgugguuguugggaauugaacugaggaccucuggaagagcaguggcugacuucuuagccacugagccauuucucuagcccccuaaauaaggguuugaaacaggaauuuauuuuauaugaaggagaauucaauagcaguuuagagccaagaacuaaacucacagaaaucugggaguuuagaaagcuaugggaaagaauaaaagaaagcauuagggaauccgaggcaggaggacuguuaguucaaggccaaccuggucuacaaaaugguaaagaguaaaauuuuacaagagaagaauauacuuugauauguauuuuuauaagugauuucggguggccagccuaaaauucacguauacccagugcugggaacugaacuuaggaucucaaauaggcuaggcaagcccucuaccacugagcccacaguuuuaguuucuuuuaaaaagugguaauuuuuagguuucauuguuguuuugcuuuuauuugaaaguugcugcuugucuguucuguuguuucuaacauaguucuguuauaauuacccagggacucagaaaauugauuccaguagcugcaaaaauacaccugucucaaacaauaaauagggggaaaaauuaaagauaacuuaggaguaaacuguaaaacuaaagagacauuuagucaaccaagccaaauuauagaaacagauuuuuaaagaaaucagaauaaagucaaauuucucucaccacacccucacacacacuccugacaucaggacuguguaggggaggucaguuggauguuguccaguucagcucuggggauagugagagucccacacaaucagggcuuagucacaaaggaugagccucaccugagauguuagccacaugcccuguuuguccuacugaugcuugacaucugaaagguugggguuguaggcacgcuccaccaugcccaugcccaguggacuuacucaacuuuuagaacacugguucccugacuauagacugggucacaacuuauuaaaguuaagguugacuguauaccuuugauuguaagugccuccuuggaucugggcacuuagcaccaaaugaagagugacagauauuagugugccaggcucagagccuggcaagcaaugacuguaugcuagcaugccagguacuuuugccaacaguaaagcaguaucuuuuuguuucugaggccuuuuucuuuugggguguucaauuuugagacagucuuuuuuguuugguuguuuuuguuuuuuuuucgagacaggguuucucuguguagcccuggcuguccuggaacucaccuuguagaccaggcuggccucgaacucagaaaucugccugccucugccucccaagugcugggauuaaaggcgugugccaccacugcccugcuguugcaggacauuugaucacaccaugaacccuaagauuguguuguuuacuggaaaaaccuguucuaguuguguggcacccuuaguauacaccuuuaaucccaacaaugaagguaaaguuaguuuguagaagaaugcccauguuugaaagugauaaaucagagaaagauuugacagaauaggauauucccaacucucaugagaagagagaggaaaggaaagcuacuucaggaguagugcagggcuggcgagauggcucaguggguuaaagcacugacugcugcucuuccaaaggcccugaguuaaaaucccagcaaucacaugguggcucacaaccacccguaaugagaucugacgccaucuucuggugcaucugaagucagcuacaguguacuuauguauaauaauaaucuuuaaaaaaaaaaaaaaaaaaggaguagugcaaaagacagagaagaagaagcuguuuaaccaggugauuuuuacagacacagguugaagagagaacaagcuagacacaggugaugacagaaggagccagcagauuagaacaaaugguuagaguuaguuugagguaaagcagagcaauuggagaaaggcaggggaugggguagauugaaccaauuaauguagagggguguuuugagccagaauagagguuagaagcuuccagaacuaggccuagguuagcagauugccaugugagugcuaggaauugaaccugggaccucuggaagagcagccagugcucuuaaccacugagcagucucgccagccuuugagauccaggcuggccucaaacuuacuauguagcuaagaaugaccuucaauuccugaccccucugccuucacuugacaaguguuaccacaaaggucugaggcuuuuuuacuuuuuguuauuuuuuuuuaauuuccagauaugguugcacauacuuuuaauuccaacacuuagguggaagaggcaggaaggaucugaguuuaaggccaucguggucuacauagggaguuccaagcuagcuaaggcuacauagugagacccugccucaaaacaugcuuuuuauuauguauuuauuuauugagugugugugcuggggagcgaggggguauagaugucacagaacacagaucucuuuuuccauccagggauuaaacucagguugucaggcuugguaaaagagccugcugguuuaguuuuaaaucagugguucucuuccaacaagagacuugcauggauagaccuaggccauggaugugcagcuuguucuucaugggaccucuaucagcagcugcuugucucugacuuuguugccugacuuuggauccuuuuccccuaacuggacggccuugucuagccucagaagaugcauccauuccuacuacaauuugauaugacaaggcggguugauauccaugggaggucugggcaugggggggcggcggggaggaggggcugggaggagaggaaggaagcagcguugguucucagccugugagucgcaacuccuuuguagguaaaaugacccuuucacagggauugccuaagaccauuggaaaacauagguauuuauauuaugauucauaacagcagcaaaauuauaguuagcaaguagcaacgaaaauaauuuuauggggguugggugucaccacaacaugaggaacuguguuaaaggguugcaggcuugggaaggcugagaaccacuguuuuaaguaaacaccuacuuucacuguuucauguuaauaauuugaguaagcaauugugcuucuuguccaccuuuccuagggcuuugauacaccacugcauuuugcuuguaaauuuggaaauguggauguagucaaugugcuuucuucacacccuuugauugugaaaaaccgaaagaauaaauaugguaaaacaccugaagaaguaaguaacauuuuaaugguaguuacugccuuguguuagaaauucaaacauaugaauaugcauucuguggcugugccugaguugugugugccuugugugccuugcggggcacaucuaggaugcagacugcuagugugaugucuguggagccaggagagaaggagcuaacccagucuugcugcuuuuacuuuccugaaucuggacaucaguuguucugaacaacucauucuuagcauguuccuucuaaacacaugggccaaccaaguucagagagaaagcagguaguggucaugaugauggcucuggguagugauaguagcaguggucuugauggcuauaguggugguagugauggugauaaugugucaagcagcugauugcuguaaaacagaaaggggggccagcccacauacauaccauagcacucaagccaagugaagcaaaccuuuuuguguuccuuaccaguaggaugaaauaugauacugugccugugacauaaagacagaccugggauaauaagaaccaaagugcuaauuuaaggaucaggcauuauaugcugcuagcugaccuagaucuacuacuuucagaaaugaaaccuaaaggacauucuucaauaggagugucuucccuagggucaggccccuucuuuagcuauuacaacauuuaguaacacucaacauaccccaguugguagaaaacuucccuaacauacacaaggccuugguauucaggaauagaggaaggaagaaaaaacaaaacaauaaaauucuacuacagagagguauaguuuuaucuauauuuuuauaaaaugauuuuugauaaccagccuaaaauuguauauaugacuguugugugucauauauacaauguugggcauagcaccuagugucucaaauaugcuacauaagccuucuagaacugagcgaacaauuuuaguuugcuucacaaagugguaacuuacagggauuuuguuguuguuuugauuuuauuugaaaguaauugcuuuucuguuguuucuaacauauuauuacuguuguaauuugcacagaagcucagaaaguugauucuaguagcugcaaagauagaucuguguucuauaugagauaguagugcuguuugagcucagauacccaacagcaaacauuuguguagagaggguauacuuucagacuauaaagcucccucagaugaggaacacgagcgaguucauguuucauacuacccacaaguuuguaugaugcaguuugucugugugcaggggucagaucucauggagauggaguuacagacaguuguaaguugccaugugggugcugggaauugaacccagguccuguggaagaacagccaguguucuuaacugcugagucaucuuucuagcuccaugauaugcuuuuaagauuuuuuuucccuucuacaaaaugggaaacuaaaguugugugaagaaaaagauaaaauuuaccauauugcuaaagucugcuuucuuucuuuuuaaaaaaaauauguauuuauuuaauguaucugaguacacuguaacuguuuucagacauaccagaagggggcaucggaucucacuacagauggucgugagcuaccaugugguugcugggauuugaacucaggaccucuggaaaagcaguuggugcucuuaaucacuaagccaucucuccagccccuagagucugcauucuuguccuguuccaaugaguguuuucagugagugaucuuauagaauaggcugugcuauugaccacaggauuuuuuuuuuguuuacuuauuuuuaugugugggugucauuuugccuccauauaugucugcauuacaugcaugauuugugccuguggaggcuaggaaacugaaauugcagacaguuguaaagugccaugugugucaaugcuagaaauugaacccaaguccucugaaagaccauccagugcucuuaaccaaugagucaucaucucucaagcccucuagcacagguuuuccgagugugagguuugugaauuuuuucauuaagauaaugcuagggcuggagagacaagcucagagguuaggaacccuugcuggggaggugccacacaccuuucaucccagcacucaggggacagaagcaggcacaccucugaaucugaggacagcuagggcuacacagagaaacccuguccugaaaaaacaaacaaaacaaaaaagaacacuuccugcucuugcaggagacuggagcuguguccccugcccccagguuguaugacucacugccugcgacuccagcuucaggggaccucuggggcaucugcacuuaagcacacauauacacaacauguacccauacacauaaauacgaauuuuaaagauacuauccuauuuuacuagacuuaagguuaagaaaacauuuauuuauuaggagauguaauauaguaauagaaugcuuacuuugucuguuuuguuuaaauagguaauuugugaaagaagccaaaacaaaucuccagcacugaaagaaaggauuagagaauacuuaaugggugaguuaugcacucaauuuaugaguggaccuggggaaauacagcaaagauugaucugcuuuuccaaguucugaaaaaauaguacuaugaauauucucagaaccuuuugaaauuauucacuguuuuuccuagaugcuacaccuccuugccugacuucauacuaccuguucuuguucugauuuuagacucucuuuuacuugauugcugcucagggacucacuccaucucugaagcagguuucucugaucauuucucacuagggagggcugaagcccagagcuccuuguguagauauuuggcuuuuguuuuccagcuuauuucagagagguuguauuuugagugcgucucccacuucugccccuaugaggcuguccagcucagcuuaaccuuucaaaccuaggauccagucaggaccauuauccugcuggauuguagagguaugauauucauucauacucauuuucucuccccuugccauuucuuucuucacuuccucauucuuuccuacacuuucuucucccuucuuuccccucagucccucucucuuuucaucuuugguauucacuauagagaaaauugcuuggacauagguuuaagcuaauagauaguauuaacuagccagcuacuucauuagguguucaggaucccaguauauccaugagucuuucucggagggaccuuuuuaagcacaaaauccauaucuuuggucaacauauuucaguuagcaaguacgguuagccagaaaugaaaggaacuauagaagucaaaaagcaagguuagucauuuauagaccauccaagaacuauggacuuggauggacugcucauugcuuucauuuuggcaggugguacugucagugugguaaguuuuauggccugaauaguaaguacuuccaugaauugugcugagguuuggaggccuguuacacuuuucuccuuuucuucuggucaggagcuccuaauuguggcuucugugcuuguggucuguggguaguuaguuucaggagggacuguccuacuguguuguuuucagugcaucuccgaagauguguugaugcuuuucccuuuguuucuacccaugcaccugguuuguuguuucugcugaccaaguaaaauugaaguuuucugaccuucuuuucuuucuuagguauuuagccauggucauggcuugacauagugucucuggguauuuucucaagucagagucccuguagccuguauaucugacauuuuguagaauuggguacuaacugucuuaguuaggguuuccauugcuguaaagagauacaccaugaccaaggcaucuuuuauaaaggaaaacauuuaauuagggcuggcuuaacagauucugagguucaguccauuuggaagcauggcagcaucuaugaggcaugguacuggaguaggagcuuagaguucuauaucuuguucugaggcaaacaaaagacuguuuucaggcuguuaaagaaggagggucucaaagcccaacccuagagugacacacuuccuccaacaaggccacaccuccuaauagugccacugccuggcucaagcauauucaaacugucacacacucccaaccuaagauuaucuggauuuuuaauuguacucuuaaucucuuccaguccuuucugccuaugcagucaugaaucccaguguaugguagaggugacagaugucucuugggcuagcugucauuuguuggagacucuaguuguguuacagaacacaacuaaacuaaacugccagaaauaccuuaaaauguaauuaguuacaguuuguggugggacuuuucuuauuuguaaucauauaauuugaucacugcuaaaaucugguuaccuagauguuuuccugggauuagcaugguacuucugcacccauguuccuuuguuacucagccuuauggaauuuugugccuucccuguuuccugcugaggucauaaagccagcuucagaguuucucguggggcaguuuucacccucuagacuuaaugcuccagggacuacacugcugcaugccaggucauccaaacaauacccaaacuuguguaaauagagugagagaacacacaacuaacuaucuaucuaucuaucuaucuaucuaucuaucuauuuuuaugcgcauuaguguuuucccugcauguauggccguaggaggugucugacaguuacagacaggugugaguugccaugugggugcaggggauuaaacccagguccucuggaagagcagucaguguucuuaacccuggagaugucucucuagccccccccccccuaaaacacagcauuuuuuuguuguuguuguuguuuuguuuuguuuuuugagacaggguuucucuguauaguccuggcuguccuggaacucacucuguagaccaggcuggccucgaacucagaaaucugccugccucugccucccaagugcugggauuaaaggcaugcgccaccaugcccggcuuaacacacauuuuaaggaaaugaauaggauaaaaaaccuagacacaagaccacugaggccuugaauccaguuuuguugaugaaguauuucaaagugcuggcgauugaacucagguccugaagcaugcuggacaccucuaccuuugaucuaccucacagcccuuuauauauaagcuuuaauaucuugcagggguaaaguauauuucuggaacauuuuaauauacgaagcccuaggucccauccucagcaugugcacacacauacucauacacacacuccaaacuuuuaaaggacuugaauauucagaagaaagguaagccauacuuuaugaauaacuagguuauacauaaguuuuguuguauacuuucccaaaaaacagccauuucaaaauccaugaaaugcaaagggaauggaaauuuaugauaaucucauagguaugugauaucagucacaaucucagauacugaaauguuaaauacauuucccugguugauuuguuuguuuugaggcagggucacacuauauauucuuggcugcccaggaacucauucuguagaccaagcuggccuuaaacucacagauauuagccuggcuuugccuccagagagcuuggauuaaaggcauauaccacuauguccaaccauuucccuauuuuuaaaaauuacuuuuauuguaugugcauucguguuuugugugugucuauguauguacauggagugcauacauggugcccacagagaguagaagaggguguuggauucugugcagcuggacuacuucaaaguagguaguuagaauuagaggaaccaaacccuaguacccugcccaagcagcaaaguuuugggcugagcucaaccuccaucacccccuuugguuuuuuuguuuuguuuuguuuuguuuuuauagaaucucguguagcccaagauggucucaaacucacuaaacucaggaugaccuugauuucugacccucuucucuuguccucccaacaaaugggagguagguauaagccaccauacucaguuuuauguaaugcuugguaucacaccuguggccucauaugugcacucuacacaaguaauaaauguuaaagauacauacauacauacauacauacauacauacauacauacauacauacauauauauguguguguguguauguguguguguguguauguauauauauauuuuuguuuguuuguuuguuuguuuuuguuuuuuuuuuguuuuucgagacaggguuucucuguauagcccuggcuguccuggaacucacuuuuuagaccaggcuggccuugaacucagaaauccgccugccucugccucccaagugcugggauuaaaggcgugugccaccacaccuggcuuaaagauauauuuuaaugcuguguuuuuguuaagguaggcucuauguuaacacucuuuuaaguagagaaagaaagauauaaaagcuauuauaagcacuuggaaucaaaaauucccaggaaauugugagcagcaugacaagcugauauucuagcacaccucuuauagaagaaugagaaauagagucagggaagaaggaagugugaccgccuuguacuaagcuccuucucuguccuagucacacucauggcucgagacuuauagcuuccuugggugucugcuugccucuucucauuccuuuuuuuuuuuuuuaauguuuuuuguuuguuuauacuuaguauauuucuggacaggaauucgaugguguguuuuacagauggauauaaagagaagaguugaaaagagugugugugugugugugugugugugugugugugugugugugugugugagaugauggggacuaggaaaaagaaaagguagguuuuggugaaauaacccugauaagccauugaucaaagcaggaagcugcagacugagcagaagcaguaggggggggguuguuugcuuguucgugugggauaggacugcacugaacugaccuguuugcucaguuaaucuucuuacaccuacucuuggcagcucauguauugaagaauaccauaaggaucaucuuaauuuuaaccucaaagccuugccaggugugucauugucuccauuaugcauucagggcucagaaaacaaaaacagauaaacagaacccugcuuuaguagagaaugguaaagagacucacuuaguagucacugauacaaauuggucucagaccccaagccuggaccuuucugucaaacuguuuuccuugacguuccccuagacccugacuuagaugaaaguaaguagaagcugcuggcugacauuuaucuccuauucaggucacuacuaugugccacuccugagagcagaagacacuucuccugucauuggggagcugugguccucagaccagaaagcugaagccucaaauacugcccacuguagaagcagccccagagauccugugaugacacugagagcuuucgugggaccucugaguccauccaaagugaguggccaggaaaagaacuguccugguuaacuauauuuuaggguucaaugcuccaaucuguugcuuuguuuuggucauggagaccaacucauggaagccuaaggucaucuuuaucugacaucaccucuaaugaaguuuuuuugguuuugguugguuggguuuuuuuguuuguuuguuuguuuuuucgagacaggguuucucuguguagcccuggcuguccuggaacucacacuguagaccaggcuggccucaaacucagaaauccgccugccucugccuccaaagugcugggauuaaaggugugcaccaccagugccugguucuaaugaaguauuaaugaguccuugggguguuuguuuuguuauguggccagggaaggugcauucgaagcccaggccucuuggcauauuaguguuuuccuagccaagauccuucuguucuuuaccaguccauugcaacguagggagcuccacauuugcaaaucaaauuccagccugagcuuccuacacaugaaacucuuaccccuuccccauguuccuguguuccugucauaccuacaccuguuuaguugagcucuacuuauaaaugauggaauugauggcucuaugugcuuuuaugccagacuuacagcuuucucgaaugaaauaucucacugguguauuauuuaaaacuuucuaaauaagcuugucacgguggcacauucuguaauucuagcuucuugggagguugaggcaggcguaccuaucacaauuugaaaauaagccuggguuauacacauaguaagaucuugucacaaaacaacuuccuaaauaauuugcaaaaaaauuccagaaggauuauacaugagagaaagaugucagcuuuccuuugauauguaaggggaaggggauauaaacuagugagguggcaguagacaaugccuguugugcuaggccagaugggacccucaacauucggccguacagaaaggcagcucuccuuuguaucacuuuuccuggagcuauaaagaaacaucuaccuagaaaaagucauacaaccaacccuaccuuucccagaucccaugaggcugugcucucucuuggcuaucuguagaaauggcuacacaaucuguaagguggaaggaaaaacauuaauuaagccuguaguguuggugguucugagucucaugugagcugcaugaagcacuuuuucuuccaggcagaagauuuucgaaagcucuggaaaacuccaccucgaaagaaagcaggcuucuuccacagcaucagaaagucugacccagaacgaggcauugagagaguuggaagguauucacagggccguggcugccaagcugagcaaagugugcugugugguuguggauaaaugauuaaaaaauauuaauuauggggcuggugagauggcucaguggguaagagcacccgacugcucuuccaaagguccggaguucaaaucccagcaaccacaugguggcucacaaccauccguaacgagaucugacgcccucuucuggugugucugaagacagcuacaguguacuuauauauaauaaauaaguaaaucuuaaaaaaauauauuaauuaugaauacugaaauguaacauuucccagaaggaauuagagccuuuuuucaaaaguaugugcccaguuugaaccugcuacagaccucuaaaauuuuauguacuuaaccaaaguaaggacacacauuaggagguuuugugugugguuuuuauuuuugcugugaaguuaugaugguacacaggucuucuuccaugagucagagucacuugcuaugucagaguaacuccucaaaggacaugcagggucuaaccacuggaggaacaugagggaaugccccaaauuagggcaaaguaaaauacccaaaacaguggcccuucagagauuaugugcuauuuucuguguaguugggguuugguuugguuuggauugguuuuucuuuuccuguuuucucaacuguuguguuuuauuucuuacagggagcuagcucaugagcugggguaucccuggguugaauacugggaauuucugggauguuuuguugaucugucuucccaggaaggcuugcaaagacuagaagaauaccuuauccagaaggaguuaagcaaaaaggcucaacaagaaauacgagaaaaugaaggcugccuucaggacagaaccucagauuuugguaaguaggugcagggucuguggguuucucuuuucuuuuuuaauauguuuuuacuguaaaaucagaucuucuccucaaacugauaucagaaauugugcauacaguuauauuaaaacaaacaagcaaauaaaagcaaggaaucacagccagcucuaugugucuggagcacuuguacgcuucugcagguauaugcaucguguuguaugcaugggaucguauguaaaaguucagaaucacagcaagcaacguguguauacuacaugaaaaauguggcauccuugcaaggagucuggugcuucuggcuucuucuacugacguagauaugcuuuacaugugaauaucuuguguaaugacguagauaugcuuuacaugugaauaucuuguguaaugucagaaggagaauaaggaacacaggcuucagaauacugggcacuggguuuugcauuaggucacugggaauagcaugucuuggguacaaagcaaguuaauggaaugcuuggaaacgguuacccuggaaacaguuacccugaguauaaagcauaaaacaggucaucauucaccaacaccacuaaagaacuugggugacaucagucugugagugacucugguagaacacgugcuaaccaugagcaaagccagaggggaggaggggauaguaaaguuuuuaauguuaugcaccuaaagugaaaugggaaaagaaaaauauucuuuaaaggaaggaaaaucauauauauauauauauauauauauacacacacacacacacacacacacacacacauacauacacacgggggaggcggggguugguuuuguuuuuguuuuuuugagucaggguuucuuuguguagcccuggcuguccuggaacucacuuuguagaccaggcuggccucgaacucagaaaucugcuggccuuugccucucgagugcucccgagugcugggauuaaaggcgugcgccaccacgcccggcuuuccuuuacacuuucauccuacacacugaucugaguuuuuugcccuuacaggcaguggaaagaaguacagcaacuccaucuccgugggagcauuucuagauggggaugaugacaguaguuuggaagaaauuaaaaaccagcaaaauacaguuccaagucagagucagcccacaacugauaaguuccaaaccucuaaaagugguucccuucccuugggacagaaggucgacccuggagaaaccucaguuggaacuuacccagauaaaggcagaaauggguuuugucacccucuaaaccacaggacugcagauggaaggggacuagaggccaccaauggggaggaggcccuuccaccaccuguuucuguuuugacucaagaguugaauaaacugaauuugcaaagccugggagacagccuucaugagacaccagauaaaaacgggaaacuagaggaugaggugcuuccuucaagaaagggugcagcagacagugacuugcuggcaucuccuccugccauagcaagccuuggaaagaagcaagucaggaccaacacugaggugucagaggcaauggcugaaaugucuuugggcccuaagagcccccaacuuggaguucaggcuggucuggaaccuauacucucaucugccacgguagauuccaccaagaggcucuuccugucuggguaaguuaaggauguagcacuauaaugaguguguaguuuuuuaauauccuugggggucuucuaucuggacuaugcuaauccagugucaauaagggaguaccaacggaaugauuucaucuacccuauguuuaagacucaaaauggaagacccaacuaguaucuuaaagaggucuuuaccauucccuacagcauuuaccuugaccagcccuggccuuggauaccagcucuacccacccaccugcuuuuaggcuaguuuaguaguuuauaugcucagcccagauuggugggguuuuuugguuguuguuauugggguuuguuuuguuuuuguuauucauguauuuugugcuuguaagccuugagcuaaaaauacuauaacuuauaagccuuucccccgacaauguuuccgcuuuuucuuacauuucuucuguucugcauucuagagaggaaccaucaaaacuagaucgagauguuuuagcagcucuugagugugcgaauauugacccuggucuguacccagcaauccacagauggaaaagcacugucaugugcuacucgcccucagacagacagagguacuacuacucacagcaucagagugcagagacugacaggguugucauacacggguagcuuucucauaguaacaaagcuaaccuggggagccccccaauacaagccuggccuguguguccauguagauguggccacaaaggcggauacauguccauagagugggaaaguaggccaggcuugcuucuggcaaacugcaucgggggaggcaguguccagaauguauagcugaaacaauauggguguuguguguaaagucgccauaucugagguguaggaguaucuccucucuguaagacaagugucaugccuaugucuuugcucuguucuuaaaucucuacucuguagugugccucucugugguaacaaaucucuuugguuuccacaguuggccaaguccugcacucaaagggaaguucacaacugaguugguggaucucgauugcucucauagcugcucaggacgaugcaguccagcugguagcagccccaguaagccuggccacaccuccuccucuucuggccugcacagcccuggacgcuacaguccagcacaugggagacacuuccaaagaguggcacacguggcccgacuugcagcucuguagagccagcuuacuccugggauucauuuacuucuuuguuuguaaaagaguaauguuuauugguaaaaauuccaugaaagaauguauccugaauaacuuaauccucgcuuugaggguacugguauuuuagaaaauacaauguucugaguauaauuugaaugucugauauuuuggaagaaguuaaugaaagcaaacucagauacuaauuguuugaaaguguagccguaauaaugauucagacuuuucagguggaaacuucuaauuuugaaauagaacaaagaugcaaaggcauagacaagugagguguugcuaauuggguuuguuagcagcaacacugcagcacgugcacacacccacuauuucugaaacagaucaauuauguauugucucuugggggggugcagcuuuuugauaugcaauggcaaaacuauguguuugucauuucacccuaguuauuccaaccgagagaaagcagguggcagaaaagcagaugugcccugacucagacuucaguaacaaugcucaaaacacugccagaaguugggaugggggguuaaagccaucgagaaucaugcgaguaaucaucauagaaaacucaccagcaauaacuaaaaccaaaacuauuucucaguacuugucaguguaguaaguugucuagaaguuguacccaggcuggagaaauggcucagcgguuaagagcaccgacugcucuuccaaugguccugaguucaauucccagcaaccacaugguggcucacaaccauccauaauaaaaucugaugccuucuuuuggggugucugaaaacagauacaguguacuuacauauaauaaauacaucuuuuauaaaaaaaagaaauuguucccaagucuuaaaauuuagccugagauuucacuaagcaugauuacaugacagauguaugccguauuuuagaaauuaaagagcuuuaugcuagaguuuagcacuugagaucugaguucauuucaguggcuugcaguguugacuuuuggcuaucccaagagauguguaccgaguggcauugcacacccuaaggcuccaagauaaaaccaccuugcugaagcugggucucagcugucugucaguugcuugcacagagccaguaguguucuggagacacuugcagugcuucaccccaguacagaacuauaccacugauuuugccaauuucagugccuuuugugagucauuuugagaucacauagugcuaaaugggggcguuagauucucuuuuguuuauaaaaauguugaccaggcaagccuuuaagcccagcacucauuaggcagaagcaggggguucucugaauuugaggccagccuggucuagauagugaguuccaagacagccagaacuacacagaggaucuugucucaaauuuaaaacaaaaacaaaaacccaccaaaaugauaauaaaguaauucugagcucaaauguuuaggucuuuucuuuuuucuuuuuuuuuuuuuuuaacuuuuuuaaagcuuauuuuaaugugguaagaaauaccagaauugagauuuuggacuuuggauuuaguuuguuuuguuccccuuguaagcagcugagcucuaaguacaagacagccaaucaagugaccuggaaacaaucccaaagggaaucuuuguucucaaaagaaaccaaaacccacacacuauauucagcuaugauuuuguuuucucuaaagucuuauuguccugugcgguuauuuuuguuguuuuuuccauacucaaaaacugaaguacuaguuuugcccuauuuuaacuuuuuuuuuuuuaaacucuucuuucuugauauuuacuuaagacaacuuuugggagucaguucucaaaccauguaggucucaggaauccaacuccagucacuggaauugaguuuuacccgagccaucuugcucgcccauuuuaaacccuaagcugccuuuggacuauuuuuccacuaguaugaaggguauauaccuguuaguaacaccuguugaucuaugucauaaacauuguuuacuugaucuuucgcaaaguguuggguaggaaacgacuccuuaauuuguuauuggacagaauccccuucuuaguaaaacuguaagaaauauuuucauuaaaaaggacauugaguagcacauugaugucugggagaugucuuacuauguuaccccaauggccuggaacuggaugaguuuacuugcugggauuuggcuuagucuaacacaguuaauagcauuugauuauguggcaguggaagacuucuuuuaaugugugacagggcugugaaaggcauccuuccugaaguggcauaguaugaaugaacuuguaacagagacacucgcuaccaccaccaccacacccacccagc

SEQ ID NO: 2593 - RNA, 10800 nt, Mus musculus
guuucuaaacacuacuuuuucccuuuaaaacaaauaaacaacaaaacaaaguaaaauuuuauuacauacuuauucccaaagaggacagagagguacaucaaauauuccaacucauugcauugauuacagaagaugcucacaaccacuucauagaaacuguacuuggguuuuugagggggcgagagggaagcagguaugguaguauauacaugcaaucccaacauuuacaagauggagaagggucucaaguuugaagccagccugggcaauaauuaagauucugucucaaaaagcaaaaccaaaaaccacauacauaaaagacaguuuuuuucuuaagucaucagacuaucuggaguaaacacaucauuucuaaauaaccuacaaguccaagguuaacaguagccaguagcaaacuaagauggaacuguugaacaaggauauuuuucugggucuuuaaacauaacucaggcuggauaguaacuccugauccugcuucugccucccaaaugcuagaauuacaaguacaugcugccuccucugucagucagcgggggcuaaaucuuugccuccaaagaagcgcuuacaggacugucaccuacuugccuuauacagaccacagucuucuugcagggccacuucuuccauggcuuuuaucuaucauauaggaagccagccccuuuguccuucauucagaugcaguaaacauaggaucucuuaauugagcugagaaguugguuuucaaagcaagaaaccacaugaaaaucuuuaauaaauaagcaaccaaaggucuuagauugcaguauaugaaauguaaugucaccuguaaaccaccauacuaccagucaggucucugcccgauguuauggauugcuuggcuggucuacuguaaucacgugaugcaguacagccaggccaguacccauaacaggccugccuucuaccuaggaagguuccugucacaccucauagggcugugcuggugguaaugguaaaggagaaaacuuucacaaaggccgucuaacuccuaaguugccuucuucagcaugagccagaacuaaagcacccaaaugugacauuugagacaacaugaagccacagcacagcuguggaagacaagggaaggcuguagucaggccaccagcagaggacagcgugcagucugauaggcagccucaggaccgaguaaucuugucugggggcaugaacccuguguccccaaggguccugagugccacacgaccauugggucgaaucaccaggugggugauacugccguuguugagggacaggcggagccaaccuucugggggaaacugcaacgcucuggggagagaaaaauaaaugcuagcagaaaagucagguugauagccagcugcuuuguucaggcaaccugacagccuucuggaauagauagucagcuaagccaguaacagaggagaguuucucaggggaaaugucucaguaguacucuaaaugagguauucaaccuguggggacaagggcuuaacccaacuaaguagaaaugugcucagggcuagugagaucaccgcauuuaaaguuuuccacuguaaccguuucugacaggcaggacuuggcuggucccccaggauaaagguaugacacguuaccccugcaugguuccuuguacauagcucaugcucuuguuuuuuuaagaugggguuucucaggcuggcgagauggcucagugguuaagagcgcugacugcucuucugaaggucccaaguucaaaucccagcaaccacaugguggcucacaaccaucuauaacgaaaucugaugcccucuucuggaguaucugaggacagcuacaguauacuuacauauaauaaauaaauaaauccaaaaaaaaaaaaaaaagacaggguuucucugugugacacuggcuguccuggaacucacuucauacaccaggcuggcauuugacaacacccagcucccgugcuccuuuugaagagcacaaguauaggagcugaagcgugcugcucuuacagaggagcagagucaagucgcaucaccuauguugagcagcucacacagucucauaccuccugcuccagggcauuaucuuuuucuggccucuaagagcaugcagacacauaugcaugaauaucuaccugcugagcaguuugcuauucugccauuuaacuucaacuuaguuuaccaacacgugacauuuccugcuacuacuuguuuaguuuuaaaauguaaaugcuguaaaaaccccgugaugaauccuggcuaauacugaaaaagggacacaguaguugccccgcuucuccccugcacacacacaccuuuuuuuucuuuucugcgccaccacgcccggcuuuuuuuuuuuuuuaagaauggguuuuauguagcucaggcuggacucaaacucacuguauaguuauaccugacuuugaguaucugccuccugccuccacaucuuaaguucugggauuacaagcaugcaccacuacacuggucuuuguuuaugcuaugaagcacucugccaguggaacuacaucuguauacuguuguggaacacuguauacuguuguggacugaugcuuagaaagcuuuuauauccucaagaggcugcauaaauauuugcaugaacaggcuuuauuuauauauuugagauagagucccgagccgggcaugguggcgcacgccuuuagucccaguacucaagaggcagaggcaggaggauuucugaguucaaggcccagccuggucuacagagugaguuccaggacagccagagcuacacagagaaacccugucucggaaaacaaaaaacaaacaaacaaacaaaaaacuaccugccuuuucauggcguaaauauucuucccaggcuaauucuuucugcauuuucaucauuaucaguuauaggggacugugaugguuuguauauccuuggaccagggaguggcaccaucuggagguguggccuuguuggaauaggugugaccugguuggaaugggugugucacugugggugugggcauaagauccucacccuauuugccuggaagucagucuuccacuagcagccuuuggaugaagacauagaacucucagcuccuccugcgucaugccugccuggauacugccaugcucccucuuugaugauaauggacugaaccucugaaccuguaagccagccccaauuaaauguuguuuuuuauaagacuugccuuggucauggugucuguucacagcaguaaaacccuaacuaauacagaaguugguacuggaguggggguauugcugugauaggccugaccauucuuuuauuugaaagaauguggauuuugggacuuuguauuuggaaagcaauggaaugcuuuaaauggugcuuaaugggucauccuaguaggaauauggaagacuuaguugcugggaguaauuugaacuguguugaccuggcccaagagauuucacaggagaaugauuucagcauguggcauaaagacugguucuguggucuuuugguuaagaauguggcuacuuuuugcccuugucugaagucugccugaggcuaaggugaaaagacuuggauuaauuacauugacaaaagaaguuucaaaaaagcccagcagagacuuuguucucugguuaagucuuaugaagagaaguuugaacaagcauagcaagcuuagaaaggaaaaauauaaaauauaugguucgaguauuaaaggaguaccaggaagugaaauggaacaaauuccuguguucuaggagauaacagauuaagggagugggaccuuggggcaagauccuacccagcuaaauuaaauccaggcauggugguaacacaccuuuaaucucaggagacaggcaagcuaaucucugcauucaaggucaaucgacagagcaagaaccaggauagccaagcuuaggcagugaaggauuuagaaaacauaaagccagugauaauguaauaguacaaagggaucguguucuaguuccuguaagcagcuucagccauguggcucuggcucuagaguuaagaauggaaggaacuacugggaaaauugaugcugguuagcuggagcuaaggaauuagcagugauuaagaagagcccagcaucacugaggugaauguggcaauucuggaaauuguuuucugggagcacgaagaagcuguguuccagagauacccaagguuguaccucaugcugcggcuggacuugguaauguguaagagucacucaggugguacugcuugugaaggaaugaagggaucauggagagaagcugaggcuuagcacugugagaggccagggaaggccauuggagaaggugaagccucagcuguaguugauggcccaggacugaaggggucaugcaaaggauuugaggcuuggcacccugaagagagccuauaaggggcuauuggugaagccuaguuggaguggaacaccccaguguauuggagaugucaguaccaugggaugaucaccaagaacagcagccguaguggaauggaucaaccugagcuuagagugcuacagagggcagagcuggaaaagugaugucaguccuuaggaggaguccaaaagaucaaguggaaucccagacaguaaaacaagaagauguaacauugaaauugcuuuggauacucaaagauguuaaagaugccagagccagggaauacaugcugaggaaggcugcuaacagggaguggaaccagcccaggagaaagcaguuuguuacagucaacaaagaugaaaaaggaguggagcucugaagaccacuuugacaucagccauggagaugcagaguuuggaguuugcccagcugguuuccugccuuucuuuggagauuacaguuaacuaaguugaaugaaucucagaagagaccuugaacuuuggacuuuuaacauuguugugacugcuauagacuaugaggacuuugaaaguuggacuaaaugcauuuugcauuaugcuauguuuaaguauggcccccauagacucauguuucugaacaagucuauggggaccagggaguggaaugugauggcuuguauauccuuggaccagggaguggcaccaucuagagguguggccuuguuggaauaggugugaccugguuggaauggaugugucacugugggugugggcauaagauccucacccuauuugccuggaagucagucuuccacuagcagccuuuggaugaagacauagaacucucagcuccuccugcgucaugccugccuggauacugccaugcucccuucuuugaugauaauggauugaaccucugaaccuguaagccagccccaacuaaauguuguuuuuuauaagacuugccuuggucauggugucuguucacagcaguaaaacccuaacuaauacagagacuauuuaugauaaugagguacaaaauaaacagggcacuccuagauggauuauucacaugcuaagaggaaucuaugggguggguccugacaagcaauggggaccucagcauccuagaagcacuugccuucauuggagaguguuauaaucuaaguacuuguccaccauaucgcccuccaucccaccaccagcucugucugauaaugaagcucccagagcccaguagggauucccagcuccccaacagcauuguaguuucuugggauugaugcuugccuaagugaccaugagguccccuggccaucucugggcuucuguucaggugugaugggaacacaucaucaugccaugggugacaguccaaagauacguagcuggcuacuaugcuggcacccaugaaaaaauggcuaaaacaaggaucuaugcagggaaacagcaugagccuggaauguccuauuguauaaaaaguaaagaaaauccaaaacacuacguagacugagcagcaaaccaacaaucacaggucagaauguacaacaggcccaaucucacguacaggacuagcaaaaaagaaucacgacccccaaggugcccaaacuuuucacaaacaaacauggagaaagacgagccuuacauaaguucugauagcaaaaggaugaaggagacaaacucugaguaaguccauguugacugcuaccggcaccaucuaccaacagacaacuagagcaaguauguaaaaaacagacaagggggcgauggcuacgcaugcuuuuaaucccagcacuuggcaggcguuugaaucucugaguucaaagccagaguaaguuuuaaggcagccagggcuacacagagaaaccuugucuugaaaagccuuagacauucaccguuuucauaagguaguggaggccagaacacagcuccuuaaucauguuauacacugucauagccagcuucacugggacuucucugaccaggcuucaccagcauuccccgaaucacaccgaggaaugcgugguugcuggcacuuaccuacaaacaauauagcggaugacauuggcauggcauaugaagaucucauagcuguccuccuccugccuggcaucagcucgguggauguaguuccugaaggcagcuucaauccgggcuccaucuucauaauacugcuaggagcagaguaaggaguugucaguguggaagcagacaaggguaagggcaggccuugcccuaauccaguggcacaagggauggcauuuuuaccacagccucuggcuuccagugagagacagguggauccgguucaaugggggcaccuucccguagcaagucugugcugacucuggagacaccuggaaaaaagcaggccccuguucagcaaggugucccaagagugaaucuacacaccccaaacagcagacaaccagcacucaccuggcaggugcuugcugaugaugucuguggucucuacugcacgggucauagaggaauggacaauuuuauuaaacuuuaaucccaggcuugcaagucggagccccgugaguucagccuguucccgaccuggaagcaaaaacaccugugaaugucauaaaccaggacccuccacuuacugcauaaacagugaagugcuaucaagcgucacucaagauguuauccucauagaccuaaccagggucagggcccuggggagcaaagaaacaaucgguuguccucaaccccaagagaaaauacaccagauucaguuagcaacgugaguaaacucgacagcaguggaauguaggccugcccuauccuauuuuuauucaacuauguugaaaaucaaguuccacucgggaauauaauauagcccacugauagaacugccuaacaugcaaaacccuggguuccauucccaauacugauaaagaaagaacaaaaucaagucucagcaucaugguagcccacugccucaugacaauagauacaacauaacaacaaagugaagaaaaaaaugaaaacugaacugggcuugguggugcagacagacuuguacucccaacacucaggaggcugaggcaggaggguugccaugaguucaaggccugccucaaacuacaaacugauucucaggggucacaaggagacagugauaguaaaugcuuuuuccuuaaaugugcuuuagcauauagcugaaaacauucuaagaaaucauuuuccuuuuguuuugaaaaugaguuuuuugcuggauacaguaaccuacaccacaguggagaccugauacccugcuuaugcccaggggucagaagccacagaacuccucagguuggagaaacaaucugcuagaggagaauccuggagacauugugaccauccaacucuuuuugaguauuauacaagugggaaauaugccaucuaucaauaaacuguuuaaaauggaacggcacaccacaaugcucaccuucccaccuacuugggaagcaaggcaggggaaucaggaacucagacuacauagugagagucuggcuguaucaccaccaugcugaaagguaggagggggagggggagcagagagaaggccuagaucccugguucagccuguaacuaacuucaagaccaaccaaugagucauaccuaauggugucagggugcgguccuucuccagggagccauccacaugguacugggaaugccggaugaggaagaugugccuuguggccuuggccuuauagugauccagccuggaugucaacucgucuucuccagauuccacauuccuuuucuucagguuaaugagugacaguggcucucgccuaauuguaaaaguaugucuuaucuuaugaccucuuguccaagacaccuuucagugcuugggaaaaggccugggggagaagcccaggccagagagccuagccucacagacucuucccgaaaaggcuaggcucgcucugguugauacauauauuauuccugcauauaacaugaagccucagguucauguuccuggugaagacaggcugggugaagagauggcucacagguuaaagugcuuguuauacaagcaggaagacuagaguccagaagccacauaaauacuggguagguauaauggcccacuuauaauugcagccucagaacguggagacgggaccccuagaagaagcugucuagucagacuacuuguguugcaaguucucgguuugacugagaggccaugccuuaaacaauaauccagaaguaugauugagaaacaauuuccauaacuaccccgggcuuucccacagaccuacacacaugugaucucacacacgugcacaugagacgggaaaaaaaaaaaaggagaaacccaaugaugccucaaauaagcaagcagugucaagagaugugagaguggauaguugcacugcagcggagccuagaacuguacugucugugugacuccaauagucuuggggcuguuucauucauuuacuacuucugcuggugauaagacaggcccucucaguguagcucaggcugacgucacaacaauucuacuucagccuuccaaguaugaggaguacaagcgagcauauacuaacaucccuaacguaaguuaaaaauacuaggcacaggaccuuggcugugcuuucucacaguacaagucuggacuccucacacucuggaaaagcugaggcggaaggaucacaaaaggccagguugaauaaguaagucuaacuauacuuaggucuuucguagcucaagauuccacacucaauauucaaucaaccgggcaucaaaaaauacucaaaaguuugcaucugaacuaaacagaccuuuuuguaugugauuuuuuuuuaaaaccucaagcuauauauuuuaacaacuacuuagguagcaauuuuauuguacugagugugauaaauaaucuaggaaugauuuaaaguauacaggaggauaagcuagaugccuagguuaucuguaaauacuucauuaucaugaacauccacagaguuugauauguucagggaucauggacccaaucccccaccauacagagggauuacuauaauuaauuuuaaaucaaauaaaaauagagcucuuuucuaagucacacuaaacacacuuuaaguguugagcagucacugggguaguggccaucacaauguugaggacuguaguuaguggaguggacguaggagccgaagaaacugaagcuacucaguuaaauguaggaggcaggaauaggacaagucagagcugcccaaauuaacacaaugguggaagaggaaggucuggaaaggguggugguggcggcucaagcaugaucugagcaggcuaaccugggguguuagucccauauacagaccaggccaaagucuugcugcagcuacagggccguguguggggcuggaccagacaaaauuuggagacgacugucagagaggaaggcauaccagaaagaaaccaaguggauaugccccuuuuagucccuuccggcacuuguugauccaucugucaugcauccuuccccaccuaacaaggccacuguaccaauccauccacguaagcagacacagcaagcaaauaugaaacauuuaaaaucaggucauuucuuuuuucuuucuuucuuuuuuuuuuuuuuuuuuuuuugagacaagguguuucuauauagcccagaauucagaguucugccugccucugacucccagugcugggauuaaagcugcaugccacucgcuauacaugccacuguacccggcuuccauggguaacccaacccuuggcucuacuucacgcacggguucucuggccucugaagggauagcaugcuugcagucccaaucuuccccaagcugcaggaggagaauuugugaggcaaaccuggcugucuaucaagacccugacucugaguaagacuuaauccuuuggaauuucaggcccacagaggauggugguccugggacaaagaccuggugcacugucucugaacaaggacucuucgaguaugggguccgggcgguuagaggucccucagagagacggguggcccaggcgcgaagaccuucgggaggugcgccauccaggcacugccaccgauucacacaaacucaagacccacuagcacgcagcguccccuucccuucagagcaccgaucuccgccaucccgggauggaggugaggaagcagggccgagcccaaaccucccguccccgcaccugucccaguuggugucccagacgccgcgcccggcucgcgcuccuguccaggccggcggcucggucgcgcgcgugucugcauccccgccaccucgcggcuucccuaccgcgaccgccgagaagagaacagcggccgagccaccggccagaccacaggccgccagcugaagcgccugccggaaagccaugccgcaaaucgcgcgaccugacggcgggacgccaggagcagacuuccgcuuccggcugguggaagucccgccccu

SEQ ID NO: 2594 - RNA, 15109 nt, Mus musculus
cuuccacuagcagccuuuggaugaagacauagaacucucagcuccuccugcgucaugccugccuggauacugccaugcucccucuuugaugauaauggacugaaccucugaaccuguaagccagccccaauuaaauguuguuuuuuauaagacuugccuuggucauggugucuguucacagcaguaaaacccuaacuaauacagaaguugguacuggaguggggguauugcugugauaggccugaccauucuuuuauuugaaagaauguggauuuugggacuuuguauuuggaaagcaauggaaugcuuuaaauggugcuuaaugggucauccuaguaggaauauggaagacuuaguugcugggaguaauuugaacuguguugaccuggcccaagagauuucacaggagaaugauuucagcauguggcauaaagacugguucuguggucuuuugguuaagaauguggcuacuuuuugcccuugucugaagucugccugaggcuaaggugaaaagacuuggauuaauuacauugacaaaagaaguuucaaaaaagcccagcagagacuuuguucucugguuaagucuuaugaagagaaguuugaacaagcauagcaagcuuagaaaggaaaaauauaaaauauaugguucgaguauuaaaggaguaccaggaagugaaauggaacaaauuccuguguucuaggagauaacagauuaagggagugggaccuuggggcaagauccuacccagcuaaauuaaauccaggcauggugguaacacaccuuuaaucucaggagacaggcaagcuaaucucugcauucaaggucaaucgacagagcaagaaccaggauagccaagcuuaggcagugaaggauuuagaaaacauaaagccagugauaauguaauaguacaaagggaucguguucuaguuccuguaagcagcuucagccauguggcucuggcucuagaguuaagaauggaaggaacuacugggaaaauugaugcugguuagcuggagcuaaggaauuagcagugauuaagaagagcccagcaucacugaggugaauguggcaauucuggaaauuguuuucugggagcacgaagaagcuguguuccagagauacccaagguuguaccucaugcugcggcuggacuugguaauguguaagagucacucaggugguacugcuugugaaggaaugaagggaucauggagagaagcugaggcuuagcacugugagaggccagggaaggccauuggagaaggugaagccucagcuguaguugauggcccaggacugaaggggucaugcaaaggauuugaggcuuggcacccugaagagagccuauaaggggcuauuggugaagccuaguuggaguggaacaccccaguguauuggagaugucaguaccaugggaugaucaccaagaacagcagccguaguggaauggaucaaccugagcuuagagugcuacagagggcagagcuggaaaagugaugucaguccuuaggaggaguccaaaagaucaaguggaaucccagacaguaaaacaagaagauguaacauugaaauugcuuuggauacucaaagauguuaaagaugccagagccagggaauacaugcugaggaaggcugcuaacagggaguggaaccagcccaggagaaagcaguuuguuacagucaacaaagaugaaaaaggaguggagcucugaagaccacuuugacaucagccauggagaugcagaguuuggaguuugcccagcugguuuccugccuuucuuuggagauuacaguuaacuaaguugaaugaaucucagaagagaccuugaacuuuggacuuuuaacauuguugugacugcuauagacuaugaggacuuugaaaguuggacuaaaugcauuuugcauuaugcuauguuuaaguauggcccccauagacucauguuucugaacaagucuauggggaccagggaguggaaugugauggcuuguauauccuuggaccagggaguggcaccaucuagagguguggccuuguuggaauaggugugaccugguuggaauggaugugucacugugggugugggcauaagauccucacccuauuugccuggaagucagucuuccacuagcagccuuuggaugaagacauagaacucucagcuccuccugcgucaugccugccuggauacugccaugcucccuucuuugaugauaauggauugaaccucugaaccuguaagccagccccaacuaaauguuguuuuuuauaagacuugccuuggucauggugucuguucacagcaguaaaacccuaacuaauacagagacuauuuaugauaaugagguacaaaauaaacagggcacuccuagauggauuauucacaugcuaagaggaaucuaugggguggguccugacaagcaauggggaccucagcauccuagaagcacuugccuucauuggagaguguuauaaucuaaguacuuguccaccauaucgcccuccaucccaccaccagcucugucugauaaugaagcucccagagcccaguagggauucccagcuccccaacagcauuguaguuucuugggauugaugcuugccuaagugaccaugagguccccuggccaucucugggcuucuguucaggugugaugggaacacaucaucaugccaugggugacaguccaaagauacguagcuggcuacuaugcuggcacccaugaaaaaauggcuaaaacaaggaucuaugcagggaaacagcaugagccuggaauguccuauuguauaaaaaguaaagaaaauccaaaacacuacguagacugagcagcaaaccaacaaucacaggucagaauguacaacaggcccaaucucacguacaggacuagcaaaaaagaaucacgacccccaaggugcccaaacuuuucacaaacaaacauggagaaagacgagccuuacauaaguucugauagcaaaaggaugaaggagacaaacucugaguaaguccauguugacugcuaccggcaccaucuaccaacagacaacuagagcaaguauguaaaaaacagacaagggggcgauggcuacgcaugcuuuuaaucccagcacuuggcaggcguuugaaucucugaguucaaagccagaguaaguuuuaaggcagccagggcuacacagagaaaccuugucuugaaaagccuuagacauucaccguuuucauaagguaguggaggccagaacacagcuccuuaaucauguuauacacugucauagccagcuucacugggacuucucugaccaggcuucaccagcauuccccgaaucacaccgaggaaugcgugguugcuggcacuuaccuacaaacaauauagcggaugacauuggcauggcauaugaagaucucauagcuguccuccuccugccuggcaucagcucgguggauguaguuccugaaggcagcuucaauccgggcuccaucuucauaauacugcuaggagcagaguaaggaguugucaguguggaagcagacaaggguaagggcaggccuugcccuaauccaguggcacaagggauggcauuuuuaccacagccucuggcuuccagugagagacagguggauccgguucaaugggggcaccuucccguagcaagucugugcugacucuggagacaccuggaaaaaagcaggccccuguucagcaaggugucccaagagugaaucuacacaccccaaacagcagacaaccagcacucaccuggcaggugcuugcugaugaugucuguggucucuacugcacgggucauagaggaauggacaauuuuauuaaacuuuaaucccaggcuugcaagucggagccccgugaguucagccuguucccgaccuggaagcaaaaacaccugugaaugucauaaaccaggacccuccacuuacugcauaaacagugaagugcuaucaagcgucacucaagauguuauccucauagaccuaaccagggucagggcccuggggagcaaagaaacaaucgguuguccucaaccccaagagaaaauacaccagauucaguuagcaacgugaguaaacucgacagcaguggaauguaggccugcccuauccuauuuuuauucaacuauguugaaaaucaaguuccacucgggaauauaauauagcccacugauagaacugccuaacaugcaaaacccuggguuccauucccaauacugauaaagaaagaacaaaaucaagucucagcaucaugguagcccacugccucaugacaauagauacaacauaacaacaaagugaagaaaaaaaugaaaacugaacugggcuugguggugcagacagacuuguacucccaacacucaggaggcugaggcaggaggguugccaugaguucaaggccugccucaaacuacaaacugauucucaggggucacaaggagacagugauaguaaaugcuuuuuccuuaaaugugcuuuagcauauagcugaaaacauucuaagaaaucauuuuccuuuuguuuugaaaaugaguuuuuugcuggauacaguaaccuacaccacaguggagaccugauacccugcuuaugcccaggggucagaagccacagaacuccucagguuggagaaacaaucugcuagaggagaauccuggagacauugugaccauccaacucuuuuugaguauuauacaagugggaaauaugccaucuaucaauaaacuguuuaaaauggaacggcacaccacaaugcucaccuucccaccuacuugggaagcaaggcaggggaaucaggaacucagacuacauagugagagucuggcuguaucaccaccaugcugaaagguaggagggggagggggagcagagagaaggccuagaucccugguucagccuguaacuaacuucaagaccaaccaaugagucauaccuaauggugucagggugcgguccuucuccagggagccauccacaugguacugggaaugccggaugaggaagaugugccuuguggccuuggccuuauagugauccagccuggaugucaacucgucuucuccagauuccacauuccuuuucuucagguuaaugagugacaguggcucucgccuaauuguaaaaguaugucuuaucuuaugaccucuuguccaagacaccuuucagugcuugggaaaaggccugggggagaagcccaggccagagagccuagccucacagacucuucccgaaaaggcuaggcucgcucugguugauacauauauuauuccugcauauaacaugaagccucagguucauguuccuggugaagacaggcugggugaagagauggcucacagguuaaagugcuuguuauacaagcaggaagacuagaguccagaagccacauaaauacuggguagguauaauggcccacuuauaauugcagccucagaacguggagacgggaccccuagaagaagcugucuagucagacuacuuguguugcaaguucucgguuugacugagaggccaugccuuaaacaauaauccagaaguaugauugagaaacaauuuccauaacuaccccgggcuuucccacagaccuacacacaugugaucucacacacgugcacaugagacgggaaaaaaaaaaaaggagaaacccaaugaugccucaaauaagcaagcagugucaagagaugugagaguggauaguugcacugcagcggagccuagaacuguacugucugugugacuccaauagucuuggggcuguuucauucauuuacuacuucugcuggugauaagacaggcccucucaguguagcucaggcugacgucacaacaauucuacuucagccuuccaaguaugaggaguacaagcgagcauauacuaacaucccuaacguaaguuaaaaauacuaggcacaggaccuuggcugugcuuucucacaguacaagucuggacuccucacacucuggaaaagcugaggcggaaggaucacaaaaggccagguugaauaaguaagucuaacuauacuuaggucuuucguagcucaagauuccacacucaauauucaaucaaccgggcaucaaaaaauacucaaaaguuugcaucugaacuaaacagaccuuuuuguaugugauuuuuuuuuaaaaccucaagcuauauauuuuaacaacuacuuagguagcaauuuuauuguacugagugugauaaauaaucuaggaaugauuuaaaguauacaggaggauaagcuagaugccuagguuaucuguaaauacuucauuaucaugaacauccacagaguuugauauguucagggaucauggacccaaucccccaccauacagagggauuacuauaauuaauuuuaaaucaaauaaaaauagagcucuuuucuaagucacacuaaacacacuuuaaguguugagcagucacugggguaguggccaucacaauguugaggacuguaguuaguggaguggacguaggagccgaagaaacugaagcuacucaguuaaauguaggaggcaggaauaggacaagucagagcugcccaaauuaacacaaugguggaagaggaaggucuggaaaggguggugguggcggcucaagcaugaucugagcaggcuaaccugggguguuagucccauauacagaccaggccaaagucuugcugcagcuacagggccguguguggggcuggaccagacaaaauuuggagacgacugucagagaggaaggcauaccagaaagaaaccaaguggauaugccccuuuuagucccuuccggcacuuguugauccaucugucaugcauccuuccccaccuaacaaggccacuguaccaauccauccacguaagcagacacagcaagcaaauaugaaacauuuaaaaucaggucauuucuuuuuucuuucuuucuuuuuuuuuuuuuuuuuuuuuugagacaagguguuucuauauagcccagaauucagaguucugccugccucugacucccagugcugggauuaaagcugcaugccacucgcuauacaugccacuguacccggcuuccauggguaacccaacccuuggcucuacuucacgcacggguucucuggccucugaagggauagcaugcuugcagucccaaucuuccccaagcugcaggaggagaauuugugaggcaaaccuggcugucuaucaagacccugacucugaguaagacuuaauccuuuggaauuucaggcccacagaggauggugguccugggacaaagaccuggugcacugucucugaacaaggacucuucgaguaugggguccgggcgguuagaggucccucagagagacggguggcccaggcgcgaagaccuucgggaggugcgccauccaggcacugccaccgauucacacaaacucaagacccacuagcacgcagcguccccuucccuucagagcaccgaucuccgccaucccgggauggaggugaggaagcagggccgagcccaaaccucccguccccgcaccugucccaguuggugucccagacgccgcgcccggcucgcgcuccuguccaggccggcggcucggucgcgcgcgugucugcauccccgccaccucgcggcuucccuaccgcgaccgccgagaagagaacagcggccgagccaccggccagaccacaggccgccagcugaagcgccugccggaaagccaugccgcaaaucgcgcgaccugacggcgggacgccaggagcagacuuccgcuuccggcugguggaagucccgccccuucccccccccccgacgaaucaggaaacgcggcccagggcgccaccugccgguggucgcaggguagcaggcgcagaugccugcccuuuaguggguggaaaucaggcacugggguuuauuuauuuauuuuauuuuauuuuuuugguuuuucgagacaggguuucucaguguagcccuggcuguccuggaacucacucuguagaccaggcuggccucgaacucagaaaucugccugcaggcacuggguuuauaugaauugaaaaaccucaaguuuggcacuucaauuugaaguuuuuauguuuucauuuguaaucuuuaaguguaugcauacucucaacuuucaccuccugaauucuuuccauuuuuuucccuaagaaccuucuucauucaacuaucaacccuccauuccccaccccuagucccuggcaccuaccaucgcgccuccaaguuuuaccgcucuaguugcuuuugaccaauugaccggguccuucuguguaggaaagguguccaccugcucuuccagggccauuguacccaaggccuagggacuagacuggcaggcccacggacuuacagcuccaggcuugggcuuuaacuaccaagcggcccagcacuuggcagcuguuauaauuuucaucuuugagcaacaaugaacagcagcaggcauuugguaauauuacugcuccugaaugaaccucuaaccucagacauucucagaacccuuggccuuccacaauggcuaaggcgguccuuuggcuagacagcucccuaaaagucuuagcaacaggaucuguuuuuuccacagccuucuuucaccucagcucucuauucucucuagccucagccuuuugguguuccuagcucagccuacccuacuauugauaaaaauaaauuaaauuuuuuuuacaaaaacccucuaaggccugacauaccaaaaaaaaaaaggauacagaggcuguauuucacacugacugaaacgugaguuucagucggcuuauauauaaagagaaaaggguguuauggcaagggucuuagccccaauccuggcaguccuucaugcacguuugaaucaaucgcagguuuucugcagagccaccaagggagagccucccccuggccuggaugagacgauugcaaggucaucagaguucacuaccaugcugucuugcucagugucgguggaggcugucuggacagaucaugacuggagcaagucuuccacggagguucugguggcccauaugacugcagaggugucugcccagugagccccaauaucuaaacuggcugccaggagggcaguguggcuaguuguccuuaagaggcugcuuuccugacaggaccucagccaggcaccagagcaggaccuguuagaugcuuuaaucuuucacaggaagcaucaauaggguguguguaacaaaaaucuguaacaaaauuacaguauaguucuuuuuuuuuuauuuuauuuuguuuuguuuuuuugagacaggguuucucuguguagcccuggcuguccuggaacucacuuuguagaccaggcuggccuugaacucagaaauccgccugccucugccucccgagugcugggaucaauggugugcgacaccacgcccagcuacagaauaguucuucuuuaacagugcuuccuuacugccucuuugucccacagggauguaggucucccugauuuguauucuagguaccuuaaauuauuuggacucccacagucuguccucuuggaacuagguguccuuuucugugucuuucuuucuuuuucuuuuuccuuccucugagaugggggucccaucauacuguguagacuuggaugccuuggggcaugcuguauagaccagacuggccucaaacucauagagauccaccugccucuguccccugagugaugggggaaaggcccuugccaccaagccuggcuuacguggcuauuuugagcauuaaauuuguaaacaaauaaauguguugcuucaucucaggaaacugcuucuguuucugcacuccucuuuaucacugcaaaguaagggaaaaggcguaauggacagaauaagcgggagguacaugcagaauugugacaccgugugacagugcaguuguaaggaccacuuuauggguuuauauauagauauugguagacuggguacacaggucauucgguagggagcuuguuuagcuuaugcaaagcccugaaucccauccucaguauugccuaaaucagguauaguggagcacaucuguaaucccaacaaaugagaagugaaaauaggagauucacaaguucaagggcauccuuggaguucaagacuagccuggaauacauaagacccugucucaaaaaagagagggugacuugggggagaauagagaggugguuaagagcacuggcugcucuuccagaggucucaaguuuauuuccagcaccagucugugacuccaguuccaggugauccaaaacccucuucuggccucuaagggcaguggacacacaugguauacagacauaaucucaagcagacauaaaacaaaaauaagugaaaucuuuuaaaaauaaaggaacuguuggccauaguaucuagagcuaaauaugagggaaagauuaucggcuuaccuaccagaacagcuccccguucauauaaccacuuguaaacacaaugauaaugucugaguggaggagacuagaaaaguacauucugacuuucucuauacguaguugugucaaccaauauguaggaaaugagcuaaaugaugugggcugggauaugccagaaauaugaauucacaccacuuuaaagcaaagaagacagacaugguaaagacaugcuuguaaguccaggacuuuagaggaagacgaagacgcaggauauggcugaccaugaugacauacuccuuuaaugcacauacucuugggucaaaggcagggggaucucugugaauucaaggccacccuaaucuacacagcaaauucuaggccgggcaggauugccuagugaaaacuuuacucaaaaaaauuaaaauuccaauguaagacuuuauaaaaauuccagguuacuguuaacuacacaaugaguucaaggccagccagguaguccugguuaccugauaccauggcucaaccaaccaaccaaccaaccaacaaacaccuguauauacuuuagugaccucaccauacuggccuaucacugacauuuugaggccacaugcuauggugguaaaguguacuaguguuuucaaacccaacaacgugaaaagaaaaaaaaaauagacaucagagacuacaccuggacaccugaauuugguuccgcauucgugaaaugcaaagaacagcauuguuauagcaucaagugcugcugacucacaaaggacuuggaaaauugcuagcaaagaaaucccucagcaaauguuaucauggcugaucucuagaacuggggguggggggucagggggugucuaacgaugggaguuuuacugcauuucccaggcuggcccugagcaccuaagcuccagcuauccuccuaccuccaugucccaagcaguuaggacugcagcugcuggucuccagaccuguguaugggauccagaucucuaucacaagcaggcaagguggacagacuagaaugugucaagcuagggcuauguuguaaauuguguaacugguaucaaucaugggcucgguuauuuucgucaguguccuaagcugagggccaguauaggaacaaugucuacacacccauauccacaccagcaucugaaugaccaacucuuaaaaaugauguagagagccggguggugguggcgcacaccuuuaaccccagcacuugggaggcagaggcaggcggauuucugaguucgaggccagccuggucuacagagugaguuccaggacagccagggcuaaacagagaaacccuguuuugaaaaaaaaugaugcaggggucuuccaacauaggaauaaacacaacaugguauagauacacuuuggaauguguagccuuaaaaaggaagggaauucugacaugcgaugauacggaugaaacuuuuuuuuucuuuuuuguagugacagauccuaugagguuuguaggcucacacucaagacaacagaggccagguggguguugggauggaaagaaggggaagaauggggagcugguguuuaauaggaacaguucuguuuuauaaugaaaaacaccuagaaauggaugcuggaaauguuuacaacgugccaugauugugcuuccugcuaccgaacuguauacuuacgugguaaguguuguugcacuuugguacaacaugaaagaauuuaaagacaucuggcuaugccuuuuucuccaagcaacagcaacugugcugagaaaccacacccauuacagacacagcugcaucaccauuuauugaccuuuuaucuccuuguucacagugacaacuaagauaaucucuuugcucacagugacaacuuagacuaacuccaccaagacucucugaagcacaugauucugacacccacacauuuccucccucuguaauuuuaaggcaucgugaaucacaucauauuagccagaugguguccuuaaugauggauucuguucucuccugcugguggauggaucuccccagaccccauccgcgguguaucugacaucacuuccccagagacgccagguaggcauaccagaacagagcugccauguuggcaaagagcacccggaacugccaagagaacaaucauuaaguccugagugggaauccugaccacaucccucacacauuagucacccgagauggaauuuaucccuucaauuauuugcuguuugaucuaccuccccacuacuggaugcccagagccuuuaguguguaacaagguuuguuagaguucagcagagguaggaguagaaaucacccucuccuaacgauguucuuugugacuugggaucagccuagcccaccaccaccccaguaccugcuccaaucauccagacuuaaccuaccugaaagcaccuucagucaggugcuaucucuucuaggcagacaguucugugacaauaacaaucuuucccuagcuugauaauuaugagccuuuggcacuggagcacaggguagugcuuaacaauacuugaugcauaacuuccuugucccucaagcacucuugugcaacuuucuaaaacuaaaaccuuaagccuaaccucauaccccugcuuugaagcgguuuucuagccuccccauuccucgacucaucaaucccucuguaucuuuccaggaugccuuuuagggucugucaucuuugucucccuaggacuccuggaguguagauuccaguacuaugagcaaaacagucccaggcccauaacuaagaggguucccuauuuaaccuuauuuaagaggguuuucuucuuaacacagaaauuuauuuucuuccaaauaccuaacuugcuucucugcucagaccgagaggagaaaggccaagcaguuuugaccauacauaucaacucucugaagucacagagaaagagcacccaccuaagcauaauucucuacuuacccaggaagccccauucucucacccuccuaagauggcucugggggacccucuuucuggaccugaauguccacccauuucagaggcagccauaucucuacguaacaauguuuuggguuugguugguugguugguugguugguugguuugguuuggugacaggguuucucuguguagcccuggcuguccuggaacucacucuguagaccaggcuggccuugaacucacagagcuccaccugccucugccucugccucccagcugcugagauuaaagguguacaccaucacacccagguuuauaacauaguuuuguaaccaugacauuauuuccugaccucaagaccucucuaucagccuggaauuccugguccuccugccucugccuccagagugauggauuacaggcaccagcaugcuugccuugagcugugaaguguaugcuucccacacacucuucaaguuagagcaaucuggcuuuggcuccuaauccaucccaauauggcucuuaggaaggccacugguaagguuacuucaaguuggacaucugcuugggguuuuuuggggagggggugaagguuaaauuccuucuauuucugcuaugguugaccagcccuuuguucuaucugaaaugcuuacuuguuuuuuccuacuuuguggucuaugugauacauguaugcauauacgaaugugggcggucuuggugugugcuuguuaaguaauauuuaugaagugaggcauauggauagguacuauauuguguaguauaaaaugaggccuauguauagaaugauguguauauguguucacucacucauucauucauucucucucucucccugacccccuguguguaugugugcacaauguggucuauguauagaguguagucuacguaguauguauguuuauaguauaaauguuguaugugugugcacacuggccaaguucccucuucuuuuaccccaugggaguccuaugcugacccuacucuguuccuccuucaguaggcccuuagucugugagcuuccuauagaaaagauguuuaacacagcacagaagaggauuaaguuccuggaacagacuaggauugcugccaaagacagaccuguuuagaagaauagcccugguuggaaacuuggcuaucaaugcucucaccuuuuuuuuuuuucuucaguguguacagaccuagcuccugggucuggaacuuggcagagguaccuacuaccaauuuuuggaagaacugugcugguuccccgggcagaaucaaacccagagccagaagaagaaugcccuuagagaaggaaaagucugcaucucggguggcccuucucccuuaggguucagcaggauccugccacccacuguguagacuuacugggacugugagcccuuccaguugcagggaggucuuagggaaacauaggggaugggccuggcacaaggacaguuguacauagcagccugaagcagugcacacaugauaguaucugcagaacaccuaaccaaugggcacugcccauucuccugugcucugcauauacaauacugauccaaugggcacugcccacucuccugcacucugcacuauacaaugcugauccaauggguacugcccauucuccugugcucugcacuguacaacgcugaaccaauagguacugccuacucuccugggcucuguacucuacaauacugauccaaugggcacugcccacucuucuacacucugcacuguacaacacugaaccaauagguacugcccacucuccugugcucugcacuguacaaagucaacagcuucacucauccuuc

SEQ ID NO: 2595 - RNA, 11905 nt, Mus musculus
acccauuacagacacagcugcaucaccauuuauugaccuuuuaucuccuuguucacagugacaacuaagauaaucucuuugcucacagugacaacuuagacuaacuccaccaagacucucugaagcacaugauucugacacccacacauuuccucccucuguaauuuuaaggcaucgugaaucacaucauauuagccagaugguguccuuaaugauggauucuguucucuccugcugguggauggaucuccccagaccccauccgcgguguaucugacaucacuuccccagagacgccagguaggcauaccagaacagagcugccauguuggcaaagagcacccggaacugccaagagaacaaucauuaaguccugagugggaauccugaccacaucccucacacauuagucacccgagauggaauuuaucccuucaauuauuugcuguuugaucuaccuccccacuacuggaugcccagagccuuuaguguguaacaagguuuguuagaguucagcagagguaggaguagaaaucacccucuccuaacgauguucuuugugacuugggaucagccuagcccaccaccaccccaguaccugcuccaaucauccagacuuaaccuaccugaaagcaccuucagucaggugcuaucucuucuaggcagacaguucugugacaauaacaaucuuucccuagcuugauaauuaugagccuuuggcacuggagcacaggguagugcuuaacaauacuugaugcauaacuuccuugucccucaagcacucuugugcaacuuucuaaaacuaaaaccuuaagccuaaccucauaccccugcuuugaagcgguuuucuagccuccccauuccucgacucaucaaucccucuguaucuuuccaggaugccuuuuagggucugucaucuuugucucccuaggacuccuggaguguagauuccaguacuaugagcaaaacagucccaggcccauaacuaagaggguucccuauuuaaccuuauuuaagaggguuuucuucuuaacacagaaauuuauuuucuuccaaauaccuaacuugcuucucugcucagaccgagaggagaaaggccaagcaguuuugaccauacauaucaacucucugaagucacagagaaagagcacccaccuaagcauaauucucuacuuacccaggaagccccauucucucacccuccuaagauggcucugggggacccucuuucuggaccugaauguccacccauuucagaggcagccauaucucuacguaacaauguuuuggguuugguugguugguugguugguugguugguuugguuuggugacaggguuucucuguguagcccuggcuguccuggaacucacucuguagaccaggcuggccuugaacucacagagcuccaccugccucugccucugccucccagcugcugagauuaaagguguacaccaucacacccagguuuauaacauaguuuuguaaccaugacauuauuuccugaccucaagaccucucuaucagccuggaauuccugguccuccugccucugccuccagagugauggauuacaggcaccagcaugcuugccuugagcugugaaguguaugcuucccacacacucuucaaguuagagcaaucuggcuuuggcuccuaauccaucccaauauggcucuuaggaaggccacugguaagguuacuucaaguuggacaucugcuugggguuuuuuggggagggggugaagguuaaauuccuucuauuucugcuaugguugaccagcccuuuguucuaucugaaaugcuuacuuguuuuuuccuacuuuguggucuaugugauacauguaugcauauacgaaugugggcggucuuggugugugcuuguuaaguaauauuuaugaagugaggcauauggauagguacuauauuguguaguauaaaaugaggccuauguauagaaugauguguauauguguucacucacucauucauucauucucucucucucccugacccccuguguguaugugugcacaauguggucuauguauagaguguagucuacguaguauguauguuuauaguauaaauguuguaugugugugcacacuggccaaguucccucuucuuuuaccccaugggaguccuaugcugacccuacucuguuccuccuucaguaggcccuuagucugugagcuuccuauagaaaagauguuuaacacagcacagaagaggauuaaguuccuggaacagacuaggauugcugccaaagacagaccuguuuagaagaauagcccugguuggaaacuuggcuaucaaugcucucaccuuuuuuuuuuuucuucaguguguacagaccuagcuccugggucuggaacuuggcagagguaccuacuaccaauuuuuggaagaacugugcugguuccccgggcagaaucaaacccagagccagaagaagaaugcccuuagagaaggaaaagucugcaucucggguggcccuucucccuuaggguucagcaggauccugccacccacuguguagacuuacugggacugugagcccuuccaguugcagggaggucuuagggaaacauaggggaugggccuggcacaaggacaguuguacauagcagccugaagcagugcacacaugauaguaucugcagaacaccuaaccaaugggcacugcccauucuccugugcucugcauauacaauacugauccaaugggcacugcccacucuccugcacucugcacuauacaaugcugauccaauggguacugcccauucuccugugcucugcacuguacaacgcugaaccaauagguacugccuacucuccugggcucuguacucuacaauacugauccaaugggcacugcccacucuucuacacucugcacuguacaacacugaaccaauagguacugcccacucuccugugcucugcacuguacaaagucaacagcuucacucauccuucagcaggcaguuuccucagcagcaucucugugccuauaagcauugcaguucucccgguuaccuccaaggggccuucucuuugaccagccagcccuuugaagacccugcuccaugccauggucuuuccuguucaccugcuccacugcauuugacuguuauaucugccuguucagcugaagcugaagcaacacagacuagaaaacacuaggaugaaacagcugcuugggagucucugugcaacuuuccagcucugaauccagagcucacggacagugaucagggaugguagaccagaccuccagagacgggugacaacguagcuugagaagacuaccaguuguuagaaaaaagugacaaaggccuucagugaagacaagcaagucucaccugcaggggcacauaguugauguuaaugaacugcaaagguguccacauccuccaguucauuugcagugcgggccagaagccacuccucaucuuggcaacaaagacacugacguuuuuccccugcagggaagggaagggaggcugugagcagucccuccacccauagcaacuguaguguggccccuccauccauagcaacuguaguguggcccuuccauccauagcaacuguagugugguacccugaccuugaugaauuguagaaccuguacuauauuugaaaacacaccugcacucacuacucugcagcuaaaaggagccaacuguccugguggaaaaucuucagugauaacagcucagggacacgcugccucccauacuggguggugucuguccccaucagcuccuuauagcuaucugaugaugauuugugcuguggcuuccuacaguaacugucaaagaugcuuacuuucccgucaaaacuuaucaguuuuuaagagaggacccccaaauaaaugcucucugaaagaaugaauguauuaagaguaaccacacugaaaauggauagaagcaccugcuuuuugccacaguuauuuuuuuaaaaacuguaaaauuauagaaauuaaaauaaucuacaaacaauaguaaaaaaaaaaaaaugaaacaaaaugaaaguaauacaaaaaccaaaucaacaugcaaugaaacugaaaauccagaaaaagaacugagucuaacuaauggccuguauuuaugaaagugagaagaugauaaaauuauuuugaaacacugaggauuacaguaagugggagacaauaagcgauauaaguggacaaauggaaacagaggucuacuuccccuguaaacaaauaugaaacucaaaagacagaagaggaaaguauaaauuacuuuucuuggacucuuaucaagacgcaucaaacaagagcuagaaugcugagagccaggccaacuagguuucccugaggcccugaaguauggagaaggaacacaguucuuucucuaaaacaaggaauaagccaaacagaaccaguaauggccgggggccagggccucugaggagcugcagauccugagaaaccaacucuucccaccuaaaggagcucugguuaucagucccaaggcugcuaugagcucuguucaugacacugucucacccccaccaaaaccucuauauaagaugcuguaauuuuaauaaacuuauuugcaugagccaucagcuuaugaaugaccuccugguccuaauuucccuaucuucuuuauuucacaaccccauaccucccacuucagacccuguuccugaagaauagccugcugguccaggucacugaagaugguccagugguaaaaaaagcacugacucucucccagagaaucccaguuugauucccagcaccuauauggaggcucacaacugucuauaacuccaguuccaaaggauccaaugcccucuucuaacauucaugggcaccaagcaagcugcugcccagacauacaugcagacuagaaaaaaaaaaaaagauguaccacacaaucacuagaaaguaguauuaagaauauuuauauuaucuuuccaucauaaaauccaaagagaaaaagaguaccagaguugauuaugaaguuuuagaauuucuguacggaaacacaggcauaugcgcacgcacacacauacaagcuuuuuuauacaaguuuacacauugccuuuacauagacagcuaacuuuauguaauaguuugaaacaccuaaaaaauggaaaacugauuugauacuuguacuugugaaaaggacuauuaaucuuaaucuauccaaauacacaagucagucuaagaaaaaaaauggcacagauaugcacaucuguaaucucaauauuugggaggcagaggcaggaagauugggaguguaaguccagccuggguuacacagcaaauucaaggccaaccuggguuacgugaaacccugucucaaaaauuauccuuccaggaaagaauaaaaagugaaaaccacuaauauaaagaagcaaaguucauggaacacacagcauuuggcauauaaaaauaucugaccuuacaaauaaagggauaaaaacaaacaagcaagccaagguauacucaccugauagcuacaaagucucggggaaggauuuuugcaacaucucaggcaacaucaagauuuuuacagcacagcugggcgugguggcgcacgccuuuaaucccagcacuugggauuucuaaguucgaggccagccuggucuacagagugaguuccaggacagccagggcuauacagagaaacccugucucgaaaaaccaaaaaaaaaaaaaauauauauauauauacauauauauauauauauauauuuuuuuuuuuuuuuuaacagcacaggucucuuuggcaaagccuauauacauccuuucucagaaucauguguuagugaacuuuuuauauuuuuauuuauuuagguuuuagguuuuagagacaggaucuugccugguacuccaggguaaccuugaacguuggcaauuuuccuuucucagccuccugaguauggcaaucacaggcacaagccaccaagcuuggcuuagaaccauauuaguauauaaacauacaaguuaaaaaaaaccuauaguaaaaguuauaacaguaucuggaagucagucgaugacagaguagcguauaugccuccuggagagcagaaguggugcugagaccuaagggcaguuccacgacacauacaacaaccacuacauggauuaugaggcucauaaucuuuacuaaggacagacagguuccauuaaaacuccugugcucauacuuacauggaaaacaugaaaaccgaaaguugagguaaaugguacuugcuguucagccugaugaccugaguucaaucccugaggcccacauaguggaaggaaagaaccaacucccacaggcuguccucuggucucuacauacauccugcagcccaugcacgucgacacacaaacacacagagaaaacagggaaacacgguuugcugaacaggacagcauuauuguacacaucgacucauaggcgcuaacacuccauguguaagacccaaacaaggccuggccaggaaagcccaguauggauaggggagagguuuggaaagucuuccccucagccaaggagcuccuggaaauguuucugggaaggaaagaguauuuuuuuaagggaugcaacccccaagagaccuauacccacgcacauacaugcagcacuaagugaacucaguagguuuaaaagugaacacaugaagguggguaaggaaaaguaagaguaaggaugggguggacacauuagauauacguacgagauccucaaguaacuguaaaaagaggaaaaaggaaggggacagaggaaggaagggaguggggagggggagaagaaaagaaaagagaaagcugagaguccagacccuagggcccuauugauagccacccuaggaagcaggcuaucaauccgccuuuaacuggagauacaguacaugccaggacaaacacccaccuccagcaaguucaugacgaagaagaacagcagcagaaaaguuggggcaaagaacaggcgauccagcaggagccucuugacgcuggcccagggaaccucaggagggaccgaguauuccaugaagagguagagguagugacucaguggaccugugacaaacaaccuggacgccacaggcgugugagcugcacaaggguuugagcaucacugugguucuuucuacauuuccaucucugguccucacaccaagauucaccuuaagcccuaagcccucuuuucuucccccaaaguauuuacugaccacacagauuuauaaagauauucuagggggagggaaaaaacuuuuuuuuuuuuuugaguuuuucgagacaggguaucucuguauagcucuggcugcccuggaacucacuuuguagaccaggcuggccucaaacucagaaaucugccugucucugcuucccgagugcugggauuaaaggcgugugccaccaugcccggcuaaaaacuuucagucaguuucagcaagucuuuuugcccaaaaagacugaagugacuucugccaguucuuccauuuggugagcagggacagccacaaugauggcccuggcugagguauaugcucaucugccuccucuguguuccaggcauuuaugccaucuguccucaucugugcccuccugauuuaacagguucugagaaacagacaaacauagcucagcucccagagauuucuaucaagcuuuaaaaaaaaaaaaaaaagauuuauuuauuuucuucauaugaguacacuguagcugucuaaagagggcaucagaucccauuauaagugguugugagccucuaugugguugcugggaauugaacucaggaccucuggaagagcaguccaugcucuuaaccacugagccaucucuccagcccuuucaucaagcuuuuaggggaaacuggcaagagaaaaccugguuaucaccucugacuucccuaaagcgcugaucucuaguccacacuugguucaccugggaaugagccaaguccagcagauugaguuucacaaaguacaguaauauagggaagggcaggaacccgggucuuucaauucuaccaaagucuauaaacaagguuuucaauugaacuuucuuuuggccacaguaaggcaaacaagggaagucuuugggaggccaagaucaggugagagguguuaaaguaccuuagcugaucuucuuacuugccaaaguaugggggauguggcuuuuuaaacauuuuaauaaauggcccaaguuauuauucuuggaagcuuuuguggaguuuggagugaaucucaguugguagaguacuucccaaguaugcaagaguacuuugcaaguaggcaaaacaaacaaacaauccuggguuucauucccaucauugaaaaaaaaaaaacccaaaaaacaaacaaacaaaaaacccacaaaaggccggguguggugguacacgccuuuaauuccagcacucgggaggcaggcggauuucugaguuugaggccagccuaguuuacaaagugaguuccaggacagucagggcuauacagauaugguggugcacaucuauaauccuagcacucaggaggcaaggggaucaacagaguccaaaggauauaugagguucggacucucuuuuauuuacacaugcaugcauaugcaugugggcacauacaugugcucgcacacauacacacacacacacacacccaggaauagucuuucugguuauuuauuuauuuacuuauuuauuuuggcuuaagacagggucucacuguguagcucugguugaccugaaacucaccacugagaccaggauggcuucccaaguacugagauuaaaggcaugcacuaccacacccaacuaaauaaugaugauacgugaggucagugguaaccuauacaaagccuuggguuuaauucuaaugccacacauccacacaaaguuugugucuuuguuuguuuuggagacaggguuuaucuguguuagcccuggcuguccuggaacucacucuguagaccaggcuggccucgaacucagaaauccgccugccucugccuccugagugcugggauuaaaggcgugcaccaccacgcccagcuucucugaugcuucuuaaacaauuauuuuuuucuuuuuuuuaauuaaauuuuuugcuuucuauuucuuguacauggauauuuugcuugcagguauaucucuguguaccauauaugugucuggggccuuacgaggucagaagucaucagaccuccuggaacuggaguuacagaagguuaugaacugcaugggagcugggaaucaaaccuggguccuccauaagagcagucagcacugcuagcuuagccauccuccagccucagaauuagguuuuuuaaaccaacauauuccgaagggcuaaugcuggcaggcagaucucugugguacuuacccauaaacuaaauaucugagaagcccacugacuucuagauuuugagagucuuuuuuccgcuucucaaucgucugggccagaagguuuccaagggcugacaaaaugccgcuguagaggaagagacaaucagaaaaugagcagcagacacaagagccugucccgcauggcaguagcacggcugcuguaagaucuuccuguguagagccgggugugguggugcacaccuuuaaucccagcacucaggaggcagaggcaggcggauuucugaguuagaagccagccuugucuacagagugaguuccaagacagccagagccauacagagaaacccugucucgaaaaacaaaaacaaaaaacaaccaccaacaacaaaaaaagaucuugcuguguagaucaugggaugagucccuauugaaguaacuugcuaaguuagguaaagccccagaagauagaggcacuaugaccuaaagugaaaaccacagaugagcacagugagacauccaccugcggggcugugugccuuccaacauccccacagcugcuccauugaaggcauggauguaaaaggcaauaggagggauccucacaaggacauggucugugggcuguauuuaagcaaauaacucuauguuguaguuuuguuuuguuuuguuuuguuuguuuguuuguguuuuuuuuguuuuuuuguuuuguuuuugagacaggguuuuucuguauaccccuggcuguccuggaacucacuuuguagaccaggcuagccucgaacucaaaaaucugccugccucugccucccgagugcugggauuaaaggcuugugccaccacgccuggcucuuaguuucuuuuuauguugcaaaaugaacaaaaaccaaaccaaacaaaaaaugagacaaaggcaacuuaagagaacaauggcuuauuucagcucccaguuaaagguucaaguccaucaaggcagagaagugaaggcaacaggagguugaaggaucuccucacagcacacccacaaugaaaagagagagaaaacgcgugcgguucagcuagcucacuuuuuccacuuccagucagacaccaacuaggaaugguggcgccccuagugggcagaucuucccagcucaaagaagauaaucaagauaagccccucaggcaugcuuaauuccuaaauguuaucaaguugacaacuagcuuuaaccaccacagcugucuucuaaaaagcuauaaauccaaaacuuuuaguauggaucauaaggacccucuugacuugaccccugguuaccucuuccuaucuacucucccuggucauuuucuccaccagaguccuucucuucaccccuccgacauucucugaauucuucccccagaacuuuuacacuuacugugcccuguaaacaaccgcuucucuucucugugcuucugaccaacgucaacaacccaggagaaauuucccuaacugcucuaaguuauacauuuaucugccuuuugcggggguggggugggguggggugggaagauggacucguucuucuuagcuccgagagaagucuaugcgccuguucugaucacagcuaugugcccgcgcacaggaagcacucugcacacacuuauggaaaagcuaaguuaauacagaaccuacaaaaugcacuaauggaaaugaacagaaacagggauaucucguuaggaaaccgaacgauguaauucaaagggcagaguucaccagcgaccgugccuggguugcucaggguuagaaugugucccugacucgcgggucuucacaacacucagacugcaaaggcuaacuaaugcuugggacccaacacacaaacagcacuuacuggcuaagcagaacggggucgcaccuuaaggaagaacucugccuuccuccacagcagugguucucaaccuucuuaucgcugugacccuuuaauaauacaguuagcuccucaugguguggucaccccaaccauaaaauuacuuucacugcuacuucuaaacuguaaugcugcuacuguugugaaucauaacguaaauaucugauauacaggauaucugauacgugacccccuguacaaaggucguucaaccuuuaagggguucccgacguacaggcugagauccacugcugcucgggcaauaucugagcugcuuggucugcagacgcccccucucuuaaccuccccugcaggagagucuccccugucggcaccccuccuuuucaccccacuucccaguaggcgcccaccugcugacugcuuuggugagcaccggguagagcuuuaggagcagcaaguauugggcgagcgcucgcuugggaagcgacccgagcucggauuccacccgcagccuggacgccgcaggugccaucgcgguccggaugucuaagucgccccgggcgcccacccaacagcuaggcagucgggcacccggcccgggacacagggcacagggcggggacggccugacauuuucugcccuuccuccgcccucagcgagcccggccgucccgccacgcgcgcggccagcuagugcacucuuuucccccgg

SEQ ID NO: 2596 - RNA, 2002 nt, Mus musculus
ugaggcagaaccugacaaaacucauggaaaagagggaggagagagaguucuguaagcacuggcaaugccagacaugucgagagagcaagacaccccgagagcugggacagcucaggcccauuggguguuggggcagucguuucaggugaucacagagagcuggcagugcccacuuucugcacagaauggaauucagcauuagaagagaaaugcugguauuuacuugcucacucuaagaccaacacaccacaaggggaagaaaagcaggcaguggcaggucagggggggauuccagugcagaguugugaacaggcaaggucugggagcuagcaggugaauuuagugaugcacagugccugugggugaauggagacugcauccaagagccacgugagggaagggcugugauaguugugaaguggagauacagcugaucaccuugugcuagaguaguacccaggagagaggccaagacagcaguccuuguucuccauggcauccuugcagacggccaaaaggggaagcacuggaaagcaggaagaugaagcuggaagacaaggacaagacguccuuaggcaccauggcucaaaggucuagauaggagcaguucuaguuagaguugggauuaggaaauagacuucacugagggggaaaaaggaaauguggccgucgggauaauggcauaguguuagugucaacuuuuccuauaagcugauguagaagugaauucacccuggcaggaucacagguauccagucaaguugugccuaugggaaaauugucaccaacacaagagguucuauuuugugagcuggauucugacuguguacuuuggacuggccuuaauccucaccaccagagacucucuuagcauccugaguauugagccacagguucaaggcaccgcucccagcuaaagaagaaauuguuaaaggaccagaagaagcuggucacugggaauuagcccuaaauggaaggggagguggauugaaguucccucuaaaagaguaaaugagaaucacaguucccagucacccuagugagcuagacguacuccauggagcacuggucuuacaaugugagagucuaggaaacucaaacugaagggcuccugccucccaugucuuguuacuauauguugcugccauaguggaaauaggaguuguccuuguguuguagcaagacucccaggcaagagaggaaacugaugaagaggaggaggacaaggaaaaggacgaggaggaagagggcaugggagaguccgagguugaggacuuacuggagaacaacuggaacauucuacaguucuugccccaggcagccucuugccagagcuacuuccucaugauuguuucaggugagccaagcuggagcugaacagccaagccaagcugagucguucguugagcgugguucuggcuccuugguguggagaggacaauggcaagcucagcggagcugcugcugucuuccccagaggaccgucugagggagucccaaagcugcuuucccuguucuguuucuaauagguucacgacuaacaucccugggaacaugugcaugcucauacaguaaugagacuggccucuggggcuucacuaacuaggaaacucacgccuugaaaguauuuguagaccugguuauuguggucgguaugcacauaagcauaaaaauuagacuuuuagaauuuggugccauucauuacaacagggaaacaggugaugagcaaagucaugaaacugucaacggacagacagggcuucuuaccucacagacagacaggcagacagggcuucuuacucaccucacagacagacagacagacagacaggacgucuuacucaccucacaggucuguaccaacaggagguuucauuugugauugcuuacaucuuugucuacaucuuuugagucuuuaccuuuccaaguugucucaagaaauauuccagguuagcugagcaguggugugcaugccuuuaaucccagcgcuugggaggcaaac

SEQ ID NO: 2597 - RNA, 2001 nt, Mus musculus
guccuuguaaaccaggaguuuuuauuuacgugcaguaacucagcagcaauccugugauuuuuuucccccagaugcuucaugugugggacucauggaauucacauuaacagcaagcgacagagagcucuaauuccuacagauuuucagaacccaaauaagggaacagucuggaugugagcaaagcacuuucuggucucugaaguccaguuuggguucuguaucacacaagaucuuguucauucacuacaagacagcaaagagagagagagagagagagagagagagagagagagagagagagagagagagagagaaucauaugagcuucauucuaugcauuauccacagcaccguuguccagggcccagacacuguucccugaggugugucaggaugucuaaaguagucaccaagcuaaagcacacccaauagguuggacucuccugacaggggccauauucuuaaccuuaugagcuauagaccccccccugaacaccauaguuugucuaacaacaaacuauguacugaacagcacacagccuccaugguguacauagcccacgcacacaauuaggcugcucacucccacaagccccuguucuccauagcucuuguucugugagguuuuguccucuggauccacuaagggccaguagaaaguaaaggaggugggaaggagagaagcuaggagacccuuucugccugguaguuguaaugguaccuuuacuugguagauaccacagacacagacaugccacacacacacacacacacacacacagaccauccacacaugcauacccacacacacacaucagagagaaacagagacagagcuaugagagagagacagagauagagacugagaaagacagaacagacauguauauauaacauguacauauaacauacaugugcagauauagacacacacucuuauaggcuugaagacuaguuuugcuccagcuccuauuaguuucaacaccagcuuccugacuuggcagguuucuggccccuccaagugagaucaacaggccuuuaccauuguguccuauacuuucauacccagagggcucagugccugguccaggaacuccggacccgcaagucagcuccauggagacaaauggacucuaacuacagggagccacugugcccucuguuggugggauuugguuucacacauaacccucaccccaccccuauggcagcuucaguagguggagguuggggugggcuacucacgacuggcaggcagagagccaggagcccggugcgcuuugugcagugggaagaagggcuguucucgcucagugggaggcagcacaggucccagcauucaaggugguguuggcauauggcuccuucgggcuggagagagauggucagauaucauuuagccccagugaaagucuuucuuccccuccucucaccagggaccuugccccauggguccauggguccuuguuccgugcucaccuugcgccaagauauacacugcaugaagauggucuuugaugagcagaaccugucuggguugcugcuaguccugaugcaacaguugcuguggcauucuguguuuucuucacagaggaacccauuuggcugugagggaacaggggaaccgcgcucucugcugccagggacucccagucccucuaaccaccccgagaacucccuucucucucccuccccaggggcccauuuccucuagcucauccaagagcagguagaaguggggcuagaagguguccccugccgguuucuuucccucccuagauguugcccagggcuccagucaccuuccuccagggcacacauuccaaaaacacggucugggaggugcagaauuucuguggguucaagcuguuggugacacagcagucgcucugacacucagaauuguuucgacacaucucuccgauccccugaaacacccggguuuuguucaccugcuuuaaggcagcagcagacccaggucccagggggcuucuccgguca

SEQ ID NO: 2598 - RNA, 1961 nt, Mus musculus
aacugguaagcaaggauaccuuuuauuucuguugaaaacuucaaaaaucgggucucagucguuguucuuggaguggaaaaggguugaccuagagugaaacuccccacaagcugggagugggguggucucaggaggaggugucuaaaagagaacaguuagcaggaaugaggagcugccuugguucugcgucuuuccaacaggguucuuuagcuaguuagaugcuagcucugaguaguuuuguaauaaaaucuggaaugggaagaagagggaaggcuggcagguaggcuggcagguguguugguccccguguuguuaagugaaagagcacacuuguggaugauaggccacguucccagaugccccaagggacgucuuggcagagagccuguggccaucucaggagccagaaaaugugcacuugagguccuguccaggggcauucuucagucgugucugcuuccuuucagggccucugcugcccagauguaggcauggcucaaugucacuuuucacucagugcccaaugcccaagcugugacaccucccuucucuucaugucaaauguucucacuggaggaauugcugagacuucgugcccagcuccagggcaucccaacuggggaaguugcugaggaaacucacgguuuugucuaguuuuguacuuccuaucggcgguccccaaguccuuggacuaguguaggcaggucucuaaggaaagacuacuugagacuggaggguuugguuuucagggcgcuaccuaauuuugcauggggaccagagugaaacugggcuugagggcuugcagguggacgaugacguacgcgcugccucuaggacuucagcacagugagcccccagcaccaaccuaccuacucucucucacgugcuuccacucaguuugccccaagcuacuguaggugcauagacccaucaccuccuacgggaagggcggaaggggaggcgcugaucgccacaaacucgcuguagguggcugggcaguacuuguaggcgagcacuaauugccuaguaggcguggucaacaaggcgaggcaugaaguaggagggaucugaccaugacuaggcucagcgaccugcacaggugagcaggaccggaaggcaagggcggggcuuaaggaacugagaaagcguagacaagagagguggagccgggaagaauggggcgugaucugacagggucggggggucggaauucuaaagagcugugcgcaaacggguguggccuguugcaggggcggagcaaagggaaagcuuccccccuuucgggggcggggcuuaacgugaaagggcgagggcccgcucagcgcagagccauuuaguccggaagggcggggucagggcggggccaggguggggcggagucgacgggucagccucccccagcugcgcccgcuuccucuggcacuccggcccggcggaagugcgucaguuguuauccgcucuggucgcugccacuacugugucugccucacggucccggugcucagaagcuccgccacccgccgccuucugccgcugcccgccggucgccaugggccgugucccuggggaccuggucuagggucgccgagagaccgccgcacuccgaugcgcgggacccgggguccuagcccgcgcggcguccggugcugagagcccgcgcccggcaugcccgccccggucccgagcccgccccggccccgagcccgcgcggcgcccucgcagcccggcggcacggcguagcaggcggugcggggcgccaaggucaccgccgcggcgccgccauggaggccaagguccggccaagccggcguucgcgcgcgcagcgagaucgcggccggcgucgggaagccgcccgggacgcccgcgcccagagcccgucgucgggugaggagccagagcccaguccuggcaaggagaacgcgggacuccacggcgcgccgccucagcgcccuacgccucug

SEQ ID NO: 2599 - RNA, 26181 nt, Mus musculus
caucgucccgccuccacgcagugcggcugcgccggcaccucgggcuccgaggcccgggugccgcggaucuuuuguuucccugcggggcuccgagccgcaucgucagucaggcccggacuuggagcuggagugugucagagcugagucccgagucggaccgggucccgacugucagcgccgggaggguaccgaggaggacgccgagggagcgcgccccuccguccgccggccugugggacugggacccggcucaggccugcccgauggggcacggggcccuggcgaugagcccgcgccuccguccccgcguacgcggcccgccggccuccgccugagcccagcgcaccccguagcgccgccccggggcccgagcccgggcucgcgcccccggcccgcgcgcgcuauggagccgggccgcggcggcgucgagaccgugggcaaguucgaguucucucgcaaggaccugauuggacacggcgccuucgcgguggucuucaagggucgacaccgcgaggugggugaggcucccgcggaggccucgcaaucccggacucccagcccaagggacaccuuaccuccgguaauccguagagggacccaauuaaggaccccccagcccgggaaacccaccugcuacucuagcuccagaaaacuggagacgccagccagcacaggauucccuaccuagccccgaagucagaccaguucugagaaccuaaccugggacuccauccugggacuuaaauuccaggccggcugacagacacucacuaucugucugccucuggcagccucccauuccaagacccuugggacagccacccuaagccaucucuguguucccugcuugguggggagcaggaggggggguuguuuucaacccugaagguucacguuuggcuuuucagaagcacgaccuggagguggccgucaaaugcauuaacaagaagaaccuugccaagucccaaacacugcugggaaaggaaaucaaaauccugaaggugagccagcgccucgggggagggggagagggugggucagcucuuuucuugcucaugagaaacuuggauuuguguccuaggaacuaaagcacgaaaacaucguggcgcuguaugacuuccagguaaggcucagcguugggcuugggggagggguaaaucuauucuugcccuugucccauccacuguugcuucaggaccuagguugccuggggcuggagccccccugagggcagaugauggcuuuagauuaguauuugguuuaggugaaaggagcuggguucugaaugccuugucucacgcuuguccuacugugaggccacuuagggccagggagaccucaucucugguccaaguuuuuccuggcuuuuccuagguucuggggaccucucuagcuuauauguugccugcaugggaaggaaggcggccaucaacacuaauguugaaucucuggcgauugccugguuuacauuguuuggguucagcguacccuggugccaaagacccuuucuucacugugaugucugacccaguggcccuuacugagaaugggguuccgggcaggcccaccugucugggcuggcggguuuguuuguugacauugcuucagcggccuggcauuggccagcccacuccugcgucagaggcuggaagggggagggguugcuggagauuccuucuagccggcaguuggggcugggcccacucauccggccggcgggagguugcuaccgccaccucagaauuggcugccugaaugagcaagccagcugaccagccagcuucugugcugcccuccaagccccccagcccagugguggcaggggcuggaggcccuggaugcgcucguguggggaccgggaacccuagguacugguccccagcaaagugcugacuaaugauuuugaaaccuguuuacuggggccacgggaccagcccuggcugagggaaguucccagcaggcagcuagcuguguuuugguggccuccuccccuuccuuccuccccugcuccucuuccaacuuuaccuugagggcugugacuugucaugaggugacaugugggccgggccaaaguccugugugacagggaguaccuggcaacagcuggaaacaugguguucuggguuuuagagguugcccccucugcagccugccuuuccuacccuuccccacugcugcuuucucucccuguccccagugcuguaggaagggccccaacggcacacacaguaugugcuucuuaaaggacccagggcugaguuagauggcaugaccuuccuagggucagauucugggccccuuugcaccuugagauccccuccagauccacaguccccugccagggcauucccauaaaggccucacuggaacugaacggauaacaguuagguucacugcagacuugcggccugucccccucagguuuccacuuguucugcuugcuucaucuagcugagacaccugauuaaggacaucuguuguuucccccaguuuuggucaugcuguggcuuccuuugccaagucccugcccucucccuaggaugcaggguccuucaccucaugacacagggguugcugcuuugauauuuguuuaagauacauacuuugggcagagaaaaaaagaugauuuggccgagaauucucucucucuccaauagcagaagacggauaaaaauaaaaauuaaaaacauuguugggcuggagagauggcccagcaguuaagaagagcgcugacugcucuuccagaggucgugaguucaauucucaacaauaacaggguggcucacaaccaucuguaaugggaucugaugcacagcugcaguguacucaaaaaauaaaucuuuuaaaaaauacauuguccagucccugugccagcggaggcuugcuguccugucuccucuuaggcauccccacaguuuuugguuucucccuggaaauguguuccuuuauugccauagcaaccccauacuguccuccauggucucuuagggaaggcaagaagcuucaguuucuugucacacacugaugucucaccugcucugaagaaucacacuugguuccuuauuggaaugauagcucacaggcucaguguucagaguggacuauggugcaguucucaccuagguuggaccacacaggcugugccauugcuuccggugucaggccaggguuagggcauugggagcacagaugguauuugcucuugucucuguugcuguggugguuauuuaaggucauguggugccuagacuugccugucugugugguucauuuuacuaaccuaacccuccugagggauacaagcuauucugggauucuggcaagucaaaauguggucaugacuguccuugggcucuuuggcuaggauugauauguagauggauuccuagaaguuggagcccugggcaagagguguguauacuguagucugagggacuguugucagauugccccccagagaggaaaugccaaugguuaucuggcaauuguccaucucuuaaagcaguauuggcucagaacuuauccuuucaauaaaauaaugguuuugcuguuuuuguuuuguuguuuuguuuguuuguuuuugagacagggugguuuuguguagcccuggcuguccuggaacuaguucuguagaccuugccucaaacucugugagcaauucaccugccucugcuaggauuuacagugugcaccacccauugggcagcaagcauuccuuuuuucuuuuaaauuuauuuacuaccacaucacaccucuuuuccuagucccacccuuaccgauuccuucuccccuccccccuugccuucuccugagagaaggagaagccacccaaccccgagacagccauccagucccugugcauccucuugggacgaggccgaaccaggcaguccaguuaugggaaggacucccccuccaauuguuaggggacccaguacauguguuaggaguguguaggggcucuuuuguuauaggugugaguauguggcacaugugugcugugccugcauaggccaggagaggaugcuccaucucuuguaacuggaguuauaggcaguugugaguuguuugaggaggaugcuggguuaucuucauugguguuuugccugaauguaugucuggaugacagaagcccuagaacuggagcuacugacaggugugaggugucauugguugcugggaauugaauccagguccucuggaagagcagccagugcuuuugauuuuuuaauacaggguuucucuguguaacaguccugggaguccuggaacucacuuuguagaccaggcuggcacugaacucacaggguccccaccugccucugccuccugcaugcugggauuaaaggugggggccaucacaccuggucacaacagccagcauucuuaacucgugagaucucauggccauggccaucgucuggaguagugagugguaaacaaauuuacuuugucucccauguuggaagcauuguccagugacuccggauggucucaggugaaacugguggcaagcugccuauccaugucuguguguuuaccuggaaaagaacagagucuguggugacaaccugaguucucacagcugugcccacuugguccuauuuaugcaaauuuuucugauaauguaugggcucuuuauaaaagaaaaguucuuuguuuuagguuacacauaggucuguccucccccuuguuugcuugcuuguuuguuugagacaaggauuaacucuaguaucaggguagccugguacucauuguauaucuagucugcucucaaacaccugccagaaggagguuaagggaggagaaguuuauuuuggcuacagcuucuaguucaccauaccaagaaagguggaguggaguucauggcagugggaacaugauuauucucauggugccuggucagggaugcagggaugccuugcauaaaaccuccagccauucuucuaggcuucacauugccaccagcuggggccaaguauucaaacaugagccugugcaggcauuuuauauucaaaccauaacccuggccagguguagggugcagucuuauuucggaaccuggaagagagaagcagacagaucucugaguuccaggccagccucgucuacauagugaguuccaggcuacacaguaagacccugucucaaaaaaacaaagcaaaccaaaccacaauaccagcuccucuuuguucuugauagcacugguaguugaacuuuaggccaauagcuugcuuaacucacacuccaacucccugcauucuaaguuuggggaggaaacuggaacauguggccuucaucaggaagggacugggugggcucucuccucgucuagcauucagugucuggaccuguuucuucuuuggaaggguggccacugccagaaucaguaucaggcuguagaugugguucccccaguccucgccugcuugccagccuuaacugcagcugaugacucccuggaggcuaguacgcugucuguccgguucucugaagcccgacgccuugccagguugcccagaggugacucacuuggaccuugcagacagauagaaccagcucucuugaguucuucugucuagguuagaagaggccugagauggggguuuggauguaguuuccccacuuacauacaguggagauagugcuuaucaucuggacccaguuagagaugaauaggccaggauucagauaagugugaagucuguacaucugcaaaauugaaugugcauuuuucucuuuuuccuuuuguuggggggguggggcuggggggggggcggagacuaguguaucgcugacaauggccuggagaucuguguaaacugggcccugaauucauagaguucuguuugccucugccuucccaggugcugggaucaaaggcauguacuaccacacccaccagcaaccacacccagcuccugcuuugucauuugaaucagggucuccuguagcccuaggcuagccuuaaacuccuugacuuucugauguccuuccuuuaccuugggauggaaggcccacacccauccacccauccagcuuuuagguuuugguacuucugguauuggauuugcuauucuccugccucaucucacuagaugcugggauuacagaugugcagcgcuaugccuacuuguuuuuuaauuacuuuauuuucuuucuuucuuccuuucuuuuuuucuuucuuucuuucuuucuuucuuucuuucuuucuuucuuucuuucuuucaugguuuuucgagacaggguuucucuguguagcccuggcuguccugggacucacucuguagaccaggcuggccucgaacucagaaauccgccugccucugccucccaagugcugggauuaaaggcaugagcaaccacgccuggcucauuuaugucuuuuuagacaggguuuucucuguguaacagccccggcuguucucgaauaggcuuuauaccucaggcuguucucgaacucacagaucugccucccuugacuacugagucaaucugcugguguuaaagacaugcacuaccucugccccaucuuuuuauuuaaaacuuuuuuuuuuaaguguuuauguauguuacaggguggagcacacacauaucacuugugugguggucagaggacagcuuagugaaauugauucuuuccuuuaaccaugugggauucuggggacucuaaauucagguugucagguugguggguagguagcuuuacccacagggccaucuuuauuuuugaacuuuaaaagguguguuuguguguguguuucccugcauauauauuagugcaccacgugugugaugugccuacuaaagcuuuaagaggggguuggauccccuggaguuggaauuacagcugguuugggccauugugugguuauugugaaucaaacccagguccucuuguaagagcaaauucugauaagugaugugcuauccucuccagcuccuuaacuccuucuccacuuuuaucuuuuucaagucugaaaugguggaaugauguugaaccauuguauugaucagaugggucccuugaucaaacucagguuacaccugcugacagauucaagguuuaaauuguagauaacauaaaaauacacaggguguaaagccuguggcugugugggauagauagccaugauuuagaggcuuccugccuuccacugccugcccuguguggcucugcucuccugccuggguagcuugcauacuuccuacaaggagauugacuuucuguugaggugagcuaguucugccuucaagugggaacuaagagucauuuuucuggcuguacugugugugauaggugagauguuugucugugguggucagaauugcaguagauaagaguucaggaguaugguccuagggaggaacuauggagaauuauauucauugcuaagggucuacucuguguuccccugcucucuuuaugguuaucuggggucugaugacuacucacaaugcagaaguugaugcauggcaguaggcuuggagaccuaccuggcuagauuaauggaugccuccuccaagaggcuagcauugcugaagcccaagggauggaguggaccuuccuuacacauaugcucucacugccucccagccccauccuagugcuacaagcuggcauuccucugucagcuguccagaagggcccagauuugcuguggcuagagccuuggcaccuucugcaguccagaagccuggcuccucaugaguuaagugggucagugccugacacccgccugccagauccagccugagaucaccagaccagaguggagcaggcagaggguggagagcugggauccuauuaagcaaaauaucucagugucuggggcggggcagccuccuacgugcccagaugcccgucagcuucccaggaugcuggacucuugggccagcagugauugucugugguuaguaagccuagcuccuacagaagugcugauucuauucugucuuaguuuucuuuuucccuugcacaaggguagcucagcaaaaggaugugugccuccaagaccugcuuuacuuugcuaccagcuguaacuagcccacuggccacccugugucaccuucccuugaaaggcugggcgaugggaccuggcugccagaguggcauuauuaggagcccagggcauuccccaucauggucaagacugucugccacccugugaugaugggaaagcugccccugagaaggaagggcugcuaucugcucagaguucuggaguguguccuagaaauguagcguuagcccgugaaguucuugggagucuggugggggcccuuagaauuuguagaaaccaauugaacagagcagggcagaggcuggagaagugguccugguugagcucaggguggguugagcucaggguggguuggcacaggauagcucugagcacugugguuauguucuggucucuugucugcuacuccaaguuaauaauggaggggacaggucgccaugcgcaauuucccuggaaaagcucucccuuggaggccuuucuugcuuuguggguuuaccuccacuccuuguucccuauaggcuggagacugccuggcccagcuuuggaagacaggcaguaaaguuccaaguuguuccggacuggcuggguguuggcuuaggcagggagauggaggauggcaugaaggcagccugucuggacgagcccagcugcacagagcugcacagagcugggcauguuucuugggccuuggcuugcucaccugugaaacuggcuggagaacauccugugacuggucuacuguggggcugguggaaaucaagcaggagagcguagaggcaggcccaggaggcuugcccagguggugcugccaggggaggacugaggccacugcucagccuggugcuagcacuuguucucucuguacaguaggucagcugacuguugggaauugugaaccuuacucuauccugaggucagcucugccucuagugugucaggacaggcuuaggggugcuggcugcuaccaguagaguagcccuugguuaggaauccuggcuucagagcucaaaagaaggucuuuugucuguccuugucacugucccuguuuguccugaccuuguccuggcuggcugggugggugaguuugggacuuuggcauagaucauguuguaaugauaugacagaccuggguguccaccucccacacucuggggugugugcuugugucugucugucugucugucugucugucuuacagcagguggccccagaagccucccuugcuucuugggcuguaugcugaagccacugagacaggcccucuuugauacagaugggagcacggugugugcaguaguggcuauuuaugaguccuuauuucugucaccuuugcugugcucuagcagucaagcugaaggggccgcuuugcuguuucuuccuuuugguucccauccuaccugaacuuugucccuccauccucagcccuaaacuccuuccuguucuguuccccugagccuuccuuugugguuucagacugugggcuuuacagagcauccaucgccugcgccagaguaucguuccccugcagcugaccuggaaggcagaggcaggaggggagccaaauggggccaagucaaggcuccucaucuagggcagggcaggaaaguucaggcagggacuuggggucuuggaaaacaagccuucauaaagcagucuaggcucacuuuuguaaauagccuuccucccaccuaggcuacacuuuucaucagucucgggcacacagcugugggacagccaggcugccugaacacaugucuuaacucccuuaccucucuacugcagcucuggugugcuccucccacguuugcauccuugguguugagauaaccugguguuugucacccaugggauguucacguguaggcacuagccuugggggcugggaagcuggacaggaguugaggggaggucaagggugucugaauaaauauuugggacagcugacuaguggaacagguuggcugcugugcuggggucaucuggggaugagggugucugucccccauuuagcccucauaggcuacgagaagggucugcucguuuacaguccucucuuggcccaggcccuagaagagaccucugagguaucucugaucugccaccgaguuccugaggagcagggggugaauccuccuugagugcuaugggggugagguggggccuuugcucuuugcugugggcuacauagcagggaaguccuguuuccugugguucccaaggccugcucuacccagcuggaagcuacauuucagggaucauacuaccugcagaaagaacuguagguuguuuagacccagccugacuggcuugaucacacacucucucggacgugcacacgugcacgcacgcacgcacgcacgcacgcccagguccuaaguuucuuguuaaugaaacaagugagggugguuguuguugugccuaugacgagugguuugcuaggggaggcaccauaguuugggcuuuggccagcccaauggguggucuucaggcuauuaguguuggguaauucauuagacaaaggugcauauugguaccuaguaagggucuaaguuugagggagaacaguggaggggaggaaaccaggaugacuccugcugagaaguccccuucauaggcaaugguccacgugcacauuagcuuuuuccuaccuugaaccuuauggagauacucagaccuggggucugagacacugaggccauguuugguaugaccaugaaacaaguaugcacacccaagccucuugcuacauauguccuuuuuccuagacugagucuuggccacaaaggacaccuagacccggcuauguucacacugccucaagcccuguagguagaugacauguugagagugccuguggucccuuguaccaagggcucuuccaagcaauguccagugagagaauaugcaagguauuuucccaucuuaaauggcucguucugucuuacaggaaauggcuaauucugucuaccuggucauggaggugaguucccauggggcuagggcaagcaugcccagcaugauaggcauagguggguauaaguauauacacuauggcauuccuagcugggauuuugggaauaccugcacuggacaggcccaagaaacugguauggggaauaaagaaugugagucaggcuagagauucuuugguuguguucucaugguacaucccuugucuuuugcaguauuguaaugguggagaccuggcugacuaccugcacagugaguaggcacacccuacugggcucuguuucuagccuaaaaugcugcagcuagauuugccuccugcuugauuguaucguugauccuccugcuuugggacucuauaggaagugagcccagcucuuucaggcccaucagucugaccacccucaccuauuugugaaguauagccugugugcugagugguuggcuuaagcagaagaggcagggauaaggacacaggccacgguuggugggucugagcaagcacuggcaggcacacacagaaaugguuugcaguuuucaugguagggcaagggagcagcuuaucugggcuugagccaggagaucuaucucugugggagaaucugguagguacacgcuaagagcagggaagguucaggcagcaggagagcucaggccccacugaaagacagcaaguggcuggguuguggugcagagugaaggaacaucaauauugcuuccauggggugcucugaggguugggggaagaagggcaaguggaaccaauguagggaccuugucccaaggccuggaaggaugcaguggcuguccauggcugugucagaaugcuuggcaaacgugaaacagaagacaguaggaauugaugguucaaagcagucccucccagaugcugccucuggcucuggcugugacagaaguggcagucccuuagccuccuuuuaaggguagggacuccccugagcaccuuucuccagagugacacaggcauuuaggacagucuccuguuguuugggucuucccucuacugcagccucuggacaccuccccagacugugacgcugucuucugguugagccaucagagaagaccuugggucucggagggcuguguagucugcuaggauaagucaguagucugucuuucugcuccuggccugucagcucacuguaugcuccaguucacguggcuaagccaugcuugucuuugcccacucaguguuuguuccuguccccuggggcagccacacagcaugcugcaccaugaccuucaguaguugagugguucuuggcaaggcuccagacuccacaggugucugugggaggaaagaaugagcaggccaauacagggcugaccuguaacuuugagugucucggggugcucacaagaucuccuaugccuguguguuugagcuccagugaaggcuuccuaaacuagacacccaucaagugauggggcuguggugagcuggugcccaauaaaagggguugggcagcccagacuggagagugaauguuuguucucaguuggcauguaccaaacuuugugucuaaguuguacauguucugcucaguuacuauaggagaagucuaugccccguugagccuaaauauguagaacucaagggcucugccucaaguucacaaauuguuugcaauuugcuguuuuguuuuguuuguuuucgagacagaguuucucuguguagcccuggcuguccuggaacucacuuuguagaccaggcuguccucgaacucagaaauccgccugccucugccucccaagugcuggauuaaaggugugcaccaccaaugccuggcacaauuugcuuuuuuaaagaaguacuucugccaggcauuugagguucaggucuuuaaucccagcaaucuugaggcagaggcugacaggucucugaguucaagaccaagguguacagagugaauuccaggacagcuagggcuacacaguuaaaccaaaacagagggguguggggaaugagaauaaaaaccuuuuagcuuuauguguacgaguguuuuguuugucugacauggagacuacauguauaccugaaguaccuuccagaggguauuggaaacccugguacuggaguuacaaauuguggugagccaccaugugggugguaagaagcagacuuagguucuaacugagagugguggauguucuaacugcugagcaucucucuguguccacuucaccuagacuugcuuuguggaagccacuguggucuagggggcaagagaccuaccucagaaguagggacuaaaucuagugauuggauugccauagggacggggaagaucuaggagguguccaggggaggaguagaaaccaacaugagcagagugcuaucagccaagagcuaacagcgcccaguuauguggaaggggaguccuacaaggaugugugggaagaggggaggggaccagcuucuggaaguugcaguacaagcuggccuuggugccuaaugggucagcccugugugcuggaggcccucuguagaguggugcuggugcuuagucccugcacuugucuuuccacacagucauguacacuccugucucuccagagagagagagagaccauggugucccaagucuccugagccuaccuuuucuuaacagcuaugcgcacacugagugaagacacugucaggcuuuuccuacagcagaucgcuggcgccaugcggcugcugcacagcaagggcaucauccaccgggaccugaagccccaaaacauccugcuguccaacccugggggccgccgggccaaccccagcaacauccgagucaagauuggugagauguguuugggugguggcucccugagagacugcagcaggggacccugcccacagagauuucagaucaagacaucugggugcuucuccugcagcugacuuuggauucgcucgguaccuccagagcaacaugauggcggccacacucugugguucuccuauguacaugguauguacccacuugugguccaggaccacauaaaaccaacuccauguauccugaugcugcaggcagagcugggcucagccuccaaccugagacccuuuguagaaacaucagacccucugaggaucagcuauggccucauuguggguuguagacaguugugcacgauuuugucaugucagaacuagcugguggaguuuguguguuauguguugguugcuuagugccuagcagcuaccaucuccaauuugcugaugccugguaccuguuacugauuauugcacgcugcuguacagaggugcugaucuguguugucacuguguaggcuccugaggucauuaugucccagcacuacgauggaaaggcugaccuguggagcauuggcaccauugucuaccagugucugacagggaaggccccuuuucaggugagugagccccaugguacucagguccuagugaauccccaaagcccuacagguuaagggucaguuuggguggcauucaacauggaaaaguacaggguuaccagauggggaaucaauuugagauuauagguaucaggcuugguggauauauuccguauucgugaaagccuuuaucauaguuuguuccaugggucacuguacuacuacauuuccuuauuaauagucaggcagccccaggccaugcccagucaauccugauaccuacugcacaaguacauacugccuaacagaauaacccucuuaccuagggcuuaggccaaaccuugauauuugguaaguuaaaggucaccucugcuaugaccuccaucagaggucagagucguguuugauuauggauacacuagguuaagucucauccauccuugcuucuaaacauaaucuaucuugcccggaagcaaagucugcaucaaggagaauuucagaaacaagggcugugucguucuugucaagaagugguugaugccuguagugaccccaaacugauaggccucgaggccucgaauagcuccuacuagccaacacugacugacuuuagaucaggagcuaaccccacucacucccugucacuaggaucucaauccaugagccuccuagauguguccccagcauauccucacugagggauuccacgaucaucugugggauauauacccagccauggccaucccucuuucaguuggagggucuaauaacuccugacuaucugacuucccguugucuuuguauggacacagcacaugaauugcccagugguccucuccuugggaagguacuugaggggcuaggaagugguaguggcagggcccugugugugguaacaggcagguacuucacaagucugaacuauuucauugcuaccucaacaggccagcagcccucaggauuugcgccuguuuuaugagaagaacaagacacuaguuccugcguaagcauccugcuuucuccccaagguggguccuccuuggcacccacauccuucuuaauacaucugcuuuuuaucccagcaucccccgggagacaucagcuccccugcggcagcugcuccuggcucuguugcagcggaaccacaaggaccgcauggacuuuggugagcacaggccaccuggcacccugcccacucagccacccugcuuggucuuggguauuaccguugcuaccauuauguuaguuggccuuagugagcgcccaggcaccuaugaucaaccagcugcugucagccugcagggcuacaguggguuguauuccucccaagcucagcaaggccagcagacuguauccugcugaaguaaggucagauguucucucaagccauuuccuggggcccugacucucugucuagguagcuagggccuggcauugacagacagggcucuggggugagucugucugggucagggcaucaggguaauucauuccuuuuauccacagaugaauuuuuccaccacccuuucuuggaugccagcacccccaucaagaaaugugagucucuggcagacuuggucacagacagggcuuggggcaugcuucccaaugucuggaggugccacauugcuaucuugggacauauucuggaaagguggagugccucguucugcuuuuucaaggccauguguuaccuggguggcucugcugucauuggcuuagggacacuggagguaucaguguaggguggcugcuugucccugugcugggaauuggaguacuggugccagucaggcagccaugucuccaaagcugugaugcacacugacccauaucccucuugcagccccaccugugccugugcccucauauccaagcucagggucuggcagcagcuccagcagcagcucugccucccaccuggccucuccaccggugaguugccuuuuuggguucucccauggacugcauagugauggguuugcagagguagaucuagcugccucugguccuucaggcaugaucuguauagcuucuguccuuuaugacuagggaagggaucgccucucauugaugcucagcaagcuugcugugggacuugagcuccauuuauuugaauuucuagcuguucaguagugucugguugggcgguaauaagcuaaugugagcagguucuguggucugugucugguaguaggagcucaguauguuggugcucauucuaugagacgucuggcccacaacugucaguugcucagggguccuggaaguguuucuguauggugccugguuggugcuggcuugcugugucaacgucgucacaggaauugauucugccucuguccucugacuugcuacuguauagaaauggagagguagggugccccagacauggaucuuucaugauggcuaggagcuaaugguucccaaacaguguguguauaaacucccaacacuaccccuaaagaggagcuucucuuuaauguuugaaagaaagcucagaagugcugcagagaaauuccacgcccagcucccuugauuagcaccaugggcuugagccccacuguggucuguaccacuacuggggagguugauugccuguggucucaguuuacuggcccuguuucauucuacagucccugggggagaugccacagcuacagaagacccuuaccuccccagccgaugcugcuggcuuucuucagggcucccgggacucugguggcagcagcaaagacuccugugacacagaugacuuugucauggucccagcccaguuuccaggucaggcccacucacaguauuuguuggacaugggguggguggguucagcauaggggauuugucagacagcucuggguacaugcacaugauaauaauggucauggaggccuauguauucgugagcauuggguucagaccucucucccugugggcaauuggaauggauucuagagcuuugagcuugcuggggauaaucugacccucacuggugugucuggagagccuuuguguucagguucaagaguauaaaaaaagggacacggaugguccaggugguauauauacaauacaaagguggcugaaaagggcugccacucacuucugucccagagcagacugcuugcacugggacccuacaaaggcacuuuaucagcauccagcugcacugccugacugcaagcucuagugagaagagggacuuuggacauaauauggagagccagagagaaggucaggugagccagggagagcagaggaccccuuggccagauaccaucuucuuccacaggugaucuaguugcugaggcagccagugccaagcccccaccugauagccugcuguguagugggugagugagucccucuuuaccuuugcucagggauaaguugggcuuuuaggagagccagugcuauccugccagguccagucuuuuuggcugggaauaaggccauuugggaaggacuaaggcugcuggggggaagccuguugagggaguuuagaaucugaaugcauguaucaaccuaaaagugucuaccugucccuucugccaccaggagcucauugguggccucugcuggccuagagagccacggccguacccccucucccucuccgaccugcagcagcucucccagccccucuggguaaguauacgugagcaucagucacacucugggucauggucacccuucuuggcaugaucuguuguaucuggaagguccuguguuuggucaaaucuggccauggcaguguggaugucccacugaaggccuguggaaguguggauggguugaugaagggaucaacugagaauguugaucaaaggugcuuucaggaccuuugcuagguuagaguauaggcaacaauuauguaggggucacacagguacaguuuugggugauuacaguguugugaaagccagcugccuucaguccuggccaaaguugagacauucugccaaaaugucugugucugagcuucuuccagugcugucuauaauggcuauucucucuccacagccggccuggccccuucuccagcaacagguacggugccucgguccccauuccuguccccacucaggugcacaauuaccagcgcaucgagcaaaaccugcaaucgcccacucaacagcagacagccagguuagugucccugaccuuagugagaauccugacacuauuguggacagccauuguggacagguugagaguuccuguaacuucccagggcuucugagcucauuaaacgcaucuuauuugggagugagucgguaggggagcagggcgggaggaggguauaggggacuuuugagauagcauuugaaauguaaaugaagaaaauaucuaaaaaaaauugaaaaaaaaaaccccacaucuuauuauuggcaagcuguguuugguaggguugggugaguguuucauguaaacugcagaaggcaacuucuguuagugauggaagugacuguaagccagcauggccaggggaagcugcccgaggcccucagugaugugggugagcucucaccugcccuggcucuguuugcagguccucugccauccgaaggucagggagcaccagcccccugggcuuuggccgggccagcccaucaccccccucccacaccgauggagccaugcuggccaggaagcugucacuuggagguggccgucccuacacaccuucuccccaaggucaguaggucuuaggaugggaacugguaggcauucccuuuccaucuguggguggguagauaugauaacuuccucuguuugcuguggucugaucuagccacccuuuuccuaccagugggaaccaucccagagcgacccagcuggagcagagugcccuccccacaaggagcugaugugcggguuggcaggucaccacgacccgguagguguggcauagucccugaccugagugucuguagagcaggcauggggcaauagcugaccuguuugcauggggccucccuccuuuugucagggaucaagugggaaggacugccacagccuagcaucaacuuuuguacgccuccugccacacaauuccuuguaucccacagcuguauggcuuuggacagauuacuaaucuuuucugugccuguuauauagaggcuuucugagguagcugcaaggauacuuguguucacagaaugagagauccacagaaugauugucacagaggccuugguuggggcauauucuagugugcuuguaugagggaccugagugugguaaugcagccuauuccuguccccagguuccucugugccugagcacucuccaagaaccacugggcugggcugccgccugcacagugccccuaaccuguccgacuuccauguugugcgucccaagcugccuaagcccccaacagacccacugggagccaccuuuagcccaccccagaccagcgcaccccagccaugcccagggcuacagucuugccggccacugcguggcucaccuaagcugccugacuuccuacagcggaguccccuaccccccauccuaggcucuccuaccaagguaacagcuucuaggagagacugagaggccuauggggugggaaaggaucuggucuuucugugguuuggcuacccguugggcuucauccucagguugcuucccuguguaggggguuagggaaggaaaauuagaagagcugguuccugguaggauccugaagcccuagugguuucucacccuuugugaacugggauugcuggcuuccccgaccggcccugcuguucauccuugggaagaaaaccugggccccaugucuaucugcuaagcuguggcugcuucccugugguagcaugguaccacuagguguuagguauuuagugguaucugucggcugguuuggguaggaaagaugucucagacuaggcaugguggccuauaccuguaagcccagcuuuuggaaggaucugaauguugagccuagcauggacuccauuucaaaaagugucacaaguagaguuugucaccucaagagauuguguaguucuguuugucuuaguuuuccuguuugggaaaaggggccccagacagcagcaccgccucaugauuucagaaccuguacacgugucuucacuucuggucuggagggaaggguuuccucaguggaccccaucuugugcuuuaguuucugaggucucccagcccaugggacuuucucagugcugucuuucccuccuaggccgggcccuccuuugacuuccccaaaacccccagcucucagaauuugcugacccuguuggcuaggcaggggguaguaaugacaccaccucggaaccguacacugccugaccucuccgaggccaguccuuuccauggccagcagcugggcucuggccuucggcccgcugaagacacccggggucccuuuggacgguaaguggagugggacgacugcucaggagcuguucucccuaccauugcugacccaacucaucuugugcugcuggcugcccaguguggcagguguuggagauuuguggugggcauuugugccccagccugguuccuuguuugggagauucgagaagucgguuaaaugacugaagcugagucuaguuaugccuggccugaggaaugguugugugcaggaauagggccccagcugucuggcccagaggccaccaccacauuagugccuccccccacugccaccucagguccuucagcaccagccgcauuacggaccugcugcuuaaggcugcauuugggacucaggccucugacucaggcagcacagacagccuacaggagaaaccuauggagauugguaugugaggggucugugggguuacuuguggacagucuggucccaacccaucccugagccugucuuguucuucagcucccucugcuggcuuuggagggacucugcauccaggagcucgugguggaggggccagcagcccagcaccugugguauuuacuguaggcuccccacccaguggugccaccccaccccagaguacccguaccagaauguucucagguaagaucugugccaaggaaaagcagcacacagggcggggauuuuugagggcaguuuccuguuguguaacacaggagaccauagaccauagaguauauggcauuucuggcaugucuauagagcagggaugguaaucgagauacuagucucuauguccagcgccccuggaaggccagccugugcuccugccacuucccaguuauuguuagugguugccuuuucuuccuagaccaccuccuucugcacacgccaucucuagggaggcaaaggggguggggggagcuagagggcuccaagauggagaccuggaggugcuaggauguguuccuuagugaagcaggaggguaaggaggugugugaacugaagcauaucugaacuccagagaugaguucagagugccugucccuuaccagccaucuaccuacagugggcucuuccagcucccugggcucuacuggcuccuccucugcccgccacuuagugccuggggccuguggagaggccccggagcuuucugccccaggccacugcuguagccuugcugacccccuugcugccaacuuggagggggcugugaccuucgaggcuccugaccucccagaggagacccucauggaggugaggcuuguggggaggugacaagcaugggugcucccaugugacuugccugcuuaguacuugggggugggggugggcaagcggugccccuuuggcagaugaaccuuucagcccugcuguauacacuugggagucccaggcucugaccuuuauugccuucucagcaagagcacacggaaacccuacacagucugcgcuucacacuagcguuugcacagcaaguucuggagauugcagcccugaagggaagugccagugaggccgccgguggcccugaguaccagcuccaggaaagugugguggcugaccagaucagucaguugagccgagaguggggguagguauugccugggggguggggaagagggcuauugggcacuucccccuuugacuuggggcugaccuguuucucucuagcuuugcagagcaacugguucuguacuugaagguggcugagcugcuguccucaggccuacagacugccauugaccagauucgagcuggcaaacucugccuuucaucuacugugaagcagggugaggaagugggcuuggcucagggaggugaugcuggguaagagugagcaagccugaggcgggaggguaaggccauaugcggggacccaggccaugucagggagcagacuacugcugaguuggguacacaggccuggcccuaugcucagagcacagaguaagucuauggaggacauaauacccaggacagagcuccuggagacugauguugauccugcuguggcugguggggguuauagcuccugugcaugcagcuggaacaugcucuucugccugcaugcuuucccaugagggucuguggggaccugaggugacugacacuuccacccuagugguacgcagacuaaaugagcuguacaaggccagcgugguauccugccagggccucagcuugcgacuucagcgcuucuuucuggacaaacaacggcugcuggacgggauccauggugucacugcagagcggcucauccucagccaugcugugcaaaugguacggucugugccguguguggcagggcuuagggauguuguuucuaggucccaggggccagggcucugaaguuaagugugauguucuccccagcaagcagcagaggcucccugguuccuaacauauacugacccacugugcagcucagguagcauccugaacuugacccugaaguucaguuuccucagcuaacauggaaagccucugugugaggaguacacccuguuugugggucugagguuucugcuuugacauacauaauucaaauguuccucacaugaggaacaugucugccaguggaaguuuaaguuggccucccucaucucuuccuuucugaguuggcugugauccauuuauugauccguuucauugucggccacagugguaggaauggcacugggugguugcuuagcacucugcaagcauuuccccuuugcucccccuggaggagggguuguguacagaccaagcagacaacacagugcccacugugcaggcaggccauguggaugagcaucuguagcuaauuccguagaccuuuuguguucacaacacaacuacaagugaaguugggcaaauccgcaguaugcugagcagucaggcccccugucgugccccagcccugcccagcuuugcuguugccuguagguacaaucagcugcccuugaugagauguuccagcaccgagagggcuguguaccgagauaucacaaagcccugcuauugcuggagggguugcagcacacucucacggaccaggcagacauugagaacauugccaaaugugagugccuuuccggagcuuaagugggggugguagguguggccucccugucucaugcucucuccuccacaggcaagcugugcauugagaggagacucucggcccugcugaguggugucuaugccugacuaccugcugccaaccugcaggguagggucugagaccuggcagacuguccucaacacugaucagauccgauggugcugagacugcugccagccaacuccagcagggaugcuccacaguggaccugugcagacuggugcaacucuugcuuccuagacugccagucucugcuggcagguagacaucagagugccaggggucccuugcccacugggacaggaguuucugaacauauucuuccuagcuggcucccuggcaagcagguauggugccgagaaguggcaccugccaccugaagagcccauggcagcccugugucaggcaagggccugagaccguugcugacuccaagccaaagcaagcuuuuccucacaguucacuugccccauugcuuguccaagaaaaaaggguauggucuucuggcccccuguucucucuaggaacuucucccucugagacuacuuacccagcuuuguaagucaccggagcacuuuaugcauacagagacuggagaaccuagccagcagugcagacugcugggaaccugccuccuguuccuggcuuucguccuccaagacgcuguauagaugcagaccacaucuuuguguauaaaaagcccaguguucaccuccuccugugucuggucuuuggaggaaagcaacaggcuugccuccugagggagagauaguccucacguuuaaauguucauuagggacagacaguucauugugugaagcaccacccaugcuuguuaaaacuccucaacuuccacacuuuacuccuaagaugugucuccacccucccaacucaguuuuuguucauaaaaggaaacuucagauguuuaaggauugaaagggcggaggcagggcaggccagguaucacacuggauguuguccuuguaggagacggugcccgcuguguggcugaggcuguagcaugugccagagcgagugugcugcuggcuaucucuauuaacuuucccuggaagggcggcagaaaaggcagugcccaggugccguccucccugugcaguggaggugugggugaagaauaacauaugcaaacauguccccuguggagcuuuccugucagucuggcuccugugcuugguggccuucaggaucugugcugaagcucgucuuccaggcuccaggguggacacaugcuaauaccuucccagccucccugaccugccaguccuuugucacggcucuguucaugcauacuugaaaguaucugaguguccacaagcugaugugggguuucagaguuauaggccacacacacacacacacacacacguuuuucuuugcaauacuugaaauauugccacugugcuugguuguacaagaguuguacaagaaagcagaucucuaagaccagucucuuccuuagucacccuaugaccucccuugcauguaacauguuguauuuauugcuuuguggccaacuggaacccagagccaccagggaggcuagugcagggauuccugacccaccaccugguuccugaaaggcuccuggguggcuguguguguguguggcuggcugugugugguaugagccaaaccugcucaugaaagcagugcucaggccugucaauuuuaagaugaauuuugugagucucccccuuuuguguuucacugugucauaucaguuuaagaaaauaaaaauuggaauuauuuauguggugucaauuucauccuggggugccacugucccuccaggagccgggugugccuucaggucugucugggcagguugccugugucccccagccagauugaguccaguaguacuucacggugccgguggugugguggcuugcucagcaccggaagcaagccucaguuugauccagggauagcuggguggguucauuguaucacccaggaaacaacaguucccacugggucaggugaggauccagagaggguggggcaauucuccaggcccccuagaguggagcaucauugauaaugaaccuuccccauuuugagagacagggucuuugauuccuaggcucagaugaucuucuguucucugccucagacuucauagcagggacugucgggcaccccauugcaccuggcuucacuugucauuuuauucuaaacuuuagcaaguaugcucugaggugcaguuucccagcacuaaucuucuauaaaccauuggccacucuguaugcuuuauuuguuccaauccucugugcucuccagccccuua

SEQ ID NO: 2600 - RNA, 42650 nt, Mus musculus
accaccauggacggaaccccuaaaacugugagucaagaaaaagcuuuucucuuguuuuccaggaauuucuuaacuugagggaaagagaaggaacacaggugucaagugugagcuuugccuuucuugcagucuuccauauguuaacaauccacagucauggcauuuauuucauucauuaccaaguguuuaggaaaccacucauaacauauacagccaaccaggaaaacgaaaacauuuucauuacauaucguagaagagaaagcaccaagagcaauacagguauggagaaaucacccuucuaugguugcucauuauaaagugaggauuuugcaaauaugcaaaaaugacagcuaggcaguaguggcccaugccuuuaaucccagcacuugggaggcagaggcaggcugauuucugaguucgaggccagccuggucuacaagagugaguuccaggacagccagggcuacacagagaaacccuguccaaaguuccaaagacgcaacuaucacugcuuauuuuucucuucuaacauuuauagccgguaaagaucauccuuguguugccuaauuuuaugucaacuugaugcaaguuugagucaucugagaggaggaaaccuucacugggcuauagguaagccugcagagcauuuucuuuuuaagaaugaucuauguguauuggugucuuaccugccuguauguaugucugugggaggugucagcucccuggagcuagaguuacagacaguugugaguugccgugugguugcugggaacugaacccaaauguucuggaagagcugccagugcucguaagugcugagccaucucuccagccccagaguauuuccuuccuuccugccuuccugccuuccuuccuuccuucauuucuuuuuugaguauuuucuuauuuaauaauugauggggagggcacagcccauuguggauggcaucccuaggcaggugggucuaggcagacaucuccaagcugagcaagccaguaagcagcauuuccacauggcuccuacccugacaucccucagugauugacuguuacuggaaaaucugaguguaaauauuuauuucaauaaaccauccucaaccgggcauggaggcucacgccuuuaaucccagcacuggggaggcagagguaggcagauuucugaguucgaggccagccuggucuacaaagugaguuccaggacagccaaggcuacacagagaaaccuugucuggaaaaaucaaaacaaacaaacaaacaaacaaacaaaaaaaccccauccucuccaaguugcuuuagaucaugguguuuuaucacagcaauagaaaccauaacuaugacaacccucagcugugagagggucucauucaguuagcuaagggcauuaugugcaaaaaaauggggaaaggacuucugcuugaaugacagcaggacacaguuacaccuuuaaccgcagcacugagggaggcgggagaaucaguuuaaagucauucuuaguuccaguaguggguuuaaagccacccuagguuacacaagacuguucaggacauacacaaaaaacaacaaacccaguaaaauaaagugcucaguggucgagcacuuacccaacagauuuagguuccuucucuguguagcccuggcuguccuggaacucacucuguagaccaggcuggccucgaacucagaaaucugccugccucugccucccaaguguugguauuaaaggugugcaccaccacacccggcuagauuuagauuccuaacagaagaaaaauauuuaagacugugauauaaaaauccaaccuaaguggguggagaugguacauaccuuuaauuucaacaaccaggagacagagacggguggaugccugaguuucaagcuagccuggucuacagagcaaguuccaggacagccagggcuacacagagaaacccugucaaaaaaaccaaaaaaacccaaaaaaccccaaaaaaacaaacaaaccaauccaaccuaagcuuuuggcccacuguucuguucuacaauguguguguguguguguguguguguguguguguguguguguguguguaugcaaguauuguguaggucagaagucauuuguguguuacuccucaggcaacacccaacuuuuauuuuauuuuuaaaaugacauuaauuacuuagagugagagaguacuugguuggguguguguggguguuuguguguugugugugccccagcagcuguguggaagucagagacagcauguggaauuguggggauugaacucaaguucuccugguugugcaccacgcacacauguacacaaacaccuuaugaccccaggccuugcccuguagcagcucugugugucagucuccaccuuugggccaguucugugaaauaacuaacuagaccuauauccccugcaggcuuucuagugacccuugacugauacaccauggaaugaaauggaaacugaacaggcugggucagaaggucaggguuuaggcgauugcucugcugcagaucugugugauccuggggcauuuuuacuaacuucuaccaacuagcggggucauuuucauccccagaaauaacgacagcauguaaauagcaugcuagauagaagcaacuguugcaauacuuggaguaugauuacauuauuuuuuuuuauuuuguuuuuuccgagacaggguuucucuguauagccuuggcuguccugguugauuacacucuugcuuaaagcuaucuuccaaagucaguucuugcaugacaauuaaggccaagaagugauuuucuuccuuccuuccuuuuuuuuuuuuaaagacuuauuuauuuuauguuuaugaguacacuguuacucuguucagacacaccagaagagagcaucggaucccauuacagaugguucugaguuacccuguaguugcugggaauugaacucaggaccucuggaagaguucuuaaccgcugagccaucucuuuacccccccagcaaguguuuuccuucucauuuccccucuaauguggccguguccuccuuggggaaauuaagcauauuuauuaucauuuuucccuuuaccucugacaguggcuucuaucucuuccauggcggccucacuuugggcgucugcgagucuuucauugauuuccaugauuuccacaaggaacugacugucugcuuuguaaucugucccuucaggaauuucuauucccuggagcuuuagcuauuggggaggagcacaaagaaaaggaguuugguuaggaaacauucaguguuaaguaaauacugcucacuccuucagaguacacggcacuccugggggaagccuugagugucaggugaaauggagcccagagccuaguacaugcuaaauaagcacugugucccuucagaaacuugagcuguccuaguaacagugagugcugguauaggaccucacucugcugaauguaccaucaaagcgaugguugguaccucacacaucucagauguuaagugagucuuuauaaacuuucccuccaguucuaaaaucgccuagauguccuuacaaaaagacucccaaguacucuuuuuuucuuuuuuccuuuuuuuuaguuuuucuuuuucuuuucuuuccuuuuuuuuuuuuuuuuuuuuuuuuuuuuuuccgagacaggguuucucuguauagccguggcuggccucgaacucagaaaucugccugccucugccucccaagugcugggauuaaaggcaggcgccacuaugcccagcccaaguacucuuaucaaauucauugaaaauaguuaaagcaauaguuaaagcacuacaaucaggggugacauuaggauaugcaaaaggauccaggucuggcuugguguggggcugcaucccaaguuacucaggaggcugaggcaggaagaucacaugucaauuccagccugggcagcugagugagacugguucaaaaaguaacaaggcagcuggggauauaguugaguggauucaaaaccuaguaccaucaaagcgaacaagcaaacaaauggaagcaagcaaaugaaagaaaauccaguaaucaucaagcaggggccauagcucaguucagagugcuuccuuagcacaaggcacuagguucaauacccaguacugaaggaaaagaaaaauuaggaacgagcuggauguggguguggugaagcaagagaauuaauaaccuggagccagccugggcuacaaccagugauguuuucuuucaaaggaaaauacaaacaaacaagauggauuuacaaagaacacugauuauucuugcauaaaaauuuaaaauuuuuuuucuuucuuuccuuuccuuuucccaucauuugcuuccuggaccaggcuaggucucauacagaggagucccagacagauggguugggaaaucaccuuacaagauauaguccucuggucaggggagccugaagagucuuauaggcaucauucaccaggguggagugcuugucagagaaguguuuuucagucuguucacagaaguaaaaacaguuuuaucauuacaagagcuggucaagcuggcguguguuccguuaucugggaagccagauaaaagcugggaggaaaugacagcucuggggccuggcugucuaggggcaggcugccacaggguggagcuagcagcccaacucuuucccagagcaacagagcuacccacccaguugugcccauacauggggacuauuggggggagggucaguaaauaccugagacuuuuggcugaagaaaucuggguggacaagccgcugcaguugcugguaccugugcugaaguuucguaacguccacccugaaggagcgguugcuggaagaaaaccagauaucauucauaguuccagccauuuacuacagucugguucugcucucggggaggaugcaauaaacgcguaaacaaagguuauuuuuaagaccugguagcugcaaugaagggaaacagaacagguucggaagaggugguauagguaugacaucagagaggagacccaaaggagcgaagaucagaaagggacaugagcggagagacgacacugaccuggcuggaaggucgauagcuugacgcauuaagggagguuaguguaaugcaugguaaacucuuggugacugagggucucuauagguugggcaagaacuuuagugucaagccacucccuacugccaggccucuuuuuauuuuuuauaaaaaaagauggauuaauuuauuuaaucuaugugaguacacucuugaucucuucagacauaccagaagaaggcaucagaucccaucacgggugguugugagccaccaugcgguugcugggaguugaacucaggaccucuggaagagcagccagugcucuuaaccacugagccaucucuccagccccuuuuuacuuuuuuauuuucuaaaagauuuauuuauuuauuauauguuaguacacuguagcugucuucagacaccccagaagagggugucagaugucauuaaggaugguuugugagccaucaugugguugcugggauuugaacucaggaccuucggaagagcagucagugcucuuaaccgcugagccaucucuccugccccacuuuuuuauuuucuuauugguuauuuucuuuauuuacauuucaaauguuuuacuuuuugagacagaguuucuuguucuguuuuuuguuuuuuuuuguuuguuuguuuuugagacaggguuucucuguauaguccuggcuguccuggaacucacuuuguagaccaggcuggccuugaacucagaaauccaucugccucugccucccaaggcgugggccaccaacaucacccucaagacaacacuuuagccuucuuuauaggugggcuaacagguaugucauugggucuagagccuuggcauuacaaaauuugggugugggagagggagagggggagggggagggggaggggaagggggaggggggagagagagagagagagagagagagagagagagagaaauagagcuagaaauaccuuauagacuccaaacuugcuauauagccaaguuuagcaacuuaaaaaagaaauccuggguguuacucaauugcccagggcugaaaauuuugcuccuccuccuuuagcuuccugaguaguuggaauuacagauagagacuacuauacagagccuuugauaacuagaagcagguauucuuuauuuauuuuuguuuuuuuagagaaaggguuucucuguguagcccuggcuguccuggaacucacucuguagaccaggcuggccuugaauucagaaauccgccugccccugccucccaugugcugggauuaaaggugugcgucaccacugcucagcuuuuuuuuuuuuuuuuuuuuuuauucuuuuaaagcauaguccugggauuugaacccaaaccuuggcuaauacaaggauguguuuuaucaccacuaugaaguaaggauucagcacuccuuucuuuccagggagugauuccaacugagucugugcagucugcuacugugcagcccugacuguaggaugcaaacuggacucuguaucuuuuugcuuuugucuggagguugggaucauaguugaguacagccacagcgggcccucccauuuuaaucuuuaguucaacucugcgcacacuucgguaccucuccaaucucugagacaggggaggaaaaaggcagaguggaggggcuggagagauggcucagugguuaagagcacagacugcucuuccagagguccugaguucaauucccagcaaccacauggugacucacagcuauccguaaugagaucugaugcccucuucgggugugucugaagacagcuacaguguacuuacauacaaucaauaagucuuaaaaaaagagaaaaggcagggggggggggacaaaguacagagaacacuucuuggugucucucccucaaauucucagccugaauuaaauuuuuguuuucuugagacagggucucacugcuuagccuauguuggguucccacuuuugacccuuuuccuucagccuacugaacacugggauuuuagacauaggcuacuacacuagguuuguuuuguucuuaauugcuuucgguuuuugagaccuagucucauguagcccagagucucaucaaacguacaggcucagcuguacccucugagugcuggacucacaggcauaacaccaacacaccuggcuuguuuuguauuuauuuucuccguuaaauaaauaauuuauuugcgaugagauguucccuauuugugugguuggccuccaagugggguaucaucuccuacgguugucuagcaugcuuuuaauccuggcauuggugaggcagaggggguugguggaauuccaggcaggccaggcgagacuucaaggugaggcuaaauuaaaaaacaaacaaacaaacaaacaaaaaccucucccaguuccuguaaguuuggccaauggauuuuccagaagucucagcccucaaaccucccuauaccguaaacuuguccguuucuguuuguugauguuuaaaaacaagguccuuguagcuacugcuagucuugaauuccugaaccuguguuuuccacuuuacaagugcuuagaucacagacaggcaucugcaacuucacuccuguuugacccccgccuccacccuuaucuucucuccagucuguaacuuuauuuccucuccgucucaggaaaacuccuaaaaucucacuagguacuacuuauaccuauggccuacacuuauccaucuuuguaguuguuuugaaucagucucggcaaauugccuaagauggcuuugaacugugguccucagccucagacccccccaagcuggcuggaaauuacagccccgcagacgcggccccaagccuagaucgcucggguuacgaagcccgagcugcuuucccgucacgacgcgccgcccguaccaguucaugaggcugaaguagucacgaguggggucaggaggcugcagagcgcggcagugugagcagaagaacucauccccacacccgacuucccuugcgugaccgcaguuccagcacugcggugcaaugcucuuccccgcggcggcauugcugcccaaaagucuccuucccaggaacccugccagccgcaccucccacacacccagcagggcacgggcuccgcauccccacauugggacggccgcucgcugaccuagguagcaagacccgagggaaaggaggaaagaccgucucgcugcugauugguuaagggagucgaggaggcgggauuagccgcgggaaaccaagacgucgagucccguucugcauguuaaacuacaacucccagcaagccuugagacuaaucgcggcagucaucuucgggcuuucuuacugguccugccggggaggaaggcuuuuugauugguugaggguggaguuuguauccguagguuuagcgccacuccacuggcggaggcugugcaguguuugcggcuccugguggucucacgcggugagucauaagugggaaacuuuaaguguuugaggagucgaauaccguucucaugcuucuugugcaaaugggcccucugcagcuuccgcuuugucugcuuucuugugcgagcgagggggcgcugugcauagucaauucuuccuuuuuaucugcccuuggggcgcgcgggggggaagcgggggggaaguucacuuuccuuguuccuugugagcugaaacaggucugggcacauaggaaggcacaacgccgggcuguucguugccagagcgaaguaguuuucauaacgaacauuauaaauguucaugccagccccuagauggcuuuccccaaauaccuacugagaacccgaucuucgcugcuaggcucugcaggaacugaagaggguacgucugcauacucagcauacgugagggguaggauggcaaggaauggauaggagacaaccaagccauucucagcuucuguacaugaaggaagaugguguaaugcuuuguaaguggccucuggaauucuauucauaauccugggauuuugcuauggucacuuuuuuuucuccccacucaugaaugggccugucuuucauuuugagguggucauaaugugcccguuccuuuaaauuucuuuauguauuuuuuuuaaucacgugucuaagucugugcagugcgcacgggggccaauagagggcauuguaucaccaagagcuggaauuacagguguuugugaucuuuuggaugugggugcugggaacuguacucuugacuccuuaacugucuucauuuuguauguuugacaauacugggagugggauccaguacuuugcuucuguuggagaagugaugaaccaucuaccauugaguuauagcagccacaugacuaauuuuggguagagauuuacuuuacuuuuaauuauguuaucugugugggaaagugcaagugugagcucuggugauugcagaggccaagauccacuacagagccacugacuuuggaguuauaggaaaccucgagcugccagauuuggugcugagaacguagggaaacuuggguucugcaagaauaguaugugcacuuuccugccgaguccucuccugcucccuccccuucuccacucucgaauccagagccuuguuccuuauuguuggacucuuguuuucgaggucggauaugaagagucaucaucagucccacagcagcaccuccucgaaggcucaugacagugcuuccuguucacagucccaggguggcuucagccagccccaaggcacuccuucucaguugcacgagcucucacaguaucaggguucguccagcuccucuaccggcacagugccguccuccagccaguccucgcacuccaguucugggacucugagcucgcuggagacagugucuacccaggaacucuguucuauuccugaggaccaagaaccugaagaaccugguccugccccuugggcucggcuaugggcucuucaggauggauucuccaaucuagguaaggcacuuuguuauaugauauaguguguguucagagaaacaguuaaagaaggugguuaggaaaaaaaaaaagaaggugguuagguuguugcagcagaagucucagggccccugugguagaguuuaucuccuccugguggcccuguucauacugaagaucagauuuaggccuuacacauaguagagagcucuuacauugaacuacauccaagguccuaucccuggcuaccuuauuuuuauuuuuaaauagaaucuugcuaaauuucauaggcuagccucaaauuuuucuuuuuucuucagaaaaaagauucuauuguagccugaguuagccuugaacucacuauguagcucagccuggcugugaacuuuugaucuuccugccucuacuuccuaagugcuggguuuauaggcacacauuuuuaucaggcucuacuaguuuguuugugagacaaggaauucugcagcccaggugggcuuggaacucacaguguaguuccuuggggccuugaacuugcauugaucuugucucaguugggauuacacauaucgaccauaugugguucaaauuuauucauuugaauguggagaccuagcucauucugagacaguuuugaaagauacuuguauuagucaggguucucuagaggaacagaacugauagaaugaguauguauguauguauauauagggacuaauuagaguggcuuacaugcuaugguccagcuaauucaacaauggcuacccaggggagguguaagaauccaguaagaauccaggcaggaugucuuaguuggucuuuaguauacauuacuaucuuguagaaguaugcucuaggggguuggagagauggcucagugguuaagagcacugacugcucuuccaaagguccugaguucaaaucccagcaaccaugguggcuugcaaccaucuguaaugagaucugacacccucuuuugggguaucugaagacaacuaccauguauuuacauauaauaaauuaaaaaaaaaguaugcucacuagugcucagugaaggaaugaacuugccaguaagagcgagaucaaacuggcaaagcuuccuuuuuucaugcccauuauauaggcugccagcagaaggugugguccagcuuaaagguggaucuucccaccucaagagaucuggauuagcccagaugugguaguaaaaggaagcagaggcaaagugagcucugaguuugaggguagccugggaguuccaggauugcuagggcuacacagagggacucugucucagaaaaacaaaacaaaacaaaacaaaaaaacccccaaacuaggggacaggaucuauuaaauugguuacaugauauggccugaaucauccauucguaguucucuucaugauggagagaguuaagacuuaggagcuacucaguccacaagacuagaugucucagccaggagugccaguuuggcacugacagccuggaggauuccuagagagcgagcugaucuucacuuuguauuggaaagaagcagcgaagggcaguagcagaaaucauggcauagaagcacuugccagcaagaagcgaaggcaagcaagcaacacuuuuucccuuggaccucccugucuuggcuuguaggaggugacacacacucuguuguaaagucucuucccuucaguucauacuucacagguccacccagagggcugucucuuaguuguuuucagauucagucugguugacagucaagguuaaccaucaguuauuuuuccauguccccaggcuggcucaccauguucucaucucaucuccugaaugcaaagguuauagaugagguaguguacccuguuguauauaguuucuacuacccugcuuuaagcgccggguggaccuugcuaccagucaccauccuggauccacagaugaaagucagacagauccccugaccccccacauguacacacaaacacacaccagcuuauuuuuaauaugcuuuuuagcucaauggcuucuuuuuuuuaauuagauauuuucuuuauuuacauuucaaauguuauccccuuuccuaguuucccuuccaaaaacccccauccucuccccccuucgacuguuccccagcccucccacacccacuuccuggccuaggcauucuccuauacuggggcauagaaccuucacaagacuaagggccucucuucccaucgaugaccagcuaggccauccucagcuacauauguagcuagagccuugagucucucuguguguuuucuuuuuuuuuuuuuuuuuuuuuuuuuugguuuuuagaaauccgccugccucugccucccaagugcugggauucaaggugugcgccaccacgccuagcccguguauuuucuuugauuggugguuuagucccagggagcucuggagguacugguuaguuuauauuguugucccuccuagagggcugcaaaccccuucagcuccuuggguccuuucucuagcuccuucauuggggacccuuugcuccaucuaauggaugacugugaguauccucuucuguauuugccaggcacuggcagagccucucaggagacagcuauaucagucuccugucagcaagcucuuguugcuuauuuuauuuuaguuuuguuuuguauuaugauacuuaucuaccugcuguguugauaaggcugucugcgagccccugaaccuccugccucuaccccuuuaauaguacagcugacuguuuauuuagagcacagagccuuaguuuuuagccuggcacaguuuagaacucacuaaguagacuguucuagccuugaacucagagcgguucugucuugggcuccugaaugcuggguuauagguguggacugcuuuuuaaucacgucugaaucuccauuuauaggaguuguugguuuguaucuuucuuguguugucuuugucuuuguuacuaagguuuaacugccaucagaaugaauugaaaagguuccuuuuuuucuucuuugccuuuucuccucuuuccuucuuucuuugauuucuguucuuaaagccaguucucuugucuucauuucuuuuuguuuucuugaguguuucauggagccuauccugaccucaaacuguguauguagccaaggaugaccuugaacuucuaguccuucugcuaguaccuucaugcugagguuacuggcgugcaccaccaugccuggcuguggaucacaccacauacccccaccuccgcccuuuuuuuuuuuuuuuuuuuggagaccgucuaucuguacaaccgugguuguccuggaacucacuguacacaccaggcuggccuugaauucacagagauccacaugccucugccucccagugcugggauuaaagguuuaugccaccacuaaccugccuggagcuacacuguugaguaagauagucacagcgguccucguggacuucauguucugaggggggaagucaggaagaagguuuacagagaaguguaauaaggguucaucuuuguagaguaacugagugggaugaccuuaaugugauaaccaaugugguagugagauguaagugaaagauggaagcccaaauuuaucuuuggcuaauacuugacccuaaacacaaagggagagaggagaugagccauucaugucguuugaaguauugucugaccuuguuccuggggagaagugaacagagguguccucucaucccagguagggagcugugaugguuuguauaugcuuagccuagggaguggcacuaauagaagauguggccuuguuggaauaggugugucacugugugcaugggcuuugagacccuccuccuagcuuccuggaggccagucuccuccuaguagcuuucaggugaagauauaaaacucucagcucugcugggcgugguggugcacgucuuuaaucccaacacuugggaggcagaggcaggcggauuucugaguucgaguccagccuggucuacaaagugaauuccaggauagccagggcuacagagaaacccuguccccaaaaaacaaaaaacucucagcucuuccugcaccaugccugccuggauguugccaugcucccaccuugaugguaauggacugaaccucugaacuuguaggccagcuccaauuaaauguuguccuuaggagaguugccugggucacggugucugcucacagcagugagacccuaagacaggaguugaugacagagcagauacauagcacugaaguccaccuuggugaacugaugagcucuguugggguuacuaaaaggaguaggaaugacucaaagacaguagcaucaccaaagcccaccccggcaugagugacagcucacaaagcugggaccuggagcacacugcauagucuguaggcagcucaccaggugcucuauccccauggcucaguuggucagagccucauccaagcaacuccuagacagcugaucuaggcuggucucugcuucuugcggauggcguggcuggucugagugucuucuuugccucuuguccuguugucugaauuacuugcagcagucuucacugcuuauguacuuacuccuggggagggaggacuuaguggucaaaagcuaucuuuaguucuuuaguuuuugucuuaaggacccugccugcaggauggagucauugcaucuccccuuuagaacaacuuauuauuucacacaaccucccccccaaauauccuuccuucaccccccuuuucucuucguaucuuaaagugcuuuccuccaagacagaagguuuuaagcuuugaggaaacugcugcuacacaauagaaauaugcugugccucacuuguuugggcugugaaguugaaaccaguggagcuggggguaguuaacaagggggagaggcauuguggaggcaagugccuagaccugaguaccuggucggacaugaggaagauuguagauuuuauaccgaguguaauaggaaaccucaggaagguaauacgcagcuaacuaaauauuuuucaaaaucaaacgauuugagaaguguuuugagaaguucuuugguuuuuuuucuguguagcccugacugucuuggaauucacuucacucuguagaccaggcuggcugcccgauucugcuuccugagcgcugggauuaaaggggugugccacugcagccugguuuauucaagaagucuuaacggcugcuuaucauuucaugguuauguauaaaccaucaauuauuuaacccauaauuguacccagccugguguaguggcacaugccugcaaucuuggcacuugggaggcugaggcgggaauaucuggaauuuguggccagcaaguucgaguccagcuggguuacacgagacucucucaaagaacaaguaaauagagcuggaauguagcucaguugguagaaagcauuugccuagugugcacaaaguucuggguuuuauuccuagcaccccuauaaauugggaauggucggcacaugauugcaaacucagcaucaggaaacuugaggcagaaggauuagaaguuuaccaucacacagggcccccaauggaggagcuagagaaagcacccaagagcugaaggggucugcaacccuauagguagaacaacaauaugaacuaaccaguaccccuagagcucgugucucuagcugcauauguagcagaagauggccuagccgaccaucguugggaagagaggccccuuggucuugcgaacgccaaggccaagaaguaggagugaguggguaggggagugggcggguaggggagaaggggggccguauaggggacuuuugggauggcauuugaaauguaaaugaagaaaauagcuaauuaaaauaauuugaaaaaagaaguuucccgccauuuuuggcuacauagagaauuagaagccagccuggaggguuugagcuccugccugccucaaauaccagggucaaauaaucaccuaccaaaacaaccuaaaacaaaacaaagguaagccauuguugugucuuuguuucccuccccuccuccccgccuugagccccaaggccuugaauuugcuaaacuugcagugugcacuguuuguuuuuguuucucuuuuuguuuuuuuuuuucgagacaggguuucucuguguagcccuggcuguccuggaacucacucuguagaccaggcuggccuggaacucagaaauccaccugccucugccucccaaguauugggauuaaaggugugugccacugcugcccggcgucccucagucuuuaauacaaaacuuugauauugaaucuauacuuuugauugucuuuuucuuuuaaaagucacauuucuuucuuucuuucuuuuuuuaauuaacuugagucucuaccuuuuauuuuuuaagauuuauuuauuuauuauuauauguagguacacuguagcugucuucagacaccccagaagagggcaucagaucucauuauggaugguugugagccaccaugugguugccgggauuugaacucgggacuucuggaagagcagucagugcucuuaacuguugagccaucucuccagccccuauuuauuucuuuaaagauuuauuuuauguauaugaguacacuguagcugucuucagacacaccagaagagggcaucagagcucauuacagaugccugugagucaccaugugguugcugggaauugaacucaggacuucuggaagagcagucagugcucuuaacugcugagccaucucuccagcccuugauugucuucuuacugcuguuuugacagugucuuucuuguaggcaagucucuuaagcuuguccugcuggacucacaugugcaccacuccacagacuugguuccuucuucuaguuaacacuuugauacauucuuuucuguguguuuuuguaucaacagacuguguuaacgacaacuacugguuugggagagauaaaagcugugaauauugcuucgauggaccacuguugagaaggacggacaaguaccggacuuacagcaagaagcauuuucguauuuucaggguagguaacgguugcuucucuccucggagacccggugaucuagucguugcucuggggcgucuuuugcuauuaauucuuggugucaaaauuuggacauaaaauauucucuguuuuaggaaaugggcccuaaaaauuguuacaucguauacauagaggaucacaguggaaauggaaccuucguaaauaccgagcuuauugggaaaggcaaacgcuguccucugaguaacaacucugaaaucgcacuuucacuauguagaaauaaagguaauguuauuacgguuaaugagcuuuucuuaacuuccucuguaaagggaaauuuuugugucucugucaguuaugcuuuaauaaugcuuuucagucaaauuaaguaagucaguguucaguagcauccaagaguuacaccauugccugaguugugggguuuuuguuuguuuuuauuuuuguuuuuagacgaggucuuacuauauggcuguccuagcauucccuauguagaccaggguggcuuugaacccugccugccucugucuucugagugcugagaacuuacuuugagugugugugugguuuauguauuugugcauuuguguagguguggaggccagcaggggauguaaggugucuuacucucaucuccaccuuaauuauuuacauuuauugugugugugugugugugagagagagagagauugauuuaugugagcauguguaggcuuacauguuacaguaugcauguaagcuuacauguuacacuaugcauguguaggcuuacauguuacauguuacacuaugcauguguaggcuuacauguuccaguaugcauauaggggucagagaacaacuguugugaguucauuuucucccuccacuguggguucugaggaccaaagucgagucauuaggcguacauagcaagugauuuuugccuaccgaacuaucugguuggccccuggauuaaaaauaauucacuuuguauuacaugacaaauguaauucuguaccuuauuauauuauguguguaguuaaacuugagaaccagucuuuuaaucgugauuuaacaagcccauuucuguccuuuccccuuaguuuuuguauuuuuugaucugacuguagaugaucagucaguuuauccuaaggaauuaagagacgaauacaucaugucaaaaacucuuggaagguaaaguuuauuuucuuuauauaauaaacuaaaacucauuuuuuucuguguauucucauggguuaguuuuuuauaacugauuuuauaacauuauuauuauauagcugucaaacuuuugugauacauguacuacugauuuauuugauaaugaucaguuuaaauaaacguuuuucccuuauaaauuuuaguguugggauaagcgcugccaccaggcuugguuucucugauaacuauucauguguguguguguguguguguguguguguguguguguguguguguguaugaugugugugugcgcaugcggugugcaugcauguguggucucuaugcuugccugugugaggaugcuugugugcagagucccgaggucaguaucggugccuucuucaguggcucugcacuuugucuuuuguagcucacugaaccuggagcuuucugacucagcuucccuuucuagauugcgagcccuagaaugucccaguguucaccacagcagcacugggauuagagacaagcuuuuaaggccggugcuguguauccaaacucaggcucuuguguggcagacuucuuuuucuuuuuaaagauuuauuuauuuuuauuuauauucauacacuguagcugucuucaggcacacuccagaagaguacauuggauucccuuacacgagagccaccaugugguugcugagaauuuaacucaggaccuuuggaagagcaguccugcucuuaacugcugagccaucucucuagcccguagcagacgucuuauaggccgagcuaucuucccagcucuauuuuauuuuaauaaacuuaguaauuuucaacauaggguuuuauuuuguugcccugacuggccuagaacucacagagauucuccugcuucugccucccaagugccuggcugcuuuguucucauguagcuuacacuggacucagccucacugugcaauugagggcgauccugaacuccugauugauacucuugccucuacuuccccagacgggauuccaagccugccucacccugccuaacuagugaugacuuuuuuauuuccucgcgccuuagugaugacuuuugaaaagcagcuuuuaaugacccuaugaaucaccaugugucuguaugugugugggcgcacucgagccucagugaguauguggaggccagaggacaacgugcagggucaggccucuccuauguggauugaauucagucgucaugcuugaugguagaagcuguugcgugcugaguaagcauaagugcuugccuugcuuucuuugucuagugccgagucaugcuuaguguuugucuuugucaggauuucuauuccugcacaaacaucaugaccaagaagcaguuggggaggaaaggguuuauucaacuuacaauuccacauugcuguuuaucaccaaaggaaaucaggacuggaacucaagcaggucaggaagcaggagcugaugcagaggccauggagggaugugugugagauuguaugugcugugugugugauguguauaccguggugugcacuuggaggucagagcaaaggcuucaaaagucuucuccuucucccacauugcagaaauugacuucagcucaucagcaguguuuauguccuaacuugcuuucuguugcugugauaagcaucacaguccaaaccagccuggagaggaaaggguuuauccggcuugcacauccuuaucucaaucuuucccuagugaaucuuucccuaggaacuccagcagggcaggaaccuagauacaggaacugaagcugcuuucuagucugcuccacaauggcuugcucaggcugcuucugucuauaacccaggaccaccugcaucaaucacuaaucaagagaaugccccacaagcuucuguaaaagucaaccugauggagacgcuguuuuuucuauugugguucugucuuccagaugauucuagcuugagucaaguugacaaaaacaaaacaaaacaaaaaacaaacaaacaaacaaaaaaccgaaccaguacaauugauuccucaucagugacauaaaaauauaucauuaucauaacuuuuccuuccuuguuuguccccaagaugucauguucauacuguugucauggacuggggguggugcagcaugccuuuaaucccaguacucaggaggcagaggcaaguggcucuuuguggauucuaggccagccuggacuacacagugaguuccaggacaccuaggacuauguguagagauccugucucaaaagaaaaaccaaaccaaccaaacaaaaccccaaaauaacauaacaacaaaaaccaaaaauuaguaucacaaugugaaacaguccauuuuuuuucaagucccacagucuuuuaaaaagagaauuugaaacuggagagugacuuagcaaguaagaacacugguugcucuuuuagaggacccaaguuugauaaccaguaucugcaugauggcucauaacugccuauaacucuaucagguuaucugguaccuucuucuagucucugggauacuacacacauuguugcacagacauaggcagggaaaagcagccauacacauaaaaugaaauaagaaaaaaaaaaaucucagcaauuuaaaaguucaaguucucaaaaaaaaaaauccaagugucucaacuguggguuccuauuuuuaaagaaaaguuuuauuacuuuaagaaagaaccaggguuacaaucagaucauagcaaaaacaaauuuccacaguguccaaguguucagugcccaaggucugguaccacuccugaucuuuuggacugagaagcugagagcagcuccccaccaguaccacccccgcccuccauagcacacacagcucgucuuggagucgcaggcuggcucccuuucaccccugaugcuguccacugugcucaucccacagucuggacaucggcauuauggagucuccaccugcagcuaagucugcaucuuuuuuagugacauccuggcuucuucucuucagggauacggcaacccugccacacggugccaagcgugaccccuucgugcuuucaaaacucauaucuugugggagacucuugauaauuuauaaaguuccagcuugaaaugcagcauuggacucucucuggcccacggcuuuugugugcuggcccagaagaucucauguugaugauguuggacucuuauuaauuagagcagauuuuuaaggcccagccaacuagcauugauuaucucagugcacaaaagguuucauuucagacucuuuuuguuuacccugcuuauuuguuuuuguuuuuugagacauggcuucucuguuuaucccuuguuguccuauaacucacucuguagagcaggauggcuuugaacucacagagaucugccugccucagucucccaaguccuggaauuaaaggccuuaaucacuuuaccuaaccucucuuucacagauuuuuuuuuuaagauuuauuuauuuauuaugcauaaagcauucugucugcauguaugccugcaggccagaagagggcaccagaucccauuacagaugguugugagccaccgugugguugcugggaauugaacucaggaaguuuggaagaacugucagugcucuuaaccucugagccaucucucuaggccuuacagaaucuuaauugaaaacaucacacaaugacucugauagagucuuaaagggacucugcaauuuccuucugaaacuccacaggccaggccuguuguuugcauuccucucagcauuguuuacagaacaacucaccaaucucugaguacccaguagcuuuuccagcccaaagcuccaaaguccuaaaaucuuccccuaaaacaacauggcugcauccaucgaggcagccacuggaggacuacuuccuguugcugugauaaacaccgaccaaaagcaacuuggagagugaaguguauauuuggcuuauauguuaugaucgcuaccccugagggaagccgauucaggagcucaagccgaguaaccauggaggaacgccgcuuacugucucaguucccauggcucgcacagacugggcugggccgucccaaauucaucaagaaagugccccacagacuuaucuaccagacgcuauaauggaggcaauuuuuuaaaagugagauuccccucuggcagaugaucuucgcuuuugagccaaguugaccaaaaccuacccagaauaugggacaaucauuucuacaugcugggauauaucuugucagccccugcccuucugagguaggcaugcaauuuaguguaaaauauuuaguucaaucccuaacagaaaaaagagagcugggcaagguggaggcauacuuggaauucaacaacuugaaaaauguagcaguaagaucagggguuuaauauuauccuuggcauaauaguuguuuaaggacagccugagcuuccuaaggcuuuugucucaaaagcgaggggugaggggauaguuagggagagguuguaaugggauguuccagcuccuagagaaguuaagugcaaacaaacacaucaagauccagucucagauaaguaauaaagacauacugguaguugcuauaccauggaugagcuuugaaagcauuaagcuaagcgaaagaagugugauuucauggauaugaaacaucagauaauuuuuaagaaagccauuuagugaucgcuaggggcaaagguauagugguguuucccuaauuggaaccagaugguagcaguugcagagcguuggauauauacugacuauggcucaauccuacacuugaaaaucauuaucauggcucauuuaauguuacauauacgcaacacaauaagagagaugugaagccuuuucuauacucacucaaaacuggucauuaucauagcucacuacagacagguuguaugcugcaguggucguugcuaggcuggaccuuaauuuugcugaacaggcuuacuguggcuaagaauggugugcauaacauccucugccaucggugguccccagugagucagaaaucuuugaaagaaaugcuccuacaggaugaguaauuguguagcgcuuucugacgugguauaaggugaaauucaugcuuccaacuauguaugcaaauuguuuguuggucauuguuuugguuuuuaucuuuuguuuguuuguuuuuguuucucuguguagcccuggcuguccuggaacucacucuguagaccaggcuggccuugaacucagccuccugucucugccucuggaggcugggauuaaaggcuugugccaccaccuccuggcuguguuuuacuucuuuuaauucaggccuggauggccuuggcuuugguuugaugcucuccuucugucucagccuucucagcucuugaaugacgguuaugugcuacucccggcauggguacucauuuuucgaucaggaagauucuucuauugauauuucucugccccccccuagagaaaguaaauuuucuuuuuuucuuaguguuuuucugggaauuucacaaucaagggcucugauuagacugaagucacuccaagcucagugcugcuggaugcucuucaucuccgugugcucuuggcaguguacucuggugagguuucaguuugagcauagagacaaugaaaaaaaaaauguuacauggacaauauuuaauuuccugucugugugugugugugugugugugugugugagagagagagagagagagagagagagagagagagagagagagagagagugcauaacauaacuucauggccacagaauuuguguggaggucagaggacagccuuggguguuggucuugccuuucugccuugagacugggucucugucuguuucugcugugcauguguggcaggcuguccuacaagcuucuggaagagguuuuuuuuuuugcuugguuuacgugggugcuggguguuugaagucagauucugcauuugcaugacgaguaccugaacagccuccucagcuccuucuuuucuuccuaucaaggccgaguuugacaugguauguuucaugaugaaagucaucgggaaaagucacugucuguguguuuccccuuaguggugcguguggggagguaaagauggcuuuugagaggaagacaugucagaaaguggccauaaagaucauuagcaagcggagguuugcucuuggcucaucgagagaagccguaaguaccugugucgggagcugcccggcucucacacuuccuuaaggaacccuggagcacgucucagccuccggaagcuuggguggcuuagauggagcaauuuuugacugucaaacagcacugaacacuuuuuaagugucuuuuauuuaaucuagaaacuuauuuguaauuuaguucuagaaauaauugguuguauguaacccugugcauaguaacaggcuuuuucuuauuuuaaagucgcuaugaagggauaggggagaaagggggucuaauggccagugcagccucacagcugccuucagccucucucaucuugguggagacccugugguguuuagagacaggugaauucagcucguauggacagcucaccuuuccauuaacaaugugcccaccucgcagaaacugcuucuagucgcccaucggcuuuaucuaagcaccgggugaaguaaugcuugggacauuguagcagaaaugaaacuuuuugagaguuaaggggucuagugagaaggaaaaaauaaucucaggaaagcuagguuuaauccugaccuaagugcuaugcucaauauuucuuuugaaagcguuuguuacaacguguaaagugcucaguaucuacaguguagcauuuucacucauucuacaaauuauggcggauacuuuuuacuucaaagcauuuuuuuuuuucuuuuugagauuaugacucacauagcucagacuauccuggaaggcguccccugggaugcuaggauugcaggcaugcgcuaccacuccugacggagauggccccauuuuuuuacucucaguuugauggcacaguuccccugacugcaaaucugaauuugaaaauaguaaauaaggagaaauaguagucucuuucucuacgccccgcagaccccauuugcucuauaaggucuuggguguucuccagacagucaguugcauuugagggacuuugccugauaugauccgguucugaggugaccacuacaaauguucuggauaauaucagacagacuuaaacugauucucaaagacaucacugggaaggaaugccccaaacuuccucauaauuuaugcagauaauucuuugcuugguuguugagguaacuucaaauucuuugcucuuuuggguguuguggcgguggcuaggaguuaguuaguuauagaaacacauuuuuauaaaacucuggaauuaaggaauaccagaccaguacucuuccauggagaugacauuuuuaauucucaguugcagguuuuuagaauguaaaguguuuuuaugcagcaacuauuuagucacuuuuucuguaauccacacugaccgaaugagugaaguggccaacuguauuuuuuuccccacauauaacccgacaaaguaaaguaaaagcagcgcccaggcacgucuuccucuccagccagcuguuucuggcuuuaacauucuucaaauuguuuuucccaagauaauucuauucuuacauggcaggaggaauuuccggucuguguucaauuuguuacagaucuuugaccucacaauucuggauuugcuucccauuuaggggagaaaaggauaucuccuagguuguugaaaacuuagaaccaauuuuuuuaaauguguuuuuauuuuuuacuguuuuuuuuuuaagauuuauuauuauauguaacuacauuauagcuaucuucagacacaccagaggaaggugucagaucucauuacagaugguugugagccaccaugugguugcugagauuugaacucaggaccuucagaagagcagucaguguucaaaaccacugagccauuucuccagccccagaaccaauauuuuuuuucuuaauuguucucuuccagucauuggacccuguaugaccucucuauuaacagaaccuccucaccccugccccugcaauguaguaaugagugugagaguggaaagaaaaggucuggacuuaaacauuuuuaaucugggguugagggauagagagaugcuucagugguuaagaacacuuguugguccucgagaugauccauguucaauucuuaggcugccaugguggcuuacagcaguguguagcccuaauuuccugguacuggacauccucacacaggcacacaugcaggugaaucaccaaucaauguacauaaaauaaagugaaaaaaaaauuuauaaaagauuuuagggcuggagagauggcucagcaguuaagagcagugacugcucuuccagagguccugaguuuaauucccagcaaccacaugguggcucacagccaucugucaugggaauccaaugcccucuucugcugugucugaggauaacgacaguguacacacaauaaauaaauaaauaaaucuuaaaaaauaaaaauaaaaaauaaaagauuuaaaaucuggguuucuuagcugaagucuauuuuacauaaauauguagucuagcgucugcugucugagcagagccugguuuguaacucagccauucuaaaugaaguuuaacuguauuuuuauuauuacuguuguacucuaaugcuauccuuguuuauuuaaggacacagcucccaguguggaaacugaaauagaaauuuugaagaaacuaaaucauguaaguaucauugucacucgucguaacuugucucaaaauauaggaaguauacgaaguguugcuauaggaggcuaauuugggcuccuuuguauguuugugagaagacacguggaccuggcucuuauucaccucugacgaguuuuacuucaaaguuuuaagaauucaauccuguguaaaaggcuucaugacuucaugaucuauuacucgguauuuuuauugagaucuugagaaaaaccuuauaaagguuaguuauauuugcaaaagaaaugaaagucuugugaaguuaguuauauuugaaaucuggguccuuuuaaauaccuuuucuuuggaguaagugguaucugacagauaagaagcccauuguugcaucugauucguaggcguggggagccuuguuggagauaagugguccucaccuacuuuguaaggaagacucgauaucuguggcagucacagggcuguagcacaagggucugacaccggcuucucuuuccugguucucucagucucuucauuaguuuaugagaacccauaaugcacgcuuaguaggugcuggaguuacuucuugccagaguaacuaagaauccucuucucuuuuagccuccaguuagaagauuuucuuuucucucuuccaccuccucacuuuccucuaagagcuagaaaguuuauuuauucuagauuucuguguuugauacaaugucuccacagccuguuuacagcucgguggacccucucgcuaacucuccgcacuccagcggccauccuuccugcuugccuguucccgaccucacacguagcagcuucuucucuucccccuccuuuccuucccucucucuuugcuuccguuucccuucugccuuuucacccccuccucaaucccccuucuuccuuuucuuucuuuuuuguuguuaggagacagccccugucuuguuacccuggcaagucugggaauacuggacucacgugacccuucugucuccgccucuugaguggaguuuguuuuucuucuuuucgacaggaacuggcugaauuggccaggcuaggccccgauuccuggcucaagcaaucuuccugcugcagcccgcuauggccaguuuuuuuuuguuuuuuguucuuuacaaaaaccacauuacuguuggcagaaugacucggagggugaaggagcuugcugagaagccuggccaucugaguuugauugcuaagacucacauggaagaaggagagauccaguucccacaaguucuuugaccuccacacauacuccauggcaugcacagauacaggcaggcaggcagguagacagacagacagacauaauuagacaaagaacaccgcauacauugcacuuacguaccaucccccuaaauguuuuauuggucauuucgagccuuauuaagguggaagucucucaccagcacucggcaguguuuccaaguccaugccgggaagcugugggugcucgcugaugcaggaagauggauguacaaagcgaaaguuacagggacccaugaagaacacggcaauggagucucaccucuuacaaucucaaaccugaaagaauuauagguucuuucuuugagucuccugugaucaguccuccaugcuggcuucuguauuccugcuagauucucugaggucuguuucuuaccugccacugagcuuggcugucagcuuuaaacacaaguaugcuaaguagaaaaucguaaugcuaagucuagagaaucuaacccuguuuuaaccuacccacagcacugggugcccugcacagauaguaaacauaucauccaugcuucaaagucuuauacugugagaggaucuuaucauacagguuccauucuccauggcccuagugcuggagccgcaggaaucagguaucuggaaguauaauuaggcuuccuuccucgccuucuuuguuauugagacagggucucuuguugcccaggcuagccuugaacuugcuuuauagcugaggcuggccuugaauucuugcuuuuccuuccuugccuucccaagugcuggaauuacaaaacagcuuuuugggucucucaucuuguguccuguugagaaaaagggcuuugcuccuaugcugggauugaacuucagauugcaggucugcugagaaaauaucccaccugccacccgccacccgccacccgagcacccagcuccugcugcuuuuccucuugucagguuccuguuuugacaaaugaggaggaagucugggaaaaccugcugucaugccuaggcggggcuccuaugcagacacgaauuauuccuuacugacucuguaugaugguguguuucuugugugaguucucugugaggagucagccaccuuccauucugccagucuccugugcuugacucaacagcauccccagacaauagguuuccugucuggaguuuucucacuucuccuuucuucucucccauagccaugcaucaucaagauuaaagauguuuuugaugcggaagauuauuacauuguucuggaacuguaaguaguaacguuuaaacucauguuuccguguaagacuuauaaaccaguaaagaauugaaugcagauuagccaggaggugguggcuuacuuuaaucccagcgcucaggaggcagaggcaggcgaaugucugugaguuuguggucagccuggucuacagacugagucccaggacugucucaagaaaacaaagacaaauauuuuaaauuuaacuuuguuauuguuguuuagcgcagagggauuaaguaguuuacccaaagaccuauagcuuaugaagaauucaacugggguucaggccccaguugucugguccugcuugggagucauauuuccaccccaucagcauguaggaaccaugugggaauguagaucuaugggccucucuccagauucuggaagcaguuuuuuuuuuaaaagauuuauuugccggguggcagugguggugcacgccuuuaaucccaacacuugggaggcagaggcaggcagauuucugaguucgaggccagccuggucuacaaagugaguuucaggacagccagagcuacauagagaaacccugucuuggaaaaaaaauuuuauuuauuuacuuuauguauaugagcaugcuguccuugacacaccagaagagggcaucagauccaauuccagaugguugugagccaccaugugguugcuaggaauugaacucaggaccucuggaagagggauuagugcucuuaaccgccgggccaucucuccagcccuggaaucagauuuuuauuuuuuuauuuuuuuuuaucuuugcguuuucaagacagaguuuuucuguuuagcccucacaguccuagaacucucucuguagaccaggcuggccuggaacucagagaccugcuuccaggugcugggaucaaaggugugcgccaccacuauccugcuagaguuagauuuuuaaaaguucccaaagaagucuccguugcuuaccauauauuccaucucucacucuuuuccuacuggggcauuugauuauggaugaggcguaugagagaucauuacuuuguuacgagauuuauguuugauuauuuuuagcuaugugucugugugagugugcacaugccuguagaggucaggcgugggcuuuggucuccugagauggaguuacagguacucgugaguuggaccugggugcugaagucuggucuuccgugagaggaaugagagaaaucaggaugcaguccuccgaggugggguugaggaguggguuucuguugugcauuucagggagagcagaggcagaggcagcuagaagauuccagaguagggacaggaaguagcagaugaaacauggccaagggacugaaccuggccaugagagaagagagcagagagggagaugggagaggggaggaagacggggagaggagagggggcuaagagagcucauagcugaaauggcagaguuagaugggaaugagagguggggggaggagggagcucaugagcuggagaaguuuaggguagggguggggugaaaagagcugugaggagccaagguccuuugagagugaguagagugagccugaggccagccggugcucuggcaugcugauagccucuccuugugaguuuuucuuuggacuaccuauuucuccagcccucaagaaaaugacuuaugggcuggagagauggcucagcaguugagagcacugacugcucuucccgggauccugaguucaauuuccagcaaccacaugguggcucacaaccaucuguaaugggaucugacgcccucuucuggugugucugaagauggcuguaacuguacacauauacauaaauaaauaaaucuuuuuaaaauagcaaaaaagaugacuuauguauucauuaugaauuuauuuauuuuaguuuuuuggagacaaggcuucucuuuguagccugacugagcugguacucauguguagacuaggcuggaccaccuuaacauagagaucagccugccucugccucccaagugcugagaugaaagaccugccucaucaucgccuggcauauuuauuuauuuugagaagaccucugguaccucuggcuggccuggggguuuucagcucugccugagugcugguguuaaaggugugcuccacucuacccagcuaaacucauuaauuuuaaaagugauaucaagacugagaaaaacaggagccauguuuuaguguuggaggugcaggccggggcuucugacgugagacaagugcucaucugcucaccccccccauccuuauuuuucuggacaagaugaguuuauuucauuggugcugugcaucagggucacgugaagguccgcucuguucguguuucaggauggaaggaggagaacuauuugaccgggugguggggaacaagcgccugaaagaagccaccuguaagcucuacuucuaccagaugcuuguagcuguacagguaagagaagcccuccuguggccagcaagggccaagagacugagguucuggguguuugcugcucuguucuaggccaaaaaaaagacaaaauuccuucuugucuggggucuuucuggaggggcauugauuuugcaccuaccugauccuuguggcaaugacuuaguuugcagaauguaaaggugagcgagaaagcaaggcugaccaguuggggugguugagggguguuaacguuuguucuuucacaguucaguaauguguuccacaagaacggggaggacucaauacuuucccgcgauccuagauuccugucacaaucccuccccaccuuucuuuucuuuucacaguccuggggaugaaacccauagcccaaaauauguagauguguacacacacacacacacacacacagagcacucauacacccugccaacaccacauacacucuugcacacaugcucacacucacauacacucacagcacucacacacauccacagacucagaacacacucucacacacagauacacacaccacgaaacaccacaaacauuauauucauacacacucauaacacaaccacacacacacuacauucacaauacacuaucacacacauauacacucucacaccacacucauauguucacacacacaccacacacuucucucucucuuucucucuuucucucuuucucucucucucucucucucucucucucucucucucucucucucaaacauucacacacucauaccacauugccuguaucccuggugauuacccauagcucuuuguaagcugcuuuuuuuugagcuuugguuuuccugauuucaccucccaagugcuuagaggacaggcagacaggcaugcaccaccucgcuuggcuucauaguucacuuaaaaaaaaaaaaaaaaaagauuuuacuuauuuacuuuauuuauaugagcacacuguagcugucuucagcuacaccagaagagggcaucuaucuuauuauagaugguugugagccaccacguaguugcugcgaauugaauucagaagcucuggaagggcagccagugcccuuaaccucaggcccaucucuccagccaucacagcucacuuuuaaugauggcugucaggugcacaggauuuugauuacuuaucaauguuuaauuuccuuguauacugaccaacaacuaugaauugcacacaaaucuauagauauaggacauuuuuuauuccuaaagaauugauauuuugucuguuuucauuuuucauucuauuuccaacaagagaauuuuaaaguacuaaagcuagucuuuguaccucaaggauagauuaguaguuuaguuucugguuauuuuugguguuuauagcauuggggguugaaaauaguucaugcuaggcaaguccuauagcuucagcuuucagaguuucucugcuuugugugugacugugugugagaguguaugugagagugaguguguguaugaaagagugugagugugugugugaaagugagaguguguguguguguaugagaguguaugagaguguguguauaugugaguguugugagaguguguguguguaugugugagagagugugugugugugaguguguaagaguauaugagaguguauaugugagaguugugagagugugugugugugagagagagagagaaugugugugugugugugugugugugugagagagagagagagagcuuguuauaggacaaccuggagaagucuguucucuuccauggugggcucuuugugacuggagguuuucagguuuggugucaaguaccuuuaaaauacucuuagggauugaauaacaaaauguguaauuuugauggaauuccuaagauauguuaucauucauuuaaauguuuauugaaacagacaccaugccugucugugaggggauuuuuguuuucugucuuuguaaaacacaagcuuuaccauucuaagacgcucuuuucauuuuuaugcauuuuaaagcuuuuuguaacauaaauuucuaagugcucaggccugguccagcucugacuuuuaggaugcugcugcaccauauagcuuaauauuacccaggcuaagaguuagcuguugguaacugugucuccuuacauguguacauauaaaccaacaguugccuguuuuuguacaguaccuucacgaaaaugggaucauacaucgggacuuaaagccggagaauguucuuuuaucaucucaggaagaggauugucuaaucaaggugacaaugcuuaaccucucuguggccacuuuuaauuucuuauauuaaaaacaaauaagaguauuaaaagguugagaaucucacuucccaaucuuaccaguuauuguugagacggcccaguguuccaccuaucuaaugggcaguuacugaacuccagagcauacaagccacuucuguguucggagggagggaagagggucucaauggaccauugagucauggaguccgccuuuccuccugagccuagcuucauuuuagaaucuccuguuacagucccaagacaaaaaacaacaagaugaccccaaaacguaaaacuuuaggcugacaacaggugcuuucuuucuccccgagcucuccagaugucccauagugucgugagacuuaagcguuuugggugcaucaauauuaguguccuaauguguuuguggcaggggucauaaaguuuuugucagauuauaaugaucauagguaaauuauuucucagguuccagggauuuuccuuuaagcaaaauuuaauacauuacaaagacgugaaauuguguauuuaggguuaaugucaggugucuguaugacagauaauccaguuuuugugucucuugggaugaugggcuaugauaauguuuggauuucauuuguuuuguuuaugauuuuuagaucacugacuuugggcaguccaagaucuugggggagaccuccuugaugagaaccuuaugugguacgcccacuuaucuggcuccugagguucuugucuccaacgggacugcuggguacagccgcgcuguggacugcuggaguuuaggaguuauucuuuucaucugguaggagacauuuucauggcuucacagucugguuggaugaggugggacaaaaaugucccugugucuggguagagggcuucuguuugacucaggucauuucuuuuugaagguugacuuaagaaaagcugauuuuuuuuuuuuuuuuuuugccgggcggugguggcucacgccuuuaaucccagcacuugggaggcagaggcaggcggauuucugaguucgaggccagccuggucuacaaagugaguuccaggacagccagggcuauacagagaaacccugucucaaaaaacccaaaaauaaauaaauaaauaaauaaauaaauaaauaaauaaagaaagaaagaaagaaagaaagaaagaaagaaagaaagaaaaaaagaaaaaaagaaaaaaagaaaaaaagaaagaaagaaaaaagcugauuuuucucacugccgagaagaagccuguguauccaaugccacugagaaugccgcuugacuuuuucccuuucuuucucuaccaacauuaagccuaaguggguauccaccuuucucugagcauaagacccaagugucccugaaggaucagaucaccaguggaaaguacaacuuuauuccugaagucuggacagaugucucagaggaggguauggauacggaagggucacagaggugugguugacugccauguggguguccuguuggugggaguuucuccucagacugcuguuuuucucccaucugaucacuccgcugcuuugcaccauuugacaggaagaggacaugauuaauaagagccuggguuucagagccugaguguuagguucuaggucugcuacuugucuguuuugugcccuugagcgaguugcucaguguuuuugagucucucuuuuuuuuauuuguaaauaagugguuaauagcccagacaugaaagguuuugugugagguuuuguauaacagagucaagggucugcucccuguucaagugugcagaagcuucucaggaccaacauucuucgaguagauagaauguuagagcucagugucaaagguuaucucugaguuauaaguuaaaagugcaaccuugcaccucccaggagaaaagugucuagucauauaaccuaggugauugcauuaaauaucagggguuuaaggaagaauaucgcugcgucauggggcauacaagccagccuuuggcuguugcuugcuugugagguaggacuuuauuuuaacuuacuuauaaagagccccucucuggucucucaccaucaagcaaugggacucaagcguuucuggcccaucgugagagucucugaacuggguagaaguucaguuuagauuugccugaacucgagcacgacaaggaacaggaaggguuaugaugucugagcagagagagauggguacauccucauucuucaggucccgcucuccuguguucagagagggaggggcuuagagggcuuucuccauccaaucagcuugucccaugcugcucucuucucuggcuggcggucuguaguucuggcauaguuuaauaaugcagguggcauguauuuauucuauuuauuaugauuuccccaauucucuugcugcuguagcucuggaccuugucaagaaacuguuaguuguagacccaaaggcucggcuuaccacagaggaggccuuaaaucauccguggcuucagguggguacgaggcaguuccuuuucgccuaaaauucagggaaagucccacacugcuuaggugaggugaggcugagggucucugugucuuuggguucauuauguaaguguuuucaaucaggguguagguaaaguguaugugcaauuguuuuuaaucaguacacacucgcguguggcagagggagagaggggagggagagauggggggcgggaaaugggagaagagaggguaaaugaauauguguguguguugggugucagcucuuuccaugcaacuguuggcguacuucaugcuggguucugguuccauuugcccugagauugcaguguggcugaaauuccucugagagcuuugucuuccucaacugccagcugucucccuuuucuaccccuccucugccugguggaucagacugugcuaugguccagacauuuuuuuuuuuuuuuuuacuuuuaaucaaaaaacuggggcagguccaggaaggcagugucccugagggaacccagccacuuccugagccauguuuuaaaggaugccagucuuguucccggugaacaagcaugucaccugcacccuuugagugugcaugacaucucuguucacaugucccuguugcuuugagaguuuugugccaggcucacucaaagccugcugccaguguaagagcgucuguaacucugggagauuaaucguuggcuuggaauuaaucagcgagagcauccugcagcuucucuuguagaugucugauuguauucuucaucuuggcuacacuuuccugugaacauccuuaggccucuguuuccuguggggcugggugacaucacuagguggcuggagcuucccccccccaacuccccaucccccaucugugguucucaguucugggaacaccuugaaaaaucccugcuguccuuaugggacucuggaagauuguccccuuucugucuugcaaccauccacaccuaaguuuuggucugacuaguuuagguagagaacgagaaauccuuaaaagaaggagggcagcuggaccugagggggaugucuccucaccagguccagcacaagaucugauggcccaaguuucauccccagacuccacaaacuccugaaaguuauccucugauucuacacacacacacauaagauaagugaaaaaugcaauaaaauauuuuuuaaaaggcggagggugaggagugguggggggaaagggacagaucuauguguuuggguuguugcccuggaaacacgauucuccucgcagaagaaaucugucaggugacuuaauguuuacucgaccacacagaucugaaagcagcaagggccuuagagacaaggagccuggaaacaaaggugucuuugcggguggggguuuaacucugaugaaaagagaagcccucccuuuggcucuuuucacaugccuuaauagggcagcuucuggaauccaaacggaggcagacacacugcguuggcuuucuguguuagcuuuggaaaaaaaaaagcacgggcuggccaguuaggccuagcaacaggguuuguguuugccuaagaugcaugagucagugcagcccauuuugcuugaacuucuuuuuuuuuuuuuuuuuuuuuuccaagacaggguuucucuguguagcccuggcuguccuggaacucacucuguagaccaggcuggccucgaacucaaauccgccugccucugccucccaagugcugggauuaaaugagugcgccaccaccgcccggcuugcuugaacuucuugucucggaaaaaaaaaaaaaaaaaauucuguuauucacaaguaauuaaagcugaagcucagcucuccuucgcuuuugauaaaauagaagaauccuuccugcuugcuuuugagggacguuguaacuuaauaguuuugggugugaugucuccuagguuuacagaaaccuugcugcuugcucucauguugagaugcuuuucucauguuccuguugaccuguugcuucugaaagcgugcagauggaugcuugugaaugcgaugcagauggauacucgugaauacgaugcagauaggugcucgugaauaugaugcagagauagaugccacaggccaugaauggcccuaccagauaguguccagaagaaggacguuugugcuuauuagcuuucuguuagcuguuacacaccuagagaaaucaacuuagaaagagaaaaggguuguuuuguuuacuuuuaugggggaggucaguccaggauugaugugagaaaacagaggaagaggcuccggggagucagcucaauggauaaaguauuugucucacaaauaugaggagcugagagauugggggcgcagacuccccugcagcucacaagccaguuagcuugacuguacacgguggugagcaacaagagacucaaacgagauggaagucgaggaccaauacccaagguugaucucugaccucuacaugcaugcuacagcaugcuggggagaccugagaggauuuguuuuauuuuuaauuguguguguguuguguguguguucuugugugcaugcguacauauaucagugcgcacccacuuuguuuuauucacacauucaucucuucagagcaccguucagguuugaaacgcugcuaggcccaugauauacagagcagagcaauacacaugaguguaguauaugagcuuggugccauccagacaggcguucugugagccacucaagaguaaccaguaagacaaggaaguaggugcuggcucccacaaaaucucucguguuggaagccuuuuaucuuugaugccaugagagagguagaaaaauagagagagaaagugcauggggugcuaaguugacaaaguguaaaugggaacgguuucagacacacaaaaacucaccucccucugccuccuggcuacuaugauugaggugugugcagucuuuuuuuuuuaaagauuucuuuuucuggccauaguugugcuuuccuuaaacccagcauucaggaagagacagagacaggcaggucucugugauucaaggacugccugguuugcauagugguucaucccaggcuagccugggcuacagagugagaccauguguaugugugaguucaaugccugaacaguccagaagaggacuuagauccccugcuccugagggauuacaaacgcuuguaaggugcuugaugugggugcuauaaaccagaugcagguccucugcaagagcgguucccacucuugccucugagcaucucucucuagucucuaccuagauguuuuaugcuucugagaacuuggaacagugccaggcugccucccagagcuucugcgugcuugugcuugaacccugugggacuuuaccaugagggaagcgggagcuaguuacguguguuggagaagauuucuccuuguuuauggcuccccugcuccaccucuccuuccuauagcacagaauaccuacaguauuugguccuguuuauugccaucccuuccaugagauguggguccgagguuuuuuuuaggcucuggcucaucugucaacuugcuucucacuugcuggauuagcuguucagaugaccugcaaaauuagcucuguuugugucagggagggaggggucugguucugugaggacuagggguggcacagugucaaccuuguguucuggccuccugacuaguguuccccacagcaugcugcugguucugcaccauagcuggggucugguucucugguugguuaagagcccaggacccuugaguuugauguagcgagugcugauugagcacagacuguuccaagaaggcagaggcgaacagccaagucccuucauuaggaaacuucugcaaagguaugagguuugcugucaggaagguagccuugggcauuucccugucacucugggagcuugcuuugccuuauaugcagccuaucucuauauaccuuuugauuucuucacaggaugaguacaugaagaagaaauuucaggaucuccuggugcaggaaaagaacucggugacccucccuguggcucccgcccagguauucugaugacuucacuguggucuaggauuaaguugccgaugagcaagucugaugacugaacuuuccguggggaggcaggugcucagcuuuuaagaaaaggauuaauggcaggcuuagugacacauacauauacucuuagaaggcugagauagggcauugacucucaacagaggcaggaggaaugggacccacaggccagcuugcuugcauaauaucauguaguaauaucgucucuacuugcuggccguacuugggauugaaccugcggccuaaugcugcuuagguaagcccuccagcccgagccaguguuucugcguuuuguuuugauaugcuccugcagcccuggaagacuuaauaacgcaggauauguugaaugaauuggaacauuagauagggcuugccaaucuaacggaagacggaagauccuguuagaggcacgaauuuaaguuuucagaaaguguaagacuuggguaaguagucuaugaugguuucuguuuuaaacuuucuguuguuagaaaguaaaaguuuugcuuuaccaugguuuuauugaggcaauuucuuguuugguuugguuugguuugguuugguuugcuuuuuuuuuuuuccgagacaggguuucucuguguagcccuggcuguccuggaacucacucuguagaccaggcuggccucgaucccagaaauccgccugccucugccucccaagugcugggagaggaaguuucuugauugcaguuuuaucauuuucaaguucuuuguaaguuauaccugaucagugguauauuuggucagugaucucgauccuuuuuccuuacuguucuuucuugaauuuaugaauaggaaaagucuaaguagcuauaaguagacagugucaggagacagcaaccaagcaaagcuguuggugcugccugcuguccacauucggauauacuucagccuacggugggaucauauucugaggaacucaucucaaauggaggcauuuuaaauagaaagugcauuuaacgauaauagcugguguggcacaguagcgugugugagcucccugguaacccugugggagccgggagcucuggcugcuuuacaaucauaccucacccagaauuuugcuaggaaagauccaauuugaacuugcuuuugugucacuugaaagguuuuuuuuuuuuuuuuaaguggcuguacauuuauuagugguuagaaaucgccagggagcauggauaagcaucuugauuccagaggugugugaggaggauucgguugucaugacaacuagucauuuccaugaaaugccccuaguuuacugaacuaugaggagcuuugauagaagcugugcuuucucuuaaacacuucuccuuuugcuuuauuuccagacuuccagucaaaagcggccccuggaacuggagguggaggguaugccgagcacaaaacgccugucuguguguggggcuguguugugagcuuugaaugugaaagaaaugugcuuccuuccacgcuccaauugucuucuccaucuugacaucuuuuuuuuauauguauauauuuuuuaaaaaauauagccaggcaguuguggcccacuccuuuaaucccagcacuugggaggcagaggcaggcagauuucugaguucaaggccagccuggucuacagagugaguuccaggauagccaggacuacacagagaaacccugucuuggaaaaaaaaacaaacaagaaacaaaacaaaauagccuauaugauggaacaauugcuuuuccaucacagauacacgauuaaaaaacguggaaaucugggcugauuguuugaugaccugcacuuuagauuucuuucuuucuuucuuucauuuuaagaaaaauguuagggggugguguugagagauuaacaccacuccuguugagggcugcaguucaguucccagcacccauguaacuacauuucuggaucggaugcccucaccuggccucucuggucaccuacuacacauguguucauguacacagaaacacauaaucauuaaaaagaauauucuaaaacaauguuaguaguuuguuguggcuuuucaucuggauccucacauugccagucugcccuaucaggaugucacucugguuuuaggcucauccgucuaaauaca

SEQ ID NO: 2601 - RNA, 552 nt, Mus musculus
ccuaagcagcagcagcagcagccaccaagucagucugaagccuaguuguccccugcguuaccccgagauagccuccacaggaaauacaagcccagagagggacaugacuaaucaggagccacacagcuaacaagagacccacuucaugaccccacccccaccccccaggcuuugacuuggcagcugugaaugggguagaaggguaggugaguccuucuggggaagguuucccaggggaaggcuugaauauguucuaggucuuggcuguggccagucuguuggggggagggggugucuuacuuuagcucugcugcaugcugugugaccuugagaaagagaacaaacugcucuguguuuguuuccccuacacacaggaugcagaucuucacaacgcuuauguccaaggguucuggugagaacagaaugaaguagcugcacugcggcacacucugugcucacugaagaacauggagggggugcacacaccugugauaccauguggcagaaggaaaccaucugccagugguacuuagggagcauggagagcccaag

SEQ ID NO: 2602 - RNA, 8370 nt, Mus musculus
ugaguugguggcaugaguguuuaauuuccuucuguggagggaccuagaguacagaauaccuauuuaccuccucagugggguucccccuccacacacacacacugaggacugugacccuuggucaggauacaaaggccucucccuaaggacagcacugcuguaucauggucaucccacucauccugcagguggacaacuggaacccccugacagacaccguucccauccacucguggauccacccguggcugccgcucaugcaggcccgccuggagccacucuacuccccugugcgcagcaaguuguccagcgcacugcagaaauggcaccccagcgacgccucagccaagcucauccugcagcccuggaaagagguccucaccccuggguccugggaggccuucaugcucaggaacaucgugcccaagcuggguaaggacauggggacuugcgggccgagugcagccucaguguccacuaugagguauacuccuuagggcagagguggacgggacuggaagcaggcccuuccugcuguuccuucauagcuugaccagggucugcagucaugacucuggacucucugugcuuugucugacagggcugguuugaaugucagaaccagaaagccucuggcccccuauuuuuuaaggaauuauuuaauguaugugagaacacuguugcugucuucagacacaccagaagagggcaucagaucccacugcagaugguugugagccaccgugugguugcugggaauugaacucaggaccucuggaagagcagucagugcuguuaaccacugagccaucuguccagcccuggccucuuaagugcuugugacucaugggauucacuguggguggagacugaagagugugccuugcugucucucuugcaggcaugugccugggagagcuugucaucaacccccaccagcagcacauggacgccuucuacugggugauggacugggaggggaugaucuccgucuccagccugguggggcugcuggagaagcauuucuuccccaaguggcuccaggugagcagugugguccaggaggguccccagugcccucugcuguccagucacagaauugccucagcucagcuccucagagaaccuguuggggauguggagaucaaggcuuuagcacauuuaggccacaggcuggcuccagauucuccugguaacugcuagaagccgcagcuucaugugcccuguagugugggaugcugggaggagcaacacugaacacaacaguagccccgggaacucugcccucccugccgugguccaguguguacaucaucagcucagaguccuguguccuuuggcaggugcugugcuccuggcucaguaacagucccaauuacgaggagaucaccaagugguaccugggcuggaagucuauguucucagaccaggugcuggcccacccuucugucaaggacaaguucaacgaagcgcucgacauaaugaacagggcuguguccuccaauguuggugaguagauaucuaaguuaggcugucauugcugugacugacaccaggaccaaggcaacucuuguaaagguuugcagguucaguccuuuaucaaggugggagcauggcagcauccaagcagguauggcaagggaggagcugagaguucugcaucuuguuaugaaggcaaacagaagacugacucucaggcagcccacacccacagugacacacuucugggccaagcauauucaaaccaccacaguaguuugcauuugggucacccugugauccacuaaucaccauacucuagcuccccaaaugcauuuuccauguaaaguuuaaauuauauguuuauguaugugccugguggacagccauaagaggguaucaugggccuggaguuagagaguuaugggccaugugaagggggagcugggaaucaaacuggauucucugaaaacauacauauuccuaaccaaugagccccauuuucuguucuacagaggggccucugaagcaagggauaguagaaugaauguaggccaugcuagacuacaaggugaccucauaaauggugacuuuagggggccacaugugugggcucagcccuuguccacaucucuuaguagugagagaaucacuucugauaccugauauuagcuacucagcucccagaccaguuuugugguagugacucuccccaagcaugcacugaucauguuagugguaccugggcccuucagcagcaggucacacacagcaugucauccugggguucugcauacccggggucacaucucaucucuguccucccuucucucaggugccuacaugcagccgggugcgagagagaacauugccuaccucacccacacagagcgcaggaaggacuuccaguacgaggccaugcaggagcgccgggaggcugagaacauggcacagagaggcaucgguguggccgccagcuccgugcccaugaacuuuaaggaccucaucgagacuaaggcagaggagcacaacauuguguucaugccugucaucggcaagcggcacgagggcaagcagcucuacaccuucggccgcaucgucaucuacauugaccggggugugguguuugugcagggcgagaagacgugggugcccaccucccugcagagccucaucgacauggccaaguagacaucggccacaccagaccggugugaauaaacagcacuguaaaccaagcugaugaauaacgucucuauuugggagaccaggccaccagggcaggaugugacucaguguccccagucggccuguauuccuggccgggcaaaggaucugguguggugugcaccguggcuccuggcccagguggagagaacuguccuguuacuccagcugagcgaucuguagcuuuccugaugaucuccagguccucacaguccugguagucaggcucuuccugggaugcccacagguccccaggcaguccuuccagcuucaauagugggaaccaguggacagauguaucauuaaaggugucaguguacuggggagucugcggcagugggaccuccuccaggccuuucagaaucugagcagagaggaccagauacgggcauuagguacaccccucucuaucuucaccuggccaccccaccguccuucugagaaauaagggauggggggguuguauuucagcacuuuucagucccaugccagugagacugcugggcucgcccuaaggaugaaggccacuggcacacaguaggagaggcaccagcugguugugcuuagaaacauggacaguguggcuuugcacccucaccccggcccagcuauucugucagacaccuuugcaauguagggguaauuuuccugcagaauccucgccaacaaccuacaaauaaaaacauacauacacaauuaggaaguauauggguguuugcuuucuuuuucaacagguaaaaacuaguucagaaagguugagggauaugcaagagggcagcacaggcaugcugugaagcagaucaggagugucugcacuuaaagcauggcugcccaaacacuucugcccuuggaagacuccuuaggugcuuuaagcuagaccccuaaaccauuuacacagguccucacagggaagcuaggccuggcauuccugcuggcucaccuuuccucaaggccucggaagcuguucccgaugaugagcacccuggacagggcgucugcagaccaguugcuccacagcagguuguuguauagagcugucccacaguguggcauguagaagacagugggcuggcccuggacacugcgcuugccuuccuguggaaccagcagaaugggugcuaaggagcagagugcaaagcccagcucuucuguggcacagcuauauuaguaaguguaagcacgcuggacgucuguaagggacacaaggaacccaugcugaccaaagguauuucgugagaugacuguccccauguccuacauucugggucuuccagauacccugcuucacuacagauccuuaccacaguggggacauagacaccuaauggcugucuggccacaccuccacugugugugccucucccugcagcuucugucaggcacaagcccauguugguguccuauggcugccuccacaggaucugccugugguacuggacaccaccuucugauggcucucagugcauaggccaacccugcuacuguacuuggucucuauaaauuaaaggugcccucaggccucaccuaucugcucuucucugcauagagccagcacacaaaagcgagugcuauagggucucacuauugcucaaagcagcaggaucaugaggcugagaccauccugggcuacagagacccuaaaaguggggggagggguggggggaggggugaauguauuugccaccuaaccaggccaguccaaccucagugauucccagaacucagacaaaacccagaaaggacacacaaauacccauuucugguuuuuuguuuuuuuuguuuuguuuuuuguuuucuuuguuuuuuuuugguuuuuuuuuuuuuuuuuuuuuuuuuuuuuuugguuuuuugagacgguuucucugcagcccuggcacucacucuguagaccaggcuggccuugaacucagaauucgccugcuucugccucccaagugcugggauuaaaggcaugcaccaccgcgaccggcguguuucuguuuuuauuuuuuuaugaguuuuccauaugcaugccugaugccugcaggggccagaagagggcaucaggucuucuggaacuagaguuagagcagacugugagccuccacaugggaaccuuccacugaaagaguagucagugcuuuuaacagcugagccaucucuccaggcucucgagaguuuuguaagccuaacacauuaauucaugcugcugauucaaguuuccacaguauauaacaguccaaaaugggagugacuacugggcucuaagaaggccagcauggcagggccaguggggcaccgagucacaggaagccugucugcuagcagaggugaguggucuggaagagaugaaagcaccuaccucauucucacugaggacagucacgccgagggaggugagaacggaaaccucagucugacugaacagagggucauagacccagcagugacuucuggggaccuggaagggaagaggggcacuucaguuccgggcgcacaugcaccaucugccaggggugggagaggaagacaaagcucaccuggcacuucucuagaaagagaagcauaaaagcaagcuggauccgagcaguggggcaggaggcaaaggucccaagaccguagcacacacacuucacaugggaggcgcuugaagccaagggcuccugugacgcacuaggcaacgaugagccaaggugcagccuuccaagggcuucuguuaggggcugcaguugcuccaacuguuuccuaagacacucggugaugguuucugaaagaucguucccccaauuuuagucacaucccauacucugcucccuggagccaggacugugaaagaagccuccacacccggagugaagcugcccaagaccuguguccaggccacuagaagccggauccuuaacucuacaucuaagaacccaagacuguguuaaaagguuuucaucuaaagccaugugucugagguguuugugcucuugaauucugaagaccucuauaaaggcaacugaauggcuagguuaaaaaccacugcccacaucaccuccuggccuuccuuuuagguuaccauccuaaacgaaagaacacuaagcaagcugguuuuguucacggauguggcaaagccaccuuuguacaguugccgcaggugaggaaaggcuguuccagaaacuuuaaaguccuugucgggaagagaacccuuaaaaccuuuuuugaugguagacgcugccuuucauuuaacaaccucaaaucccagagugggguggggguggggggguggcugcagccuacaggugaggcuuaacugaguuauugaaacaggagccugugauacaguguaaacacugccuguccaucccuggauacaguguaaaccagggccugcucaucccuaaggaccaugcugaagaaaccgaauugagagcaccugcaagggggaaaggucuacacuguaaaggagaaagugggauccguauacaaucuagccaucuugaugacuaauagcacuuaggagagccaugcacuucccaccuuacuuaaugcucacaacuacacugcaggauauacacaccaccaccuccacugcaguguucagugccaaagacacagcucugaggaagucagcaccagaacccaccacaagcaagacugugaagcaaaauguccuuggauggagaguguccuuuguccacuuucagguagccccccuuccacucccacaccuccccuacuaaccccuacucacccagugccgaacugcagaaaucagagauccgcagguccucccuguugagaagacauggccugcucaucucccuucucuuuugugccaucuuagccccgaccaugagccagaugcacgggggauggaggacccucugauacagagccagcccuuacugaaagacauucccauggccuggauguagauugcugaguccuuuuauaaaaaggaccuccaucaagaggcccugguuugccaagggauggucuggguguguucuacuacuuuggcauggcagagaugcaguucaauaaauaaaguccucagacuuucccuuuaugaugggaguguccucucaagacuggagaguagcagggggaaaugaaugagcuacucagcaggaacucaauagcuuccccacuauaaauaacgguaaaaagaaggucaaagaggaaguccaagggucuggucagcugguuuccacagccuaaggcagaacaaucaacagugaauuuaaguaugccagaggcaauguuuagggacaaagaggagagaaacugcccccaggcgaccuacauucuucuaaggaaagaagugcccgauaaaucaaaguacucuguaauauucuaaguagcccugaaucagauucucuaugcucaggagugauaaccacaccccuggaaggaugcugggagaagcagggcauucugggagauucugaagcagcugaggaaacaaugacuaucuggugugcgccuugaagaguucagguccuagacaccuaugucucacuaaucucgagacuuuaaggcacugcuugcuucuaucuguccucucagcugcaccgccaguaauuuauguucagagguaacuucugggucaccaaugcuuuuuaaguguaacuugccccccucaucacagcccuucugacccauacaaaaugcuaccaacauuucuaacuuagcccuguaagaccaaaacuagaaaaggcaagaacacgguguagccuguguauggugggcaccgucuaugugcccuguaagaagguacagaccaagugcuggggagauggauguaacauaauagaguacaugauaaugauuagguggaagcaugggguuugaagucaccaaggccugggccugaaacaaugaucuuuguaugucucucggagugcccaggauuccagugagccugugaaauacauaggcugcaaaagucugcgcacacagcugcugcucaguaaaccauugaugcaaauguugacaucuguguuugcugcaaccucgauuuacaauacggauaauaaccaaugugguguguggcccacagcaaagacgggauauccuccaauucagggcugcugggcuagccuaagcuauaguacaagaucccgccuccaaauccagagcugaugauuuauaggguaaagguucuugccaccaagccucacauuugaguuugauuguccuaaccuaugcagugaaagcagaggucuucugagcaccuucugacacccuccucccccaccucgagcuugggugccagggagugcucuacagucacaucacacaauccucugagcaucccuacguaaugcuuaaacccccaucucaaagguggcagacagggacacaggaugauaaacugccgcagccgcagcgaaugggaauggcagcuuuacugagagcuugcuacagugacaccggagggagaacucagccuuucccagcggguuggcacacccauuuccagguuagggacacugaggcuggaguugccucucggcgcugcacucacucggccucccgcaggcggcguagcaccgcuucgccguccgccuccggcucggcccggggccccucgcccggccgcggucgccuucccgccgcgcgcuuccuccuccgcggagccaccgcgcuccagggcucgagagccgccgccgccaugcucugacgucagcagag

SEQ ID NO: 2603 - RNA, 2554 nt, Mus musculus
ccugucuuggcgaggggugcacagcccaggaaugcaggaggggccucgggagguggccgcccagggagcuggcgucagccccaguuuuuuuuuuuuuguuuuguuuuuuuuucucccccuaagucucaacucgcucgcucgcugucccucggggacuucaugugccagacugcuuacccaccccaggcagcaccgugcaggaacgcgggugagugcgcgcgugugggggcauguacgugggaggcggcugccccggggagguggaggggccgcugccgcacgagccuccagggcuucaggugaagucugaggaccuguggcuggcugucagucugucucccucucccggcagcggcagcgcccuucggcuuccaucuccuugcggagcuaagcagcuaagccucccccaccaagcuccuucccccucuuauccgcucagcagucccugcugccucuccucgaggauggaggacgcaggugaccugcccugagcuucccucaagggugggucuggggcugaggugccugcauuuugguacaagcaggguugccauggcaacuugggggcacagcaucugcccccuuuccuaggcugggcacaaggagccauaaggaugauucauaugaacgaguaucacaugagcucacugugcuuaacccuuaagggcuggagcuugugggggcugauaagagagaagaggguacacacuggacagggaggggcaucagcacagugggacucuggaccuuccagccaggcucuauuccccaucucuguuccuuccacaggugaagagguggauucacaugucgaaggucacacagcaagagcacgaccaaggugcucuuggaaauggcccccuccccaugguugcaagcacgucugacccccccccacaccucgcccacuggcaggccuuaaaaaaauauugacuuuucaaaaugccaggccaaauccaagguugaaauccacaucugcccaaccaccugguaugaucgaugcaccgcccccucaccucucuguccugagucaauauuugcucucuagacaccagacuugccaaaguaaguaucuugaaggcccacccugugacagacagugugugcaggcuaccuacagccuccucuuccuccuccucauuccaaccccccaacuccccacccccggugguccaggcaucuccgguaagagugagcaccuccucuggcccagcucauggcccugugcuguggagggucagagggaugcaacacagcugcugacugaugccaccugagccugauaaaugcucaaaggaucccauuugcuaaaaagggagacugaggcccagagagcugaggcugugugugguggccugccucccagaggcccccaggguccccacuaccccucccacaaugcaucaggguugguccccaagcgccacagugaggaugacucuagggcauguaaggggcagccaugguggaugcucuggaggagaaacccacagagaagagacuagaguuccagcuagaacccagcaccauggcuggcuacuggacgaaggcagguaccugccuccggucagauccagaggacaggaaccauggccagcuucccgacuagagucacugggagacaaaaacucacucagccaagcugcccucagucuccugaucauaauaugugcaaagguccugaggugagccagguucauagggaacuguagggaugaggacaggauggcuuacaauggaaggagggccccugacugaggucaggcugugugcccagcaggugagagaggucagacugugugcccagcaggugagaugucaccccagccugcaccucugcagaugaggaaacaugccaggggaaggccaauccccuucuccaccugagccuggcuccuucccuagccuccaaagggggcuacacccacagucacagccgggguuucuggguucuacaaggaauucacagcaaacuccaggcuccggucacuucauagacuucccagguaaccagggacagacagaagacaggaaaggauagacaggcccuucccaaucuggccccagaaaagccaccccaggaacauuucgagaacgagagggggacccaagugugacaggcuaucuggacacagagauggggaucauucuauccuucggaggggagggggggccgugagaggcacgagacacaucuaaagugaucguagcucccacugaauggcuucaagaggggugcagcaccuguaauauuucuaagagaagccaaacaccccagaugaaacacugccccuuugggauggauagacacacugaagcuggggaccagguugggaugcacaggugucaucggcuuugaaaacaccucagauggggcuggagagauggcucagagguuaggagcacuagcuguucuuucagagguccuaaguucaguucccagcaaccacaugggggcucacaaccaucuguaauggaaucugcugcccucuucaggccugcaggugaacaugcggguagaauguuguauacauaacaaauaaaucuuuauuua

SEQ ID NO: 2604 - RNA, 9038 nt, Mus musculus
ucccauagcaacagggaaggaguucugauaagaggggaaaguguagcaucuuggccuccaccuccaaguccacccagguuauuuauaaccacgcugagcacauggccacuuccuugugucugcguauucaacaucgccagccgucauuucagaggugcacuguuaauuaacuugggagagggaggggaucacccagaaaggaggacuuucuagaaacagcgacgugggccaccagacucccgugggaagcauuucccgcacuauggaaugcaggggcauggcccugcuguggcaaggcaggccuacggucaguggccucucacuguggagccaagcaagcagggccuagcacaggcaggaggguuucaaacacagccuaccugccuggcacccagaaagagcugcauaccaccauucuugccaccaaagacuggauuucaggguuuuggaucaaugagccaccagaaggaacuggaggaaucaauaccuggccccugagagguauugauuucugagcugucagucagccacacauagcugagcuauccccccuccaaggagcaccccaggaucuuagggucacagugaagaggacaauggguuaggaggaauuugggggauucagcuggggugguggugacuguggaaccggcugauuugcugcccuggguguggaccagcaacuuccuggaagauaggccgguuacucagcaccugaggcugggacucuccuagagaaggacggaccacaguucagcagagcaaggcacuuugcugaaccuuuccguugcugaggcucaugacuaaggauugagaaaggacacuaugcccacauagggagacaccucuucccugccuaccacccugguuuucagcccaaguuaugggaaauuguaguaccgccccaggggugaaacagacaaggcucaguagagccaggcagcagugagggaaccauuccggcugguggugggugcagaccuggcccagacucaagacuuguucaaagccaagugccuguguggcucacggagccaucgcuggccuucucugggucuuuacugugugaccuugggcaaguggcuugcccucucuguuugcuuauguuugguaaagagaauaaaauugaccuguguguuaggaaaacacgugugcacugcaccguagagacaaggaaacaggcagggaguggaggcugggggaugucuauuugguggccagucugagugugagaccuguguucccguguugccauggcucaguucacaaggggauaauggugaccacuguggugucugcacccaacuccaucauuuuauccuggcucucccggccccaccccucuccucaaagcagcagcagcagcagcagcagcagcagcagcagcagcagcagcagcagcagcagcagcagcaguaaggcuguuccuccuccuggcugcuggaggacaggcuucucacagcuccacuccugagucaccaucucccccaacacacacacacacacacacacacacacucacacucacucacucacucacacuguuccaggagucacccuaggucauguucuagcacauuuuagcacauaaucuuggcagcucgucugaggaaagagagacacacacacagagucacacacccacucucacacacagacacacagucacacuaucacacacacucacacacacucucacauacacucauuaucauacacucacauacacucaaacauauucucacacacucacacucacacauauccacacucucacacucagacacacauuuacauuuucucacccacauucacaaacacacucucacacucucucucacacacauucacacucacacucucaaacacucucacacucacaugcucacucucucucucacacacacacaauuucacacauucauacucucacacacacacucucacacauguucacucacacacacucauucucacauacucacauacacucaaacacacucucacacauauccacacucucacacacacauucacuuucucauccacauucacacacucucacacacauucauaaacauucauacucucacacacagucucucucucucucacucacacacacacacacacacacacaaacacacacacacaccucaagacaaagcaagcugucaaucucccuacuuccaggauccccagcaccccacuccacuacagcuccccacaggccuacaaguguccugcuccaaaguccgagauccccagaccaccuacuuugcucagagugccugcacccaggcuuugcugccacaggguguggcuuaccugucccgcucugccucucuaagggugggagcacuagcagcugggaagugccaaguguuauggucugacuucaaagauagagccuggcaggagggauggagagagggacugacugaucuguuuguagcaccaugccauacccauacccagcucuaagucccccagugccauccaggagacagccuggccacccugugcacucaggcccccagggcugcuauagcacagcucuccugcagacaucuucuaaggauuaacuacaauaacccucagacuucccuaucauugcaggggacaccagagcaggggacagguaccagggaggagccucccucucuccuggcucagcccucaaagcgccaccaagccuuccugugauggcuggauccuuggcagcuauuuuggggcuguucuguucuggaaagaacuaggauaggaagaaccuaggcugauccacggauucgggacuuaagauuaucucuggaaagugccagauggugacuauuuuuggcuuugcaagucacauguagcuuuuuugcaaccuaaaacucaugcuugauucgcaggccauaucuggccaacacagccccauucggguccccaaccagguacgucagugagccuccucaucgcuuggccaagagucaugaggucaugucauguucagccucagacaaaaaggccgccagggcuggugaggacauugguccggugaaucugagacggggaacacaaacagccauggagccgcagguucuggcgaggcccagggacagccuggcuuacauccagcaugcagugaacguuacuaccagcaccacagacccaggcccaauuuacuucugaagcuagaaaauuugccuucuauuaaucuacagaauacuccucagaugagcccugcucuggggccggccuugcuccuccccgcucccucucagacuucuacacuaccucccaccacagcaggaccuaucuuccucugccaccgagccccaucagacaagcucacccaccuggaagagauuagugauaccccagucccacucccccacccacccaucccacccccaccccaccccacccccgaagcaaguucuggccuggccagcuucccgcccuccaggcuccaagguaccgcuuggcugugucugaguguagcauucucccugccuccucuucccgucaaccucccuccugcuucgaugugaacuuggccacugcuacacacuucccucucauguaagcacuggacacccauuuccaggucucccccaucugaccccuccaccacgaacuuuguacuccuguaccccaccaugcaguguucacugaugccccucacgugauccuacccagaauacacacagacacucugccuuguccccaaaagucccacuuucuccucccuugugcaccacauggcuggucacacacauaggccacugggccucagcccucccuuacuuguucccaccccaggaccuucacacaccugaaaccccuaauugggaaaguuaucuaaaugccacauccuggcaccaagacauguccgcugaaggccugaggaggccgugugugacagagaacaaggcucacugugccccgguagccauggcaacugaaaucuucaaguacaauuuuuaucucccucugacuuuacacauagaaacuuuggaaggcaauauucaggcccuuucccaacaacuggcauucagaaaaaaaacucgaucggccccggcacugcacagggcauccucaccacauagaaagcaccugucuggagccugugacgaaaaggcucaggaccaccagagagggaacacaggaaaggccaggaaacugcuuacugagcucaaagaucauugcuguccaggacuccuguaguccccaagagcccaggguccuaauaggaaacggcccagaggucagagagaacuuuguccagucucuaugccccuaaguccucucuacacagcucauccccagccucagucaaugggaaaacuguagaagugggugcccugugccguaaauuagcaaagaugaguucaccucucucagcucaugaccgugugacaucugcucauguuccugccuagacagcccucggugauggccgaccauaagaguguaugcuacaaauccucucuccccgaagcugcuucuggcuacagcaccuuagcccagggauagacgugaaaccaggauucccagaggaggugucugagaccagcaggugcucacugaacaaguauguaagcagguagcugucaccgcuccuggugggggugaggaagcacccagggaucccaccuuggagcuugguacccacaaggcccuuagaaaaggguuccgcaaaucgugagcaagaaggccauguccgugugugugagugucugucugucugucuaucuguguaugugugaggguaugugugaaugugagugugaguauguuuguaugugaguguguguaugaguguauguguuaaguguguaugaguaugugugagugugugugggugugugugucuauguauaucuguguaugugugagugugugugcaugagaguguauaugagugucuauguauaugugcgaaugugaaugugugcaugugucuauauguaggaguguguguaugugugucuguaugucuguguaugugugagugugugugcaaugugaguauguaugagugucugugugcaugugagaguauguuuguauguaaguuuauguacgaguguguguuguguguaugaguguguuugagugugucucuguaucuguguaugugugugcauguguguaugaguuuguauauauaugaaugugaguguguguaugugucugugugaugaguguaagugugugagugucugugugugucuuucuguaugccugucuaugucuaucugugucuguaugugugaaugugaguaugaguguguguguguguguguguguguguguguguguguguauucugagugucugagaaucugugucuguaugugcaugucuuugugugugugugcacacaaucaugugaaggccugaguugacaaucaggugucuuccucuacacacucucucucaucuucugggacagggucucucacugaaccuggagcucacugauugaacauccaucaagccucggagugcaccucucccugggucugaguuggauuagacauccaccacugcaccccacauuuacagcaucccaucuccacaacagccaucuuuucucucagacaaggucuuacuauguggcccaugcugcuucugccuccaaucucucagugcaauggcagaugcucaccacugcaccuuccuccuguuagagcuucucaucaagacaccagacaccaagcacccgagucaguaacccgaagcuggcuggcaccacagcaucuggucagacgccacacugggugaccuggucucugggcacugaggcucugcuccgugacucacaagcucucuuccccagucuucggguagaggaagaacacuaccuaacucucuaaaaauggccuccucaccccaugugagucccagcuugcacccugccccgcacacugcacuggggagaagcaggccuaucauuaugaacagcaagauggcugcccuggggugugguccuucagagggaagggucugaugaagccagacaugaagccagugcuggggaacaggaucccuugagcacacagagaaagaaccucuuuaugcccuuuuaugguggggaacucgacuucagggcagcuaggucuguugugcaagcauggagcccagcgggcucugaggaagccugggucaggcuuuggggucagugggccucgacacugagacacagcagcucaauggcugcugcaggcuggcacagccugcucuaaacuuagaacagccaacaaggcugggaagagggguccccgggggugcugcuccuuagcagcaugcuuggcagggugccacggccguucaaggccagccugggcagcagcucccagcagccugugcgguuuccuguccaccuguguggaccugaacaacaggaaaggcggcagcaggauugccaccccccaccggcuuuucuuccauucugcagagacagagaccccugaggggccccggauaucccaguaagcaugagccacgaaccugccaugugcguagcccugugugagaaguggaggaaacacaacaaaacaagucucagccagcuucagaaauguauucaguucagcuacucacucaguacagugugcacguagcgagcaccucugugcacugagcccaguucauucacuguaaacaaaccaacaagaccucuauucucaaaagaaaaaaaaaaaaaaaacccucacuuugucauuggcucacuauuaacaagcacauacugugugcaggagcuuguacuaaaaaacagaggaaaugaacaagggauccugaucacucgucagucguucauuuucucauucaggucuauaagcaguuauugagcacuuucuguauacccagcacuucgccaagcacggugaacagagucauggugcagccgguacuugaacauucacccugagucacgggcgggcuccuggaugcccacugugugaugacacaggucugggguacagucaccaccucagcugcauccuuccaugcaccaaccgcaaccagccuacuaugugcauaggagagaaggcccguugugaccuuccuuccccucugauagguucacuccaccaaagcaucuacuaugcgccaggcccugagaagcuagugaaugaaguucauauccauggggccggaugacauaggaugcgugcucacuucaccagucaggccugagugcucugucaggacagcaagaaccucucaguuauucaaaagcuccgugagauuugggugacugugaagcaggucacacgcacccugaucuggcaggggacacagggaccaugaagggaucucuugguacccaugaucauaucuuaagagaucaagaugagagaauccaccagaacucagggacagccaagcuuggggaaagauguuuccaauaguguggaggcacagggaagcagacagcaggcaggcagguccuucagcacccacaccgucccaggcugaguacagggcaggggaauagcaggcuucauacccaccgcccagauggcugaggaaguaggucuguggcuaccagaauccacagagagcagaagggaugccaggagccaucuguggcugccuccacaaugugguccucguaccggcucucucacccccggcccuacaugcacagugacaacguuucuacaggacuuaguucugagucccuggggaacccagcucacccaucccuagucagggacaacuguguccugccccaagaacucacgaguguggcaacagauaguuacagggcugcaucuuucgaguggcuugucaggacaagcuagcaggcacauacacgugccuguguucugcggaggauccaggaaaucggaagacagaaggccaagcucccacgcugugcacccgggaacccggcagcaucugccuucccgaccucuucagaggcccugaccccugagccugcccagucggcugugugggucacaggaugaccguggcuucacauggcaugccaccugcuaugcucuacaagucucaggucaccugucccagaggacaaaggccgcuuucacugggccccggcugcucacgcaagccugggcaggcgucagggcagggagggcggccccagcaggccccucugggaagacagccagacagcccagccucuggggcccugcaagccagggcagcacugaggguuggcccucuuccccucccaaucuauaccuucaacagggugagaacagggcagagggaagcuuugaggaaaagcugaugaauucaucagucagcuuuguuuagcacucacgagaccaagacacaccuucagagcuaagaucaagucaacaugguggccgcccggcgcaaacuccaaggccgggcauccuaggucaaauugcuuuccacugcugauggcuaggugacucuccagagguggcuuaaccucucugggcagaugauagcagucucucucuccaggacuacucaaaggacaaaaugaaccucugacaccccaaccacccaccauaccacaccacaccacacccccccccccccccccgucacagaacucagaaugugacuaaauuuuugaagagccuuaaaaccacuggguaagcuaaaggaggccaguagggugggucuuccgauucaaguaucuuugaggcugggggugagugcucauguaguucgaugcgacugccucugcuucacaagugcugggaucauggaggcucugcaacugguguguguguguguguguguguguguguguguguguguguuggggggggugucuagguaagcugagggaaggagagcucaggcaucagggaagcucauacacaaaagauucugagaugucacagagggagccaaggacaaaacccuccacccaagaccuucaucuucacuugggggagggggagggcagaacuacagggcggggcuucuccaggccugggauucugauggggcuucuuuccagcaucucuuccaggaagaagagaaugaagacugcuucuaggaggcgacaucuccaucagagcacauaaggu

SEQ ID NO: 2605 - RNA, 1261 nt, Mus musculus
ugcaagcaguaugcaaaagcaaagagcguuucuucagcugaauuuccugcuugcuggggucugucucccccguuugggaauggagaccccuggugaaaucaggggcucaucuuuuauugucaguuaggggaauuccagggagggguuugcgcccucuuaccuugauuggucagcucuaucucgggggucugacugauucuauaaucaagcucugaagacuucccagggguggcuugcucauucuagcuaccuauucuuacuucaggccagaugaugagguguccucggacuggcugcccgcggcucugguuggcugaccacagguuccuggauccuggcucucauuucugggaaacagaaacuuaggccuagucucccaaacggccaguuugcagcugucauggagucagucuggcucuccugaccugguguucccauuuccccuucugauuugcaacuggaucaaaucauugauuugucaggguuuuuuuucccuccaaucuuuuucuucccaccuugucacuugucaggggcagaagucguuauuauugagaacaguuacugccaagcaaguuuucauaugggaacaguaaaaagccacaucugaaaccugucuauaccuuaauuugauggcuauuaguaaagcaagccugucugccguuuucgaaacaagaaaccuagcaguuuaacccgauaaguuaaccaaugaacuaacgucgugguggauuguuuugacauaaggagcuaguugccuguaugucacugcccagacaguugcuuggggcuccugcgucucuauggcaccgagggcagaggcagccuuuggccaucagccccagaagacgaagaggcuuuuccugcagaggaggaacaugggagacuggccuauccuugucuacagcaccguguggcgaucaguucugcccuccauccacagcucaggccaggucuuggcagcagcaggcaagacaucaggacaguuaugcccagugguuaucauaccaccauccaggugguguccucugccauugugcccaccaauuuucagagaccucggugagucgccggugggauuugggagucucuguccgucacgguaaguuuaaacauguucaaugcuacauuccguagaccucuaacaggcuugauggauagccaguauugaccuaccucguagguaucugagcgaaacaaguugucuguuaccuugcaaacauaaagcaggagacuaaauaaagcuuuaauuuaugaugaaccucau

SEQ ID NO: 2606 - RNA, 1595 nt, Mus musculus
agagggcaucggauucccucgugccagaaaguugugaaaccaucaaacccagguagguccucugcaggagcaacaccuagccuaacagcugagucaucucuccaguccccgcccuccucaccuucuguggaucuugguaaaguuaccuugacuuaagucauccaccguaaagucuuuccgcggcucucccugauccuccuugcccgcaucaugugaggauugggacauggucgcuggugccuuugggguagcguuagccuguggucacaguuaacgcugacuuucuguuuccgaauugaaggcugccaccguggcuccgucauggccagagcugcugauuugggaaacuucgcuucagucaccagggucaggggaaccgaggacgggaagagggccgaguccgguucgcacggcggcuggcggacagguggccgaggaaaagcuguggcguggcaucuggcgcggcuuagagccagaagacuagagaaccgccccgccccgcccucugcugggucggagcauuggagcaccacacccuagagagaccucaucgcacaggcuuggcugcagggucacgggcuccuggaccgcuuucuggggaaagcgugcagaaagucacuggucuguguagccuugaggcuauccagggaugucuacuacugaggcuuuggagguggagcgggaagcugcugcucucccugcugggcaauacaaagagucaggcuaggcaggccuggaagugggggggggggguuugcagagagaggaggugccucccuugagccacaccccuucaccauggccaccuugggugagggaagauaauucugcugaagcuacaagaccccaagcauccuuuagauuucuguucuggccacacugaucaucaccaucaccacaugguccaccuuauaauguguuucuguuaaagcucugucucccuguaaacauucagaaagcaccuguccaaguauccucaugcuguugccugugugaccccucuucuggguucaucaguauuguguccugugaugaccaaccauuaguuagcuuacuggagaggaagagcugaaaucaccuaggagauaccacuuugacuggguccaagaggguguuuucagauagguuuaccuguggaucucacgggcuaacgccccagaacaaauaaaaaaacaaagaggggguggggcuggagagauggcucugcaguuaagagcacuggcugcucuugcagaggaaccgaguuugaucccccacacccacacggcagcucacaaccaucuaacuccagcaucagaggauccagcucccugucuggcccuugugagcacugcacgccugcggugcacaggcacacaugcgggcaaaacacucacacauaaacaauaacuuaaagaagggaaggggaagcaagcugagugucuacauuuauaacucucugcuuuccagccguggacaaaacgaaacaacucaucucacaguuuugucuccauagaagacuguguccccucagacuguaacucagaagccccuccucccucaagcugauuuuguauuuugucacaacaaugagaagaagaagaagaagaagaaga

SEQ ID NO: 2607 - RNA, 1420 nt, Mus musculus
ucaaagaaauaaaccuguauuuaaaaaaacaaaaacaaacaaauguuuagggaaaccagccacacauuagacauuaaauaaacacuccauuucagugugggugugauuguguuugcaacauuggauaagggauauuucagggcuaagauuuccucucuccuggaacccuuuucauucugaccuucaugggcgucuccagagccaguucuuucccagugacuuuugaauuuuugaggucacuuucugggucucugcauuuucuguuucaucuuaaaggagggugaagaacaccuuagcggguuggggaguucuugacagcccuuucgagaagccauaugccacacagguauuugaaaagacauggcuaagcucacgggucugcaccuucaguuucuguggucccagaggagggggcagaguaugcggguggcagacagaugccacaaagaacaaauggugaucugaaaucguacacacacacaggauggauguguaacagccaccgcauaagacuggcaggcuguagcacagauagguccaccccgaaggcccucugcagcuggguuuccauuuaauuuugugaugugugugguguagugugguaugaugugguguguguaugugugugugugugguguguguggcaugugugugguauaugucugugucuguguguggugucuguuugugccugugugugguguguaugcauuagguuuuucuauuuuaauguauauauugcaugggaaugcauuugcucuuucauguguaguuaauauuaaucacuuaccaccagcugcuagcaaaaucuucuuguagcauaagcacauuguaggacaacuuuacgcagaggcagaacuucgaggaucgcacggauguccccuuagucaccugccaucacucccuugauucaggucccaugcugggucucuacuagacacaacugcccaguggacacuugucaccugucucauguggcuguugcucuagagacuuuagugacuggagucaguuugucccucccucuggaaggcgucauggcagcaguaugacccaaggucaccuaugaccacucagaugucggcccuucacaccuccgagccagcaugcugguauggaguccacacuuccugugccccucccugaggcucgucagugcgcugcuccguuuccaucgggaaggcucugcuuucgcucucuccuccguucucuuaucguggaagcccggcuuauucuuuugcccuggagcccaaggucuuccaagaauacacugauuccgcagcucuggucagcacccagugugcucucaggaaacaaggccccagcaucaucuccuuggcagaaagacuaugagggaugggccuucauguuuucucccugccguuguuuuggguuucccugcugguacucggucaauucu

SEQ ID NO: 2608 - RNA, 5262 nt, Mus musculus
aaucucccuggguuccagugacuucccugcucguguuagagaaccuaccugguucucuuacugguggccagugcccaagugugacuuccugcucuccacagcaucaugacacagcugagccuuuccacacgccagcaagggccaccgaaucauuuuaaaugugggggaaaacuuuguaaauuuaacuuggggcacacacaaugacaaagcaggggcgggugucucuugaaacccuaccagccaggaaaagcucugauccucgugguggauggagaaccaaccacucugagcuggcuugaugucuuguuuaugcuacacacaacaggcacaugaaaacucagugggugaagccaggaaggcaguuucugagcugcucuggaauaugguuucagaacaggaugcauggugguggaaguccuggaugagacaacgcaauguuuguaauaaaauacuuuauuagaaccaggaauuuguuaaaauaauauuuuccacauguagcuaaagugcagguucucacuacaggacaaagugagccucccaugagacuuggugugcagagaagagccaggagcugggggccgcguccugcagagcuguugacggugcugcacgcacacaucuguuuuuuuucucagucugucagaaaacugucagaguaucuuucuaaacgcuggauaccaucguuugguggcugguaugaguuuccaauucaaacaaaaagugcagugcgcugggacacuguaggcugucucagaacaaaauccagugacguagccauuaugacucuaaauagcagcagucaaaucggcauuagccauaaauaugauugaaaaaaaguuuauuuuuccuaagaugacaacuuggaaauguaucuaucagaugugacaccauccaucacuuuacaaguuacuagaagaaggccacuccaaggcaguggggacacuggacccugugauggcaucagaugggaagaggguuucaaagcauaagacaaagggggaaaggcugggucguggucacagguguuugcccguuuucagucuuuuaucagaacugcuuauuugggguugaugcgguuucucagauacacccuuuuguaauguuagggcaggugccuuguguguggugcaugcuggguaguauucucccgccaagcgucaccucccguguccucagaagacugagugggaggugaaggcagaccugcucuguggagugaggggguagguuggcuuggcuagccucaguugaugcaagugaaguauagggcaaagauaagggaaagcccuucugccugcccuccacccuuagaacagucugggcagggaagcgcuauccccugccacucagguuagcaaguuaauagcucagagggucuucggaaaucugcaaccuccuacuggcaaagggcugggcugccaguagaagcugcugccacagccucucaggaauaaaaccccaccuuagcacagggcagguucugcccaagguugcagccuucugaggucucaggaccuccaaggcacccgagugaucaccguggcccugaguuccgucucacagaucucucugccucugcccuucgugcaaagucugucuagacacccaggcucaggacauuagaaaagcacugcugcccuacuggguuccgggaucaccacagguguuguggucgcagcaccacucggucgcugcuagcucaccaaaaaaguaagaaaaaaaaauuaaauaaauaacuuggcugaacuauaaauuauccugaagacaggcuuaauaauuuaguuuucuuucucaacugaaaaacaucuggagguaaagaauguuuaaggguuuccuuuugcuaccaggggagaacuguuucuagaaaggccuucucuggaugccaagggagggcuggcgguuagggccucacagggagcgucuccuugaacccagaaugguugggcugggcuucuggcagugccaccgaguacucggugguggcaaggagcaacguguccagugugaccuccguacacuuggcuaugaagcggaugaaaggccgcacgucacccucguuggcgacuuccaguacaugguaguacucggaccucugcuccuugcggauggugaugggcggguaucccgccugcaucaaaaucagguucaucagcagacgggagguccucccguugccgucgaugaaaggguggauguacaccaguuuguaaugggccagggccgcgaacucgacugggugcagguucauggcguccucugaauugagccacugugugaacuccugcaucugcuucuccacaucccggggguggggugggaugugguggcccaccaggaccuggguccuccggaaccugcccgccuccacuggauccacauaccccaguacccuccuguggaucuccagcaugucguccauggugacagacccgaugcgggagaccagggugguguugauguacuucauggccgcgugcaugccgaucaccucguucugcucuuccaggcucuucccuggcacggcguagcgggucuccaggaugugccugaucuccgagagggugaggguguugcccucgauggccaccgugugguagauguggugguaguaggucuccuccaugacccugcgcagcgcugagcuccccuuugggauggacaugaccuucuucacuuugcugucgaugacgcugaaguaccucuggucgauuuccuccacgaggggcaguguccgaucccgguugaccagggcuuucucguggaagggcgagauggucagggcccugguguauaaguagucagccuggaugauguccuugucuucuucggagaagaugccgaacucauucagugcgucuacaaagccgggguccaucuugagggcgugcaggaagagcuugugggcuuucccucucuugccuugacgcuucaucuccagggcuugguuuagggcggccuuggcuuccagcuucccugcuggaagagagccagagaggccugaugagcagggugggcugucccuguacaggccucccagggacacuaccauagccauguggcuucugugacucaggccccgacuacugcugcucuccacagcuggaaugcugguugcuguccuguguccuaggccacucuacauugggagguccccugccaacuaucuucugcccgggcguagacagucugggcauuugcuaucccugugcuugcccuacaguauggcugcacuggguggcccaccuucccuguggacagguggcucuuaucucuugagacccucuccuucaggccugggggugccaacaccucgcccucagcuaucccuggcccuucccaugccuggacaauuucuguuuucuggcagugcuggggacuggaacccugggcccuugugcaugcauaccagacaggugcuaucagagcuaugccccugcuucuaaugaugugauuccauuguggugaugugugguugucaccccuggggacagugugccgcuggcauccagguaggcugcuguaacacucacugugcacacggggcaugcuuugcacugagcucugugcuucgagggugagcacccacccacacucagcuucccugaguuccuggaccgcucuccagucccauccccagugguuucuggccagagggagcacuguucucaggugcucuuccuugaaccacccccauguagaucugaggugcagcucagggcccacccuuugugugucucccuccaaaugcugggacacccguucucagucacucaucagacuggaguuccggacugucucauucacugggacgcccucaugcuuacacacacacaaacugacaaggccaaccaaguuggccagcacacucaccuggagacgccguagucuugacugucagcagcccugcaucccuggaggagacacugagcucugugcauaggcuggugcacuuggggaccacaggcugugcccuguccaguuugcuccugagcagguggaaaccucugagcacagccaggcaaugcucuuccacaacucccagcggcagcagcagagccagcagcgaccccagagccaugcucagcagcgccauccacaggaaacggccccagacggagacccauuuggguucggccacugccaccaccgacgccauuggcaugaguaucaucuggacugagggcugggcccagagcacucgacacagaggaaaagcuggacccugcaaggaaccaagcauuguaaaagaaugaggcagugggaguggacccguucccagauggagagaccagacacagaaucgucacacuuucuaauucauuagggaccacggaaaugggggaggggucucauggugcagggccagccugggaagauucauccuaacccauagcuccuccgggguagagugauaggacucuaaugcauuuauauauauuaacuuucauaaucucagccuacaaccccaggaggugauguuuccacaccgcccuccccagaggagaugcaaucagaacucagaaaagugaagucggggacuuuucagccccccucuuaguccacuaguccaccacaagcgacuauugccacaggacaccuaguguuugggcuguaacuccugcauacgccccuggacacacaccacaaucuucgauaaggacaaaugucugguguccugauguuaccauaugaauaccgacagccucggugaccaauguugugucccuucugcccuuccuucccuggcuuguccaucauagacagggaaacccaaggccuggccaacaacagugggugaugaugcccuaccucagcgagggcgaacacaagcuugggggcuggcgggggauggggggggggagcgagggaucagguaugcaaaugccaucuugccaacaauaagcauuuauugggcaacuauggugugccggacacugcgcugccggccagccuugcacgcugucagcccccuugcgaagagcgagcaagcuaccuguagcucccgguuuacagaugagggaugacgccguucugacaggcggcgccggagcuccggggccugacccgccacgucaucacuucgcgcggccugugcagcggcucgagcccagcagacuucggcuuacucccgaagcgggggguggggugggggguggaaugaggcugccgcgagcucccgcuacgaaccggcccagggcucgugcccgccuccagcauccaaacccgcgcggccguuccccgcagccgcggucgcaggccccg

SEQ ID NO: 2609 - RNA, 356 nt, Mus musculus
gggagcccaagcccagcucacuuuuuuuuuuuuuuuaauauaaaugcuuuauuuaacaguugcagaucauucugugggcuaaguaguggauauccagaaccccaccagcugcaagauuaacacaaccuucgagcuucucuuucugacuccaauagggugagcacgucacccucuugaacggggccuuugacauuucggaugauagagcggcuggugucauccaugaauuccacucgcaccugcgugcacugucccugugaaccgguccugcccagcacuuugguuacccuagccagcuugaugggcugcacgcgacucguguccaugauggcggcgaucuggcggagagccccagc

SEQ ID NO: 2610 - RNA, 24401 nt, Mus musculus
cgcggguuccuccacuuugcgagccuccugucuugggcuccucauuccgcugcggcgggcgggcgagcggggggcggcggcggcagcgguagcggcggcggcagcgagcgcgaugcuaaguucccgggcgcaggcggcgaggacggcggccgacaaggcccugcagcgcuuccugcgcaccggggcggccgucaggugagugggugggggugcgggguggcgguggcggccgcagggccuccaggccugcgcggacccggccgaggcggaggccgcggcccggcgucgccuccucgucccugcuguggccgcggccugcgacgccccgcagccccucgcggugaccccagacucgggcuccgggcacacaaucugcacgccgcugcucccccgcaguuugucagaugccggucucccaccucugccaugcuggagauucucacuucugcaucccaaaccgcuccgguucccaagcuuccgaaggcucccagccgcugagcuccccaggcugugacaauuccaggcucuucguuccugcuaggacccccgucugcaccccagcccgguugaucuucccaaggccuggggccacacccccguugcucacccugacugcugggaccuguugcuuggguuggcuaccuuggauaccggggcaggucuaacagcaucuuauccggcucugaagccccccaccccguguuuauuccgcccagcggcccuauuuuaccaggugggaaggaaggcuugauugggccuugcggccuaacagcugaccugagagcagggcugguggccagcuuaaucucacccucaggcucacguaccgucuucaugguacgguucugcagaagaacuagucaaucaacaccaugccucgguuucccucguugagugugugccgagcaggugugcuguaacuggcccccuccuucucccgcugacugcuuuuuaagccaaggucugugcacauucuauggacucacccuggaagaacaaaaagauuugaaacugguaauuagcugugacaucggagaaugcuggccguugucugacgauugcuguugucacuagugauccuuuucagggaguguuuauucagcugagaccaauauucaugcaggcagaauuagggggacagaucuuagugguagagcauuugucuguccugcauaaggcccuagcuagggucagucccugguaccaggggaggugaucaacuucauauaguccaagcauuagguaagaacguauuacacacauguccacaugcaacauauauguggguacauguuacacacacguugcacguauguguggguugccuuacuuggagauacagaacuuuguauaaaauuguguuuugaauuacugcugcaguuuucuuaauugugggaaaaaagaauaguguccaccuucaagucuagccuggaacgaagaaaucuuuaaucguaugaacauauagauguccucuugugguauuguuucguauucucaaagagaaauccauuuuuaaagccaggccuggugccaccgcucugucacgaauugcucaugagccaggaggacucuugaguucagagccagccugagcaacaacaacaacaacaacaacaaaacccuaauuaaguaaauagggagagcuuggggagaugguucagguguucgacugccuauugcauaagcaacaaaugugaaaaccagaguugaggucaccagaagccaugcgagcaccagguggccuggcauauuuccugcaucgggagggaagaagcaugagagagugaugagcugugccaaugagcucugggcuccccacccgaaugaacaagcuacagaguggugacaaggacucccagugucccucccccucccccauuuucuaguuaagugcucaaguaucccaaauuccaaggcaaggucuuauugguacauauuaccuuagauuucaagcuugcugguuggagggcuuauuuugauguaacaugucaccuuccugccacugucuguaccagccugcuguugggagacagagugacaguccacgucuucuccuuuucagauacaaagucaugaagaacuggggagugaucggugggauugccgcugcccuggcagcagggaucuauguuauuuggggucccauuacagagaggaagaagcggagaaaagguagggauggggcccugcaucgaggucuuggguuugacuugagccucucuugucuguuugagugguuggcccucuuagcuuuaaagcgaggaccauggucuacgaaguagaacuccccacccuguggugggaaggcucuguuuuuuuguuuuuuuugagacaggguuucccuguguagcccuggcuguccuggaacucacucuguaaaccaggcuggccucaaacucagaaauucaucugccucugcuucccagcuuacaugugaguuuaagacaugcuuugugcuggcccaguggcucaugccucuaacuccagcacuugggaugcuggaauaagaggaugcuaugaauuugaauccagccugugcuuuauacagcaaguaccaggccagagugugacauaggcaagaccccaucccgaggaggggggugaaaaaaggcaggccauuguguuucaaguggcucaauuguuguuacuagugugugguuauguuucaguccugcagcugacugauuacaucacagcagugguuucucugagagacaggagggaaggagggagugggagaggggagcugaggggauggucauagagaaguucccugcauguuuucaugagcacucuuauguuaaagaguuucuaaacaaggccugguggccagccugggcucuguguacugagcucaugaguuuuggcagaagaggaaaugagggcaucuugugagccagucagugcugcuaucucugcaggcagacugaccagugucuuucucaguugccgugggaagaacaaaagcacugucccgggaggcaguacaguugccagcuauuguagggcacugcucucuaacuaaaggagagagcguccaggagcgcaugaggcaaggaggaaggcauggcugcugcugccgcugccgcuuuuauccguuucguaucugcgccgggcaccuggaaggguuucagagagaacacaagacagaggcccacacugcggcucagucuacagcauagcaugucccgugcccaggcucgcucagggugaaaucccgacugagggcuccaugcauagaugccgggucccagaagcgugaggaagaggaaggaaggucuccccagugaugcauuguccucuuccucccgcgcccucccuagggcuugugccuggccuugucaaucuggggaauaccugcuucaugaacucgcugcugcagggccugucugccugcccugcguuugucaaguggcuggaagaguuuaccacccaguacuccagggaccagcaggggccacacacucaccagugccuguccuuaacacugcugaaccuccugaaagguacuggggaccugagggaacgaccauuuucagugucuagcugacagaauaagaggcuuaggggagccacuuuguaggaaaagacguugugggggaggggugugcacugagaaccuaagagacagcaucagauugggaaaacaguuguauuuguugugugugcacgcagcacacauagggagcucaggacaacguugguucucaucuacugucugguccuggggacugaacucgggcugugagguuugggggcuggugccuuuaccuacagagccugcucaccagcccuacuuuaaaaaaaaauuaaaaauggaacuaucuauuaaaaaaaaaaacaacuuucaguuuaauaggggguggggaggggaagggaggaagggggaaggggaggggagaggaggggaggggauagcuugaccucuccugaagguacuuuagcagcauucagugagcccgugcaauguggucaggucugccaggccugcuaaucucacugccacaguuagugucugggaaaagaugugggcacuuuuuuuuuuuaauuuuuaaaagauuaauuaauuuagucauuuuaugugugugaauacacugugguuaucuucagacacaccagaagagggcgucagaucccauuacaguugguuguaagccacugugugggugcuaggaauugaacucaggaccucuggaagaucagucagugcucuuaaccacuaagucauuucccuagugcugggauucauuuuuuauucauguguaugugagucugugugacccuuccuuuaucucccacuugagcagcacugagcugugcuccugcacuguggucagaauggcagucgcagucuguggccaguggguucccuguuguuuuguuuguuuuuguuuuguuguuguuguuuuguuuugagacaagucucacuguguaacucuggcuguccuggaguucacucuguagaccaggcuggccucaaacucacagggauccuccugccuccgccuccugaaacuggcauucgagccgugcaucaccacacccugcuuagaugaguuuuacuguucauguaucugugugcaucucuggguauccauggcccugagaggaugccagguucuuagcuggagucagagguggcgagcccccugaugcuggugcugggcucugaacuccaggcauugugucaaacacugcggaucccuccugccccgagcugccuaacucgcuagugacacuuuuucagcauccaggcugugugugcuuagccuauggcugcuucugugcuucaugcgcagagcacacuguccucagggaaaggagcugagcgcugguguacacaaaacugugacuccuuagcagacccaccugcaucuuucuuuuguuuauguuauucgucaucaucaucguuguuguuguuguuacuugggaagggaucuugugcugcugccaggacuggccccacccucguggggucaggaaagccucccaccccagcauccucaguagcagggacuauguguggccuaugcacugugccacacagacuuuucuguugguugggcuuuauugugauucuaaagugaagccuucagcugccccuucagcaccugguggucaagagcacacaagcaggagcaaaggcugcagcaguggucacccugguagugagugccuuccaaccuugagaacuaugaguucagaccauacucagccggcuuauaacaucccucuuuaucagaugguaauuuguaacuuucugaaaucuuagauucauucaacaaacaugacuugcucacuccgcacugugugaggcuccaaagaacuugagagagcugcagugucacuugucauacugucaccucugcaugcauguguggcacuuucuuaugcucugacucaguugucuuccucucuuguacccagcucuguccugccaagaagucaccgaggacgaggucuuggacgccagcugucugcuggacguccugagaauguacagauggcagaucucguccuuugaggagcaggugagcacuccgacagcaggagaccugggagacagacgccuuuaaccuagggacugggggaaggggugcauggacacguaugcaugggggugugcacacgccauggggaucgagcccagggcccugaacaugcuaggcaugucuucuuguuagaucuccugaugugagcagagagccagcgucucacugcuguccccacuagagaggacacagcacuugucacucaguagguagacagacgcuggcacuggggcauuagacaguggccaaagggaaaagcugcuggcuucccacugaugcccucgggucgggagagagcacgguuagugugagacgcucuuucagcccucacccuugcuucagaggaggcucaaacuguccccagaccucacagccacgggcuucauucgggaucuucugcccucccuuuugcaacuucacuguggucuuuggagucugcugugccgcccuccgaggcccaggccagcagacuggggcccuggggugagaugcuccagcugcacgcaccuuccccagcugcuccuccugucugcugucagcaucccgaccuggacugaggcagggaggcagccccuccgcagcucugcacgaggcuggagcgggaggguucugucgcuuguucucacugaucugcagcccuguggcauguuuccaucacgaagugugugacgagugucucugugacgagugucucucugaagguuuaucucacuggcugcacuugcgagcuagauguguuuccgucuccauuuggaaaugacccuuagcuauugcucugacucagccaucuuuccugugucucagcugagagacuggcuccaaggacauugugacuuuuucuaaguuccaccuucugucaaggaugacuuauaccaagugacccuugggucagugcacagcagugugugggcagcagcggugcggccgcgggaaggaggggaggagggggcgucuguguucucuuguucuucagcaggcagagcgccugcucuuggccaugcccagcaccucagcaucuagucaguccugaccagcucacacugacaggcaguccacucugugucuaaaccaggagcuguaggagauacacuggcucagucauuccugaguguuaccugggugcacccccaugacagccuguaaggcucagagaagcagagugacuucccugucaccugcuguguuggcagcacugaagcacacacucagcugcugcgguaauuucuuaccccaauaauccggcauaaaaacacacaaccaguuauuauauuuauaagucauaugccuggauugggcagagcuaucacuaaucuauuccccagcuaugagaucccuuguuauuugcggcuucuccaggccacguaguucugcuccaucuuccuuucucuuccucuuccuccauccucucucccuccuccucucucucucagaccuccagucccaccuuucccuuccacugugcagucaucagcucagccuuuacucgaccaaucagaauggggagggucagugaggucaccugagugcagcucuuguccucauggggggggcggucaggaaccuggaggcaggagcugaugcagaggccauggagggugcugcuuacuggcuugcucagccugcuuucuuagagaacccagggccaccagcccagggauggccccacccacaauggcugggcccuuccacaucacucucuaauuaagaaaaugccuuacaguuggaucuucugggcacauuuucuuucuuuuucucucucucucuuucuuucuuucuuuuuuucuuccuuucuuccuuucuuccuuucucuuuugagacaggguuucucuguguagcccuggcuguccuggaacucagucuguagaccaggcuggccucaaacucagaaaaccaccugccucugccucccgagugcugggauuagaggcgugcaccaccacugcccagcuggagauauuuucucaauugagguuucugucucucagaugucucuagcuugaguccaguugacauaaaaggagccagcacagaagggacacauuguugacauuauuugcagcuaaggaaagggggaggggcugcugcagggacccagcccagaauggcauagcucaagucuggccugggcaggggcugaagagguuuggaguuuggguugugcuuaggagcuggagccuugugggggaggaaggcaagccugagauucuugggaacauguggagcccucagucuucucuagaaggccuugugcacaggugggguggggcuccuuuacucuggcagagcugaccaucagaggcuggcugugggccuugcagaagcuuacucaaaagcucagaagccggguuagcucuguguccagugcuugccugguaugcacauggcccggcucuucucaccagcacuggauagccacaaauaaauaaaaacuggcagaucugaugccuguggccugaagcuaagcucaaguaugggacuugcucuuccuaguuuacaagucacucuggugcccaccugagaugcgauccaaggucucaaggcccagccugagcaagggagagaaggagcugcagagcagccgagcaggcugcaucuuugcagagguggucuuucaagucgaucuguagaggcacauccugccugcauggacacuuguggauauauucugagaacugcaggcagagucucaacagguguuuguagguuagaauccaugcuuagaaucccucacagaggcuguggugcucugaauaugccuagaccaugggaaguggcacuauuaggagguguggccuuauaugaggagguauauacuuacuagaggaagugugucacugugggggugacuuugaguucuccuagugcucaagcuccacccagugcagaagugagagucuccuguuacugccuuuggaucaagauguagagcucucagcuccuccaacaccaugucugccugcgcacugccaugcuucccacuguuaugguaauagacugaacgucugaaacuguaagccagcuccaauugaaugucuucuuuuauaagaguuaucuuggucacggugucucuucacagcaaugaaacccuaagacagagauugguaccaggaguggggucuccaaggcgacuucagcuuacagccuguuccaaugucuggcauaauuaccagcaccaggcaguugugugucauggccacuagaucacccacuaaaaaggauuccugacgaacagaugcagugcugaugaugacauugccagcucugaagaaaauuccacugcaggaugugaucaaccagcccagcagcacagauguggacaggggaguccuggaggguuacacuggagagaacacaacuuggagaacuuccucauugugcugagaggcagcacagaagcugugagggguaaagggucuggaaaagucccgagacucgguccccaggauuguguguucuuguaccucacugaccauggagccacuggcauccugguguuuccuagagaugaucuuuaugucaaggaccugauggagacuuuucacuacaugcaugaacacagacuguacuagaagauggugguguuuguugaagcguaugggucuggcuccgugauaaaccaccugcccagugaugucacuguuucuacaacugccaccaccaacccugcuacuauaacaaggacaggaacguacaccugggugacgguacagcaucagcuggauggaagauucugacauggaggaucugaccagagaagcgcucgcuccauaagcaguucccacaccagccccagccacaucaugcagugugggaacaaaucugucucuaccguaaaggugaaacaguuucaagguaugaagcagagacccaguuccccaucucucugcaucuagucaccugccuugaccucacccccagcccagaggugcuccuggcauccaggaaaggaagcugcugagcgccaucaacuugaagcaaucccagaucucaucgggacgaucccgaggcuucugggugccgggcacaucacugaggucugugcacaagauucucuccuugcugguaggauuuggggcuccugcugagagacuugugucagagagagcuaugcucacaggaugcugugacacacuuccugcaauuaggccacaccucugcaguuccugugggucaagcauauucaaaacaccacaggagccaauaggcagagcaucguaaaccccaccagugggugaagagaugagggcagacccuucccauggccgcaaaccagggcuucaccugugcaaccguuaagcugcaucuucaacccaaacaacaauagcaacaauuguuuguuaagauuucuuuuuguagccgggcgugguggcgcaugucuuuaauccuagcacuugggaggcagaggcaggcagauuucugaguucgaggccagccuggucuacaaagugaguuccaggacagccaaggcuauacagagaaacccugucuuggaaaaaaaaaaucuuuuuguuuuauguguuugguguuuugccugacguccaccacaugugguggcccugguguucacacagggaccacaagaaggccuuggauccugugaagcugggguuauagcagucgugagucaccgugucggugcuaggaaccaaacccaggucuucccaaagagcagccgcucuuauccacugagccauuucuccagccccacaaaauuuuuagacaggccaauccagccacacccuaacaggaaaggguucuucaacauacugcuuugugugcaugagccuugaggacacuguggccagggcaugcuuguucugcugugugcagggccucagaagcgcagcagcagugacucugcuucccuucacgggagcugccagguuaccaagggcagcagguaggaugcaggggucaggagcagggcgggugguuacuguccggaggcucagucggggauugauggcggugcuggucacacaaggcucugaguauucucagugcugcugcugcacaccugagcacguggaggugcuugauuuugugcugcgugcaucuugccugcucuuuuaaagcaagccccugcuggaguugagggcacgucuccuucaguuauugggacucagagaaagcagaaagcauucugcccaguaaggguuaggucugucugcugcacguggccuggguucugacccuagccuggccuugugaaccugucuucaaggaagcuuuguccuuugauaggaugcucacgagcuguuucaugucaucaccucaucacuggaggacgagagagaccgccagccucgagucacccacuuguuugaugugcauucccuggagguaacgucucaguguugguccaugcgugcucaguaaggacagggcacacagucugucaguguucacacucaguaaggacaaggcacacagucugucagugugugcaugaucaauaaggacagggcacacagucuuugucaguguucacacucaguaagaacagggcacacugucuuuguaaggccaagauuagagaguaagagaauuaagacccaguauccgggaggccguggccggcagagccugagcugcacuccugcuguuguguuugcuggaggcggcaggcucuuuaagaggauucauugcugcagccuggguuguguuugaggagagaaugguuuccuuuuccuuguuaauagaggggaauaagggcugcugggcucucugagugagugcucaucuuucuguaacaacauaauauuuaggucagugauaggaguugacugggaauagggaaaagauaucccagagaggaguaacaugguuuuguauaaaggaacucaugcagaauccauccagaaggugggucagagccacuucagaaugcugggcugcggggagcguugcugcuggucccggaacuuguaagauuagggcggugagggugguuaaagggcugccgucaggcucucagucuccucuuuucccuacagcagcagucagaaauggcucccagacaagucacuugccacacgagagguaggcguuuuccauugacaaaaugcguauuuaaagaaaugaaugaaagcaaacuguguaccuuucagauaggacggcacugugccuguguccugccaguuggaccuggugcaccugcucagggccuggugcaugugucuccugcccugugcccagcuggggcugugcuggaccaccgugcuuuugcuucagaaugcuauagcuuucuugagaaaucugcauuuccuccacacuugaggucagggcagccucugggcggcagccgugcccugcuggucuuuggucccaggcagcaagcacagccucucaucugaaccucaguggaucuggggggcacucacucacccauuuccacaguuacguuuacagaccaagugugggcucacaccuguaacccccaacugagaggcugaggcaggaggauuuacugugucuuuaaggcuagccuaggcuacauaguuccaguucagccuggacuauagcauaagaugauauuucugugacucagagagacugggagagaugaagugacuuuccuggucacaugacuaguaagcaaggucaggccaucacucagggcugcuugauuguagagagagugguucccacaaugcuuuguccaccagccccauccuaagcaaggagcagccccauucucuagaacuuguuuauucaggucguuuccagagcuucccucacucucugcaaugccugugccuccuccugcccucucuaacagugggcacgugucucaagaccuuacuucauccuuaggucugcucccaugcacggccaagugcggaggccuuaaggcucuuccgugaagauggagacuggcagugcccgagaaggcucuugcugcacauuacaggaccauuuuccuagagggggagcggcugcucugugcgcaggaggguggcguuagggugagccuggggugacuuggugugucauuggugcuuugcauuccaggguccccucaccccacgaccaaucacuggaagucucagcacccuuuccauggaagacucaccaguaacauggugugcaaacacugugaacaccagguaagcggcugcccgucccuaugcucccagggggacugcuucagucaugaugcaggacagggccguggugcuggcuggccgugugugugcaugugugugugugugugugugugugugugugugugugugugugugugucugucugugcgcucaaguguguguguguguguguguguguguguguguagggguggggaggcgcaccaucugugcggguguccccuggugcucaggcagcaucugccccaggagcagcagagcugcugucgacagauugcagguccuaggucuucgugucugucugcucuuggugggcacagcagauucgaggagugggagggccuugcuuugcauuugaagguccuaaccuuuuuuauggaaacaucucaaaagugcaaagagaguuuuacaacuguuagucagucuuaagacaucugacacaucacacacgugagcguucucuccugaacaccacaggaccacugaucuaguuucugaccugcuggguuacauggucuggaugguuggaccuucucuuuuggggugcauagcgccuccugcuguuuagaacccaaugcugcugugccacauggcccugacaaguagccuugucugccaucacuuggggauguuuacauuguuuccacucuggggucuuugugugguuguuuucuuaaaugaaagaauacuaggaucuggcagcugcacgguuccccaaggccuccgugccugugcccgcuguggugucugacuccugaggcuagccugcccugcagauguauccuuuaccucucagcgagggcuucaccugcuucccugggaauaacaagcaaggcagacuuuacacagauguguagaaugcugagugcugguuugagacgugcucuagugacugccacagucaagccagcgucuucugaagucauggccuuagcgcgcucucgcguguguguguguguguguguguguguguguguguguguguggugacaacccaucaggauccucuuaacaugcgugagugaugacaauucaucaggaucaccuuucaguaaguuuuacuuaugcuuauugacagucaccguucugggcgcccugaagguuauguccccaugcuaccuuccaccuggacaaguuagcagucugcgucucucugaguuugucaugaggcgagguucaccugugcagucagaaagcauagugcugcuugccuucucuugggagaacagucuccaucguggagagggguauucaucuaccccucuccuuacccucuccucuggggguggggggcggagcuugcuucugugcccugggccagagcugcugugggcguggagccacaguugucuucauacugugcugagcuaggcuacucuuccuucacaccagaaagagauuggaucgaucauaugcuaagucuguugguugguugguugguugguugguugacuugaaacaggcggucacuguuguagcccaggcuguccugagacucaguccuucagugucccauagacagggacuguaggucaccagacaugucuaguugucuguaguuuuuugaagaaucuccacuuugauuucugcaguggcugcccaguucuugccacaguguggcacaguugcuuucuccagccuuugccagcacaucguguccuugugugcccaugcccauguguguggaguccagauggaagucugagggcuacuuguuucuggagacaugaucucucacugaucugguaauuuacuaagucagcuaggcuggccccugccuguccccaccuacaagugugugcuacaaacaugccuggcuuugguuuuuggauuguuuguuuguuuguuuucuuuuuucuuuuauguaaguacgcuguagcuaucuucagacaugccagaagagggaauuggauccuguuacaggauccuguuacaggugguuaugacccaucauacgguugcugggauugaacucaggaccucuggaagagcaggcggugcucuuaaccgcugagccaucucuccagacacccccccccacccgccuuauuuuuuguuaaaagaauguagguucuggggacuaaacucaggucccuuugcuuacacgguaagcgcucgaccccugagccguccuggcaggcacuucuuguccuuugcagugccugucagccaugucugcgcuuccuggaaaaauguuuuuuuguguccuuugcugaucuguuugucugcuuucaguuccucccucucucaccucccucccucuuucccucuccuccuccuuccucuuuucuugccuuucucucuccccucccuuccuucuuuuccuuuuugguuguuuuuggagcaggguaucauguagcccaggcuagccucuggacugcugcuccugccucugggguccuuccaggugugguaucacaauugucaccacaccuggcugcuuguguuuuuaaaugucacuugccuuaguguuugggggaugggugcuuggcucucacccccaucaggcgcaugguuugcagaggcucucucuugcucucuagguaccuuguacuggcuucacugucuuguguugguugacaucaccugugacuaacacguuaaucuuuuugagaagauucauauauugugauuugauauguccuggcuacgcaucuccgauuuuuccccagaauuuauuuauaucuugaagguguugcaaguggaauuaagaauguuguauuuucgccgggcagugguggcucaugccuuuaaucccagcacuugggaggcagaggcaggcggauuucugaguuugaggccagccuggucuacagagugaguuccaggacagccagggcuacacagaaaaccaaaaaaaaaaaaagaauguuguauuuucugcuugucgccacuucauggaguuguguugguuguugaucuguguuauaucuugagaucuuacaaauuuuauuuuuuauuuuauuuuguuuuucacaguauggggacugaacgcagggugugcccuuguaagugaaaggccaacacugucccugagccacacucgguucuggaccccuuguggagucuuugcaguagcugaccugucuagaugggaguugucugucuccccgacagcucucugcccuuuaugucuucucucugccugucucuggcaaggccaccagcgugaggcugaguaaggcggugauggccacugugucuucuaggaaacacgugacagguguucccaaggugaugcagcuuagucuugucaccuuuguguugcacagagcguuccuuuugagucccugucgggaugcgcuguacgugaaugugcgugugcguguacgugugcguaugcauauggagccugaggcccaagguggccguccuccgcugcugcccugacgccugggcuuugaggcagggucuuucucagagccuggagcuugugcuuuggcuuaacuuggccaucaguaaaccacagggauugucucuccagcuccgcagcuggggucccaggugugccugccacacccaggggggaaagcacuugucaccaagccugacagccugauuuugacccuggaacuuacaugguggaagacgacgacuugacucccacaagcacucuucuuacuagugcaugcauacuuuguacauagguguacucaugugcauacacacacacagacacagacacacacacacacacacacacacacgguggaaagccuuccuuccuguuaacuucucugcugagacucucucucugucuguugccuucucacgauucugcugcccuggaucacacuugcagcacgggugugaggucuguggggccaguuucacaccaggcuagcucucgugguuaguuauuuccccucucuccuguggcacucgguguuuuuauuacauauucaauacaguagacucuggauuccgaggucccugagaaaaugagcuuucaggcggggcacacaccucucccagcuauaaggagacaggccugggagucacaaggcugggccagccuuagcugccaguugaaggccagcccgggcuacauuugacccacauacccacauacaccaaaagaagaggaggaggagagaaggauggggaagaagaaaauggauuuuguucugacaggcaguuaauuuggcccauaucccaaacucuucuuuuucuuagacagcaaaugcccuguucuguucugacuuccgcuguugugucugccaggacccucaggguccucucgcaccuguguggcucugugggcagcuguggaauaggcaggugugcacaauucagggguuauccucucugacaacccugucugccugccagcccugacucugucuucugccaucucggucuugaacuguggcugcuucucuagcaccgugcagcguagguaggcaggacucacgcaggagccuguuucugcccaugucuagccauccaagacauccugcuuuuagagcuuuuccagugguugcaggucugagcuacccugucaccuuacacagggaugcugccuaacacagcaggaccaugcgugcagacaugcaugugccacugugcuacuguuguuaaugcauuuucucuccacggacguccacgagugucugaugacucccuaggcuucagcuacucccgguuuggugcucucaguggaacuguugggcauccugguacuggugccagucccuuagauauuaaaaaaaaaaaauccccaagcuucugggcuagguacauacuccagggugaucuccugcugcugcuuaaugaugcugugcacgguguccccucacugugucccuauuugacugcuaugcacuguguccccucacuguguccccaucugacugcugugcacuauguccccucacuguguccccaucugacugcugugcacuguggccccucacuuuguccccucacugugucacugucugacugcuaugcacagugucccccgugucaccaucugacagcugugcacuguguccccucacugugucacugucugacugcggugcacugugucccugugucaccgacugacugcugugcacuguggccccucacuguggccccaucugacugcggugcacuauggccccucacuauggccccucacuguguccccucacuguguccccaucugacugcagugcacuguggcccccaugucaccaucugacagcugugcauuguguccccucacugugucccuucagcugacugugucacuggcugcugugcacuguguccccucacuguguccccgucugacagcugugcacugugucccucugucaccguaugacugcucuguacuguguccccucaaugugucccaccacugcguccccucacugugucacugucugacugcugugcacagugucccccgugucaccgacugacugcugugcacugugucccuaugucaccaucugacugcugugcaguaucccccaugucaccgacugacugcugugcacuguguccccucacuguaucccaccacuguguucccaucugacaacugugcacugugucccugucugacuacugugcucugugucccagugucaccaucugugacugcugugcacuguguccccaucugacugcugugcacuguguccccugugucaccgucugacugcucugcacagugucccugugucaccgucugacagcugugcacugugucuccucacugugucacugucugacugcugugcacugugucccccaugucaccgucuaacaguggugcaccgugucccugugucaccaucuugacuacuauucacuguguccccucacuguguuaccauuugacuucaaacacuaaccugcaagccugacgugguggcacacaccuuucuuuaaucccagcacucgggaggcagaggcaggcagauuucugaguucaaggccagccuggucuacaaagugaguucaggacaaccagggcuauacagagaaacccugucucgaaaaaccaaacacuaaccugcuccguuugucuuuugauuucugugauaugucuuucagaguccuguucgguuugacaccuuugacagccuuucucucaguauuccagcugccacuuggguacguacugauccuguggcuuauuugaaucuauuccagacaccuuucaguccaaagggcuuugggugauuugguguggcccagguacuaauugucauucagauguguggcuggcuaagccuuuuccacucugaucuaagguccauguuguggggagagaaggugacaguuuaucucacugaagacucauuggccuuuggacacuuguguguugggcacacaucucaaacucuaagauuguagcucuguguacaaaugcagguccccucagcucugcuucucuccugagcccgugugagugcccuguucccacuaccccuccccuccugagccugugugagugcccuguucccacuaccccuccccuccugagccugugugagugcccuguucccacuaccccucccuagugcaugugcucagcuagcccucugagcuguucuaauugccugccucugcucuaggggcacccacugacacuggaccacugccuucaccacuucaucucaucagaguccgugcgagacguugugugugacaacuguacaaagguaugcauuccacagugucaccucccaccuccagggccuucagacagggccacaggggcugaaauccaaggauaucuggggauacugagguucucuggagcagggagggccaagaugucuagaauuguccccagaagcuguauacaugagacuccagagugaaguauacagggcugggaggaagaggcgggccuggggguuuauuuacuuaauaaaguagagcgcuuugucugcauguaucuguguguaccaugagagugccuggugucauggaaucagaagagggaauuggaucuccuggagcuggaguuaucucugguuguaagcccuauguggguguuuggaaccaaaccuggguccucugcaaaggcugcaagacugacgucuccagcccucucuccauggaauauuuuaguauuuaaaagguucccauuucagugcuguguuuccuuugccuucucugcucucugaggguggagcucacagagcucacagcccugcaagccgccacuccagggcuccccagacauacuguugcuauauugcagauugaagcgagggggacacugaccggggagaagguggagcaucagaggagcaccuuuguuaaacaguuaaaacucggaaaggugggucauccucgcuugugcuccccccacucccagggggaagggaggggaggggcucugucugccccugcacugucuaagcacuuccuucucccucugccugcccaccugcagcugccacagugccucugcauccaccugcagcggcucagcugguccagccacggcacgcccuugaagcggcacgagcacgugcaguuuaacgaguuccugaugauggacuucuacaaguaccgccuccugggacacaagcccagccagcauggccccaaagccaccgagaacccagggucugccccagaaguacaggacgcacaggcggccccaaagccaggugugugugugugugugugugugugugugugugugugaugagacggggaguguuaaguaccacaggccagccgguugacuuggcaguaaaagcaaccucauuuggagccuuggagcccacguaaagguggaaggagaggacagacugcacagaguuguccccugacuuccacacagcgugcaugcaguaaugauaguacauuuaaaaaaugugaagacauaaauaaaagcuaucacagauggaaaggcacacuucagggcgacgcugcagggcugccaucuugcuuugaccuuauacagcauuucagagccagcuuggacugcauuauaugauccuguccgcagcuaaacagaaacccagaccaacuguucacacaggucagcugccaucucuauaacuccggcccuuuucucccacaggucugagucagccaggggcccccaagacacagauuuuucugaauggcgccugcuccccgucucuguugccagcccugccuuccccgguggccuucccucugccagugguuccugacuacaggugagaggggcugccgacaagcccggccuggcaccgggacacacagugggggggcagucaguccccucuuucauguugacauuguuuguuaccuaguuauuuccaagacaugagugugugcacauguguaaagugugcagagaacuguuucuugggccuccagcuaggcagucaacacaaaccuuagcacuuggacgcauguuguacucagggcacauccuugaaguuaacagccguaguuaacaauuaggugugccugugaaugcucacacucaccuccuguaguguaacacacagggcucuuuaagcuuuggcuuugccuacaaaccccaggucugucauaaacaauugguguuuuucccacccaucagcuccuccacauaccucuuccgcuugauggcaguugucguucaccauggagacaugcacucuggacacuuugucaccuacagacggucaccaccuucugccaagaacccucucucaaccagcaaccaauggcuguggauuucugacgacaccguccgcaaggccagccugcaggagguccuguccucuagugccuaccugcuguucuaugagcgaguucuguccagggugcagcagcaggggcgagaguauaggucugaggagugacaggccagcccagagccagggcccauggugagguccacacuguccaggauaaaagcaaaggcaugccacguguacacgugcaagccagcccucuagagcccucagccuucuguguauucugagagcaggcuccacaagggagccagacccacacagcacugccagggugaacuggaagauguccugugugucuagagcgucuuaccugacagaggcaaugaaaagaagcagaucccagaagccaccuuuucucugcuguaauaugcuagguguucucagagggcagccuuuggcuagccccugacauuucaccauagauauuuauuuuuaauaaggaggcccguaaauauuauugacaagaauuagugaaauuauuaaaggcaacaauugagaagaaaaagugccuuuguuucccauuguugugagaccaagcgugaccugagagucacagcugugacgcugggaaagccuuguccuuccaggcuccucagaggccaaaagaauaguucaagaaugccuaaaacagugugguggcucaaccuggcaucccagcacguggagacugaggcaggaggaucacugcaaguucuaggccagccugggcuccaucauuaaaaccuuaucuccucccaaagccucaagacaccucccaccucuggggacgccuuuuguaaucucgaguucccugugccgcccacggaggaccaggagugaucacucuuccugagcugugucaucugcaccucugauccgcuucggaagauggcucgcuuccuguuaguaguugcccacgacaggguuuacaggccagaaccugggcagggugaccugacagcugggguaggaagagcaggcccuaacccaggguggcagucucucuggaccuugcuuucucagucagccuacgguaaggacggaagcagcaugauaccugagcagaaguggagcaaaauccugcaguuuggcuuuagggccaugcucuaagagugugugacucucaugguuucaauaagcaaacgguacacugggccucuccccuuuccagacuagccucauggacagccagggggggaucgugacggcacugacguaccuagauguuagcuaaguguguaauuaaaaaugauaccaaauucaaacugacucuucuggucuaagguuuggaaccugaccuauccaaaggucacugagguaaggccaaggauguguuuucucugccgggggugagcuggcagacauuccagaugugccuaggcaucagcuaugagaucagaucucacugugcauacugaggacuugagacucugagacuaugcugugcuggacuccacgacacagcagccccacagaccuggcuuccgggcugagaugaacacaaaagccggcagucacuugugaccauagagcaccgugcagggcugugggccccaggcaccaguccugcugcuccugagguggcugagaggacaauugugugcgugagccgcuguagaugugucacccugaccgagcgcuaauguccuuccucauuuuguaaauuauuacauuagguaaugaccaaugauggcuccuaguuuuaaguucuucacaguaggcaccuacuucccggagaaacguaagcuaagcuaguacuuccgccguaggcugccgaguguggacuugcugaagccuuuguaccugcugagcacuacugcaauaaagacgguuuuguuaggaaacagccaagugcggugcuuuaguccuuuauguaccgcaggcuaccugucaacuugugaagauggccugccucugccuccugggugcugccacgccaggccugacggguggucuuuuuggugggugucccauggcauccuccuccugggugcugccuauguuuuuauaaccuuuccuguucucugugguaaagcaaacaccaacuccuuccagcuaagagaaagcacagagcacugacuauuaaaaauggcucuuaggggcuggacagauuugucuccacauuaguaccuguguugagcagcccacaaccacccauaacuauaguaccaggugaucuggcaccucuggccucccugugcaugcacauaacacacacauauguccacauaugugcacacacaugcacacacccccccccaaauacaauaauaaauaaagacauuuuauuucuuaguagguaaaauuuuccgaaaagucaaguugacccgcggagccaggacccucuugcggauggggagacugugguaccaguggguguugguugggggguucaucaucagcaggcuuccgugugccagcugcagccugaccaccuccacuguccuccggggccucuucccucgagagucuuugugccggaaaaugaagucucugcaagcgccaaaggagacagacgcgauggggcuccccggagccaguucucgcucgucaucucugugcucgccgauguggucgcaaccaucuuuguaccuacagugggcaagcaagcaaucaguucagaagaaccucgcucccucagcugcuaauggagcugccucacucucuugcagccugcagcagugcuggcuucgcaaccucguagccuggcaggcgcacaggugagcccggccucggguguccgugcugagugugcugcuuagaaugagaauggucucugcaggguccuguuugcacacuugguccccagcuaguagaacuauuugggaccaagcaggugugaccuuguuggaguagauaucauugugguggggcuuggcuuugagguuucaagagcucucaccaggcccugucugucugucugucugucugucugucugugucacuuguucuugccugcuauggugccagugccaugccugucuguucccccugccaggaugaucacagacucacccucuuaagacaagcaagcucaauaaagaaagccucagcacaau

SEQ ID NO: 2611 - RNA, 4294 nt, Mus musculus
ugaggguuccuggggcugcgugugucugugcagagaccugacccaccgcuccgggcucuccgguggagcccgguugcucgcccgugccagccccuaccccgcggggccgcagggcagaggcaacccugcuuuucuggguaacugggcgagccucaugccucucugcgcuugcgucuucccauguguagccuuuuggguuugggcagccguuugcagccaaagcucucgaauuccgaagaggacggacgggucuuuaaaaguacuccauuccagggcgggccuggggaugcgugcccgggauuccuaccgaugggcgccuggggcgugaggacagcgugguucgggucagcuugugcuaggaagacuuaagcuacagggcaggcuccccgccuggaugaugcccgccaggcaccuccuaggagguuuaaugcgcucuuguuuccuuuguaggacgcgucugagcugugagugggcggcgggauggacaaguuccuggugaggccagaccuccgcgaccuccaagggggaggggaggagcccgccccgacgggaggagccucgggcgaccugaagagcccggacuggcgacaccuucgcgcggaaggucugagcugugauuacaccguccuauucggcaaagccgaggcagacaagauuuuccgagaguuggagcaagaaguggaguauuuuacugguaggcggaggucuuacgugcguuaggcuugugcgaggacaggaugcgccuucccugggagaagcgugaacuuccggcugugacggauuaggucacggucugggcagcucugguuagguuagguuaugguuuggcauacgaacuguccacgaggucuagaacgaaauuauuuggcaacugauuggaauuaccugggaaguuaaaaaacuaaauaacaaaaaaagcaaaacaaacccccaaaccgaaccauucugggaucuucgugauacugauucaaaauagcuggaggcgaagguuaggccucagugguuuuuguuuuuucgagacaggguuucucuguguugcccuggcugccuugaaacucacucuguagaccaggcugaccucaaauucagaaauccuccugccucugccucccaagugcugggauuaaaggcgugcgccaccacugccugucgacacccuguuuuguuuuguuaaagaccauaauuaaauaaauguaugagaugagucagcaguuaagacuaguugcugucccagaggacccaaguuugggucugagcacccacauggcagcccacaauccucuguaacuccaguuccagcuacuguggugcccuuguccagccuucgagggcacagacaucacaagcaagcaaaauaaaauauuuaaauacauaaaauaaaacaaaauuuuaaaaaggaaggggagaaugauggccucaggggccuucucuuagaaggauuugguucuggaccagggacaaagggaguguguauuuuguauaucaaagcagaccaggccuccagguucuuccagcaucccccuccuccccccacacacaaguccuuuccugacauacccugcccccaacccuguuuccagcccagggguugagcagcccuucccccagaggcucuucccuauaugauccagacauuguggucucuccucuuucucuucucucuguacacucgagcucuuuuucuauuucuauuucucuuccuccuccccuauggugaauucccuggccagugaacuggccccaagaaacugcauuuaguauuaucuaaucugucuuggcccauuucacccguggcagagaaauaacuuaucacaagucacccauguuuuguuuucagcaauuucaugcauguguaugaugcauuuuggcuguuuucacacacccccgauucaucacccugacuccuacagaaccccuuugucccaagccccuguggugcucucauguuauuuuguuuuuguggcccgcugguuuuaaugcuauuguguccacaugccuugugugucugcacauagugugucuacaugucucaugugucugcacaaggaagccacagaauccaguggauuuucaguauacucaugugcauuccuucugccccuugacauaaagcccagcuggagaccgcuuccucacugagacauggccucuccugagucuggaacuugcagauccagugaggccagcuggccagugagccuccagcagugggauucgaggcauacugagcaauaccuugugguggacacuuuaccaacugaggcaucucucucuuucguugagacaugcuggcuuggaauuuguguucugucuacuucagcaccagagugaauacuugggacaagccacaaugauuuaggguaagagguucccaacauggcguuuuacaacgugagcagagggaacguuguuucugcuucuccaccuuugaaugugcggagcugucugcacccaagggucacugguggaacucccguucuucuacgcaggugcacuggccaagguccagguguucggaaaguggcacaguguucccaggaagcaggcgaccuauggcgaugcuggccucacguacacguuuucuggucuuacccugacaccaaagcccuggguuccuguucuagagcguguucgagaucgagucugcgaggugacaggacagaccuucaacuuuguacucgugaacagguaaggcuuccuccgaggaaagccgugcuccuuugugacaacccuucuauagugcaccaggcuagacagguggccgugccacucuugcagagaacccaaguucaguucccaguccuggcucuggcagauccaacaccucuggcuuccgugaauaacuguacucaugcccaauuaucuuuuucuuuuuaaagaggggagucuucacagagcuuguguguagaugugagagggguuggaccuguuacugggaaaguuaaacauacugauaggauuggggauagggcuggauuugggguccaaaguacuuugcuguacggaguugaccugugugccaggaugcucaacacacccccagccucaacccuguaggugcccguagcaccuagaauggguuccaguauagcagccaacagggcgucuugauucagccuggcuccgaggccugagcuaaaggggaagccauuucacuuuagguggugagagggaggcucccaggggcugggacggcugacuugguaacuagcuagagagccggagauacccaguguucagaguagagcagagggggcuuacggugggugccacugaagaucggagauggagagggaaggguguggagggaagggcugaacugcgggggggggggggggguggucagcaaauguggggaggagcuugugacaggcuuucgggcugugaaccuggaaggcguagcuaugugaugugaugggugaggccugcagguauuguaagaagcaacuuauuaaguguucuauggcugugaggaaugccacuguuaaaaaagaaagcauugugcugaggcuuucuuuauugagcuugcuugucuuaagagggugagucugugaucauccuggcagggggaacagacaggcauggcacuggcaccauagcaggcaagaacaagugacacagacagacagacagacagacagacagacagggccuggugagagcucuugaaaccucaaagccaagccccaccacaaugauaucuacuccaacaaggucacaccugcuuggucccaaauaguucuacuagcuggggaccaagugugcaaacaggacccugcagagaccauucucauucuaagcagcacacucagcacggacacccgaggccgggcucaccugugcgccugccaggcuacgagguugcgaagccagcacugcugcaggcugcaagagagugaggcagcuccauuagcagcugagggagcgagguucuucugaacugauugcuugcuugcccacuguagguacaaagaugguugcgaccacaucggcgagcacagagaugacgagcgagaacuggcuccggggagccccaucgcgucugucuccuuuggcgcuugcagagacuucauuuuccggcacaaagacucucgagggaagaggccccggaggacaguggagguggucaggcugcagcuggcacacggaagccugcugaugaugaaccccccaaccaacacccacugguaccacagucuccccauccgcaagaggguccuggcuccgcgggucaacuugacuuuucggaaaauuuuaccuacuaagaaauaaaaugucuuuauuuauuauugua

SEQ ID NO: 2612 - RNA, 2119 nt, Mus musculus
uguuuuuuuuuuuuuuuacuauaacaaaauaccugaggcugaguaaauggaaagaauagaggagguucacuugauucugggcaguccaagagcagagcagaccugugacccauccucacacagaauccuaauacggcagaggcgccccaagggaagacaagccagagugauaacucaggccuuucuuccucuucuuauaaagccauuaaugccaucgcgggaugggggaucagauccucaugaccucauccaaccuuaauuccccaaggccccaucuccagauaugaauucaggcuaugaauucuccagcaggagaacuucagccagauguggugugggugggauauacacacaccguggccacugcuagcuaguccccgaaaaucuugagguacccagccucuggagaaagaaaucuagacgagauguuuagcugaguguuuuaggcuuuuucccauuucaaagacagauaguggcggcccaggagauggucuugauaucuguccaggacucugaccuuaggacagagcuuuggcagagauggcugugccuggggcucugugguccucugugguuucugaucaagcccugcggcagcagcucugcuucaccuucaugggcuucuuccugcuggacccgccgcagcagguggaagcuccugcccuuccugccuguccuccuuuucccaacccaaagcccuccucuuucuggcuccuuguuucuuucacacuaaagguuucuuuguucccaucaggccugacaguucugcaucgaagcuguauguucucuuccucuuccuucuccuccuccucuuccuccuccuccuccucuuccuccugcuccuuucuuuuucccuuugcuuuucgagacagggcuucucuguguagcucugucaguccugggauuugcucugcagaccaugaugcuguccuuaaacucaaaagucugccugccucugccucccaagugcuuggauuaaaggcaggcagccaccauugugccuggcuugggacuugcacuugcaauggcagacaugugcuuugguuuggcugucugucaauaucuuaguauuccuggagauacagaggaaggacuggccuuuuuacuuuguaaugugcccagccauccagggcucccuuacccugacccaccuuuaaagaauccagcugcuagcuucuauacuaucugcucuguggcucucacaacucuugguucugccuuuuaugucuuuaucugguuccuucugugucgccucucuccugugcuggguagcaagucccuaaguguagggucugucuuuccucaccaccaugugcuggcugaagguagguaggcuuugaauauuggccagaugcauggaugaaaccagcaauguguacccucuucagacaaaaucugcauuggggggggggcguaguaaauacuuagacaaacauggaaaucaauggaugaauuguugguggaucaaugaauagacggauagacauaugaguagguggguggauggaugguagauggauggaugaaugaacaagugguuagauagauagaugaaacagagauggacagauguagguugauagauagacagauggaugggugacuagauggauggacagauagauggaugggcagauggaaggauggauaaaugaauggguagaggaauagauagaugaauagguugguggauauugauucucuuuggccuuucccuggacuugguugguccuugagggcugaaauucucacacaacucacacagaaacagagucaacaagcacaucacaggguguggcaaaacagccucugacacugccuuuguucagggacacaccaugguguuggcugcaugcuguggggucagcagagugggacaagacagguucaggaucacaacacugcagugcuaugagacggagcguucuuuacuggugugagcccccuuacccgcaggccuacucaucccacugcacaaacauccguguuauaaugaagaggacagcuuugccuuucuagaaaccacguuccaagucccaaagcacacugggcccugagaguucaaagagaggacucugcgcguguguccugugcaggagcaguccuuagcacacauggg

SEQ ID NO: 2613 - RNA, 2119 nt, Mus musculus
cccaugugugcuaaggacugcuccugcacaggacacacgcgcagaguccucucuuugaacucucagggcccagugugcuuugggacuuggaacgugguuucuagaaaggcaaagcuguccucuucauuauaacacggauguuugugcagugggaugaguaggccugcggguaagggggcucacaccaguaaagaacgcuccgucucauagcacugcaguguugugauccugaaccugucuugucccacucugcugaccccacagcaugcagccaacaccauggugugucccugaacaaaggcagugucagaggcuguuuugccacacccugugaugugcuuguugacucuguuucugugugaguugugugagaauuucagcccucaaggaccaaccaaguccagggaaaggccaaagagaaucaauauccaccaaccuauucaucuaucuauuccucuacccauucauuuauccauccuuccaucugcccauccaucuaucuguccauccaucuagucacccauccaucugucuaucuaucaaccuacaucuguccaucucuguuucaucuaucuaucuaaccacuuguucauucauccauccaucuaccauccauccacccaccuacucauaugucuauccgucuauucauugauccaccaacaauucauccauugauuuccauguuugucuaaguauuuacuacgccccccccccaaugcagauuuugucugaagaggguacacauugcugguuucauccaugcaucuggccaauauucaaagccuaccuaccuucagccagcacaugguggugaggaaagacagacccuacacuuagggacuugcuacccagcacaggagagaggcgacacagaaggaaccagauaaagacauaaaaggcagaaccaagaguugugagagccacagagcagauaguauagaagcuagcagcuggauucuuuaaaggugggucaggguaagggagcccuggauggcugggcacauuacaaaguaaaaaggccaguccuuccucuguaucuccaggaauacuaagauauugacagacagccaaaccaaagcacaugucugccauugcaagugcaagucccaagccaggcacaaugguggcugccugccuuuaauccaagcacuugggaggcagaggcaggcagacuuuugaguuuaaggacagcaucauggucugcagagcaaaucccaggacugacagagcuacacagagaagcccugucucgaaaagcaaagggaaaaagaaaggagcaggaggaagaggaggaggaggaggaagaggaggaggagaaggaagaggaagagaacauacagcuucgaugcagaacugucaggccugaugggaacaaagaaaccuuuagugugaaagaaacaaggagccagaaagaggagggcuuuggguugggaaaaggaggacaggcaggaagggcaggagcuuccaccugcugcggcggguccagcaggaagaagcccaugaaggugaagcagagcugcugccgcagggcuugaucagaaaccacagaggaccacagagccccaggcacagccaucucugccaaagcucuguccuaaggucagaguccuggacagauaucaagaccaucuccugggccgccacuaucugucuuugaaaugggaaaaagccuaaaacacucagcuaaacaucucgucuagauuucuuucuccagaggcuggguaccucaagauuuucggggacuagcuagcaguggccacgguguguguauaucccacccacaccacaucuggcugaaguucuccugcuggagaauucauagccugaauucauaucuggagauggggccuuggggaauuaagguuggaugaggucaugaggaucugaucccccaucccgcgauggcauuaauggcuuuauaagaagaggaagaaaggccugaguuaucacucuggcuugucuucccuuggggcgccucugccguauuaggauucugugugaggaugggucacaggucugcucugcucuuggacugcccagaaucaagugaaccuccucuauucuuuccauuuacucagccucagguauuuuguuauaguaaaaaaaaaaaaaaaca

SEQ ID NO: 2614 - RNA, 13029 nt, Mus musculus
gcggggcggagucauccccgggccuggacgggugccuagccgggucagucuuggaugcguuaccgugcgcauggcuguguggcucuuugggggucgccucggccugcgcgggcgucucagcgccugcagacugcuguguccccguuuccagagccguggcccucagggcggggaagacggggacaggugaguuucaggccuggagaguaacucaacacggaggaggaacgguuguuuccguggguacaucacaccgaugacgugcucuauguggccugacgucacugggcucgucauggcgucagaggccaggauuuccuccccaaguucuaacggagucuagcuguggucagucagggcaggggcaugcucuuguggguuuuguccggccuccccaagcaguuuguuuggauuaggauuaagacaccaggaagacaugguaacacuuagaaacuugcauagggacuugcagacuaccaugaccucaugaucagcguucccuguccaguccucugacuuugaaauaauuuugugaauucacauuuuaauuuuaaguuaugcacugcuaguugaaaauggcagagucgggguucauucgcaguccucaaaaaaaaaaaaauuaaguuaaaauagcauuuuugaaauuccauuuugacaguguauuuuuuuuuuuccuugacacugaaaaaucuuagaaaagugcaaguggccuaguuuucuuucccccagaagugcuaacuucuguguugggguuagaagagacaagaguuuggggaggguaauggaccaggucaggcuuacaguagaaggguuuugggcaugaaucccagcccagucucuuccuggagaucuaggaaguugaaucuuugugggcuccaguuuccucaacggagaagcguauggcuaacuuugggagugugggagaagcugaagggcaguuccaggagcuagcggcuuuagcccacuguggagcuagggcuacauggagugaccaguuaguccuuccugccaguauuugccaagaaucuuuauugagcaguaugcuacagcagcugcuguacagguagagacagggacaggaagcugucaggaaggggcagcggggaaauggcugacgggagauugccaucccagaggcagagaagugcugccccugagguugcagacugaaagcugggcgucacuccccgaggcgcagccguucccacuuaccacgccuuugugucuguuucucaucaggcugcagccguccucgacggcagccaagauccccaagauuuacaccaagacgggagacaaagguaggccacgcuguagccaugugacgggucugaauauacaucauaagugugaagccacaagaaaggugcacuguucaaguguucaaaacaaguuguagcgcugcuacaauggcucagacugcucuucuagagguccugaguucaauuuccagcaaucacgugguggcucacaaccaucuguaauggacucugaugcccucuucuggugugucugaagagagcaccaguguacucauauacauaaaauaaauaaaucuaaaagcaaaaagcggggcuggugagauggcucagugguuaagagcgcugacugcucuucugaaggucagaaccacaugguggcucacaaccauccguaaugaaaucugacgcccucuucuggggugucugaggacagcuacaguguacucacauauaauaaauaaauaaauaaauaaauaaauaaaucuuaaaaaaaaaaaaaaaagccaaguuguaaggaagccaaguauagugcacaccugcaaucccaguacuuaggagcugagguuggagagucacaaguucaagaccagcuagguugauguaccaaacuccaaggcagccugcucuacauaguaaaacccugucuuuuuuuuuuuuuuuuuuuaauuuucgagagaggguuucucuguauagcucuggcuguccuggaacucacuuuguagaccaggcuggccucgaacucagaaauccaccugccucugccucccgagugccgggauuaaaggcgugcgccaccacgcccggcuuaaaacucugucuugaaugaugggaaugacacgugugggguuggaaguguagcucagugguagagugcccagcuaguauucugaaggcccuguguucaacaccaagaccaaaaaaaaaaaaaaaaaaaaagauaaaaagagugugggacaguguaaggccuccgagucaugagagacacaguucagggugagccugcucugcucacccacagugggcggcucacaccuuucuauaacuucacaucuacagggauccauugccucugaccucugagaacacuugcacauacauacauacauacauacauacauacauauacacacacacacacauaucuauauauacacauauacacauacacauauauauacacauacauauacacacauauacauaacaugcauacacauauacaacauacauacagacauauauacacauauacauacauauacauacacagcaugcauauauacauauacaacacuugcacauacauaccuacauauacaacauccauauccauauauauauauacauauacacacacacauauauacacauacauauacacacauauacauaacaugcauacacauacacaacauacauacagacauauacacacauauacguacacagcaugcauauauacauauauaacaugcauacacauacacaacaugcauacauacaugcauacacacauauauacacagcaugcauauacacacauacauacuugcaaacaugcauagacauacacaugcauacauauauauauaacaugcacacacacauauauaacaugcauacacauauacauacauauauacuaugcacacauaaauauguauauacauauauaugugcaugcauguaugucaggguaucucugcauaacccugcauguccuugaaccucacucuguagaccaggcuagccucgaacucagauauccgccugccucugccuccugagugcugggauuaaaggcgugcuuccacugcccagcccaaauuuaaaaaaacauaaaaagaacuuuuaguugauuuggauuaaaacguguaugaugguaagcaugguggaacagguauguaauccugguacucuggaggcagaggcaggaggaucacuguaaguuuaagccugggcuauagugaaagcuuaucucuaaagaaaagaaaaaaaauguguguguauuguguguguguguguguguguguguguguguguguguguguguguuuguauuuguaugccuggucuacauagcaaguucuaggcaagccagggcuacauaaugagaccuuuaucucuaaagaaaagaaaaaaauaaugaauguguauucagauaugucuuugggauuucuuaaauugcaacuuauuuagaguguguuugugugugugugugugugugugugugugugugugugugugugugugauaugugccuauaucccaaugcauuugaggucagggaaaagcuuggggaaguugguuuucuuccaccauccgcuucccagggauuaacuugggucaucaucaggcuuggcagcaagugucuuuaccagcugagccaucuugcuaauccugaaagauuuuaucuuugucugguagcuaggagagagaucugauaugugggagagagaaauacagaaaaguucacacacuguucuucuauuuuccaauaauaauaaaaauguauugcuucaauauuuauuaaauguaauguaauggagaaauaaacuacuaugguaccauuucugaaguuuuaggaccauacagaucauuaauagugauuguguuugaguuauauccuuucauacuaaaguguauacacacauacacacaccccacacucauaggauguacuuccugucaccgagcuguaugugaacaaaacgucagaaugauagauguuuuuucugccacgucuauguuguuaccagaacggugggaaaacauguguauagaagugacaggugucagaugguggugucagugcuacaccggacagguucggggacagccucaggucacucacagacggggcagugggcucacuauggcccggcaguaucugcuagauggggugaggcuucugcuggcccgcacagggacggaggcaaagaaacugaccuuuguucugggucugauguggucgggaagcagggcuccuucuguaacguauugaccuuucuuagaaaguagaagagaggggcguggggugggauggggguguccuggaacugugauagagacgcauacaucuuugucaucagccaggagagccaaagccuggucacuuuuguucagacacgguuacuucaguuuguugagguugcucugucaacagccacaauguggauaucggaugucccucugugaagucauuuuuacuuaccagugcugcagcgggcucaguggcuggacggcaugaagccacgcugauggcccuaggcagaagcugugaccuaggcugacaggagacaggacgagcagaggggugacaccacaggugguuccacuagucuaagccaggaagaagagggauagccuuggugguagugaccaaaaggacauucaggcuuaugguguguggacauuuugacggguaugagcguuugccuacauguauguacaugugccacacgaaugccugcugccuguggaggacagaagaaagcaucagaucccaggucagcaagucacucugugguugcugggaccugaaccuggauccucugcaagagcagccagugcccuuaaccacagagccaucccuccagcuccugccccaccuguuguggaauaaauuuaaucucagucaggggcuucuuccccuccuuugauuauucaguucccagauaaaagauacacguagaccuuuaauuuauaauaagcuuuuaucgccacuaaagcugggcagauaccuacccucuauguuagaaucuccuuuccuaucgauaaccccgaauuacuacuuacaguguuccaucugggcugcccugagcuccagcuggccgcccucauggccauaauuuuaggauucuuaccccauggcaucuucucuccgcaccuuccucuuccucccccucgugguuuuccucagacucuaagcccaggaacccccaagcccuuccucucucaguucugcccaggaaugaucuguagguaucuuuauucaccaaucagggguaacuuggagggcagugucacguagcaucacuugggucuacaugcggacucucugggacaaccagguuuuagggaccaguauugaguguuacaauacaagcaauaucagaccaacccacuacacccacccccaagaaaacccccaaaucuuaaugugcuaaaaauaucuucccccaggguuuuccagcaccuucacaggagaaaggagaccuaaagaugaucaaguauuugaagccguggggaccacggaugagcuaagcucagcuauuggguaagcggcgggccuggaugugguuaguacugggcaucagagacccauccuugugacauucucugcccugcaggagggcccuggagguuauccucaauggaucugugugagcugcuguuacgagaagucagcucagcucguggucugucccucugucaccugugccuaggaaguuuguuuccucuucuguccuaccuuaugaagaaacuccucuuuuuuuuuuuuugguuuuucgcuguauagcccuggcuguccuggaacucacucuguagaccaugcuggccucgaacucagaaaucugccugucucugccucccgagugcugggauuaaaggcgugcgccaccuugaaagccucccccccccccccaccccaugagcggguuaacuugggcaucugacgcacugcacaggucucucucuccugcuggacagaucccaggucuccugcucccugcuguugcaacaggacuagccuauccauguaauaagaacagcugacucggggugggugcuuuagaaagcaaaugcccccguccacguguucucuuugucagcaagacaaggcugccuugguggguguagcucauuagcuuacagcucucagagcauacugucagggacuaauucuuccucgucguuuuagguuugccauggaguuggucacagaaaaaggccacauguuugccgaagagcuucagaaaguaaguagcaucauuuuugcccacgacagggccuuuggugccugugaccugaauugucagcuggcagcuucgccuggcccauuaccucuuugcaucacaguagcuaaucacucuugaggaccugcugucuucaucucugggacacauaauccucccugaggcuaggggugugggugaacguugacucugcucuccgggggugcucggcaauacggaaggcuaucugugcucgacacaucuaguggcaaguccuacaucgcaugggacagccucuuggguugcagaggacaacccagggcucaggcugaagagcugugugcucaggagcccugcugccuucgagucucagcaagguggaccucuaccuguuagcgcugccauugaguucugaggggcaucugcuagcagagucacucuaggaugcagugggaggccgaggucacccaagcuucacuguagucugguuggggccuacgugggucccaggaauggacagguguccucccugaguccuccugucccgcugaccaccgucccaugggcuauccuucaccauuuaggcggcacugguauguuugguccagugaauuaaacuccaggagguuucgucguguuuagaguuagggcaguuggauucaugguccaacggccccgacacgguccacaaacggucuuucuccucacccuugcuccagauccagugcaugcuacaggacgucggcuccgcccuggccacuccacguuccucagccagggaggcucacuuaaguaauucccagccugcacagggaguuaguggggccuuggggugaggguggcccugagaguugcccacugggagcccugggcccuagagcucucugguagggcagacauccuugcucucugccuugggagagauguuauccuggaggcugguggaagcagggcucccacacagaaggaagggguguuucccaguggucugguggcaugcuuacaguagggccucucugcccuugacuccuuagagcacacggccuuccaggaagggccuguccuggagcuggagcgguggauugacaaguacuccagccagcuccccccgcucaaggccuucauucugccuguagguauuggggugcucaacuugguguggcgggguaguugcuuugauggaaacacgggcuugccaguagacccaacuguagcaacagagucacccccugcaccccggccgcucagagguauuccagcauagagcaacaguggccaacacccacucucucuuucagucuggaggcaagagcagcucugcccugcacuucugccgcgcuguaugccgucgugccgagagacgguaagggccccagaggacaaugcagaacccuugucguaucugagccaccgccucuucauuguacguguccugaguacuguccuggagggcacuguaaugagugacucacacugcucagaggccaagcagagcuuuuuucugcucugagagccauaggcucccuaggauguggggcugaggagaacaccaugaaaggacccugcuagaaaccagcagaaaggacuacagggagcccagcgguugggggacaccagagaaacucuguccacaucucagggguuccucacagcaccuccagucugcaggggucaggagcaggccagugagauucuggggguccgcagacucagaucgcaagccuuuucccuucacagaagacugcugaaccuggacauuucccagcauuuccugggugacaaacaacaaaacaaaucaaaccaaaaccaaaaugcuugggccuccagagaaaauggccauuugcauaaagucacccgcaucaaccgggcuuauaccaucagagcacgagucugagcuggugucgcaccuucagugcagcugacaggccccggcugcauagugacaugccagaaagcucuccaggcaggaggacaucuaggugaagaagccaagugggagguguggggcgagcaggacuagagacgcaagccuuccugggccgauggccaaacccaacacacacccccaggcuagcucaggggaggaucagcugggaucaggaggugggaugggacaaauuguaugugcgcagucaggugcgggaccucggguaauuagaauuacaacuuagaacaaguagcuccuuggggauuaagggcuagacgaaagcccuucuucgagcccugcccacaaaggagcccgggccaggcuuugguggcacaaaggccagcagacugggcagccuacccucaccuugccugcugugcgucccccuucacuggccaggccacguugcguguccccaagcuaaggggcuggcugaggcagugguggguacgcugugucugguuugugcuugccaggacucgguugaauagugaagucaagugguggcaauacaugucccaggcuccuauguguggagccuugcucuguaaccugacugugcguuuucucuucacaguguggugccucuuguccagaugggagagacggaugcaaacguggcgaaguucuuaaacaggugcuuaaguggaguguggcgggucugucugaccaccaggccccucccuucaucauguauauuggacugugcuguguccccaguggcccugucccacucugaagucaggcucuguuuaggaaauaagagccagcgcaggcacaccuaaacaagggucaggcgaucuuaaggucugcucauggagacugcucccaggggccuugauguugguagagcgaaguccguccagccagcgucucuuccugaggugcucagacggcccauagccagguugagcucagugcucugagcaagguuacuacuccaggagugcauugcccugcucucugcugccccacagccaugcuucuggucucuacugcauccuggcucagaugguguuagugcagaccaggcugcgccccaggagcugccuagcaagacaggaagugaccucacaacaccuagcugugggguuauguguguccuggguuaccuccccaucccagaauauagacuaccuuggaucuucauagaauccuuccuucuggguggaaugucacccaggucaagagagaaauggcuccuuuuaaacucagaagaggcaacccugaggauacccgcugacucuacaguguugugcgggucagggugggucgugcccccucugcagguuccagggagucaccaagaaagcagcacgugguugccccaggaacacauggcucagaaggacaaugccaggacagaaucuugacugggagcccaguaaucagcuccgagaguuagggcaccagguggaagggggcugggcacagggugccgggcaagcaggaggguguggagaagugacaaaggcuugcuuugagccuccaggaggucagagccucgagaacaccugggacagguguggcguugucuccuaggcugucccuuuuccugcagaaggccucccaccccgagcccaucacugcugggccugacaaaaagcuaguagacucucucaugagaguacuaaagaccacugaugcucaagugggacaccagcaacaucuagagacaguuugggucgucauagugggugcuggguaccacugauacuuaguauguagacaccaaagacaccauugaccauccuccaugcacaggagagccccagccaagaagacugagccagaauguugauaguuccaaggucacgacccaccuaaggccucuuuauuugaaauguagcagagucuggagccggguugaccugcaggcuucugggcugaugcggcucuccuggauugguugccuuuugggcuacuuuacuagguucuauuaucuaucacccuuucaaccccuuccaacccucaacacuggguaggagagaaaggcuaaagggagaauuggguguagaccucuucaggcuacuucuuacugauuaggaaugucagguuccuugaggcagggccaaucucugucgucaggauaucuccaaccagcaaaacagcaauucagccggagaaggagcaggggauuucccauguauacucccucaagaguccccggaguuaaacugucugcagcuggcaaaaaucucaccccuccuggagcacgagacagucacagucacagucagcggcuguggacagucugcagcagccccaucucccacacgaccgauuacaacaaaaacguagucacccgacauaacugggcuuuuaaagaaaccagaauucucacuacaccccugaauuccagacgcagccugucuguuguggaaguauaggaucaacucaggaacugguagccuagagucccugcccgucccacucugggugcaccacagccugugccauuaggaguguuccauucauaccucccugagggcaggcaggggcuggcuagcaccauucaguccucucacauccuuguugcuucucucugcucuccaggcucagugauuaccucuucacuguagccagauaugcagccaugaaggagggcagccaagagaaaauauacaagaaacaugaugugugaagcaugaauuugcacagugggcgagaggucaacuccagacagucgugcugagaguggaaguggggguuggcuacagacucagcaucaccuugugcucacccccccgcccuccagggacuuucgagacuccuggcuucuccagguugugucgaacaugucagcugacuuccaaauucugggaaggcaagguaaacuggaggccacggaggggaugggcuccucggaauugagaaugaacauggggaagguuugaacugugcacuugggcuuucugugugugugugucugugugugugugugugugugagugugugugugagagagagagagagugugugagagagagagcacacugccaacucgggcuguucaaggacuuggaauguaccagaggccucuggaaauguacuagugauuuaccugugccgacgggacuuuaaaugucacauuuauaaagggaaggcaggcaggcuugaggaguuuagucaccucugugccgcccaucacugccacagugucggggaaagacagcugcagguccacagggguucagcucggaguauccucuccaucaaggcaggaggcagguggcccucccugucccgggugguggcagagauuuggucuucagccugacacuugcucucugaugucccuuggcuggucugugcuuccgugagccacaccauggccugucuguaacucuaccggccaccacugcuuccucucccuaugaagugacaucgcagugacaccuguguccuugggaagagggauauuuaugagaggcuggaggccgcccugagaaccucaugguaugcggugacuuaggaagggcagaucugagacacccuagacucugcucagcuauugcccucuucccugugcaccugcuuggcacgccuuccgugcuagcugcccugauggucaaucagcgagccuuugguuucagccguguaucuucuggguccugugaaggggagaggcccagcagggaggaacaucccuaggaggcuguccuguccaaugccauugcagccaccauagugagacacggauuggguacagaguuggugccaugugugugagaccagagacaggaggcacagucuuagggaacuuaaacaccaugcuguugguccagaccuggcgggggaagccauguuccaagagcucgaagcggcccugacacuccgccuacagcuccagaucuuccuaaaaaagauaguaugaacucaagagaauaggaagccacgccccucgccugugcccaggucggauguugaguggcacucgaaaggucaauccccaccuucaggcuccaggcauugccuagcuucguguacaccacccacgcuccucauacagucauacagugagucucacugcgagcuaacaagcugcaaaagccgccuuuacauuguacccauucaccauugaucucucugucugucucucggucucucacaauucaacccuugaaaccauugcgggaaggcuuucucuccuuggaacuuuuguagaaagcgcuuuuauugagauacaguccaaccaccauaaaaugugucuuuuuaaaauggacauuucaguggguuuuaggguauugcccaguuuuugccaccccauaccucacacccaggaggaugcccccuagaacagcauucaucagcaucacagaggugaacaaacuuggucagugaagccaugcuaccaaagggcccaagccaagcacuuacacuggaccucaccugagccucacugggggcguggaguucacauuacuacaggaagggaaacggaggcucagcacugaccuagacuguggccucacacacacacaccgcccacuggcacuugacaguuguuuuaaucacaaccugggccgcggcaggcagugccaggcacuaacagauugcugucgcaucucucagcucagucuuccuuagcugauacuucacgacucuuguuaaugugcguuucucauggaguaauuuucagagccugaacuuguagcacaucccaaugauaaaugucccccguuccaagucccuugucagcugcaaugucacccuuacuuccuccccagcaccucccgacagcccauccaguuuuacgaucccucugucccagugaucacggcugaaccuuuaagaauccggacgcacuucaaguuuaauugaauagaauucuuuguauaauaaauuccgcaugaaugcuacauaaaucagugccuggaag

SEQ ID NO: 2615 - RNA, 16325 nt, Mus musculus
agacacacccgccuccuuggaacucucccaucugauauggagaagaccgggagcugcggcccggguuucagcucacuugggcgcuggccggggcaggugagaagccugggcugcgggaugggcggcgugaggaccgggucccggacaccccgggccgggcgccgcgguucucugccuucguguccucgaucugagcgcucggcgaccucagaucggacaguuuccccuagacuagggucccguagacugggcuacuuagugugcagugggguggccagugaagccuugaacccgggugauuuuugcauuauuuauaacaacguaaaaaugcaugcacccauaaauccagcaaaaccacucugugacaugacucuugccuugcagaaguucuuguuugaacgugcaacacagggcguuaacaggugagucccggcagccgcguuugugauugugacagguugguuguggucuugagguccgggaaggauucuuucuccugcaagauuuuaucuaaaccucgcguucccacacgcaucaaacacauggccguccucagaguaggcaagcaguccaugccugagcucaugucaguuucuacuggcaacagcagugguaauaaacucuggagcugagaaccugucagugccgaguagcucaguauagucaagaggccacuuugccagacagacaggccuugcugcugguaguccuuugagucagccuccaguauugccucuauuaucugauauaugggaaacagauucauggcauaagacauucuggggacggaagagcuguggucugaacccagauuuuuuuuuucccauuguccaccugacuggcucacugcacugucauccuggaacauagcucuggaugguaguucuggauggaguuucucuacaugcuccuggcuguccuggaauucacucuguagaccaggcuugccucguacacccagagauccaccugccucugccuccacagugcugggaugaaagauguucaccuccaagcccagccuuccugguguuuguaacuaacaucuagggaacuuuguuucucucucucucucucucucucucucucucucucucucucucucucucuuuccuugcagaagucucagaagccauguugucagaagcccugcugguguccgccccggggaaggucauccuccauggagaacacgcugugguccauggcaagguaaaaaguccccagggagcugggcagugguggcgcaugccuuuaaucccaguucugaauuugagaccagccuggucuacagagugaguuccagaacagccagggcuacacagagaaacccugucucgaaaaaacaaacaaaccaaaaaaaguucccagggacuugaacgaugggguaccaugucucucagacccuggauuggaagacgguaaaagaaaggccuaggguguucacuggaugaguaucuccagccggacgaaccuuaagcuggccccacuaaguacaauagcugaggaugguugauaaaaccuacagguuggguuggaaucacccaggaagugaguguuggaggggaaagggauugaagggcugggcuuuggacauuccaguguugaggaauuggaaagauggucugguagaaguguugugcacacgcauuaucucauuuaacccucagaucuaacccacggcuacgauguguaaucuucuauuuuacagguaaagcugaggcuuuuuuuuuuuuuuccgagacagcgcuucucauuaucuuacacucuaagaguugggauagggaaggagugaaggccaguaaauccugucuccaccuucagagcauacggucgcugguccccaagccgcucacccucaggcuuacugcuuuugcccuuuauucuacaggucgcucuggcagcggccuugaacuugagaacuuuccuccugcugcgaccgcagagcaaugggaaagugagcgucaauuuacccaacaucgguauuaagcaggugugggaugugggcaugcuucagcgacuggacacgagcuuucuuggugaguacaaagaguggggagccggguguagcaagaggcuggccccugaagaaaguugggggugugugugacagggugguuacuucaggcugcccgugaagccugaagaacgauguucuccuuggacccccgaaaaucggcuucauucauuuacuacaugauuuaauuuuguuugugauaccaggccucacagagaucugccugccucuuuucucucaagugcugggauuaaaggcaugcaccaccacaccaaccuagcuaguucauuuuaaccguguagaccagaccugugcccugagucucuguggacuguuuugggcagauuauucagguguaaaaauauuaagcuguuuuaucaguugcccuucucguugcuaugauagaggcaaguucagaauguauuuugguucucaguuugcacauaguccaucugucuccuggcaggaguguaaggugccucuguagucaggagcaggauggcucuaguccuccuaguuauucagucuagaaccucagggauggggccacgcacaugcacagaguagaucuuucuacuucaguucaaccucucuagaaaggcucucauagacgggccugaagcugugucuccuaggugauucuaaauccuaccugcauuaacuagugcauccucaguacucgggcgggggaggccagagggucagaaauuccagaacagcuccggcuguaugguaaguucagggcuagccugggcuacaugaacccacaucauaugaaacaagauaaaggagacaaaaggauugaccgucacagguguggaacagccguguaauguacuuauggaagccaguguguaaaggcgcaggaaagucuaugggaagagccgucaaccaacaacauuuagucccuggggucgaugcugggaugggaaguagaccgagaaagccgucgagucugcuuuuaguggagggugaaggcacuauuguucuugugugguuuguuucugagcagagggccuggguggcucgguggugggguguauccuuaccaacccguguuuauuacugccuaauccaaucaauacuaaggaaguguugcuaaaaucccugcccaggggaaacggaacaucucccccuccggcuccuaacgucccaacgacaaaucaaggcacaauucccccagaguucacucuggggagccaagggguuuguuggucguguaagucaagaguugguuauuggagugugggugcccccacauaaaggccucaccagaagguuugacccagcaggaaugauaccguagucacauagauggagccccccaccucuggucuuccccagccuauauacccuaaccccccacccuccagaaggccacaagcaauuaaggcagaguugcaugcagugugguagggagcugcuagauauuuagaugggggcccugugacccucuccaccccucugugaggggcacaaacagucaacaagcccagcuuggauaaucguuuuugacaaggagguauagcugaacuccccaagauggugguugccuggcaacacaaggugacagacaccuugcuucagcuuccucaggagcaaucuaggcauucaggcaccagcccuucaugacugacuucuggggacggggacucagguugccugagagaugugaacacugugucucugaaacagagccaggggacagggguccuuuuggggugucagcacuuucccgugccauuagcccaaggccccugugcugcugccgguggcaugggaagagcggugguuacagcuguccaggcuauuucccuuccaucagcaggguagcaccugccccaugggucaccccagucugcugccucuuugguucaugccuuucucagcaagcccagggcaagcaggagcccuccaggauacuuccagccugcucccaggcccugccaccagagauggagugucugugaaagcuuccacuugugguguggcucaacaggggagagcugggcuugaccccaaguagagaaagaaggaaggggcugucugucuagacuggcucuuuucuaguuauuggggcuuguacuugggggaggggaccacuuuguuggguuuuuucucccccccggugucuguggcuccuggcucugccccucaccuguggagaauugguaguuguggugggaaaugacuauauuuugcaagaagugcccugggugacuccugggaccccucagcuaagagccucugggacuugcuuuccaugguaccaggcacucguuagggcagaaauguucccuggggaccagcagcugcuuuucuaagucucugucuaaagcggcaacagccaggcaugguagcuacuggccaagaucacgcaaacccaccagagggucuggacaggcccaggggugguggcaugugaccuggucaaaggaugcuguggagaaccagcaggaugcguagugggagccaggauucuaagucugcuccaguaggagagugaaggagccucucggagacagguuuucuccuuuugggaugguggcccucccuccacauaguuacaggcaaagugaucagguaucaggcaccccugcugggcugcaagccaaguguugcccccaccagugguccccaaaguaggugagaccauucgucuucauuuuauggcuaagaugguuagggcgaaggguacuaccauguugucauggauacagaaagggcuuugaagaugcaggucucuaaacuccaagaugggucugucuccaucccagcacucugcaauguuggggucuccuugacccucugguuagguccucuggaaucuaucaucagucuguuaggcacacaugcacugaacgcuuaguggguggggccuugaacuuuccaaacagccacacccugcucugcuccagcugcugacuggaggcugggaaugauuucuacaggugagcuggucggacuggaucagccuccucugugucgcagagcaagguagcccaggcuccugugcggcucuagacaaaaccugugggugggugguauauguggucuguguuguauguggugugugugugggggguauaugucugugugugguguguuguaugugugguguguguaugugguauguuauaugugugauguguauauaugugugguguguuauauguauguguguuuguguguguugugugucugugugguauguguggugugugugucuuugugugguauguguaugugugggugucuuuuugugguaugguguauauauauauaugggguauguguguuguaguguguguugugugucugugugguauuuguggugugugugguaugugaugugugugguauaugguguguuugucuuuuuguguguuguguuguauauguaugugguaugugugugugauauauggugugugugugugugguauauggugugugugugcugugugugucuuugugugguguguuguguguggguguguugugugucuguguugggagugcuaaggguggaacccaggaccuggcacuugcuugggccugucaaccaagccacauccccaguucucuugcuaauuguccuugagagagagaaacugcugccuuugacuugauuuugaagccuugugcucagcaugugcgcagacuacuagcuaagcacuugguccuggccaggagcagugcugaguccuagggccugguccucaucuuuacaaagaaccugaagaggugcuauugcuauccucuucccaagguucagagacggaagccacucagcugagggccacgugugccgugaauggcagcuaagacccacaccuggggcugccuauaccccaaaauacaagugagggugcacagggcuggcagguugggacccuuuccuccccauguggaugccgauguguuccaugguuuuacgaacaucugcuccacaggccucucacccaccuguuuguuugcccgugugacagagcaaggugaugucucgguacccaccuuggagcaacuggagaagcuaaagaagaugggggaccuccccagagaccgugcaggcaaugaaggcauggcucugcuugccuuucucuaccuguaccuggcaaucugccggaagcagaggugugugcauggucuauaggagcccgucccugggaagcauuccggagaaucccugugccuccacagagcagggaguccuguaguuuacagugauccacuugaggucuggugcccauuuccuggucgucagggucgucuugaggcccugacauccaaugggcaucacucccuucaggguccagaugcucaguugccccucccccacuguccacgccuggccccagguuccacuuggcacuucacacccuuuaagggagucacuuucugugccugguguauuucaggacacucccgagccuggacauggugguguggucggaacuuccccccggggcaggcuugggcuccagcgccgccuacucugugugucuggcagccgcccuccugacugccugugaggaggucuccaacccgcucaaggacggggucuccgucagcaggugagaacuguccuucaccugcucacuguccuuccugugauggagcaguggguagcacuggggucuggagcucuguugugcuccucugaaccucaguuuccccucugugugaaguggguagauaacccugccuuucccacaggauuucucauugucucugucugucugucugccucucuaugaguguguguguguguugcagauuugugaaauccucacaugacacaggagaaaagacccagaggcagcagcuguugggccagguuuugcauacacucaggaacuaugcucccaguaguccguuuuaggccacugucccugggcauuguacaauaguauucuuccaucucacagugugcagucgccucuggcuucacaggugagaaaggugaaguuugaggacugguguaggggacgggguccaaccagcaccccauauagcacccagcagagcaccccagacagaacccugcacagcacacugcaugguacccugcacagcaccccacacaccacccagcacauuaccccucacagcacuccucacagcacccuacauagcaccucacauaccacccagcacguuaccccucacagcacccuguacaagcacccagcacaagcaccccacacagcacccagcauccagcacagcaccucauacaacacagaugggguuugaccagcucacagcaucccucacagcucagccaaugcaaggggagggaauuuccagaaaggagccagacugggggugggggggcagcuucacuuccaaguucccgagaguguuuuugaccuggucacacgcuggcacugagcccaccccauuccucgggagacuccucggcuucacggagacccagaggugacaggugccaaccagggagucacaguaguggugcguuuauuucuccugaggugggaucucaggguguggcacaggcuggccucacuguaugcuugcugccucugccucccgagcacacaguugcaggagcaugccacggcaggacacuuguuucccucccccacaccuccagcuccaggggucccacagggacggcagccucgccucugcuggcccuucccgagaugggccugucgaggagcuggcacuuagcagcguugucaacacaugacccauguagacacaaggucugccuccagccauaggugacuuagccugacgaggaugaaaugaaacauucuaucccugaggggaguggggcucagagagguuagguaacaaguccagagucucucagcgagugaacgugcaacacucccacugcacuuuauggguuucagaggagaggaaaacaaaggucauugucaccuuaggccgagaggggcagauucuacugcuccaucugagucccugugcccagucacaaagcccccggguuuuggguagccccugcacucguagcgggugcagcccacagcuccuuccuucugcuguccaaggcuaccccagccccucacucucugugugcucagguggcccgaggaagaucugaagucaaucaacaagugggccuucgaaggggagagagugauccaugggaacccuucugguguggacaaugccgucagcaccugggguaaguccguuugcuccuuguccuucccgggagucucguuuguagguacgcugucucucucgggcuugggguggguccaguuaggggcuucuaaggagaagaacacguuccuguuccaggugaggggaagaccucaggcucugccucuggggggggggggggcugggaaauaggaacucccccaggaaauggcugcuguggaguugagccaccgagcccugggccuuagccucaccaacacgggcaaaggcugaggaugucagguggcucagaaggcuaagggcuggaggaauggguagggugcgccacuuagccuggcauguccuggggaccacacugaucucaugcugucccagaaugcaaaucugagccaggcccaugaugauggcuacugucucucucucucucuaggcggagcccugcgcuuccagcaagggacgaugucuuccuugaagagguaauucaggcgucauugccacagcuaacacaguuacccccacauauccaggaagagcacugugccuuugugagauuaugaggggcaggguccuuguguccccucccugcugugaggccuggggcacugugaggcuaccuugucucuccgugccaacucuucauccagauaaaggugaagguuguguguggccaucccuuccccuugaagcguggcugaucugcagacccuggcugucugucuguccauuuacuuagaaaacauuagguacuauaucgucuuuuucugaaugacaucauggggcccgggaauguagacauacgucucaggcuguuuccgggagauuuugcugggcaugacagugcaguugggacagauagguauggaagccaacugaggacaaagcaaggcuuaggggagccggagcccgcagcgggagacuucagcaaagcucagaauggagggcuuggcagcucccagccugcuuuguauggcugugccccaccuggucagauguguggaccgaaucuuggcccuccggggaaagggacagggauuaaaugguggcaaacaggagcacauuuggaauuacauguuagggagggucacccacgguggucagcacagauaggcacagaguccuggcacacugcucuggccagcugagaaaaugcauuaguaguucggugccccuccccucccccgccccaguccugccuguccuuugauggucuacaacucugcaucagauccuuccucggggaugcuggcuguccugugcaucacacagcagccuggcuggaugcccacagcaccccuuaguugugaugccccgaaaugagccuuggugagaucggaggcaugggguucccugggggccucugauaaggaaacgccgaggccugaaugagugagucaggggcugugagggggacgcagccugggagaauggacucaagcaugaagguccugaggcuggcauggagcagcuggaggaggccagggugacugggugacugcacuggggugacacagagucagggagcccaggccccccagaugaccucagagcagagcccucagugugacccuggacaugauagguuucgugagggcugacagcaggcccucaggagagaugugugugagcaugaagacguaagccgcaaaccacccaaccuccaacccagccccucucuguccacaaugccauuccaugcaaagcaccguguuugcgguguggcuuaaggcccaccuucccagaucacgguccuuuugagugacaaacagucuuuaaaagguagaggagccagugcucauuuuaaaaguuuaaaaggaaggaaggaaggaaggaaggaaggaaggaaggaaggaaggaaggaaggaaggaaggaaagaagaaacaaagaaacaaacaaagaaacaagcgcuauccuccuggguggucaucgaugcucacugagaggauugccagugacccccuccaucugugcuggaccuuacagccuugaacuguaaagaggguggaugaaggugugggccgcauggccuccaacugucucacaggggugcguccagucccccaccuucauccccauccccucccacagcucacucaaggguaguggguggcaagaaagggcagcugaagauagcugccuccagagucuacuuggcucaagggcaaucaggauuguacagcacugccuacggccaagccugggaucugcagacugcagccucgggaggcugcuccccucccuacagcagcagcagcaggggccucggcuccccauggccauagcaggauuccugccuggguugcuguucugggcacuguagaaugagcuccugggugaguaggggcaucuggugguggcuggccuauucgguagcccugccugcuugcucccucccucguggacccacgggagagccggcaacccucacuagaaauccagacucaaacuuggugcccaggacucuggaucguagagcguucucagguuucuagauuaaggacggacuggaaucaacaucccugcagagaguccucaguuccuagaaccuugagaucuagagcuuaucugcaggaagacguuagucacucgcccugugccccgcucccucauccccaccgaagccucaggguugggcaccacugaaccucugacccuuccugcacucugucacagagacuuugaacuuauaacccaaugaaggguuaugaccuaccaccuccaggcucagcauaugcuacugugccccccaaccuuggucccugguggucuuucuccuuccucaguucuuauaucucauggaggugacaucuuggaggaccuccuuucuccccucccagcccucuagucccuagacucagcugaggugccccugugugcuggcuguguggcacacccacaccuuccugggccuggucccuccacacacauacccccaccuuuucuccgcagccucccgucucugcagauccugcucaccaacaccaaggucccgcggaguaccaaggcccuuguggcugcugucagaagcaggcugaccaaggugcuccugggugaaggggugcugcauguacuggggggacagggacaucucugggcaguguaugcagaaaggaaggugcuaacuauggccacugccagcccagucaggauggggacuuugggaacaggccugucccuuuagucacacuggcuuugcgguaaggauacacauacacacacacacacacacacacacacacacacacacacacacacacacacacacacacacacacgcgcgcgcgcgcgcgcgcgcacacacacacacacagacacauagacuguaggacaucggcaggacaaaggccaggggggcuuguguaaauggugcucugccacuacagcagggucugcccuccccuaaccuuaggccucauggucugccugccuuccuuucccacaguucccugagauuguggccccgcugcugaccuccauugacgcaauaucccuggagugugagcgcgugcuaggggagaugguggcagcuccaguuccggaacaguaccucguacuagaaguaagccccccacagaaagaaucuacucaccccucugcuggcccaaggagcgucucccccuguccucaguuuacccaggccggggcccugagcacauguguggccgugagggcaagcauggaaaccuggcacacugaggcccugcgguaggugugggcccugagguugaggggagaugcccaccuuccuagcuccugcaccgugcggacuacggguguccacucaacagccaccuggcgcuucugggcaggcaggucccugaagauguucuguggucccuuaacuguggccagcaccaucaguggaauucuaguuagcguuugagcagccccgcgucugaauucucuuacacucacugcccacugguggccucacuagggugccacaagcuuauuccaguuccagggucuccuguucccagugcccaugugucaccagcucagacagccaaagccucccucugagacagacaugggccaucuggucugguaagucaggcugguagucaaaagccaucuguuguccucccuugaagugcgagggacccagcagccccuggcuguagcagccgaaccucagcagucaggaggaggugccagcacggugcccuccaggcggcaggcgugcuuccccuccgccuggccucugguacugaccugugauacccacugcagccucugucccuccuggcaucccugugugcagccaacaccacagcggccucucaggguaacgccacuccugcuccuuauaacugugucuccuccaucuuacagccgcaaaagccgaaguccaaagaggcuaacuucugcuuaugucagccagcuagggagugucagagccaggacccaaacaaaugcgugcauacgccuccacucggccaauuuuacuaguuuauguuuuuuaauauuuuauuuauauagguacaccauugcugucuucagacacaccagaagaggguaucagaucccauuacagauggucaugagccaccaugugguugcugggaauugaacucaggaccucuguaagggcagucggugauuuuaacuacugagccaucucuccagccccuuauuuuuuucuuuuucaagacagggucacacuauguaccccuggcuggccuggaacucacuguguagacuaggauagccccagacuuagagaucugcuugggaugugcuccgucacacccagaaucacuccgaucuuuccugagcaccuacugugcgcucaccucgaaguccucaaaccuugcuucccagcucuuggcuccucccacguucagaaucacagaccggagcagggaaguaauaaagaugaaaacaucucgcacaugcccugucgagccccuagagcaagcaccgggagcagcaggcugauuacgcagggaggguauuuuuggcugccacagccgcucaagugcacaucgcugcucccggacagcuuugcaugugaaccagcgagcuauucucuggugucagagucugucaccugauucuugacagauuuuggaucagaaugugacaggugucuggaaccugccuugacaacgugacaccuggagcucaggcacacagagaggccccugaagucuccgcaugcacgcaugcaugcagcccgccgagcucaugaaaggcacucagggcugccaccaggccguguugccugucuacucuucuaucaguaucccagcaagugugcgggcccucggaagagcaccuggcagagcuagcuuagccauggguggcccuccauacacggcauccugagcuccaggcucagagcagauacccuccaucccaccccacccuccaugcaagaggaaggaagcaucuggaaugccaagggugcucuaacaagcaggggcacucuggcacugacccgcuaccugggauggccccagacagauuuuuuuuuuuugccccuggcccucaguguuccuuuucuaaaaugggauaauagugacauauacugauaacaggguuugcagagcacagguguuaggcaaaaguccuucccuucacacagccgugggugguggggagcaggggucaugacagacuucauacugucugcuuccuugggaggaaaggacugagacggcagagccaacccucacccuacccugccagaaucccaggcccaggagggagggcaggcagagccuugcugggugcuccucuccagcacauaguguguacccagcauccaacaaaacgcaagcaguggccgccuucagcauuuacccacaugcgccuuguuaguccucggcaagcagcaaucacugcacauaauugaagaaaccuagacaaauauuuagcuauuuccucuccacuugugaccuugcuggaguggcagccagguucuuauuccgaaaaccagcccgggagggaggcagcaguaggguuggcacaccguauaugacacuuucucucucgcaaauaguaagcccuccucacuggccuuuagcaggaaaggaacugucguuuccuaaguaagggacgggcggcaauggcuucaagcauagcuucauccagagauugaagcccugggguuagagaucuuucacgugaucucugaccacauggcagguggguaggugugguggcuagugucuggagccaacugguuucggccauucuggugauggggaccucuacccccaccccuguccaguuuggauuaugugcaugucccuuauaaucccaagggccaggcuugguacugacuucauuggggguggggguggggucacuuaucuaagccccacagagagagcgugagcugucccaaaucagcagcugccagguggacaggcaaccugggaugcgacagagggcucgcccugggugggcccaggcaggaacagaugaccccucuucuaggagcugauagacaugaaccagcaccaucugaaugcucucggggugggccacaacucccuggaccagcucugccaaguaacggcagcacacggacugcacagcaagcugacgggcgcuggcgguggcggcuguggcaucacccuccugaagccagguacgugauaugcggccugcuaggugucugguugccagugugaacugugguggaggguccgcaggagaauccccuagaggggggaagacuugagcucugcucuguggccuugagcaagugaguugaccucccugugucccugugggaaagcauggaugauagcagguagacuacuggaccauugcuccccgccaggaggagccuguggcugaaaagcucaucugccccgggcugcuucugccuccaccugcacaaguuuuggagacauccggggcgggcucccacccccuagcugccaccugacuccugaucacugggaggaacggaugggcauagaagagugaaauggccaugcucauuggucuuugugggaaagacccacugauagaccugaggggagggagcuccaugcuauaccagagcgagaggaauccuugcugcaggcauccagugguaccaucugccucacccaccccugugcuugcccuccuccuccuccucuuucuccucuuccucuucuuccuccuccucccgcuaucuccucacucuguacagcccaccaggguucccaaagccccaggcuucuggcuucaaggacugugaugcccucccugccuccuggaggccuugugugguggcuccugguccacgggugaugcuugugagucagugcuuuaagagcaugcccaguaugccaggugcuggccagguacacacguggggggggggcauugucagccccauuccugguagggaaacugagacccauaugaggauuaaguuugaagccacauuggaagcauggugugaagucaagaggcauagcaaagcuggugacuacagcccaugaggaggguguagggcuuggcacauggcucauagguaccacagugagccucagaagccacaagauacaccgcaggagggccucacuccaggggugggagcguccgcugagaaccaucccccaaggcugacugcccucccuccccaggucuagagcaagccacaguggaggcagccaagcaggcccugaccagcugcggguuugacugcugggagaccagcaucggcgcacccggaguuuccacacacucagcugcagcuguaggggacccuguccgacaagcccugggccucugagaccacccgacacaccauccuaccaagaagccucuaaguaucuggggcuggaguuggccugcaccuucuagacucugaccucauccguguucugccguuucugaagccaggcagggauuaguuguggggucuucugagauggcaggcugacacaggaggccuucgcccuggagcuccuaugggcacaucggccucacacaaacucucuggcuccuagccacgcacucuucuguccagccacgauguccccuaaggaaccaccuggccagcagcucguggcuccuggcuccuggcucuugcccucucucggagaucaucagcugaggcaaggcaugccgacugccugucuccguguggaaaagcugcugugggggaaauaaaaagaaauaguacaaacaaag

SEQ ID NO: 2616 - RNA, 569 nt, Mus musculus
gcaaccaaacugaagaaggaacaggagaaccugcugaggcagcgcugggagcuggaaaggcuggaggaggaaaggaggcagauggccgcccuccggcgcaagacagagcuggggugagucggggaugcccagggcucuccccagagggugggucucuugccuucucaggcguccuuggaaucuccugagaaccaaaggccacgguguggucuguagggugcugcugguagcugguaaucggcccuauggggacugaagcugccugauucuuccugucuuuaggcgcuucuugaaacaucaguacaacgcgcagcucaacaggcgcacccaggagauccaggaggagcuggugagugagcuggcaggcuuuuccccauccucugggaacagcaucaccagugugcaggcaggaccugaugugggcagagcagugcugguggacggugcagagaggaggggagcuugcagcacggucccuuucacaacacuacccaugugccugagcugcugggcgcugugcgaccaugguggacuguguugcuuuagguuuuuguuuguuugguuguuuu

SEQ ID NO: 2617 - RNA, 9050 nt, Mus musculus
ugugggcguggcccaggcccugccccugccguccggaacuccagagcugcugcaggagguccuggaggucugugcccauggcugccgccuugcucgcccgggcccguggcccucuccguagaggugagugcggagccccagggcgggucacagggcggagauccuggcggccgguccugcuguggccccgggcagacgagugggcagcacccaguggcugcgcguggccuuuguccuaguuugguagccucuggccggugcaaggcccagacucugagggauccgggcuccugcucggcgcuuuucccgcgggucccucaucgccagcuccccuuaugcggcccuauccacaccccuuacgccauuucaguccuagcugagguucugggugaguugguccuucauggcgggggguggggggaggggcuuggcauuuaacuccgaccuaugaccuuggacauaacucucaaccucucugcaucaagugguccaagugucaacuguuuccauccucagagcucuauuaaaucacaggaugcaucgugguuggcaucuaacguguuuucuuaacguuagcauuuacuuuuuuguuuguuuguuuuuguuuuguuuuucgagacaggguuucucuguauagccuuggcuguccuggaacucacuuuguagaccagccagaaauccgccugccucugccuccugagugcugggauuaaaggcgugagccaccacgcccggcauacuuauuuuuaauaguguuuccucuccugugcagcagcccugacacuauggccaccgcuuccuuuggcuaauccagagucacauuaacaauuagaucaguguuaaauaagccauuaaguacuucuuuaaucuuuccacugccgggagcugaguucuguucuuguccacauuuuauagaacucccagaccccagacccagugaaacuuaaaauccauuuccgagguguuguaaaugggauuauauggaggaaguguuuagcgagcaguuaagcauucaguuagccugggcuuuucuguaacacucuguugacauuguaucaauacauuuuuuuuuuuuucuauugagacaggggugggggggugggggguggggggguggaguggugcucuuuuuuuuucuuaaaaguuuauuuuuauuuuuauuuguaugagugcuuugccugcaugugugccugcauaagugugccgugucccacagaggccagaagaguguguuggauccucuggaccuuucauuacagacaauuagccacucuguagccugguuccucugaaagagcaacaagugcucuuaacugcugaaccauuccuccagacccugggaugaaugaaaucuugacuuauugcauaggcuagccugaacuccaggcuaccucagcguuuguucuucuuacagaagaucugaguucagaucccagcgcccauguugggcagcuccuaauccccuguaagguccaggggaucugacgcccuccucuggccucuguggguaccugcaugcauguguacauacauaaacacagacucacagacacauaaagagaaaggagucuuaagaucuuucacacuguccuucccuaacucggaucauccucugauagcucucgguguucgggacuggcgacgguuacacacuguuuaccagucuguggagcugccugagacacaccagauguugcgucagacaugccgugacuuugccgagaaggaguugguccccauugcggcccagcuggacagggagcaucucuuccccacagcucaggugagugcagcagccucacugugaguguguggcucagaguggcucacaguguccagaggcggcagccaggggcgccacgaccucugguaggaagcucagaacauacucugaauguucagcaucuggccccuagccaagaugugccaacuuuuuaagaagaugcauuuauuaacuaagugcaucuaugugugccuguuugucuggauuuuaugugcaugccuggccugucaccauauguccugaaacuggaguuacaagcaguuaugggugcugggaauugaacccugguccccugcaaaagcagcaagugcucuuaaccuccgcgccguuucugcagccccucuuugguuuuccugagacaggcucugagugugcaacccugaccggccucagacacacugaacucgcccugcccuugccucuuguguguguguguuuuuuuucuaaagauuuauuuauuuguuauauauaaguacauuguagcugucuucagacacaccaagaagauagcaucagaucucauuacagaugguugugagccaccaugugguugcugggauuugaacucaggaccccuggaagagcagucagugcucuuaaccgcugagccaucucuccagcccaccucuuguguuuugauaaaggcacccccuaccacaccuggcacuacgguauuuacaaauaccgaggucguucuuuuguaaacuguaucauuaucaugcguguguaugugugauaugcuuguggauggugucugccauggccugaguggggaugucaggggacaacuguaggacugugugggacuggguucucuaccccuucacuucuacauggaguccaggggucaaccucgggucaucaggcuuggcaggugcaucacccuguaguugguuucauuuauguauaugugugugugagagugucagguaugugcuggugcccucagaagccagcagagggcgucagaucccccggagcuggaguuacagguagcugugaugugggugcugggaauugaacucaggaccucugguagagcagccagagcucuuaaccacagagcccuuuguccuuguagcuaagacagccagagauuggagaccugcagcuuccuggguuggcuaguguauggacccugagggccugcuugccaugacccucacacacuuugucuuuccauuuccacugagguggugggaugugaggcacagcuccaaguuggaccaaauagaggaacaugucuugggaguggggacaggggaagcuugacaauaucauuccaaggugaugguggcuucccugcuucaguggcgcaccagggacagcuacauggauggcagauggugaaggguguuggagccagucagacucagacucugaggucuaagcuaugugaaggccaccaccucuccacccggccauguguuaaaaucuauauugauagaacaauucauuuguuuuccuguuuuuauaaucccuccaauguuuugcauuuuguuguucgagagagggucucccuagguagccccggccucaaacucaugaccuuccugcccccaccucccugcugagugcuaggauuauaagcacagagcagcacacugugauaugggccaguauuuugagucuuccuugcccuuaaauuccauccuguaccuggaaguuuagaaugcuauacagcaacuaaagaaguaagcagaccacauccucaguuaagagacacaaacacaacacgcacacgcacacacacacacacacacacagacaaagagacacaaacccugaccuguagacucugugaccaccaggcaagcaccuagcucagguggcugacuacacuggcacagaugcugccucgaugucccuccccgagcugcucauaauuucccccugcuagcuguauuucugucacccucagaucccaucccgaagacaugucugacaagguuggguccccucguucucccgcauuccggauaagcuuuccuuuuuaacagugaaggcggggaaaaugguguauucgcaggagggaugcaguuacuaagaacaaagagcugggcgggguggugugcacccuugauuccacagcucuggaggcugaggccuccagaguuugaggccaaccuggucuacauagugaggucugggcuagccagggcuacacaaaaacacccugucuggaaaacaaacaaaaggcgacaagaauuuagaugguaaagugugauguauuacggaggcugaggcaggaagaucccaaguucaaagucagccugagcuauauagugagguaaaaaaacagucaaggggcuggagagauggcucagagguuaagagcgccgacugcucuuccaaagguccggaguucaaauccuagcaaccacaugauggcucacaaccauccauaacgaaaucugaugcccucuucuggagugucugaagacagcuacaguguacuuacauauaauaaauaaauaaaucuuuaaaauaaacagucaacccccccacaaaguccccagaucaguagaagcaaaagcaaaacaacaacaccagcaacagcccuugcagcccuugcagcccuugcagcugauguucgugcacucccgugggguuggcuugaacagaaugguaagauucugugagacagaauucucaggaacacacuuccaagccaccucagcaggacccaaagcuuagauuccuaagcucucgcuaaggaaugguuuuauccucgcaggaucauaacagccgaucuacagaaaggccgaggggcggccgcugugaggaacgugggccagacucaggaagaaggcugguaccaaugucugccuuuuggcuguuucacaaccaaacuggacuucagucuuuuuacuccuaaacuaacaaagggaagaaagaaaugaguuuacaguaccagaguuuacagccagcuucagagcccuuaaccuugaaaugguaauuuucuuugggguggaggcagugcuggguuuacaguccuaggccuugcaggggccgacacucucagcuccuucucaguaaaggaaaaaaauguuuuaaaauaguuuuuuaggggcuggagacugcuuuuccgaugguccugaguucaaaucucagcguccacauggugccucacaaccaucuguaaugggaucugaugcccucuucuggagugucugaaggcagcuacaguguacuuacauauaauaaauaaaucuuuauuaagaauacaguaaaauagguuguuuuuuuuuaaaaauauuuuauuuauuucaccacugcucucuucagacacagcagaagagggcaucagaccccauugcagaugguugugaacuaccaugugguugcugggaauugaauucaggaccuuuggaagagcagucagugcucuuaaccacugagccaucucuccagccuguaaaauaguuuuuaaauaaacuauuaaugcagagugauuggaaaaagccaggcagugguggcgcacgucuuuaaucccagcacucgggaggccgaggcaggcggauuucugaguucgaggccagccuggucuauagagugaguuucaggauaaccagggcuauacaaagaaacccugucucaaaaaacaaaaaacaaaacaaacaaaacucuuuguuccguucaguccugaccacuuaugcccuuuaccacucacgcacuagaaugugcuugucaugcauucuuucgcucccuggcccuggguauacaacaggaagggaaaacaaaaacaaaacuccacaaggugucugcccacuuggucagggaaaaagacaguagucaaacuagcauguuaggcugggugugguggcgcacgccuuuaaucccagcacuuaggaggcagaggcaggcggauuucugaguucgaggccagccuggucuacagagugaguuccaggacagagaagcccugucucaaaaaaccaaaaaacaaaaaaacaaaaaaaaaacccaaaaaacuagcauguuaguagacaagcuguaagaaggaggucacaugugugcaugcgugugugcacucgugcgugcaugcgugcgugcaugcgcauaugcacguaagggacugaagaaaaguuagcguggcagaaagcuuucugcuucuuaccucaaaguuccccagcgggcacccucugccuguugccuucagcagcugcaggcugagaugcaagcuuugucaaguguggaugcaguguggcuggcguggaccccgcugggggaguaagaucuguguggaugauuagggucuguggcaggagccugcagguucugccucaggggcugcggagaguaggcuggaaguggcugucccugaugugaccucucccccuggggccagguuaagaagaugggugagcucgggcugcuggccauggaugugccagaggagcugaguggugcaggcuuggauuaccuggccuacuccaucgcccuggaggagaucagccgugccugcgccuccacgggaguuaucaugagcgucaacaaugugagucucugugggucacgggacauggucgggggagcagcucugugaggaaguuggccauguaucucugcagccaagcacggccagccccggcuccuggacuugucuccuuaugguccucagggagggccucuggagagaguaaagaccugggguggccucaaacugcucuccgcugucccgucagucucucuacuugggacccauucugaaguuuggauccgcacagcagaagcaacaguggaucaccccuuucaccaauggugacaaaaucggcuguuuugcccucagugagccagguacugcacgguucaggauccccugucuccuuaccucagaaucagggugacaggcagaagcuacauguccucagacgaaguggcaggcuucggaccuguuguccuggagucuugaaccacugagcaggccucgggguggcuugcugggaugggcugccacgcguggggagagggagguuuggcuugaagauguguccugucccaugcgggccuguucugaugccccuguccuuguggacgaguccuugaagguuugguccaaggucccagcuuuagaacccaagucacagggacuuuaugcuuggcagccagggcucuaagcuggaugccccgcagcuugagggguaggucccgagucuguuguuucuggcaggcaauggcagugaugcuggagccgcuuccaccacugcccgggaagagggugacucauggguccucaacggcaccaaagcuuggaucaccaacuccugggaggcuuccgccacggugguauuugccagcacagacaggucccggcagaacaaggugggccagcagaccccuggggugguccuugcaauuucuuggucuugcuggagcugcuccugcugaugagcagucuuucuuuccccaauggaguuugcacuccuacccaaagccagcagaggguacaggggcuggagcgggggcggggcuggagcuuggagccugcauaggcgcagcucugcagacucauccuagcuuuuggggccuuccaggguaucagugccuuccugguucccaugccaacuccugggcucacgcugggcaagaaggaagacaagcugggcauccgggccuccuccacagcuaaccucaucuuugaggacugccggauccccaaggagaaccugcuuggggagccugggaugggcuucaaaauagccauggugagcuuggugacagggcagcaagcacccggggucgggcccugggcccagccuacagcuacugacugggcgguccccacagcaaacccuggacaugggucgcauuggcaucgccucccaggcccugggcaucgcccaggccucccuggauugugcugugaaguaugccgagaaccgcaaugccuuuggggcaccgcucaccaagcuccaaaauauccagguaggggcuuggaggaugggguuuuagaagcugggcaccggagucuugguaggaaagcuggcuuuuggcuugcuuaucucaccccuaccacaccuuaccaccuccaccccacccccaccugacucccacccucacauaucccacucccacccccacuccuaccccaucccugaccauugggugggagagcaucgguugacggguggggcuggauuguugcaguucaagcuggcagacauggcccuggcccuggagagugcccgccugcugaccuggcgugcugccauguugaaagacaacaagaaaccuuucaccaaggugccuguggggaggggacucccaaggcccgcucugagguggggggagugggcagcacaggacuuugaagggacagggaaggcugugcaugcugcuuacggaggguguugagccugggggucccucugaaagugaaggcauugacuuugccguucuuggggcggguaggaguccgccauggccaaacuggcugcaucggaggcugcaaccgccauuagccaccaggugagcacugagccccugggcacugcagcccuuuccccaguguggauguggggggcuucucucuuaguaccuguuuuccccucucaggccauccagauccugggcggcaugggguaugugacagagaugccggcugagcgguacuaccgagaugcccgcaucacugagaucuacgaagggaccagcgaaauccagagacuggugaucgcugggcaucugcuccggagcuaccggagcugagccccuccucggggacuugccugccugcagaccgaggcagagggcagagagccucauggcuuaacuuugaggccuggucagaccagaaagggacuugccuuucauucugccuguucugcuccgucccucacuguagaccccuagucagacuggggggaagucuaucucagggagaggggaggccagaugcugugaccugcaaccgagaagaaaucaguugucagcucagagcugagcuuggcugccucuuuaccccccaccaacagugccucuuucuucauuugagccgcccuuggagagcugaaugacccuggcccucucagugcuguucccaugagcccucggaggcaagaacacaagggacaggacaggggucaggagggggaggggguggggguggcccagauggcacggaguuucaguguuugaguccccaggguugcugugggacggcugggggcugggucauagggcccucgcuggaggucaagugcgcgcaggugcguguucugcuguagaacugcccgcggccaauaaagcucaccugugcccugac

SEQ ID NO: 2618 - RNA, 16151 nt, Mus musculus
aggugggaggcggcgccccaaggccgaggagguggaggaggaggaggaggaggcccugagagcgacaugucccggguugccgaggcagaacgguccgcugcgcuguucuccugaguugggggcggccggccgaggacgagggucggcaggggcugcccccgccgugguggccgccaugcugaggccccggggagccgagggaaccgcuguggcgcuucuccggcugcuucuguugcugcugcugcugggaccgaagcuccgggguccggggcucggcguggucggcgccgccggggccggacugccggagagcgucaucugggcagugaacgcaggcggcgaggcgcauguggacgugcacgggauccacuuccgcaaggacccucuggaaggccgggugggccgaggugagagccccuccggccgagccuggggggguccgcagccugggagcagggcgcagcugcgggccucgaaccccuuccucuccagccgggagaccacagccuuggaacgaaguuucucucugcagugaaccuacccccagccccccaaccccccacccuccagggaccuggccaggacccagggccuagcccugacuggaagcuuccaagagccaucgaggcauagaguuggcgagaaguuuauauuuagacccuuucucauuuuaccuugccccagccccucaucccacccaagcugggaauguaaaaggcaaggguggccuuuugccuggcgccuggaggccucgcagguuggaggucaucgacuccgcugcucugccauccaucgcgacgguuuccaggagaugcuuugcccacccuacagaucacccgccguuuuccgugccccuuccaagcccgggacugaggcuugauucuucgccagaacggcagggagucuucgaagggggaauaguacgggaaaguuugacuguggcaccccuccccuccccuccuuuggaauuuguaugcuuaaaagucaaagccacccgacgggugucgguauaucgcagcccauccugccuaugaggucaaccuguguaagguuugagugugacccccgggugaucguaagacguuugaucccagcuuagggggaaaguggguuuuacagaguuucacaguucacaacggccaaaugagaauuuugagggcagaugguuaaaaauacagguucacaacggccaaaugagaauuuuugagaacagaugguuaaaaauacagguuccugggcagucucuagacacaguagacaaacuuuuuuuuuuuuuuuuaacuuaacuagcugggacucgggucucugcccuaggcacuucuguuauagguuaccuuaccccccccccccccaauucauucuuuggagaaaaccgcucuagauucuuccauaaguaggauugaaaaacagguuuagaaggaaagucggggacugaagagcuggcucggugguuaagagugcagauuguucucucagagaacccguuugauucccagcauccagaugauagcucaggauuguccauaacuccauuucccagggauccagugcggcuuucugacauccacagucacaggcacacgugugcacagagagacauacaugcaggcagaacacuacacaaaacuguuugaaaagguuuuuugaaaagguuuuucuuguuucauguucuggaagauugaugcuguaugcugggcgcagaggcugccuuugcagacaacaggaaaucucuuuuuucaguguuugugugugguucuuuuaacuuuacugaagguuucaacuuaguuucucccaguuucugugucgagauaguuauauugugugugucuuaucuggauguuguggcacacaccuauaaucucaguaccaucaaggcagaggcaggaggaucccugauugaugaaagccagucugguuuaucuagggagauccaggucagccagcaauccagggcuacauuaugagagcuuguuucacaaaagaaaccagaauucuuugcuuuuauacauguaagggucuuggcacauggggcuguucucugaaguucuguguccuggaauucauuuagaccuggcaugcaggucccaggaaccuggauuccgcugagucagggcuccaggucguggcagccaaagccagacuuuguaacagcaggucguuacugccucuguugcugguguuccucuuucuucaugcuugugggcagagaggaaggagcuccugaggaaaccgcacaguugguggacuuugccucuugagauaaugguggugagggcaguguacagcugguuucuucauucagauauccagcuauacacugguuccauuguccuccuguuagguccccgguacagaggaugaaacuaggacugccaucuuuaguccucugguauuccucuuauucugauacucugcuuuuagguugcuggugcaggugguuuaguuuuggccuggucaguagccagcuaggcucucucguccuuggauuguaguuuccugggggccagaacacucaugugugugugugugugugugugugugugugugugugugugucagggguugggguugggcuggguaauuguagcaaauacacagugugugagaccugccagacucuuucaucguggaaucugauuuuggacgauagcauuuggggggaaguagaaccgaagguccccugccccagacugucugcuugucuggguguggccggcacgaaggcauggauagaaagaaaaguuggguauagugcuguggcguggaccggcgaguguuaguacuuacuaagucccuaggcagcucccuggcauugggucugggccccagauacguuuaagcguccacugagcagucagcuuucuaguuuguucuguucugaggcaucggcccugcccagggaagagcagcuguucaggcugccuugccuucucgggaucagggugugccccuuauuuggagacccuugucucaugcagcuauuuaugcugauugcaggagggcagugcuucauuucuuuucccacauggcugggauacuguuugcagcacgugugcugaggacauuuucuaaggguuuggccugauucugaacuugccugccauuucucugccuucuuuguaaguucagcauucuuguaacugaguggccuggguacccaguggcuuaugcuucuaacagcacuugauaacauguguauugacuuguuucugccuugggaucacuaauggucacagccuggaaaaggcauuuuauaucugugugccucgguucaacagacagauguacugcuguggaaagugcuguggcccagcaugaguucugggggguguggcuuugcucuuggcugguuuguuuugagacaagguuucagguuguccagguuagccccaaacuuagcauguagcuuugggauaaccuuaaacucuugauuauccugccuucaccucccaagugcugggauuacaggcuuggcccaggucuggcuuuccagguucuugacuuggugaccuguggugacuagacccugccauucuauauguuguaugucagggucacagaggacuuggcuugguuuugggggacacuccuucuuuuccuaaggagauucacucuagaauuuauggcuugagggccuugcuuacugcccugagccuugucuuccuucgugacagucacacugucauauguuaggagccuccaacaggacugcuguccagagcaggguagagugcugucuuuuuuuuuuuuuuuuuuuuuucuucccugcuugauggccuuuuacaugaaauuaaaaguaggucagaguguguguccagaggggagagauguugucuggagaccugagccggucaagugacuuacuguuuaacccuaaaguggaccccauugggggcugccauuuggcuaaggaagaauuuagccuugaggagcuaagagccuuguagagagagugagggaaaaggggguugggagagccaugguuugcuuauggccuggagguuuguguagaguucuguuucuguguuguuuccuauuaguggcaacgcuucugagagcccuaaguacuggaaauguacagguagaugauuuaggucauagguuccuugaccccauuguucauuauaauuuauuagaaacuaaccucucuugaaaaagaugauugagaagccggacagcgguggcacacgccuuuaaucccagcacuugggaggcaggggcaggcggaucucugaguucgaggacagccagggcuacacagagaaacccugacucgaaaacaaacaaacaaaaugauugagaaaaaaaaaaaucuaguggucagagggccuagaggaagcaauucauuuauuuguuuuuaagcaggcuucauucuacuccagacuggccuugaauuuguggcacccuccuaccucagccuccugagugcuggggucacagguguacuuggcacucuauaguggguccugcccauguguuccugcugguuccagacuuucauuucagcuacagcuuuccaauucauuuccuuugccuccuuucgaucugcuuucguauguauguauguauguauguauguggacaggaacucacugugcagcccugcuugccugaagcuagcucugcagugcaggcugacuuguagcuccuagcacucugcccugccugccugcuguugcuggcgcagcuaccccguuucuaacucccagagcagagguauuuucuuuacugccugugucugcccagugggcauuucuacauguuuaucuuuugucugucuccaugugggacaaucugcuaagauuuuuccagguggcucaccgccucugcaguucuguggaugggugaugaccucauacugcaguugaggaaauggaccuaaaagaaacaacuaguuaguucagcaucacuuaguagaugauagggucaggauucgaauccaggccugucuuacuccgagcuggguugaauuuuccagugagccuggcugcccuaggagcagauaaaauguaggcccuguggccuccuuccuucugguuaagugagcugugcugugccggcuucagcagugugcugacuguccacucauucuauguuaaagaaaccugcuuagcuguugguguguaaaggcuaguaagggaagaaaaauccuguuuuugcaacucugucuccugggacuuuguggcaggucucuuaggacagccacuugggcuuaaaagugaaucccagauuguuuaagucucgcucacuuggcaguuuucugaacuguggggcugaggcugcugcaggcaacacugcuucugguuucucaaguuuucuuuucagugaggggauggggguggaguccacacacgcacaacauuuucuguggcucgaacaauaaccgacagcuagcugauguuccagauuugcaagcgucucucugcccuccugggagaaggaaauucuuagcacucagcuggaggagaaauagccuuucagguugcauagguguguguguccugagcagccuuugaguuugggaaggaucgagaguguguuagccccacauccuuuggaagccaugugucuuugauuuccugaggagauacagggaggagagucugaagacaaaacuacagugaguuuccugccccauugucuccccugugcaacugaucacaaggcuaaugucacuuacaggaacuguuaacaguuauguuuauuuuucuaagggcuugaccuuagccacuggaacuuuuagcucaucuuucaccuuuugucggguccuuuucuuugaaaugauggugauuuggaggacagagcucuugggcuauguucuuaggagugagucagaugagcucagacauguucaggguggugugguccuggcugaucugcccgucugucaaaggauccaggugucagguaucuucagggggaagguaggcuuaaaaucuucaguuggaguugagaaagcaguugggggaaggggagauuuuauggaauguugauaagccucauugugugugugcuaaagagagcccaacauucuugucaggacgcaugaguacucauggccugggacuggagggugguauauguuugggaagaccggaguuuaguguuuguuugguuuuuuuuuugggggggggggggagcacauuuacagcucguuaccaagaagacugggggcuguagaggauuucucuguuuuuuuuuuuuguuuguuuguuuuuaagauuuauuuauuuuacguaugugaguacacuguagcugucagauacaccagaagagggcauuagaucucauuacaaauagcugugagccaucauacgguugcugggaauugaacucaggacgucuggaagagcagagggugcucuuaaccacugagccaccucuccaguccuuccuuuauccuuggugucaguccuagaaacgagggaggcggcucuuaagcuggucggucuucugaagguggacucuuacgcagggugcugugcuccucacgcuggccccaccacugugcagugcuuuaaucuugugucaguaggagcugcaccgaguggcuacugagcggaaccuggguagaacauuucucugguugguuuaaucgagcgaggcggugguggaaagggcagcggaggugaacucagucauguaagauaguugcagcuggaggaaguugcagaacaccguccccucuuuuacgagccuguuuuucuuugccagcuugggaacuuuuuucaauaaaauuuuugaaaaacaacaaaaacuccagcuaguuuauucuuuguugugaguaauguaguaaacguaagaguaagcggcuucccugacagauagccugguugcuuuagaccgaaaacccauuacaacugaggagaguugcugguuggucccuggucucaggagguuuucccugaggcucuccuugaugaucucugcagcaccucauucccuuuacgcucguucccacccuuucccagcaugcccaggaacuaaauuuaaaguucugcugacgugauuccuguuugguuucuuugauguuucucuuccaugucagcagcuaucugauucuugucucugugugaacucuuuagaaccagaugcagagggaguggccccuucugcugggagaguuacuagaguguugcccuggcaaugccucuaccgggucuccacucuuccucauccugccucugaugugccuucucuuuguauuuuccuuagccucggacuauggcaugaaacugccgauccugcgcuccaccccggaggaccagauccuauaucagacagagcgguacaaugaagagaccuuuggcuacgaaguacccgucaaggaggagggcgacuaugugcugguguugaaguuugcugaggucuacuuugcacagucucagcagaaggugagggguguugagguuccuguuuggccaguagcacacugcugcuuuugaacaguucaguacucugaagccaucguagaaaccaugaggauccucccacccuggagaagcguccucccccugcccauuggcuguaccugucuuggguccuuuuaggaaccuccugcucacuuccuucccagacucucagcagcuuguccccugcguuggcgucccugguucagucugucugcuuucucccuguaaggccagcaugaaaccuuggcagccaagggccauggcuguguuggcucugguggaggacuacagucaccuuggaguauguccagagucauaauuuaaguuaugaagcccgagcagguacaugucugaugucuugaggggucugaagcuggugguguuaacagugucuugucuuuuacucugggaagguguuugauguccgguugaauggccaugugguggugaaggacuuggacaucuuugaccgugucgggcacagcacggcccaugaugaaaucaucccgaugagcaucaggaaggggaagcugagugugcggggggagguguccaccuucacagggaagcuauacaucgaguuugucaagguaacggcggcugggccuccuccugugggagggaggagaagaugugcugccuguggccugacugugccuucccuuuucuagggguacuaugacaaucccaaagucugugcacucuacauccuggcugggacaguagacggugaguuggaauuuuaccuucugcuccgugacuugugcugcaggguaugcuugcggagugcuugcgauagauaauacagcuggucauuguuugggaaauauuuaaagccacaucauagggaacucccagucaaacauacaaggacaaaguaucacaugguucuggccacaaaggguuaaagucaggucuguguucaucccugccuguuacuguuuaaucagcagucagucuuuggcaaaaucuuuuuuuuuuccucuugagaucgagucucucuaguccuggcuguccuggaacucacuguguagaccaagcuguuguccuuuacucacagagauucuccugccucagucucccuagugcaggcaguaaaggugugcaccccuacacccugccucugggacaaaguggaaacugcucuaugaguugggauuagugaugaccccuuuugggguuccuuccccguuaucucacucaguuagaauuaccugaggacuggcaggaaagucaccucugcugcuaagaccgaugaccugaauaugaucccaggaaccacaugauagacagagaacugaucccacaacuuguccucugaccuccaccauggcuugugugcaugcaugggcacacacauacgcacacaugcaugcacaguaaauguacuagaauuaccugaaauaugucuuaaguuccauuugugguuugggcucuaguccuuuggagaaaaagacaaaaauaagagucccugugggggggcuggugagauggcucaacagauaagagcacccgacuguucuucugaagguccugaguucaauucccagcaaccacaugguggcucacaaccaucccuaacaagaucuggcgcccucuucuggagugucugaagacagcuacaguguacuuacauauaauaaauaaauaaaucuuuaaaaaaaaaaaaaaaaaaaaaaaaaagagucccuguggguuugguuaggugcagcuccaguaccugagauaacagguggcuccuugaccuuggaguucagccuuggucaucucuugcucaggguuuagauugcucugcugcagccucccagcugauuuuugcagggaaaacuugguauccuacuggguuuucuccuccaucuucucucugugcuguuucccaucuugucuugaauacauggaaagucauaucuuuaauuuuuuuagacuuauuuuauguguauaaguauuuugucuguaugcguguacuugugcaaguguguuaguguguguggguuguguauucaccacauguguaguauucucagaacucagaagagaaacuggaagugcgguuaugccaugguggcuguaagccaccagcucggugcuggggaccgagccgaggucuuccaagaggaagagcagccagugcucucaagcguggggccauaccuucugcccguccucuuguccuaacaccuucccucccgcccagugcugacauggaucuucuaggaaggugacacuguacaccaggcucuacuuggguuccuuaggaguuaggacagagguguggugaggcugggaaccagagccugguagggcagccuucaguaucuggaucagaaggaagacgaagacuuugaaauaaguuuuaacugucagaucacugucccugccuauugugggccucugggagcuuugaagaagugagucaggaaggagagagaaccuuccuuuggggaaggcccuguauugcuuuuuagguaaaaccugaaucugacuacuguuccuguguccugcuguuuagguuagagaucauuucuaccccucccuguggaccugguuagaugacagaggucucucuaguguggcccauuuacggcucugaauguucucauguaaaugcucugggucuuaguguacuuaaaggguuuuucuuuuuuucuauuagauguaccaaagcugcagccucauccaggauuggaaaagaaagaagaggaggaggaggaggaggaauaugaugaggggucuaaucucaaaagacagaccaacaagaacagggugcagucaggcccccgcacgccuaaccccuaugccucggacaacagcagccucauguucccuauccugguggccuucggaguguucauuccaacccucuucugccucugccgcuugugagaggacaaauggccauccucagcaggguggagggagugugcgagaaaccagacacuuugguuucuguaaucuucacaguguuuaggaaaagagaaaacaaaucaaacagcgcacacacacacacacacacacacacacacacacacacacacaaacacagacacacaugugcucacacacacacggaaagagauaagaaaagcagagagaguggggucaccccaccaacacagguugcagagugcucaguccugcucugccuagcuggccccaccccagcucucuuucucugggguacuuagggagaggauccuuccucuccgaggauccucauuauauaccuaguaggaaggacucugaacucagagcagucacacuuccuugguuuuuuuagguuagacauuaacaaacagcaggaaaaugucacauaaccuggaaagaccgcacuggaguuggguguguucugaguuucuguccagaugugauuucagcagucaugguauuccaaguguguguguggagguagauaagugggacgguaaagacaaaggcguggaagagaaagucagcgcuuccuuccugggaagccugucgucuggguuaaucuguugauguaucuucauugucaucucucauccugaugugugccaguuagaggacugucugguauccaagacgacuaguguaugucagguccucaaaucaccaacagcuuguuacuacaacaaauuguuuugauuuuagugccuguugaggacuugauuucuucuugauuuuucucuuaaucugguucauuugaaauuucucacuucuuaaccauagagcuaaguuauugucaaaacugggcaggagacaggagauuggaguggucucugcuggggugucugacccuccaccaccucaccuuguugguaccucccucccugaauuccugagccagcaacucuuacuggccccuccauagggucuugcugccagggacagggaugcuuuccagccugcagcaacagaacacuugaccuuaaaagucucuucuggucuuuggauuagaaaaggcuuauguuagcaaccucagagacuugagcccugcuaagugacugaccacuguuuagaauguccagaaucugauguccaucugucccugugucuucuguccucuuucagcuaguuuaggcuuaugccuagagucaccccaaagaacugagacuggcugcagcagcccagcuguguuucucauugaugauaauaguaggcucuacugcccuccccuccccuauccaaguagcaguuaaguuccauccaaauacgugggacucaaagacuccuagucagcuguaguucuggaggcucugaaugucuaacuuuagcaucaaagugucugucucagauucccaguaaacaccucuguaggggaugaaguuuccaugucccccaucuuccuuuuggucaccuucaucugugugucaguuaagacacagugagggacagcccagcugcaauaaaagggauuuucuaugucagaagcagcaggcuuugcuucagcuugaguuggagccgugugagucucaggccaggcccuuauuucugaauguguuugaauuuuaaguuugccuuaucagauaucugagcugugcgacaaguaaguagcucuggggccaugucuugacuggcuccuaauggugacuccaggccagcacuuggucauuugagaacugucuucuguguucucugugacuuaggcuagcccuaggguacugagguggcagcugcauggcuguggccugaaguugcacuugcaaagguccugcuucuacaggacgcugagguacuuacuacccuggucucgggaacugccugccuagggcaacagauguccugacuaaucuggcuucugguucccgguccaucccuauuuacaaagcuaugggccacugucagcacauuaaacaaggugagggagaguagcugccuccgugucaccuugucugccugggucucugaggaaggagggguccugcuuucucacccagcucaccccuuuggugacucagaguccuucucagaaggaaacccugacuccugggccauuuccuaaugguacuguaagccaaguggcucggcuucugccucuguuuccaagcccaccccuucccggagggauagggacgggugcuuuccucucuaguuguaucugagcggaaggaacaucuuucuguagcuaauaaaaacuaaaagggaagaggaagcagaagggaaggaguguggcggaggcugggauggauucccuaagccaagccugcccagcuaaugagcuguuugacguugaacuugaaagcuuuccccucccucuaagaugauguagguacuugagguuuggguuaaaggggcuggguggggcacgcuuuauuuuuauuuuuguauuguguaugucaagaaucacuccauuguucguguugcuuuuugcacuguuuguuccccgcuguguuuugagcuagaacaaggaguugccugggauugggagcuguggguggugcaagucagggagugggccaggagaggcccggguuuucuguuugagcuauacucugacccaggauguuagagcacacugauccagccacuagagagaaagguacaagagcagagcagaggagcaagcaaggacagcuggguugagucugcagguccagugugguuuaggucagucaggggccagcuggccucugacugcauugcuuuaggucguauucaaacucucuuaaacauugugccaagaaacgauuugugggauucaugucccgaaaccauuaaaucuauuguuuggaaagucugcaguccugaggagggcuugcucacuggacacccacagaucuggcccuuugaaaggcagccuucagaugcccaucgugugagaggcgcugccuguugaugaagugugugaccuuuucuccugcugagugggagaucccagggucccacacgccucaccucggugagugggcagagcugagccgcacugugugccugggagcagguuacaacucugguuugacuuucauuuuguugagaagcuucuguuuuaaggaauuucuccuucuugucucauuccugccuuuccugggaagggccuggcccugaucuagagucuuagcuaaggagcugagaaacagccacaguacucccuucucuucgcgcacagggcccucucucuuagagacugcucagcuuucgaguccagggaggagucagcggggagucagcagguucucucuccucccugggaacuggggaccaacccaccccggcagcacagugccuuuuuuucuccugcucugagucaggugggcguccccucuagauccaggucugggcaggggucugaugguccacugugggcuguuucccuauccaccccccuccuugcuggccuacucugacauaauacaagugucuucuugccuugaggaaccuuaauggcauuguggccaccacaugugacucuucuccgugacucuauaaagaccuagcagagcaugugagcauucucaaacaagagacuaacugaugcuccugcuguuaaaaaggcagaacuagggaggugacuuuaggccuccugcuguggccucugaagaaggugacucuucagguaagacugauggaggcuacaccgacaaaccgcagacacgcaggaucugcucagagauugcagaagagcguggccucucuuauagggaagauguaauuauggaucaaagagugcuaagaaaauugcgaagaagccuuacugcuuacaccagagagcucagggcagcuuuaucuuccagguuuaucuaaaacuaucuguguugggcuucccugacacgggagaggggcaaggauagacgauugacauggcacugauggucaguugcccagggaggccgcuuacucuggaugcagauggcugcugccgauccacucugucuuucucgggcugcuuuugcgucguuguccuagguggccagauugucuugauaagagcagaucuggggacugaucggauuggcaggaaaagaacagagugcaucucuugggaugggcuucucucggaguguaaaagcaaggggccaggauugugcuggcagccagggagacaguagugccugcggaaguuggcagaggaggccuuggcaugcucgcauccaggcagucaugugugaugggagcacauagcaucgggagaagcagaacuccauccucaccucuauuuugagcuuagugcuuuauuucaguaugaggaaaaacaacaacaaaccgaagugugcuuuccguccuuucagaggacaacugucaggaaacaguugaggugccaggugggaggggagacuuggcaaggagagaugucguggcaaaacuaggaaaagagacauucuuggcucuucucuuuccuggugugccaugauccagggaaugaaaagaaauuugacccuggauuaguuucuuugucggcgcugaggaacacugcuuuuucacaaaguucccccgggauagaauggcuguccagucuaagcucagggcagccucuucaaccacuguuggcccagccuggcuugugaggaaaccagcccugucccucaguauugaacuuggcugcuugugggauccaguccuggaggacaggcaucaaguucuuagccucuguagcucuuagcuuucccaucuuucccugcaaggccacaccgugcauuuacagcaguguggcaagguguaggagggaccuugaaccuggcuggccagggcagcagcaggaguagguagagcuguuguuccuucugggcugucuccauccaucuauaccccuuucaugccccaccccacucccaccaaaaaguaaaaaaucaggauguuuuucacuguccauugcuuuguguuuuaauaaacaauuugcagugauacuccguguugagagugaauugaacucagagagagagauggugagcuggcugcaguggcacucacuugucauuccaacgguugggaggaucaggaauugaagaccacauccaauuaaguacucaguuaaacugucagucuggacucccaacccccaccacuaagaaagaccagggaggucgcucagcugcuaccaaaacugaucaaagccugagguugacccccagaguguggagagagaaagagagaaagcgcuaacacaugcugugguaccuccccuccccaacagauaaguaaauguguccccuccccaccccacaauaauaguagacaccaauguaggagaaggggagggaagagaggccauggaggacuaaugacaugacauucuugucucucuuggggcuggcaagauggcucagcgaguaaagguccuugcuaccaagcuaaggggaaggagagaaccagcguucccacaggaaugguugucaccugauguccagucacaaacggguacacacuuccuccccagucuuggccugaccacuucagccagcacuccaggaauaaucaagucuguguuauuuggaucugauuggaaugcccagccuugacucuguucagaggcacaccaggccuccagcuaugucuuuguguccuguacccucuacugagaggcgaccugcaagcgaagccauagaauauuucucuugccgggcgugguggcgcaugccuuuaaucccagcacuugggaggcagaggcaggcagauuucugaguucgaggccagccuggucuacaaagugaauuccaggacagccggggcuauacagaaacccugucucgaaaaaccaaauaauaauaauaauaauaauauuucucuugccuuccccuuccguggcaggugggaguccagaaugcaaga

SEQ ID NO: 2619 - RNA, 25509 nt, Mus musculus
cugucauucucgguuuuuuuuuuauugguucugagaucaaagggcuaggcgagcugggacgggcaucaggaaggcgcugagaggcucugcccuggggcacacaugcuguguggggucugcuggccggcucccuggcccacccagccagccagcagcggcugggcacauggcacuuggugccuugcauguccucuaccggcuuggcacuguggccuccucgccggcgggcgcccccuuuuuccaguugcaagaguugugagucuuucacagugcggagggguggggggguccggggugggcaccuccccagggugcaggcaggccccauccgccaguacauccugggcuuucggcagcuacugcgggggugaggcgagcucagcucuucuccccgccugugggaguuggcagaccuggaggagccccucgggggccucagcgagacaucauccggacaaacucugggaggggacagaaacggguguagagaguggcagucagagccagcaaaggacauuggggccgggccccuccucaucacccuugcuucgaggcugcgcuguccccaccuccacacuccaucucuguaaggaagcucugggggcuucuggucugcaagucugacccaugcagacacccccccgcagcuccucccuaguggguggccucacagccugauauuuccagcacaguccccuggguauaucacaguuuuauggguuuuuguuuauuugguugaguuuuuguuuauguguguguguguguuuuguuuuguuaauccauucacuuacagaggaacaucuuggcuguguccagguuuuggcaacuguuaauaaagcagccacgaauaucuauauucaggcuucuacacugacauauaccuucaacucacugggauaaauauccccuccuuuauuuuuauuuuuaaggagacuuuauuuauuuaauguaugugaguacacuguugaucucuucagacacagcagaagagggcaucagaucccauuacagaugguugugagccaccaugugguugcugggaauugaacucaggaccucuggaagagcagccagugcuuuuuuaacaacaacaaaacaaaacaaauuguuuuguuuuuguuuuuguuuuguuuuucaagacaggguuucucugucuagcccuggcuguucuggaacucacuuuguagaccaggcuggccucuaacucagaaauccgccugccucugccuccugagugcuggaauuaaaggcgcgugccaccacuggccgacucagacagugcucuuaaccgacaagcuaucccuccagcccuuaucuuuauuuuuaauugugagugugcaugcgugugugguggugguggugguggugguguguguguguguguguguguguguguguguguguguguguguguguugugaaggcaaaggaggccacgaggugcccuagaguuggaguugcaggcaccugaggggccuggaaugugggugcaaccugaacccucuuccagggcaucaggugcuguuaaaucccagagcauuuccccagcgcuuagcagaguuucuagaucggaccauagaggcuccucuccacccagugucacucucucuuucccuugacccccugaccccuguguucugggcacgagccagcaugcauccauccuggcucuccacccagaaguaaguuccuagaguauaagaugaaugcuacuuuuccguucugucuuccacagugccaagaauggggcugcgcgugcgcagcugacuccaaccucugucugcaucccaacucugcuuuccaacagcuaggcaacugugucugucgugagacagggucucuccauguaccuaccccaccccgguguccuggaacccucuguguagaucaaguuggccuggagcucacagagagccacaucuuuccgccuccccggugucgggaucaaaagggauccgugugccaccgcgccuggcuuuuauacgauuuugagcuuuauuacuaagcaagccucgguguucucacuguuuaauaugaagugguggaaguacaggccauagcauugugagaacagagagguauacacauuaagcuaccuaugacaagcgcucgguacacauaggauaaaagauugccaguuuuauggauuccuuaaaaaaaaaaaugccuguaugauuaggcagguguaucggcucacauauuuaaucccagcacuugggaggcagaggcagguagaucuccgauucugaggccagccuggucuaugccagugauucucaaacuuccuaacaccgcagcccuuuaaaaugguuccuuguguucugaugaucccagacccuaaaacuauuuuuuguugcuacuucauaauuguaauuuugcuacugcgaugaaucagaacguaaauaucugaccugcaggguuccugauguucaaccucuuugaaaggaucguuccaaccccaggcugggaguuccaggccauuuggggcuacagagugaaacccugucucgaaagaaagaaagaaagaaagaaagaaagaaagaaagaaagaaaggaaggaaggaaggaaggaaggaaggaaggaaggaaggaaggaaggaagagccgggcagugguggugcacaccuuugaugccagcacuugggaggcagaagcaggaggguuucugaguuugaggccagccuggucuacagagugaguuccaggacagccugggcuacacagagaaacccugucucaaaaaaaaaaaaaaaaaaaaaaaaaaagaaggaagaugucuagugaaucuuaucuauaugugaggugugagguguuuauuguguaagaaauguugagauaaagaacacaaaguuacucuccucucaaauuucaaagucuaucagggcagcaugggguacagggauggaccuguacagaggucagaaaagaggagacucagucugcagaaggggggucuacuaccggguccuagaagaauaagggggggucuacuacuggguccuagaagaauaaggggggucuacuaccggguccuagaagaauaaggggggucuacuaccggguccuagaagaauaagggggggucuacuaccggguccuagaagaauaagggggggucuacuaccggguccuagaagaauaaguagaauuucacuuaagggugggugagauggcucaggagguaaaggugauugcugcaaagaucgaaggccuaaguuugauccccaggagccaccucuugcagguuguccuucacacucaugccuuggaauguguguggaagcacacacacuggauggauggauagauagauagauagauagauagauagauagauagauagauaaaaugcaguuuaaaugauucaacccaaaugcaaaaagggcaccaggcacaaaggacagcauauuuccggaaaggucucacagggucauuugucuugggcaguucagagugaaggaacaauagauagauggcuggaacagugaccuguggucagaugucagaggccuauggucaggcugaggagcugugaugcucagagaacagcaugaagggugaacagagacaguugaggcagacugaccacaaggguggacgaauauaugaauggcuggauacaaacaggaaggggaaaugacgggacagacagaucaauggcugcgaggaacaaaccagggacgcauaggaggagagaugugggugggagcccagguaccgagacguaugcauggcuggauguauagucaaaugagaaugggugcagaauaaaccgaucaaugcacggauccaugcuguaccgauggcuuuuagagaugguaacaaacugaacagacaccuggacggaugaagaaaugaacgggugaaaaguaugaaugauagacagguagauggauacacggacugugaugggcauggauuggcauauacacagauacgauggaagaaaugcaaggcaggguggggagcaaggcacagaaacuuaggugggauuggugauuuccuagugcgccugcgcuuagagggcuccguggcuggcucccuucgcaccgguuuucaagccccaccuaccuucaaaguccacucguccaucuccauugagguccacgucucggauaauuuccucuaugucccggugucccaccugaugacccaggagcuuccucauggccucucgaagcucgcucguacuuaucuccccgucaccguugguaucaaacugaagaguguuacagggagagaauguugaauggaugagcggcggaccccaacacggagcaggguuccccccuaugucagggcuccuucccuauccaagacccccucccacguucuaggacuaggauccaggauuuagaauccuuuauagucaucccgagguugggacugagcccgucuacuccugcuugucaccacccaucacucaccucccgaaaggcgucucucagcuccuuuacaccaaucauaucugccgucuccgccaggaguuuagggcccaucaguuccacaaagucaucaaaauccacguggccacccacuggagccaaaagaagaagggauugagccacucucaacccaagagcugcccaccucucacuaagcagccuccuccaucuccuccaccuccagguccgggugugaccgaggucaaugaggucagaccucagacaaggggcuggucaggaaacgacucgagggguggucagggagccagaaaaggggagagucacaaagugggcaggaggaagcacaggagaaaaaagcaucgggcaacagacuccggugaggaaugucaaagaugaagaagccaagaugcucucagaggaagaaaggacagaaguuccguggaccugcgccacacgcuccaagccuuacuuacucgagcugugcuaauacaaacucaacuuccaagcaacuaacagcagguggaaggaaguagcgcacccaccugucugcuggcuacaacuuucuuuucuuucuuuuuuuaaagauuuauuuauuauuauacauaacuagacuguagcuggccagacaacccagcagagggcaucagaucucauugugaaccaccaugcgguugcugggauuugaacucaggaccucuggaagagcagucagugcucuuacccgcugagccaucucaccagccccuggcuacaacuuucaaugaggacugacugcagcaggaggaaauccagcagggggucuggagggguggggguggggagaccccagcauaguguucauuuguguaugugugcaugcgccuauguguaugcaggcauaugugcaucuauagaggccagaggucaaugucaggcaccacgacccuccacugcucuccaccuuauuguuugaggcagggucucucacuaaccggaaguucacuaacugagcuacaguaguaggucagcaaacccuuccuuuuuccauugccuagugcuggaaucacagauacauacugucgcgcuuggcuuccuccuagcaccccacccucacgcccccgcuaucaccaccaccaucaccaucaccaccaccaucaucaucuuccuugagacagagccuucuguagcccaggcuggccucaaacuugcuauguaucugaggaugaccuugaacuugauuuuaugugcauggguuuuuuuuaaccuacauguuugucugugucccacaugcaugccuggugcccacaaagccagaagaagagcucacaccauccuggagauagaagucuccaugugggugcugugagaaucagacccauguccuccucuggaagaacagccagugcccuuaccuggggaccaacuugucagccccaaucuagaaugucugccccuccaucucccaggugugcucucagcacggggauuggggugugugugugugugugguggagacaggagggucccuggagcuugcugaccaaacuccucuuaccaaaucagugagcuguaggcauguaccaccaagccugguuuaugcaucucuuaggaccaaaccuggggcuuugaguauguuaggccagcgcucaaccaaccaagcuguaucccaucuccauaccaacuccaugaguuggcuuacacuccagugcccccugcaggggcugcaggggugcagcaguuagugugacucuauccugugugggacccuucccuucccuucccuucccuucccuucccuucccuucccuucccuucccuucccuucccuucccuucccuucccuucccuacccuucccuucccuucccuucccuucccuucccuucccuuccccuuccccuuccccuuccccuuccccuuccccuuccccuuccccuuccccuucccuucccuucccuuucuuucccauuucccuguuccccccugcacuuuccuucccuuaugugacaaacgccucaaacucagauccucauuucuguagaacccagauaaagacacaggaccucgugauaccaacagcauccucuuuacuucuuacugugagccccguuuuagggugcugcuguucaccucacgcccuaacuuacuccuaccgucuccuuacacuccuuacaacccugauucacacgggaagaaacugaggcucagaaaagacaagcggguuugugucgggaaacacagaacacgagauacaagagcugaccccaggcccgugugaccaaucgggagggggcggcggcgacucacgguucauguugaucugcugagacagcucaaugagcuccaucucggugggcauguagcccauggugcgcaugcaguuccccaggucccggcaguugauguaaccauccuugucuuugucaaauucucggaaggccucucggagcucugggggaagggagcaggggcagauguggucggagaugggacccaucuuuaaagcaaaggcagcccagggccagcucugagagguagagaccccggaguccccuaggccucuggcauugcccaaggcucucuacaaaaugaucccuguuuugugcuagggacuguuccaagugaaccugccucucuccccgccaacaccuagaggcagguggaucuuuuuaaguucaaagcuggacuauucuauaaggaguagguagcaaaauccugucucaaaaaaaccacaccacagccaggcagugguggcaaaugcccuuaaucccagcaccugggaggcagaggcagguggauuucugaguucgaggccagccuggucuacagaaugaguuccaggacagccagggcuacacagagaaacccugucuugaaaacaccaacaaaacaaaacaaaacaaacaaacaaacaaaaaaaaaacagcugggugugguggugcauaugccauuagccccagcaccugggaggcagaggcagguggaucucuaaguuugaggccagccuggucuacagugugagcuccaggauagccaaggcuaugaagagaaacccugucuaggaaaacaaaacaaacaaccaaaccaaaccaaaccaaaccaaaccaaaccaaaaaccacaccccacacaaagaguugagcagcccuuuucucuaagccugacuuuaccuucaaucuccucuggucguaacgaucuguccugaaacaagagaacaugucacauuagcagcagcaagggaccuaaaacuugcaauaugcccaucuaaugggggcauccaaguggcagcagacaguaggggggaggugauaggaggggagcagaggucugucuggaccuugagggaaaaauaugaaguccccaagucuuagaacaagaguggcauuggcagagaugucccacacccgauagucccugcaaagacugggccaccaaggagcuucugccuucuccagacacaagaaugaguugggaacagagccgguccagagacagaaaccuguaaauaaaauagggccuggggaagucaccuagugaccacagagggaagagaccacccagugacaccaggaggagccuggcagcagaggccugcaugccaugggagauggggguugcuagaggaggagagcaggcaggggccacucaggcaaccccaagggaagaaaagggucucaggguaugcaaggaagagcuggagcuguguccaucuuccugggcacugcccucaccuucccugaugugauccccaugccuguaccaggcccauuauaagacucagcauaggaccugggggcugccaguguccagaagcugcaugccugcagcugccagcaaggcacauaucuccacacggagccaaagaaacccugcacucaggcauuaaaccugcugccagagaaguuuccaaaaaauaaaacaaauuaagaggaaggguaggguaggcuccuggugaugacggccaucacccaggccugccugguaggccuuugauaauggcgaccaucaccccaggccugcccaggaacucccaguucagcauagguaugggugccauuguuccugcucucugccuuaggguggagagaguaugggguaggucuggcuacccuaaggaggcucccagcaggcauuggcucccauaucauuaacacaggcaggcauacugggaaugccauagugagugugggcuaucucagcugugcacaaaggucauuucagucaguguggagccaagaaggguggaggccagggagacuggagacaaaggcacccggacacaggcacccagucugaagaucauguccaaaggggagguugauguugauguucagaauggaugcgaguuuguaaggagcaggcuacagauagcucagcucuucccagggggcaguuccaguugaggagcaagaguugcucucugugaugugacauggcugcagagauuuuccccuucaaaggcuggcccacuguacacagaacgagggucacuccugcucccagacagaaauacagguucccggacaugccuggguggccaaaaaagguauauuuccauauauuauaucaccaguaugugauaauaauuguacagucaucccucauuaucagcgagggauugauuccagaaaccccaggcacgccagcauccagaaaugcucaagucuuuuacauaaaauggcaugcugauuugcauauaauuuacauaccuccuccaguauacuucaaaucaccucgagauggcuuguucuauguaugcaaugcaaauacuaugcagauaguugguacauuguauuauuugggaaaugaggacaaaaauaauaauaauugugcguuuucagggcagaugcaggguuugauuuuuuuuuucacuuaaauguuuuuaaagacauuuuuauuugauguguaugaguguucuuccugcucacguguauguaugcgcaccaccugcacauacguggugcuuuaagaagccagaagaggacaucagguccccuggggccugaacucacugucaucugcaagaacagcaagcacucuuaacaucugggcucucuuuccagccccagaugcaaaguuugaaaaaauuuauugugcggugguguguguguguguguguguguguguguagaucagaggauaacuugcaggagucaguucuccccuuccaccacgugaguccuagggauugaacuuaggucgucagacguggcagcaagcaccuuuaccugccaagccaccucaccagauucagaugccagucuuuuugauccacuguuucgugaauccucaaaggugggaacacaaggaaaaggggagcagacuguaugccuguguacacaagugcacaaaguauacucagugggcucagcuacggauauaacgagaguuaguccuuucccgcccccagacccugagcagcuugccgccccuccagggcugaguucugcaggucugggaaggaugcgcacacugcagacccuccccacaaacccguccaccccuguucccagauuccgagaagaggcaaagcaacguacuaagucacagugagccugcgacagcagcccugguggcuguucccagggucacccucugaccccuagcuauccccaugcaggucaguggucaggguuguguucuggaguaguuaggguuauacacugguauauguaccauccccuggggugggggcaggcagccuuggguacguguauguuuucuccccaguuugugcaguuaggagaagcccugagaaccuagagucagacagacccagguuuaaagcuuguagcugcuaccuccuagcugacagucauuccugcuucugaaguugaaacgugguugcaugccaguaugcaccucguagggacuuugcgugcaucccucaaaacaugcauuuagcaugugaaauuaagucaaugugaucuacaaauaucuguagccauaacaaccucaauacuugcuucucugggacaauucgagacaccuguuagaggcuguucaguacagaagccacuaaccacccgcagcuacuuauauuugaauuggagggcugggugggguacauaguucaggauggaucccaugcuuagcauauucaagaccccauuccaagcucaacccucagccaaaacagcuugcaaucaaaaugaaguaaaauaaauaacuccauucauuagucacaucccuagaggucacaugugauagguaccccugcacuggcuaucacagcgcaggaggaccaggagacugucugagaacacagaguugcucagagaccgcagaaugaggcugucugcuucugacacuugcuagcaugaccucaaauguguuacugcaucagacuuagucuccccaccagggaauggaggacgaccaaagccccugccucugggaggaaucgggacuucugagagacaauccaccaaaacacuucacauaguguugacuuccuuggguacgcgcauguuuucucagccuaccgugagcacauuguaaggcucucaccaaaucgcagaugcuuguugaucuacgcaugcgcaggugcgcgugcaggggcgugcguguguggaggaugggggucagccuuagauguuccuuaggggccuucaccuuuuuuuuuuuuuuaauuauggguugugcguauauaagcucauaagugaaggaccccuuggggccagaagauggcaguaaaucuccauacauagugcuggacugagagucaaacgugagcuaucugauagggguauugggaacugaacccagguccucccccgaccccgaaagugcaguaccacugagccaccuggccagcccaucccuugccccauccaccuauguuuuaagacaaggugucucagcuguggcgcacaccuaugaugccagcacuugggagguagaggcagguggauuucuaaguucaaggccagccuggucuacagagugaguuccaggacagccagggcuacacagagaaacccugucucaaaaaacaauuuauauauauauucagugagucucagggauuuuccugucucugacuccucagcgcuggaauaauaagcacccgucgccaucuucagcuuuuuagugggcguuggaagcuaaacucagacccuuuaucaaauacuaucucuccagccucugauuuuauuauuucauuuuaaaaacuuuuuuaaaaaagauuuauuuuauuuuguauguguaugaauguuuugucugcaugaauauauguguauggcaugcaugccugaucgccaaggaggucaaaagagacaucggaucacccucccccaccccacccccacccccgccugguaccccacccccgccugguacccauagaggucaaaagagggcaucggcucccugcccagacuggagucacagaugguuguuagccaccaagugugugcuaggaggcaaacccagguccuuuacaggaacagccagugcccuuaaccauuaaaccaucucuccaguccccugcuuuaaucauuuccugcuagcugauacagacucacuuuggagccacaagaaacuucaagaaucagauucacaaguugugugugugugugugugugggggggguugagaguugggguugcuagguuacaaaacccccuuucuucccagcaccuccucacgccacgccacgccacgccaugccacgccacgugaagccagguucggccggcugcaccgcgucaacuuacguacagguugucuguucucagcaaaacccuuucggagaaaaaugcaggcgggacccagcagguugugcaugaccgcacaguucugggccagcaucaugagugguccauggagcucgccgccauccgccagcccguccucgcuugucugcaccgccauguagcuggucuucuccuccuggcgcaucuucagccggcaccaagcaaauaagagagaggugaggugucaccucccuguccaccugggcccucccagccccagccuggcuguugauucuagaagauccuugagagucacgugaugacguucugagcgcuuugacacggacaggguugaauauguaauucauccaacggauggagaugccaauccuugacugaagugucccguggagagcuagaugugauucuugagauaggcugugcgcacgcgcaaacacacacacacacacacacacacacacacacacacguaugcacagagaaucacacacuccugagcaugacgcagagggagaggcauccuaauucaggagugucacacggaaccauauccuuucccuaaaugucccccacccccaccccacaguguuccaacucaacccugguaccuacauccugucucccagccuucugauagacucaggcccugcccuagcuggauacaccccucccccucccccaccggaagagcggugcagaguuggggcgacacagagaacaaacagcuuccgcaaguccccuaacuggagcucauacacuggugucauugcugaccaauaaggcaggugaguggugggaggggggaggggacaaaauggacgcagugugcucgcucuaaaugggccgcacuacucaguacacaccugccaaccgaugccaaaucugguuuaaaaagcaucagugggucagacaagccccaccugugcccaggcuccaccuguucaugauggccuacuugggcagucuuccagcacuuuuccuuuccuacccgcccucuuucccuggcuccaugcccaggcuggccuccuugaacuccagaggcugaggcaggggccuugccaucugaccaaauauagcugugcucucaggccccggccagccugaagauucccacagaguuauaaaaagucagccuugcccccacaggccuuccccccuuaggacaguagcacuauuccagacacaacauguggccggcuggacccaggccucacagaauucccagcgccucuccagguccagcaccaugcccugcaagggacagccucucuucagggugggagccuguagcagaacuuucccaaggacggcaggagagcuggacucccgagagagcugucugucugagacacacagaacuauauacucgaugucccaacuggcugccucuagcuaagcacacacacagguauagacaggagaagccuguucucuuggagucucccucgcccuguccucucaugcuccucuuccaagccugaggggaugggggugggauuucuguugauggagacucgauuccaaccucuuccaacacccuaaaccccuuccagaccuagaggaagaacagcauauggguuccucaaaggagacacagugacucagaccaaggcuggagggucacuuguaagaaaucucugaacacaagggauggccacagaccaaggcucauucuaguuugaaacucugcuccacuuacaccucugaaccugugcuggaaauggcaaagaccagagagcccuucccucuaagaaggggucugugagaaaagagcccgggacuggaugcaagacuagcuccaggaaguaaccuuacuggagauguuugugggaaaagcagacuuuccguuucuggccgaaucucacacgaguuggcucgggagaagcacaggccgaggaggggaggcagcagggagcacagaauccucagaguguuuagugugcuggcucuggaccccaucuugggagaagcucugaaucugccacuugcucucugugugaccuuguacagcucccuucauccccuaugugccccagcauccucccuuacucuuggguguuaaucaucuguauccacaaggcucuugugagccaacgaagaaagcuacggccuauagaucguuuuugcauaguguuucaaacacauuaagagccaaacaaaugaacuugccgucguuaaggcaacaaugcagacaaugauguugguagagcaagugaagagauguugggagccagaaggcauuuuuacuucuggcuccaggggaagugggggaacaucugccaaucagcaaagaaacgagaaggauggagaggaauuugcacccacgaagaacgagccagugguggcugggaauuuccacugcaucucuugaguauaacucugccuggcaccaaguugccccaggagacagccguuccuccccagccagcgaggauggcaccugacaggcugguccugcccggcucagggcuggaagcaggguaccuaucacccuguccauuuucccagcuucuacuuaaggagcagagccagggaccaggaaugccuggccuggaaccaggagaagccagaauauuagagaauguagugaccuccagcucucuaaccaaacaaacugccugagggcacacgggucaaaacucccgaucuacucaggcucaaggagaacgugaagggagauaggagggggcgagcugcucuacaggguagggaguugaacucgacaaucucgaaggucguauuuuggaauuuaugaauaacauuucuggcagugggagaaagaaaagcgugcguagaaugccagccagccccgaguuuacacagugcaggcuccaaaucccaggcucugcuagcgaccagaugaccucagaaaugcuuaucucugggcccagcuuucuuucucugcaaaccuagccaggggaaguguucagaagaaaagagggagugugauggcaaauaugcuguaaauaauccaaaagaagaaaugauuccuacgaauuaugaucacuuccaccaggggacuaagaaccucgccugcuguacuauggcuuggugguagagagaggcacaggguucagcacgcaugaggcucuggguaauaaagucuuccuggguaugguggcucaagucuauacuauauuucuaauaugcagcagcuaaggcaagagaaucuugauuuccaggccagccugggcuacaaacagaaaccucaccacagaagcagcgguaacgaucaccacucucuuccgcuuuuauacuccauccuuuaccucggaugauagugagcauccuaacgcgugucugguacuguuuacaucuggcgcugugcacagcacacgaucauuuuaagaguuaaauacuuggggcuggguguggugauacaccuuucaucccaggacuuuggaggcagaagcaggaaaacuaugaguuugaggccagucuggucugcauugugaauuccaggccagucacggcuauacgguaaaacguugucucaacgcaaagcaaaacauaacaaaacaacaacaacaaaccaaaccagccagcugcacuggcucauacauauaaccccgaugcugaaggaagcccagguuucagaguaagcccuuguuucuaguaagcagaacagaacaaacaaacagacaaagcuacacaucaggccugggcgguguguagcucugagcuugauccccauagaucacaauguacauaggcauuagcauucccagcugaugggcaaaggaacuaagucucaggacguuaaguaauuuguccaaaaucgaauggccagaaagaagaggcucaagcacucaugagaagaggguaggaggcagaggacaggccucguucuucaauucauaucccucugcguuggcauuugccugggauccucuaauuuagaucagcuuccgcuuccccagauccucccaggcagaagccuccccuaagagaauggcagacucugaggcacaauggaaacgucagacgccccccccccccccgagccgcccaaggaacggccgaagauuaaauggaauuugaugucaacggcuuagccacacgaggaaggcgacagggcgaaaaagccccaaguguccuaaauugagaggucagaagcagaauggggaagaugggaccugagugaaggcuccauuagccaauccaagaccuucggugagucaccugacccuccaauccccgcccccucgauuggcaaucccauuucuuauuuggcaaaugaaaacacuggaggcaaaaaucuuuaucagucuacgaccugacuccagccagccugcaauauacgcagagcccaagcagaacacacucuaaacauaacccagaccuuccuggagaagcccgagggagggaacacucgcuuucuccaaggaauucuugcaaaaaaaaguccuagcguacaagcaguaaauccacccugaaaagugacauguacaauccugacccacauaucucucaggcaccguguuucucaaaagaagccauccuggguccuaagaccauaugguccugacucccaccccugacucaagaguuauuguaaauauaaucaaagggggacauuuccuugcuuaauacgguuccuucgaaacuuagauaauugguucucaaccuguaggucaugaccccuuuggcaaacgucacaaaucauaacaguagcaacauuacuguuaaggagaaccaacaaaaauaauguaauaguugggggucaccacagcacgaggagccacauuaaagggcugccgccuuaggaaguuugagaaccacuggcuuagagauuaccagugaggagcacagaccggcucagcccuggggucugcuccugaagggucuccgaugcuuuagacucuaaauauguacacugccauccuaagaauccacacguuucaucuuauagccaugaagccccaaagucacaugguuucuugcuuaccucuuucaugaaucccagauaugaccuuccgggaccccaugaccucucaccccuaaccccaggcaccuuuaagcccuaacuuuagcucagagccucccuagaacauaagaaucugcugauggagggugucuugaagucagaauagggacacaguuuuggacagacacccugggaagccuaaugaacaucagaugcccacccacuucauccccucugggguaggcaacaagauguccgcaaccccaguaccaagacucgggggcucccaaaacauaccuuucuugagagguuucuuaguggcgacuugacgcaguugcccauccuacgcugacacagccccuuuggcggucucuggguccaugaaggaggcuucugggggcggggggggggggcgcagaagaccucagucugggucacugccaaccccagcgacucucucugcuccagucgcucuuccuccaggacagagcugagccggagcgcgcgugcucgucugucugccugccugccugccugccugucugcuccugcugauuuuuuuuuuuuuccuggugguuuguaugugcguuugugugucuagguuuaacuuucuagucaguuucuuaaggagccgaaggcagaaggaaaaagugcauagcaccgggggaaaaaauccccuggagaguagaucacagagggcacuggcgcugggaagccuuuaggaucaucaacaacagauuacagcauuaggcucaguccauucucugucuauccccuugccucagccccuccuucuuaugcuaccaaauaugcagggagauugccuuggggagggggacccaagguggcagcugcaacugggaauuaggccagcagauccagaaggggaaagcuggcuagggcccccaaagccagggugccucacagccugcgcacacgcacgcgugguugaacacacaggcacacacacacacacacacacacacacacacacacacacacuaaccacacacaugcaugcacacgcaggaccccagggagauguaagccgggucuggagagcacugagccgggugagcaugccucaucagccacuggcaauuccagcugacugagcagcaaggugguucucaguugagggccugggagaucuugugacgucucuauuacgcuccauuuuucacacuugccucaucgcugacauggaaugaggcuccagggcuggcggcacagcugaagccacagcugucaucugcuucuuccuuaugcucccucugccguggaaaggcucucugacccucgggaagccaagcgauggccuugaggagaggagaaugaaggcagcgcuggcacagaggacguggccaaggucucucugguccuucccauccucuucccaauucugaccuaaaggucuuuuucacuggcuucgcuggagugcagaacagggagguuugccuuuuaaaaaugguccuccgaguucccacagucggaacuuuacagaugacucgguguuccuugucccuccaaauucuugcuuuggcaagggaauucucaugccucagauguccgggucugagcgcggcagugguaggcggguacccagagaagcauuccucuuauccguguauccagcuuuuccccagcagggggcgccagagauagaccaggagguugaccuacucccuggccccugaugcaaucgcagacaccaagcccagacugcuuccucucccagggacuuuuguccauugggaugucuggucaggaauuucauuagagaagauggcuggguuccuugcccaguggguggcacaggcuuccuccuaggaggcuaaaaaggaggucgcuggcuaguucacuaugucucuggugcugugugucgcugcagaccagggaacgguguugccuaggcaguuucuugaugccuugcuuggcccauacuccuggaggaggggaaaaggaagaagccacuccccgaacacaaaaggaggagacugggugggaacagcuaaagggcaggaaagaggguaaagaugccagagagcuggggaggggcagaccgcuaacggaaaugcaaagcaacucagaggaagcacuccgcugguccaggggucugggucaauggccucugaugaauggggaaggaucuggggucuaagguugagccccagcucugccugugaucaccuucuauuccugagcuucaguuuccuccguuagaaaaugggacuuucccugucuggcuaauacggcgcauacaggaaagccugugguacauaauaggcgcugauaaguaauuauucaaguggaagaaggaaguaucguuugcccggcauuuaugagccgggugcugugcuuggcucuggaaacaaugaagaggaacaacaacaacgggaguuuacauccucgcaggugggcaagagagagugaggaguacaauuauuuaacuauaguccagaauaacgcuaagaaagagaaauacaggcgggcaguggugccgcaugccuuuaaucccagcacuugggaggcagaggcaggcggacuucugaguucgaggccagccuggucuacaaaguguguucuaggacagccagggcuacacagagaaacccugucuugaaaacacacacacacacacacacacacacacacacacaccaaaaaaaaaaaaaugagggagagagagagagagagaaaagaaagagaaacacagaaacagcuggacccugcccugaaaucccuggugcagugggcauagggcggccaagugcagagucuguggacucucuggggagcucuaaccuguagcuggcauuaagacccacugagaguggcugggaaaaugauucagugguugugugugcuuguuguuuuugcagaggccccggggucgguucccagcacccacggggaugcucacaaccuuuuguaacuccaguuccagaggaucuaauguaccacuucugagcucugaaggcaucaggcacacaugugguacacauacaaacagggggaaaacacacucauacacauaaaauaaaaauaagucuuuuuaaaaauaugaaagacgacguaccagggauagaaugccgagucagacgaauugcgaugaucugauucacuuuggacuucuggagguugucccuuagauacuaacaacaccuccuuugggcucuuauggguggcuaacaaaacaauaucacaaaaggugccgcccagugucuggcaccaaaaaccugucccauuccucugccucgaacugaaagggcuaaacgcagcauccacucauccaguuauucagcccuggugacuccugcccccugcaggccagucucagguauagcagguccuugucgaccuuggcuuuguaugccucuguccuuggaaacuggagacagaagacagcaaaaccaaucaaaugcuuaaagaaagcccauccugcaacucagcaagauugugcaguuggucaaaguacuuccugcugagccucacuaccugaucaggauuccugggauccagaugguacaaggagagagucaacuucugaaagcuaucuucuggccuacacacacacacacacacacacacacacacacccuugagcauacauacacacauacacacuugugcacauguacacacacauauacccauacccauguacaugugcaugcacacacauuugcauauacaugcacacccauauacacacauauacaugcacacacacguaugccugccucugcccaccaagagcuuggauuaaaggugugcaccaccacacuuggcaaacacacauuuuaaauaaauaaauguacaaaaauucaaggucuuuuucugcuuugggguaagaaugugguggacauuguugaggcuuaaggucagcuagggacccagaaggaccagauauggggguuuuaaagucuccuuaaacuaaacugggcaggggcgggagguuugaccuucccuuaaaaacgcagcaaggcugacgcuugggaguuuccucuaagaagugaagaacacuuugugacauacacucuucuuauucucugcaagucccugggccucuggagcccugcuuuggauucugaacagaauaauaggaucagagggugagaaggcugagcccauugcugguuauccccgcuuaggaggguggccggucuuaggucuccaccagaucaaccaacagcauaugaacuugggugacaacccagugccgggacacucagggagagggcugggguacacagcaugugagguacccugugaacaccucugauaacuuccauuccuggccagcccagugccacucagaugacagguguuacccauuuauuuacuaugugaccucugacaggcacugcccucuccagagccuguguucucauuucgaaaauggggggugggguggggauggugaugaagccaacccuccaaggacagacucuggcaauuuuggauuccagacugaggguuuuugaguagcccugccgaucaccgggaacagccgaagccaaacgcagacauccagacaucccagaugaugcucucguccacugacucagccucuccuaacaucaugauugaugccaaccacaggcugaccuucuccuuccucgucccgggccucaaaggaaaggcaacggaaaagagcaaguagcacaggaauggauauucacaguccugaucuucaacuucacacaggcugaugcgguugaacccgcagggcccgagccaucauggcccuggcccaucuccuccgucuguaccacaggaacgaggaaacccaggagucacucaugaauacugugaugcuuuuugcguauugcauggacacugggcuggucccuccacaucaagagagauguuucucuaggaugguaccagagcugggggcguuacuugcauuagucucuucucaagcuuuaaaacaaaagcagguguguucauaucauagucuuccaaggcccaagaucucauauccauaucgugcuuauucaaggucgugucucacgccccacagucugccugggcaccuggguguccuuagcugguagagcuagggacaggucgcugacauugcgcucugagcccauucuuuuaaaagccuuucuagcccagcauggaggcagcaucccuuacccugcgcuuacucagacugcggcacucuuuuaaugacuauuaaugaaggcagucacaggaaugcaggcugcucuuuagccagcgcucacuaugaaccaggccccugauauccuucaucucaggcgagccucaucacaacccugcaaggcagcuuuuccccacucucaauucuggaagaagaaaccaccgccacagagagaaaaaugaugccaaggucacagagauacaaagugacaaaguuggaagcuagggaucugguaccuuucccagccaccaucccacacaucagccuugaagccacagugucuccucccuacaggcagcagagacacucccgguugucacugggggguguguggagguggggggucuuacuucccauuuccccaaguguggagagucuaucuggauaccucuagugugcccaauccuggcucucucugcugcuauuacaagcagaagaagugcagccuuauaguuaaucagcaucagcaacagcaacauagaugccacccuggcuuggugauacccaguggaccaagcucucuauaccuaggccugcagaaaccauuuaacuuccccaauucacuauaauugaucuuuucucucucucucucucucucucucucucucucucucucucucaauaaauaaaagcccugaugagauaaaagcaauucaccuaauucaccugagguuuaaaaaaaaaaaguuaaaauuuuugauaaauaaguuaacggcgugaacaaaauacacuuugcccuaaguggauccaccuagaacuuucuguuuucagggcuccauuuugccuucucuuagucuccacccuaucuuuaaggacagaauguucaaugcaggagagagauagcaaggagaaacuacuucuuccuagucaaaggagacaggaggcucugacacaaaccucuuagauggguuugugguccuguccccacaaaucccuuagaggagucgucaccaggaaacucaaacugaaugugcugaggggaggggguggaaggggagagagucugcugcucugagaggcaagcgcuuccagagagagguaguaaauauuucauggcaccuuccagcuccuugugacucaagugaccccgugacauuucagaacccgggggcuggagaaucgucuccacuuaauggcugagacauggaagaggucguugaaagguucuggggcuuggacaaaggccucugccagcaaauguugcaaauguagggagcaaugguccuuuugccagaucacuggcaaacugacuaaucagccugaugacugggcaccuuccaaacggcugggucgagagcuccaaaacagccccaaauccuaacucuucccaccacucgcuuccuaguguaccaccaaugccccgggaaaguagguguucaagaaaugcuuaguaacugagugaauugcagcuccccacucacaacacagcauuugaaugacaacccaguccagacccacaaaucacuccuaacacgcuuaggcuccuuggagcacacaaaccacugcagugagcaucucccuuggcacguagccaggcucucgcccucucccucucucucgcagggcccugcguccaaaccucuacuccugagcaccgcuaacagggcucccugcaggaacaaagccgugugccugcuggccccgucacaccaucacagcggucccggugcaacccgaauccacgugcagcugccuucaugacagagccccgccugcauuaaccacugcagaguaguauuuugaaaagaagcgagcaguucugaagcaaaaaacacacgcggccuccugauccccgcacagccagcgggagcuugaggugguuaucuuugcgauagauccuaccaaagaaacacuuagaccccugugucugaaacuaugccagccuuuugauugcgccucugcagaacugacucccugaguuugauucaauuacagucucccaacuagaggaaaucuuggcuuugcucagaaguucacggguuccugucucuccugcgacacaauaccacaauguagccuugagcuguuuguaaaugccccgcugacuggaauccuugcgggcaaaggcgugcgagggacaaaaaugagucaccaaugaccucuuaguggccuuccuaacccuaaaaggcacaccaacccaggcuuggauuuucugggucuuaucccacaauugccuaacugccauucagauagcaucccuggaauaccaucuuccuugaaaacacucucaaguucuagauggagccguagcucuggacagacccuucaugccuguccagacaucucuucuccuccccauuuuuccaauccccuaacuuucccagaccuuugaggacacucuaagucacggcuaguauaaaucauccacaagcaacucgcuguacucccaggcccucccccuuugccgcucagacuccaagcccuucgcuccucugggucgccagaggccagagagaggagaagguuggcgccgccugcuccaagcgcugcucacgacccuggaaaaucucccggaggauugcggaggucgcucuugcaggugcgaggcaggcucagcugagcggcgcccaggaagaggcccgaaguguggacagcgcacagggugcugaaucagacacggggguggcggagcgccagggccgcgggaggacaggaugagccaaggugcaccccgacugggcagagcgagcagaaccggggacgcgccgccgccguagggucccgagcgccggugcccggagcgcgggcgaggggcgcggcccuuaccuggccgaaggcggagcugagcauggggcgcagccgguggaggaacggguccgccucgggggugccagcaggagccggguccccgcgaccccgcgaucgcagggagccccguagaccgagcgcuggcgccagcccccguuccuccccaucgcgcccgcgggccggcgguagcgucucccggggccugcagugcgccuggggcagcccacgccggcucccgcgcgcgcccucgucccgcggcacgggccggcacaggggccuccgcgagcugggguccccgcacgguggaggcgagccggggcagggaccgggcagccggcggccacgcagcccggggucccgcgcagagcuguggcggggagcccggcugcccccgcucgccgccgccgccuugagcagcgacgucuuggacucgcucuuggcaaugugcgagcucaucgcggcggggcccgcgcucgcauggcccggcggggguggugcggggcccccggagggcagagagcggggcgcccggcgggagccaagcccgaggacgcgcugcag

SEQ ID NO: 2620 - RNA, 9770 nt, Mus musculus
cgucauaagcagacucuagugucugaauucacagcucuaaccaaccuggcacauugcaguauuuaagugaaagacuuuuagaguuaguccuaagcuacauuaaauucuuagguuugcuucugacuucuuagaucuuguggcuucguaaagccugcaucauuuuucugacccaucuguucuguuuucucuuauucccauguuuaauguuuauaauguccuuucauaauauugauuguaaaagucagacuuacugaguacacgguagggaaauggcuuaauuaaaauuuuauagguugggcauggaccauugcuuagguaugcugggccuuggacaucagucaucagugaagaacagcccugcagacuugccuacaggcaggccaguccuacggagaccuucucccgacggaauuaagaguccuucuucauagaugaccuucguuuguguaaaguugacauaagaaacuagucagcacagacccugagacugaugaucuacaggaacuucaguggcaggaacgggggcuagaccaugguucuuacagacuguaaccaugauguuuccccacugaacugggaaggaagcugcugcgugaaaggaugcuguggagcccuggguacacuauggggcagaguccucgugcuagguuuaguuuggcagguuuggcaauuguggauuucuaaagcaagaauaguuuaguucucagagugaaagugucaaguagcauuggguggguguggaaggaccugcuacuaggaaagagagagacaaggugcccacugcccagugcccaccgccuagcagugucugcagcagugccugaugugugggaugcaucagcuguaggugagagaggauggacugcucccgaggacucuguagaggaagacugacuuggugugugucuucaguccugacugccagggcaucguggccacaacagugaucuggauguuucuucugaaguuguccauccacagaaaaccaguccacagcaaccaucucagcuuggagagcuagcaagccuuucuguuuuuauuucuuagacagucuugcuauaucacuggcugugaacucacuggugcaccugccucagccucccagccuuugugagggguguagcauuuccuaaggaaagggcugucuugcugugguugcaugccgguguuaaaggagcuuugagaagccucuugucugcguucacugguguaggcaaugccuaguacucuggaauaagaacagggcaggauuaauauuugaaccaaggcuuacuuuuucuuuggggagguuauggcaguuauccaugccugauuccuucaccuccccaucucuucccccucccucccucucugaggcaaaggcucacucagaagacuggucugcaccucacuauauugccagaguggucgcaggcaagggccagcaugccuggcucucaugguuguuucucauuaaaaggauacucauguaaccagguuucugauuuccuuucagacuuucugcugaccccucugucacccacugccagucagggcaguccuuccuucugcguugggagucuggaagacgacucucccuuccuuuccuuugcccagguaaauccuuugcuugagaaagcagcucaugggagcucugcugcugucugggaaccuagugcagcugugagaguggcugcauguuggagaggcagccagagccagugcaucacccacaucaucaccacaugcacagugcugagagauuggcucaggacagagcucacggaaguaguugagaauucaaguaguuuugauuauuuaagaucauuaaaaucuuauaaaaugacuauagugaaagauaaagaaagguaagugcaggccugaaaucccagcauuugaguggugagcagaggauggggaauuaaagccaagccaggauacagaagacccugucccaaaauacaagaacuucaaccagaauagguuacccugugaagccagcaccucguagcacagcacacuucaucucgaauaaugugucucacuuugggacacuggugucagggucaggcaggcuugcuugaauucugugcgggguggggugggguggagaagucauguacuuuuuaguguaguagcccaugccugcccaggcuacaaaaacaggagaacaaauucuggugggugcuguggggcacauuagcaaaugaaauacaguagagcuggcuuugauugugugaaaugaaggcaguucuuguaaaggcagaggacuguucagauuuaccauauguacagaaaauaacugggccacggcuuaggacugcacccgaaaggcaguaugugcgugcaugcaugugcaaaaagcacuguaggguuuucagaguaggaggcucaguauaugcauggcuuuuuaaacuggaagguaugcugcuugugguaaacaccuuuaaccccagcacucaggaggcagaaccagacagauuuuugugaucuugaagccagucugguccacagagugaguuccugguagccugggcuaugcaaggaacucuguucuuuccuuacucccagaggguuaaaagaaaacaaucaaucagucaaacagacaaaaccccugggagacacaguauauccuuaaggucucuaugccccauauuacccuaaaacucauauuguccugacugguuuugaauuguaggcaauccuccugccucagccuccccaauucugugauucuuggugugaagcaagcaccauacccagcuggcugauguacuuaggugccccaagaagggcagggaagaccgaccaucagagcagggguuccugacucauggcugaggaaagcucuuccacagcccucugucauguccacgacagacuguagacaguccugugaagcgcuguggugacacuuaacguucuuccuucugucccacuuggcagaugcugaggguuggcaaagcaaaagcagacggguggcccaaaacugcuccaaagaaaggugagagcggucagacggcaagggcagaucuggacaaccccucucaauacaaggguuacaauuuuaacacugcccuuuucagaugacaauagcuugguuccucccgccccuguggacagugauggggagagugacaauucugaccguguuccugugcccaguuuccaaaauuccuucagccaagcuaucgaagcagccuucaugaaauuggacacaccagcuacuucagacccccucucugguaagggcgggaaacucacucaacucagagcucaggcuuagccacgugugcugccguuccugccugggucaguggcagguaccaagugucagcacggggcuuauuguccacccuaugugaauccuuaagguccagaaguggacuugugaggaacucuuuuuuauuauguguguguaccaugugcaugcuugauguuuuggagcucgaagggaucaaaucuccugaaguggagcugcccgugggugcugggaaucagcccugggccauuucaccugggugcccacaguacugugccuccccuugucuaagugcacucucuguuuccccucagaagacagaggagggaagaaaaggaagagacagaagcagaagcugcuguucagcaccucggucguccacaccaagugacacuauugcccaggcgccuucuccaucggguuuccucucugugcuuuuguuuugcugcuguaauuuuuaaguauuugaguuugaacagauugauuagcuuggggcggggggaggggcuuuccacaaagugagggggaaccaagaaaauuuuaaauacaguguauuuuccagcuuccccucuuuacaccagaauaaaguauugacacucaacuugagccgccuucccgacaagcauauucauuuguagcccuuaaguuccuucauccagugggacagcacugcucugcugcagguuuuucuccugggaagaggcugugccuguugauuccccuucuuaccaagagagguuuggcccuuucacagccccuuuuucuuaaaggccuccgaaaggguguuugcaugccugucuguuggccccugcaacuggagucacucuacauuugauugugagccuccguguaggagcuggaagcugagcccaacuuguuuaagugcccguuguuuaaaggcgacagagucaguuguaaaccaucugacaggcaggaggcagagagagcuacccgggacacuuucaacaaggcugcaccucccaauccuuccagcugggaccacagccuuuagcuauaugggagcuucuuauucacagcagcccgccucccaaggccaggaguacacucaugccucacuggggccugcugaaaggcaccugagccaugguaaacuggagauccccugcuauuugcaguccuaggacacagugcugagcuagauuauguaaguauagcuggggguuauucaccaguguuucugcuugaacccaccucaccuguaacacucuguggaaccuuggcuggccucaaacucuagagauaugccggucugucuaccugguguuaagauugcagagguaugccaccaagcccagauuuacauguguucuuauauuaagggucuaggaacauuuaaaacucaucucgaaccacacggggagcacauucaaggcaagugcacauuuuaugguuuaggaauguuuauuccaccccugagcuaagcaguuacauccgaaaugucugcacagagccuucacaaccauggaugcaagguaaggcagcaagcccuccacuucaagcuggucaccugagugcugguuaucagucauuuccauuggagaacugugggaugcugcugucaccuccuguaauguccuguucccacaagugggccuggaaacggucacuccauugcuucugcaaccuccucaccagcacugucugaaagcucuucaacgggcucucuguccagcagacagcuucuugagacagacuucuugauggcuucccgcucuccuacagcaaaggaagauguccuagggcaucguccuccccgcugagccucagucccugcuuacgcuggccuggcauugcuuaccuucgucagugcaauucugcaacaagaucagcagcugucuccuguuguacuggaucaggaacuucugacagguucugaugguaccuggcacaugaaagagcuuuuguggacaauggcuugugaaacgguuaccgucuuccaggggguggguggugggaggaacaucuuguucucaguggauagaagcaagacccacccaccuggcaacugcucugaacaacagccaccauccacaccacccguaccucccacguguaauguguugaagaagcacggguaacgguggccuuuguucuccaaauaggugaugaaaggaagagcugaccacacgagcugguagaaauccuuccggcaucgcaguagcacgacuccaguguaggcauugagguaucggacuacaggaggaaggggaaauugggaaagaaauuaaaauucacagaauuauacagaaaaacccuaucguaggcaaacgucacaugggaggaugugcuggcauggaccaccccagccgggauaggggucccugggauguggguucucgaggucagguggcuaaggauucgguggugauaaacaaacagaggcagucugaaucugcguguauuuugcagcucuccgucaaggguuuuuauacuuagagaaauagguguuacagcucagcucggaaaaguuguguucagugaaacagcaaaauaggacagacauaacaaccaccugguacaucaaauacaaaaucauccaagucacaacuucaaagaaagguguucucaguaaaacauacgaaagucaucugaggcuggggcaaauucccaaaaacaugccaaugaauuuuuaugaucaguucccuguucuguagcucuuuaaacuguuuuaauuuuuccuauauaauacuuucuuaaacaagauaccaaaaccuauuucugaugacgcaggugcagccauauaaaauauuguugggaaaguuuauauuuauuaauacuaucuuacacaugauuuauaaagagaagugcugucuuuccuggagaugaggucauguuuagugacuccaucucaagggaugguuuuguagucauaauacucgcuuaagaucuugaccuaggcuaucaggaacaccucauauacaggaaaaggaauagaaaacauaaaacugauaaguagccaaaagaucuacgacucaauaauuuuucuccugugaagaguuccacagccuguuccaggaggucuccccuuuuugagaucaaacgccucagccuguggaauuugucacacagauccuuacuagaggugguguggcaaugcaccacacuaaagauuuguaaucgugugcuguuuugcuugcauguauuuacacauuugugccugguguuguccucuggaacuggaguuucagacuauuucagauaggaaucuuuccucucccaaagaccgcugagcccucucuccaucuccaccuaacauucuugaaaguggcuuuuuuguuuuguuuuugucugcuuuuagacaguccaguuaggacuuccuggcuggccuggaaccugccuuugcucccuggggacugcuaggauaaaagcaugggccgcagcacccagcuugaaaggaaacguuaagggaaaccuuccgcccucaagaagucgcugaccacucaggucaaugaauggagagagagcccagcuccaccguaauuaacauuaacgcugcagggggaaaaaaaauccuugccggggaaacgccuguuuuccuguagagcucagcgaaagcaagaaaacuuugugguuuuauguauguuugauucugcauaguucaagugugcuugcggaauuaggagcuaaacuaagaagcgacauucugagaaaaacaaagcuuccauccugcguuuccauaugagaauuacugucuagucuguucgagcucgcagccggguuuaaacuuugagggauacauuugacauuuuaaaacgugcuaacgugaccugucaaaucauggcucuuaggaauucuacauggcuacuuucauuuagccuagugaauucaacacccaucuuccacuaaaacgggcaguaaacggaaucccccaacucaacccaccccggcacacacaccgggggcuggguauugaacuuuuugccuugucccacugcgcgaucggcaccuucuguucaguuuucgacccgccgcacuccgauuuucuagaacccuccacuaucguacaaaacgcgacacacuggccgggccucgcccuggcaaagcgcgccccgcacugcauccgcagcgcccucguaccugcaaagcccacggagcaggcggcggcgccgaaggccccgugcacccgggcgaucgugucgcggaccagcccgcccagcacgcggucguccaggcucaaacggcagcgcgcguccucggacaccagcucgcacagaagguaccugcggcgacagcggggugagcgcggcccgggucgcggggacggcgcggggacagcgcugcuuaccugugcuugaaccgcaccauggcguccgcgccggaugcgggaggaaggcggcacuaggcucggacaggcagcgugcccugucaaucuccacgcuccgccucccgcggcgggcguaagagcgcaugcguucgccuccggccggcgcuggggauuuuccacacaaguucugugcgcucagagucccccaagugaacguuuaaggucagcccugcacuuaaaguccgagagugucgcacgaucugggaccuaaaagucagagcacagguuuucccauacagccaaauacgcgaauucuuugaggggauuucgacaguuuuguggaggggaguucuuuucaagugguuuccaaaaacaauauaguauccucccucccucucuuccugguuucuuuuuuuccucaagcuaaccccagacugacuguguagccaagacgaccccgaacuucugauccccugccuuuuccuacgaagcgcuggcauuaccaacgcgucccaccacacccagcccucuguuuucuguuaagaauagaggauuauguuuuaaaaugaagaacagaggguuaagguuuuuaaugcguuuuucuagcccauucccuugaauaccuuugugugauuaauaaaugauaaauuauuauuguuguuguuggguuuuugauacagcguuucuuucuguagcccgggcuguccuggaacucacucuguagaccaggcuggccuugaacucagaaauccgccugcuucugccucccgagugcugggauuaaaggccugcgccaccacugcccagcauuuaaaaaacaaacaaacaaaaaaaaaaaaaaaaaaaaaaaacagggucccacucuaucuaccuaaggcuagcuuggagcccaaagcaauccugccucagccuccuaaggacuaggacuacaggggugugcuacacuucauuuaucuugcauguuaagugcauauucuuuuuuaaaauuuauuauuauaucuaaguacacuauagcuuucuucagacacaccagaagagaacaucagaucucauuacagaugguugugagccaccacgugggauuugaacccaggaccuucagaagagccuucacuccagccccuaaguccauauuuuuuuaaagauuuauuuauuauuauauguaaguguagcugucuucagacaauccagaagauggagucagaucucauuacggaugguugugagccaccaugugguugcugggauuugaacuccggaccuucagaagagcagucaggugcuccuaccuacugagccaucucaccagcccuaagugcauauucuuaauggugugacucagugagguggauuugugugacugccacccuauuaagauguagauaagguucagugcuccccaaauucccaggcccuugccaaaaccuuuagugggaaggagccaucauccccauuucuggagagauagguuuugccaggccuuggccuggacauauauguuuuaagcaugcaacaugccuguaaguccgcugcuugacucuauuuuccugucgccggugcugcuacagacauuccucacgugcucgguauugcauguuuuaagugcaccacuaagucggucagcauugccuuaauacacauugucuacagauuuucuuguuauccuggguuucuuggugccuggcuuuguagcagggucauuuuugaaaauuagauuuauuuauuuguuguagaaauguggaggugcguauuugccacggccggagguggcgaucagaggacgacuuugggaaguugguucucaggaccuccguuauguguacagcugucauggccucgccuggccaggugugguaacguaaagcaagacuuauauuucacagcugacuauuuacaagauccgaaaucaguuuucagucuucucuuagccacagcuuuaggggaccacagaugucccuucgcagacugccauucacuauugcaaucaagaggcaaucaucguccacagccagcggccgguagggggugccagaggcccacuguguagcucgccacacuccccacucucuaaaaauagcaccagugccuuuauccuaacccugagaccauuuuauagaugcgguccgggcccaggcccagaauuuaaccuugaaagcauuggucuccaaacucccugcucggauccacuccgaugcucacugcccaccugcuguaacguagccacaggcguggguucggaucccc

SEQ ID NO: 2621 - RNA, 3889 nt, Mus musculus
auugggagaaacuccauacaccaucaaaccaauuuuauuucuauagcaacauguucucacaucugaacccgaaaauacaagucaccagcuccugacagcaaacaaagccugaucaaguuagacucucaguguccagccacgcggucucgcguggcacuggggacugcuacuggagacuuagcaauuacagucugauggccaaaacuagucaggucacaaggaggaagagggacuccauucaugcaaacaguuuuaccuguucaaaauagacaaacuuaacugcccuaucuguggucacaugacuccaaguaccccauuguuucugcagauaguaggagaggcaugucuacugucacaaaacgguaaaacaaucaggaggggugcccaucugcaaucccaguacuuggcagggacaaaggaacauuuaagguugccaggcagugguggcgcauaccuuuaaucccagcacucgggaggcagaggcagguggauuucugaguucgaggcuagccuggucuacagagugaguuccaggacagccagggcuacacagagaaacccugccucaaaacaaaaacaaaaaggaacacuaagguuaucccuaaccaugacauaguuugaggccaggacuggauuuccuaagacacuuucacaaagaaacaggcuugcaagauggcuuauggaauagacuugcugcugagucuuagaaucuacacaguagagaaucacugacugcgcacacaccaacagcaaagucucacacuccugguccugacagaacacaaugucugaccaaguucagcuuacaaagcuguccugaggcucuccguaagaagcauagugaagugugggcuggcugccugggccucuaccugcaggagucuccuaugcaggccucuccuuggguuacaguagcuccaacugacaacggggcaacuuggugacuccgggcccauagcuuucauuagguccccaagugaagcugugacucacauguacugaugauuucugagcacagccagugaaagcagcagccuagcaaaugaacucuuguggucgguccgcuaauccagggccgccuagaaccugcucuacuccuuccuuagcuucccaagugcuaggcugacaggaacagggccucagaccuguggcuaauaauccaaaucaucuggaaagacagguguggccugccagacauuccaucaagagaacuaaacuaauccuacagaacaggaacaccucagacaacagaccaagucacuuaccaacugcuaagccucaucaacccuaucuugaacaaacuagcagagacauacaucuccaacagauuuauuuuuaaaggaaugaccuaagggagaaaaaaauggggguacagaaguauggacuagaaaauaaauacaaauguaagcuguuuuacuaauuuuauaaccacagacuuguacagagaaugaagcccuguacacaacacaacagauucaaacgagguguucccuuagcaaggcugaagauucagucucugguauuuggaauuuggaugcaguccuuguuuuuggauggaucacuggguguuuggcacaguccaugcuuuuaaccagauuugaacagaagaauggccaccugacccagguagaaguagaugaaguguuugguuucaugugucacauaacuaccgaaguuucggcccacaaugcagugccagguaggguuguacuucuugucaaacuccuaggaagaagaaacagaaauuuagugguacaccuggaggauucacuuuccagagccuguaggaccagaaagggcaauccuggcaucuguaauugucuccacacugggacugaauccagggcaugggcaugcaggcaagcgcucaccacagccccagcaaauucuuaagagaauguucccuggcuuuaaaucaucuaccuaaugcaacgugcuugcagucugagguaaacugagaaugggagcuaagaagaucaaagguagaaggucauuuucaaggacaguucuguuucaaugagggcacuucuggacuacuuugauuuuuuuguuuuguuuuguuuucuaaagacagggucucucuguaguccugaccgcacuagaacugguuuggucucaaaaaucaaagagaucugccugccucugccuuccuagugcugggggguuaaaagacccaucaucugcaccucaccucugacuccagcaauucgauggagguagaugacaucagcauuugcaguucaucaggcuccaccacuguauuugccaugcaccccaaaucaggaagacaaccaccacccccccccccaaagaccaaaggacaaagucucaauuaccacauaaaucaagccaggcugaaaaaugcaacagaaccugacaguuaaaugccaggacuuuaucuuuuaaaaucgcucuccuccacaucuacccagucuuaaaaauuagcaaguuagagagcaucugcuaccugauucucccaucccauggacauuaaaacuagcaauguguucauuucuucacuaguuggauagaaccagggccagagaugauguaaaauucuuuagggcuccuacuaucuuaucgggcaaucgguaugaaaaccucauuuauuaagcagaaugucucucuuacaauccagacgcacauacugcugcauuugucaaaaaaagauauucaagccgggcguggucucgcacgccuuuagucccagcacuugggaggcagaggcaggcggauuucugaguucgaggccagccuggucuacaaagugaguuccaggacagccagggcuacacagagaaaccaaaaaaaaaaaaaaaguauucauuuuuguuccaugugagucuuucauccucccguucuccacuggaacccucccacggcuucggcuuccaguuuccuuccagcaaacauagcuugagaaguuggcagucuugcgccagcuuucuacaaaacugccauuuaccaagccuccacccaagccccccaaaccaccacugccacccacuuucccugaacugucgacuaacucccgacuagaaggcuggcaagaucuccuccuagcccggcuggaaacacccacgcaggcaggcgcaaccccccccccucccggaacacccagauggauccucggcgcaggaauucuacagcagggggaacugcucgcaacucccugaucuuggaaaccguugcuagguggcgcuuucccccaaggagcuggggguuuaaaaaaaaaaaaaaaacuucuggcguugagggucuggucuuccccagaggaacgcgaaacccuugcguccuuucuagaacuauccaucccgagccgcccugagugcuacagggaaacugccaggcgcccagaggacgcagaaucggggaguaggaacuacgcggcgccggguccucaccuucuugauaugggccgcaauauccuucucgauguuguacuucuccaacgccuggguagcgcacuccaccgaguccuguugcaucucuuccgacaugucugcauuuuugaucaccgccuuccggucgcacaugguuaccuguguggugacgaagcgcagggaagagggagaggggucgggugcgggccgcgcucgcugcccucccgaccggcgccccccuugaggacgacgcccccacccgcuuccgaggggcagcucccgagguccgcaccgcaggcccgagguaggggggacggggaggacccgagcccggucucaccguggagcagaggccagccggcugcugcgagcuccuagggaaggugcgggcgccgcucaagcagcagaagacagccggucgcuaccgaagccguggcgcaucuaagcugccccacgccagccgccgccgccuaaucccuaggccccgcccugcgcccgcggccccg

SEQ ID NO: 2622 - RNA, 3889 nt, Mus musculus
cggggccgcgggcgcagggcggggccuagggauuaggcggcggcggcuggcguggggcagcuuagaugcgccacggcuucgguagcgaccggcugucuucugcugcuugagcggcgcccgcaccuucccuaggagcucgcagcagccggcuggccucugcuccacggugagaccgggcucggguccuccccguccccccuaccucgggccugcggugcggaccucgggagcugccccucggaagcgggugggggcgucguccucaaggggggcgccggucgggagggcagcgagcgcggcccgcacccgaccccucucccucuucccugcgcuucgucaccacacagguaaccaugugcgaccggaaggcggugaucaaaaaugcagacaugucggaagagaugcaacaggacucgguggagugcgcuacccaggcguuggagaaguacaacaucgagaaggauauugcggcccauaucaagaaggugaggacccggcgccgcguaguuccuacuccccgauucugcguccucugggcgccuggcaguuucccuguagcacucagggcggcucgggauggauaguucuagaaaggacgcaaggguuucgcguuccucuggggaagaccagacccucaacgccagaaguuuuuuuuuuuuuuuuaaacccccagcuccuugggggaaagcgccaccuagcaacgguuuccaagaucagggaguugcgagcaguucccccugcuguagaauuccugcgccgaggauccaucuggguguuccgggagggggggggguugcgccugccugcguggguguuuccagccgggcuaggaggagaucuugccagccuucuagucgggaguuagucgacaguucagggaaaguggguggcaguggugguuuggggggcuuggguggaggcuugguaaauggcaguuuuguagaaagcuggcgcaagacugccaacuucucaagcuauguuugcuggaaggaaacuggaagccgaagccgugggaggguuccaguggagaacgggaggaugaaagacucacauggaacaaaaaugaauacuuuuuuuuuuuuuuugguuucucuguguagcccuggcuguccuggaacucacuuuguagaccaggcuggccucgaacucagaaauccgccugccucugccucccaagugcugggacuaaaggcgugcgagaccacgcccggcuugaauaucuuuuuuugacaaaugcagcaguaugugcgucuggauuguaagagagacauucugcuuaauaaaugagguuuucauaccgauugcccgauaagauaguaggagcccuaaagaauuuuacaucaucucuggcccugguucuauccaacuagugaagaaaugaacacauugcuaguuuuaauguccaugggaugggagaaucagguagcagaugcucucuaacuugcuaauuuuuaagacuggguagauguggaggagagcgauuuuaaaagauaaaguccuggcauuuaacugucagguucuguugcauuuuucagccuggcuugauuuaugugguaauugagacuuuguccuuuggucuuuggggggggggguggugguugucuuccugauuuggggugcauggcaaauacagugguggagccugaugaacugcaaaugcugaugucaucuaccuccaucgaauugcuggagucagaggugaggugcagaugaugggucuuuuaaccccccagcacuaggaaggcagaggcaggcagaucucuuugauuuuugagaccaaaccaguucuagugcggucaggacuacagagagacccugucuuuagaaaacaaaacaaaacaaaaaaaucaaaguaguccagaagugcccucauugaaacagaacuguccuugaaaaugaccuucuaccuuugaucuucuuagcucccauucucaguuuaccucagacugcaagcacguugcauuagguagaugauuuaaagccagggaacauucucuuaagaauuugcuggggcuguggugagcgcuugccugcaugcccaugcccuggauucagucccaguguggagacaauuacagaugccaggauugcccuuucugguccuacaggcucuggaaagugaauccuccagguguaccacuaaauuucuguuucuucuuccuaggaguuugacaagaaguacaacccuaccuggcacugcauugugggccgaaacuucgguaguuaugugacacaugaaaccaaacacuucaucuacuucuaccugggucagguggccauucuucuguucaaaucugguuaaaagcauggacugugccaaacacccagugauccauccaaaaacaaggacugcauccaaauuccaaauaccagagacugaaucuucagccuugcuaagggaacaccucguuugaaucuguuguguuguguacagggcuucauucucuguacaagucugugguuauaaaauuaguaaaacagcuuacauuuguauuuauuuucuaguccauacuucuguacccccauuuuuuucucccuuaggucauuccuuuaaaaauaaaucuguuggagauguaugucucugcuaguuuguucaagauaggguugaugaggcuuagcaguugguaagugacuuggucuguugucugagguguuccuguucuguaggauuaguuuaguucucuugauggaaugucuggcaggccacaccugucuuuccagaugauuuggauuauuagccacaggucugaggcccuguuccugucagccuagcacuugggaagcuaaggaaggaguagagcagguucuaggcggcccuggauuagcggaccgaccacaagaguucauuugcuaggcugcugcuuucacuggcugugcucagaaaucaucaguacaugugagucacagcuucacuuggggaccuaaugaaagcuaugggcccggagucaccaaguugccccguugucaguuggagcuacuguaacccaaggagaggccugcauaggagacuccugcagguagaggcccaggcagccagcccacacuucacuaugcuucuuacggagagccucaggacagcuuuguaagcugaacuuggucagacauuguguucugucaggaccaggagugugagacuuugcuguuggugugugcgcagucagugauucucuacuguguagauucuaagacucagcagcaagucuauuccauaagccaucuugcaagccuguuucuuugugaaagugucuuaggaaauccaguccuggccucaaacuaugucaugguuagggauaaccuuaguguuccuuuuuguuuuuguuuugaggcaggguuucucuguguagcccuggcuguccuggaacucacucuguagaccaggcuagccucgaacucagaaauccaccugccucugccucccgagugcugggauuaaagguaugcgccaccacugccuggcaaccuuaaauguuccuuugucccugccaaguacugggauugcagaugggcaccccuccugauuguuuuaccguuuugugacaguagacaugccucuccuacuaucugcagaaacaaugggguacuuggagucaugugaccacagauagggcaguuaaguuugucuauuuugaacagguaaaacuguuugcaugaauggagucccucuuccuccuugugaccugacuaguuuuggccaucagacuguaauugcuaagucuccaguagcaguccccagugccacgcgagaccgcguggcuggacacugagagucuaacuugaucaggcuuuguuugcugucaggagcuggugacuuguauuuucggguucagaugugagaacauguugcuauagaaauaaaauugguuugaugguguauggaguuucucccaau

SEQ ID NO: 2623 - RNA, 2347 nt, Mus musculus
ugacgacaucagaaugcgucgccgucaccgcagcugccaucaccgccaugaacagcgucggggaggcuugcacugacaugaagcgcgaguacgaccagugcuucaaccgcugguuugcugagaaguuccucaaaggggacggcuccggggacccgugcaccgaccucuucaaacgcuaccagcagugcgugcaggugagucucgcccggccucgccgcagcagccugcccuccucggccaucccccgaaaccgccaggcugucuccacuugacacaccgggaugccuuugcgguacuuugcuuuauacagaguacauuaguauuuuguuguuauugcucauuuauuugggauucauuccaaacgugcaaguagcuaucauccguaucuuuaaaaaauuggcguggccgggcggagguggcgcacaccuuuaauguccuagcgcacgggaggcaggggcaggcggaucucugagcucggggccagccuggucuacagagugaguuccaggacagccagggauauacagaaaaacccggucuccagaaaaaaaaaaaaaaauguguucgcgucugcaauaaggguggagacaacuuccgggagucagauuacuccuuucacauuuauauggguucugggaauaaaguucaggucacuagucuuggugacaaggcguucuauuaucuaucuaucuaucuaucuauuuuuuucuauuaucuauauuuuacacauggaaaaacuagcagucagaaauaggaagugaaugguucaaaggaacuagagucugaugaccuugcuuauuuugguggugcgucauuucauuguuauuaggaguggaugguguucacaguuuucuagaccuaagguaaggcauugcagaggucgccuguuuuguugcgaucuuuucauugcucuguuuuccuccgccaauuaccuguuguagccaguaagauuugauuucagaccagcacuucaaacuuaaccuaaaacuaccucuccauuccagaagcuaccuuuagucaguucucagacagggaugguaacucaaggucacagagccgauucggagugaacacugucacuaagauagagauaggcaccugaacugaccuucaggccucaccucccaagagcagguguucauaccacacaggacuuacauuacagucuguacaguggcacuguuuuguuaaaacaggacuaagccguacucacuuuuaauccuaggauucagaggcaggcagggugugugggucccagaauagccaggguuacagaaugagaccuugccucaaaaaaagggugcccagcugggcagugguggugcaugccuugaaugguggguuucaagcccguccaguucagucugguuuaccucuguaccauuacaccugucacaaaacauggacugcaagcuaucauggacugauagugcauuuucuuccuccuuuagaaagcaaucaaggagaaagagauuccuauugaaggccuggaguucaugggccauggcaaagaaaagccugaaaacuccucuugaccugccugccacuuggaagacaucaguaaagugagaggcuucuggauucugucagggaaggcugugaagcuggcaugggauuccaagauguuaaagguguucuccuccauucugaagcugucauuccugcuuugaggcaacuucaccuuugcuggcauccugaagaaccccucgugccacagcggaccagcuucuugggguuaugguugcaaacuauggucuggcaucagcuuuaacugguccuuggauaugaguaugguaaacuggucaggauuaaggauggcagcauuugcugcggaggaccugggugaacuaugggaggcauugcucauggggcucggucgggaccucuuuuuccucucagggaugcucugaaaagggaugcggacacaacccauucaaucacugcuuggaaacaugauuguaguuuuauaauaacacuuccaacugcugguggccuggguuauggaaaaagacagcuuugcggagcucuugccuuaaugaggugucagcuuaccauucagaaucuucagaaaugacauaaacaccaacuuuggagcucacaagccuugcugcucacagcuccaaccccugggguggccgugcaagagucaccugcgucccagguuugcuguggcuaacuuucaacuccacgaguucaagucagugugcagaucacauaaaaggggggugcgccuggcuaagugggggaaaggugcuuacugauuuuuguuugcuuaccaugcccuaaggcuguaaucaugaaaugaaauaaaucuuaaaauucaaacuuuacucuuugcucccaaaac

SEQ ID NO: 2624 - RNA, 3361 nt, Mus musculus
cauuuccgcuuccggcgcgccgguguaguuccaugauggcgucggcggugcugucagcgucucgggucucucggccgcugggccgggcccuccccggguugaggcggcccaugucgaguggcgcccacggcgaggaggguucagguacccgggggcucucggaugggcguggggucucggcggguggcgugcggcggcguggcggggccggagcccggggcggugaccuuggcgggagggagcggccgaggcugacguuguggcccccgccgcagcucggauguggaaggcccucaccuacuucguggcgcugcccggggugggagugagcaugcucaacguguuccucaagucgcggcacgaagagcacgagagacccccguucguugccuacccucaccugcgcaucaggaccaagguaggcgcugcgccuuuacuguccgucuguccguccguccuccaggcauccguuauugcgggguuguccacuccccuggcccagcccuugggggaguuuuaggaucuuggcugccuguccguccgugcagauagaauauuuuauuuacucuucguuugacggaagggaagccaguuuguaggucguggcucgguuuucuuaaaaggccacccaguaaaugccugcgggcuuucagcuccuccaacuugucaccuuuuguccaauggugcacuuuauuagcuuccugcgggaaaguuuggagguuuggggugucccuuuauagccgcaaauccugaaggugauccgggauccgggcgauuggcguaggcuuaagcacagacugcccguugguucucacagugccugucguuuuaucaguucuuugccuuggcuguucguguagaaacccugucucgaaaaaccaaaaaaaaaaaaaaaaaaaaaaaaaagacaguuauaaugucucaugauguauuuuaacaagcccgucuuccacuguaucaccuaauucaccuaagacuggccuugcagaaacuuauucuagacuucaauuuuacaacccagaaggcuccaugccguucccguacagccucagcacuugagaggccaaagagagccaaugucuuguucaaggccagucuggucuacaaagugagcuccaggacagccaggggggagacuuucucagaaaaagaaaagguguuugacagcagccuugccuuggggcucugcccacuagguggcaguagcaccccccuccuaaggccucuagauaaugcucccauaucccgccccuggcacuuggggucagaaaacaagcguuuucucaguaguagcuaucaggaaguuucuaucaguaguaguugcugguuauucucugccacguuaugaaauggagauuagcuugggcuaaaugggguuaccacagaaagccaaaaaugguugugagcuauugaccaagagcaaugcuuuucaaacauggaggggaagggacaggagagagggcucagugguguagagugcugcugcucuuacagaagagccuaguuuccaguggguggcucacaacauucuuuagccccagcugcaggcagggaugauaucuuuggucucuguguacaccuacacucgugcauauacccacagagauguacacagaauaauauucaugcuggcagaggcagguggucaacauagcacauucuaggacauccagggcuacauaaagagacccgucucaaaaucagacaaaacuaugauuggcagagucauacaugcuguaaccccagcacugcaggcagaggcaagaggagcguuguaaguuuuugauuagacuguucuauuuaguguuccagguuagcuagauaaggaaacccuguuucagcaaccuugccaagucugccagugagggcuagucucuugggauccacucuauaggaggacagaacuucuucuuuuguuuuuuugguuuuuuuuuuuuuuugcggggggggggggguugguuuuguuuuguuuuguuuuuugaaacgggguuucucuguguagccccggcuguccuggaacucacucuguagaccaggcuggccucgaacucagaaauuugccugccucugccucccaagugcugggauuaaaggcgugugccaccacugccuggcugagauuuauuuuuaugagugcacuguagcugucuucagacacacaggaagagggcaucagaucccaucacagaugguugugagccaccaugugguugaugggaauugaacucaggaccuuuggaagagcagucagugcucuuagcugcugagucaucucucuagccugaguuagucuuuuuuuaaaaagguagugagcaaaaggauugaauuuaggucgcaguuuucuaguccuucugcaaccucuguucuucuaggagcucuggaauagcagucagugugugugcacacgcauaugugcacgugagugcagguguuugugucacaguugugagucaccucaucugaaguuugggagaauuuugaaggaacagaucuuauccacugagccaccuuuccaacaucuuauguuaagauuuauuuucuuuuaaauuauuugugugugugugcacaugagaagagggcuucagauccccuagagcuggaguaguagcagaugugagcugccagccguggaugggugauagucacgugcagaacaacagaugcucuuaccugcugagccauccccuuccucggggagcuaccuugcgcuugcuugucuuaccaucuacuucgaaggagagauggcucagugguguuagagcacuggcugcuucuccagggguccugaguucaauucccagcaaccacauggcagcucauaaccaucuguaaugggaucugaauccuucuuuugugaagacagaguacuuauacauaauuacagaaauaaauuaaaguuacauuaaaaaaaauaagaaaaagcucugggaaaguugacauuuuuaugucaguaaaucuaugccaguaaaggcacauuuccauuuugauuuuauguauuaccucuuucgauucugagcauuuucuggaaauaacuaauugacaucuucgcuccgcagcccuuccccuggggagacgguaaccauacccucuuccacaacccucaugugaacccacuuccgaccggcuaugaagaugaguaaagagaaccuggccucccccaggcaacaaagggaccacagcacugguuuuggacccuuacucuguguggaccacgaaaacccuuuggaugcuaagcucgugucuccuuuccucagauggcgaccauuacucugaucuuccaucccuucugcuuguaagaggagaugccuuaaauaaauaacuuaaacucagaugguccgugagcuggacgguacgauuuuau

SEQ ID NO: 2625 - RNA, 1911 nt, Mus musculus
cacuugcucagcauggguggaguccuggguuuaccucagcauuaaaaagcaaacagaaaaaccccugggucagugagaugggucggcagguaaagaugcuugcugccaagccuuaaggccaaaguucaaucccuaagaccuaaggguaggaagagaacagauuccugcaaguuguucucucugucucucucugucugucucuccauccauccauccauccauccauccauccauccauccaucuauggcugacacuagaccaccagcccauucauucaacacaacuacucccggacgggacccuuauuuuacagaccaagagacagaagcaccgaggagcaaauguaccccuauugcucuggcuggccaguugugaugguuuacaucuguagcaucuguccuuuggggacagagacaggaggaucauuaauuugaggccagacuggguuaccuagugaggccucuugucaaacaacaacacacaaaugucagauugacagcaagugggugagcugaggaugucauguggaaaaaaaaauacacuuucuauauaguuauggcuagccugaaacuuauuacguagaucgggcuggccuuggguucaaagaguccugcuucugccccugagagccggggugugugacacauuuuuuguuuuguuuuuuuuuuuuagacaagggaucucacuauauacccuuggcugaccuagaacucacagacaucccaccugccugcacuuccuuagugcuguucuguuuuuuauaguuuuugagacauggucucauguagcacaggcuagccucuuguuuaaaauuuaauacguuucaugugugugugugugugcacaugcgugugugcauacacauauauguagaaguaauuucaaaaauuacuucucuccugcuuuguggguccagagaugacucagaguuuaucuuuggccauggcgagaggcacccuuaugcacugagcugcaccucuggcccucaggcuggcuggccucuuauccacucugucccugagggugaccuuggagugcuccuccuucucacaguggagcaguggcauuccagggaugugccaccauaccuggcuucagcauccuuucuggaaucaugaaaauguccugaaauugauuaaggugauguuucaaaacucuaggagucuauuuuaagaagugaaguagguggaucggaugguaugggaauuacagugcagugaugauguugccaaaaaaaggucguuuuaacuuagggugacccuuucucuaauccagugccuaucaacagaauggaugcgcggcacccuuaccacgauacacuuuuuuucuucauuauuaucugaaugugacuagaacuugcucaccugcgagacacuguacuaagcaccucccaggauuuuccaguuugguccuccuggcaaaucuauuuuuuauuuuacugaacaggaaaacauauaaugcaaacagccauauaauaaaugacgacgucucaaugccaggauguccugggccauuacaaguugccaagcccugggcugacaccuggaccaccagcccguucauucaacgcugacaacuacuccgggaugggacccuuauuuuacagaccaagagacacaagcaccgaggagcaaauguacccuuauagcucuggcuggacaguugugaugguuuacaucuguagcguccguccuuugggggcagagacaggaggauuauuaauuugaagccagacuggguuaccuagugagaccucaugucaaacaacaacacacaaaugucagauugaccgcaagugggugagcugaggaugucagacauauucaugaugucauuauuucuaucauaaaccacuauaccauguuacccaccucuuuaaagaacacacaauaaaccuauuaauuauagau

SEQ ID NO: 2626 - RNA, 688 nt, Mus musculus
ggguuuucucuuccggucuccggcgcugcgggagccgcggguuaccgugcagacauggccaaguccaagaaccacaccacacacaaccagucccgcaaauggcacagaaauggcaucaagaaaccacggucgcaaagauacgaaucucuuaaggggguugaccccaaguuccugaggaacaugcgcuuugccaagaagcacaacaagaaaggccugaagaagaugcaggccaacaaugcaaaggcagugagugcgcgcgcagaggccaucaaggcccuggugaagccucaggccaucaagcccaagaugccaaaaggccccaaacucaagcggcuggcuuucaucgcucacccuaagcuugggaagcggauucgaagcuacauggccaagggucagaggcucugccaaccgaagccuaagguccaaaccaaggcaggggccaaagcuccagcuaaggcccaggcuucagcuccagcccaggcucccaaaggugcucaggcccccaaaggugcccaggccccugugaaggccccauagaaaugacuccugccagugugaagacagacggacugcugugacacaccuccccacacacuauuugcagaugaccaguguccuaugcuguucuuacaaauaaacucaggcaagaucuguuaaaaaaaaaaaaaaaauuuaaaaagggucagag

SEQ ID NO: 2627 - RNA, 2184 nt, Mus musculus
uguuuuuuuuuuuuuuuuuuuuuuuuuuuuuuugagaccacugcuuuauuucauuauuguucaacaacagagccaucccucucagguggaucuggaauugcccaugugugcccauguguucuccucguucuuaauaaaaaaagguaaugaagaaaagccuguaauuuuuggagaccuagaaucuuauugaugcuaauagaagcuuuugacugcgauuucggguuacgauuauuuccugcuggcgucccgguggucacacagaagaguuccccacuccggcggagacggcuguccgcggcuaccaccguugaaaacaaaaguauugaaaaaugcaccuuuuacaauaaaaaaguagaaaccaauucaauuuccuuuuuuuuuuuuuuacgaauauaaaguuucuuguaaauauguacagucuguugagcuagcucuauguagcaggaagcacuucacagaugagacacgcaauauacacuugucagggcucaaggaacccguuucucguggagguccuaagugagaugccaagacugaagaccaguuaucagugaccauuccaaauacuuguggaccaagagacaaaaaacuucagcaaacagccagucagaucugcccuggggguggggguggcggugggggcagggggggggauagggaacaugacccccaaagacuccaagcaacacagaaaacacaacagcagggcacgggauguggagggucacaggcgucucaaacaagaaagcacuuaggucagagacagagcaggaaggagucugcauuuaggccagguuguaaucugggaagcgacguggacuguggacggacgugugggcugaaaacacagacacggucaccugcugcggugguggggacaggucuaccuuucagccuaccuagggugugccuucgugguggaggcacgccuaagagucgaggagaauccaaagcaggagaggccuugugggagauuaaaggcaaagauaaggccuauaguuagcuugccaacuguaaagccucuaguugguugguucuauccgguugccaggaauucugggcucuaaagagggcggagccggggugagccgcacugcaccuaaggggaacucgccagccucaaggggcugggagcuuugagcugcggcuucucuccaauguccuggccuuagguccagcccuagggagaggcucaucugggaagucacaguuucagugggguagaaccgugcuggguuuugugugagcacacagucguccuugaagucagcagggaacuggaaggcaggagggaaacggagggacggaggagugugguuugcugaaauccuucucuggucguaaggcuugagcguuuuuuuuuuuguuguuuuguuuuuguuuguuuguuuuuguuugcuuuuucagugcuacagauugcagccuguuguggccgguuuguugacaggucaucgggagggucuugauuugguggggcuaugggauggcagcaguacaucggcagagcaacccagggaggagucaggcaggucgggguaguggggcagcacaugcagcuaucugccaugcagagcucccagucgggucuccuccucaucccagagaagugacccucggacaggaaguggugccccaggucccaggcccaaccccaaggccuaugaaugcuaggcuuggagcaagucuauugcacgcuuuccuggccaaagcuacgcagaaagcuggagaagcaggcuggguagaugaggcugaggggugggugggggaggagagcuugaggucccuuggccccaggucacugccucugagcagaggcccgacugacccuccauacauucucagcuggugggaagggaagucgucaaggccuuaaaaaggcaaugagaacgguaaacauuuggcuacgaugucacccuggguaagacagggccaucuaugagaauggacugggacaaggaugacugaagcuacauggacacgggagguuagccaacgggcagggggugcucuucuagccuacauuucauuggcaaagaccugauggugugaucuagcuaaaaaccacuacaacaggaaauacaucgcuauccaagucuacuaagaauucuguugucuuaaaaaaaaaaaaaaaaaaaaaaagaggaggaaaaagaaauaaaaaccaaagggggaaaaaaaaaaaac

SEQ ID NO: 2628 - RNA, 10925 nt, Mus musculus
cauccccagugaccacccuuccuuccuuccuucgcugggcccggccggaagcggaaguggcuaagggguggaggggaguugcgggaggagugucagguuacgcuccggcucuguucggaguuccagucgcggucgcccgagccagguaaagcggagcucggcgggcgagcgagcgcgcgauccgagagggcgugacucgcgauccccggggguccgacccggccuuuccggcuuccuugugucccugcagauucccagccaugggcaacacgagcagcgagcgcgccgcgcuggagcggcaggcgggccacaagacgccgcggagggacagcuccgggggcgccaaggauggggacaggcccaagauccucauggacagcccugaagacgccgacaucuuccacuccgaagagaucaaggugcugaguggaggggcgucggagcccucuugacucacggggagggucccccuuugcuguaguucccgccacauucccagcgucacaccuugggggggggcgggggagguggcucugucauagcccucuuugccguucugggacuugugccuaauuaccgaugggaggagagucacccugggcuugguugaacaucauuaaggagaaagcagcucagggaccgcguuugagauccuuaauuaauuaagagucgagcuaaacuguaauugagcacccgugucgacuuuucucuucgguguaauugauugcgcggcuuggagacacuucaggccgaccggcuuuugcaaaaguuggguugggaguucuaguguucuuuuuggcgguaaaacgggagcacauacguuaagcuggaaaugaaguugacuagcugacugccagagguguuugguucugacaguuucaguccacccugcucacuuuauuuuagauccggcaauuccacuggaggaggucagugaccgagagucacucugaacgccagccagcagcuaauuacccccacuucucucccacguuacugaaauaaugccuuggacuuuaagcagaccagagcaaacagauuuuugcaggccaagcugaaaguuccugccugagccacauucucuuaaaaccacagugagguggccagugcuuccggcuacagggccccaguccaagggcauuuggugauucuaggaggaaagaagcuaauugcucagaauaaacuacauucaggaacguuggcgcucaccagccuggucucuguuacuugccggguugccaacuaauccccauuacuuaaacaggcuaauugccuggccagcucacuccgcuuucacucccccacccccacccccuaacugggcuacauaacccacauuacuauucuccagaucuuaauuuugggucugacuuuaaaagagccugcuuuugccagggagugguggcacagcacuuugaucccagcacuugggaggcagaggcaggcagaugucugaguucgaggccaaccuggucaacagagugaguuccaggacagccagggcuacacagaacacuugucuuguggcaggagcuuguuuucugagcuuguugcauuaggggaaagguguguaccucgaucuuuagcguguuucccgguugagauuguccccaccccuagaagacauuuuugcccaaggcuauuuaagaggaaguaaaagguauuuguguuguagccuguguauauuggcagugcccucugcucucuuugcagugaacugaguaaacuuacuuuuuaaaaagaaaugggcgauguggugcuguucucuucagggucagggaggaaggacuuagcugacguccuuucucuuuucaucuguaguggcugauggaucgagucagggguucuuccuguuaccccaguucagcacuggagcuacaguuacuuguccucuaaagcgguggcucucaacccgugggccgccacccucuuggaagccaacagacccuucacaggggucggcaccccagacccugcaugucggauauuuguauuauuacgauucggaaccguagcaaaguuacagauacgaaguugcaaccaaaucgucuuaugguugggggucaccacaacauaggggaccguauuaaaggggcgcagcguuaggaagggugagagccccacagcucucaagcaaacccugcuaguuauccaaucuguacgguucagauccagggacuugcugguaucucucagauaacagcagaucaguaucuggaguggaagucacagaagccuccagggcuccuucagggcuuucuccacccuagaaguccgguguuuggcuucgauucugacugaagaagagaaaugaugcuuaucuaacugugucucaccccagggugggguguguuccuuugucucuagcuggaguaaguuccucugauauaccucaguggauauuaccauuugccauuuguaucuaguucucuguaccccagcccuucccuucccaucugauuguguccauuuuaacagcuccgagaccaucccuaguaaauucuuacauacucucaagucuugcuuaaugagggaaguggagcauauugaacccacccuggacucauggcugucuucucccgaguaggccuugcagcuuccuccagaguuugugaagucugguugcaguaauaguagcugcugguuaagcacugcaugugucagacugucucagucgucacgauaugacagaagcuguuguccuuauuaucuccauuggcaggugggggaacagacgcagucaugugccgcagacacaagcagagcugccugauuagacucugcuguccucuuagguuaacagucucggguggggagcucgcugccagcugccugaccccaaguaaacgccucugcuucuuaggcuccagagaaagaggaauuccuggccuggcagcacgaccuggaagcgaaugauaaagcccccgcccaggcccggcccaccguguuucgauggacaggggguggaaaggaagucuacuugucuggguccuucaacaacuggagcaagcuuccccucacgagaagguaaggaucucggcggacgauauuucugugcuaugcucugacauuuagauauacauuucuucugagaaaguuguucccggugcauuggagagaacgcugggcugggacccuuagggguguggaucccagcccauuacugcauggaacggucacuucuguaucggacuccuggaccaggugaccuggaucccuucuaacugaguccuguguguuauuuuuuggaagguuggaaguuccaugcucugaagacaucauuagcaaggguucagugagacgauuuaucaaaacccugauguggcugggcagugguggcgcacgccuuuaaucccagcacucgggaggcagaggcaggcggauuucugaguucgaggccagccuggucuacaaagugaguuccaggacagccagggcuacacagagaaacccugucucgaaaaaaacaaaaacaaaaaacaaaaaaaacaaagcaaaacaaaaaaacccuaguguggacuccugucaucgcgccuuuaccagugacuacuucugguaaacagagggagagcccgugcccugcuggucugagcccaacuguugucagugucccuguguuuccagggcugcuacaaguccacagcaaucucaggaguggcgggguaguuagacaggucuguguggagaacgucuaugugcccuguuacgcuggcucagucccugucauggcacacugacaaaagggauggcucggcagccuauguuuaccuccguggcacccagcccgccugcccgcccggugguauucugcguggagacuuggaagguaugaacagccauuuguugaccuuccaguguuaggauucuagguuccuagugucugagcaaagugaguuuccugcugcuccauuaguggccgugaccaagaauuaauugucugaauugguugccauguuugccauccugcagccaaacucuugguuauaccuggagucagagggcagcccacccagcugaaauucuacuuccuuucuuccugcagccagaauaacuuuguagccauccuggaccugccugaaggagagcaucaguacaaguucuucguggauggacaguggacccaugauccuucugagguacuuugccugcagcccuuggcccucuaguaccuaccugcacaaccagcacccaucaccucccuuguggcgugcuaucaggacccucuucccugcguguggcucugaguuagauagcgccaguuaccagcucauugguauaauuaaccaagagucgcuaaccaggcagugaggccuuccagccaggaauucuaguccucugaagaauccacagaccuuccacguuaugauuucugccuaucugucucuucccagccaauaguaaccagccagcuuggcacaguuaacaacaucauucaagugaagaaaacugacuuugaaguauuugaugcuuuaaugguggauucccaaaagugcuccgaugugucugguaugaacaguuacuuuaucccacgugugugcaggcuggggcucuguggccuggacauacucuguuucccucgccucucacacuugagcaaaagcugcccagccagguggacaguuguagcucuccggaccacagcaguuccuuccuaauuccaguggcccuggcuguuggaguuuaacccccaaagaaaccauaagucacugcccuugccuuaugggauauuuugcaguuccacuuggcuuuagaacagagcuacacuugauguuaugccauaggcaggccugaagagacccacgaggacacguugggucaguagugaaccacugccagggaaacugccagcucguguccugccaguggugccuggagaauugcaggcugacaggugauaaacgccaccucggugaccuuggcugucacuggugccguccauucacacuugacuggaagugacuccccauagaaaacaggccacauggcacaacgcucuuuucuggaaaccuguugugcucagucacgguaaacuagaguccucuaagcacggagcuuucggugaccuuuguuccgaccacaucugggaggaagagaaucccuggaaggucagagggacagcucaggagagaaacuguguguuagaauccagauggacguuaggugugcuucccuucuuugugugugggcugcuuccugggcagcaguucugggaaucaguaagauaagcucucagcaguagccagcuaucaguuuaccgagggcuuucccacccucaccuccgugucucugggaucucuuacaguuagcacuucugacuccacagcuguaauugacuggugggcuuggcuggccgugguuaagguuacagaucuaggcuuagaaaucuaaaaacagugcucucuuacugggguuaucggccauuccuggaugaccacuuacacauuucagacaggcaaagggugcagccuggaggcagugcacacgcuucugacacgaacuucacacuauucaacagagccuucagcuaaaggucugguugaucauuugcaggcagaaagugcaccgcccccugcugcuggagccagaucagcucuaaacuuccuguuagacauucaaguggcuuguuuggguuuguuuuuuguuuuuuuuuuuuuuaaaugccauguauuuauuucuuacagcucagcuuucugcaucgagugcuuuuucucaguucuugugcugaggugugaagggagccugaccuagaaauugauguugagaaaguuaaagcagcccugggccagcuuaggggucagguagccagaacccuucccgacacucgggugacagcucagugccauccucuaucuagccagccagcugucaugauucgaggugcuucuaaggcaagguacugugcuuccagaagcuucuacugcgccuacauagugaaaacacucagacccaggaguguagagccaaagauccuuuacacguuggucuuuaugguuauuuuuuagugcaucaguaccucguuagacuucuuuuauucugccugggagacuugguaacuuaggcugggccacuuaauccccacuugaagcccagaacuuguggcaguugccaaacucagccugcaguaagaaggaagccuuacugugcugacgagaggccaggcuaugggggauggcuucccuguuaggcuuugccacagcugcucuuccuuccacugagcuucucgagguagcgucgagcuuuaucccgagcaccccgguuccagggcacuuuucauccccucugguuuucccuguuugagcuugaaugucuuugaagaaaauacaaaccuggauugaggaaaucaggacagaaagcuagaugagggccccaugcaucaaaugcagcugcagagccuacagucugagugucuugucgacaucucccaacagagcuguccagcucgcccccaggacccuaccaccaggagccuuacaugucuaaaccagaagagagguucaaagccccgcccauccucccgccacaccugcugcaggucaucuugaacaaggacacgggcaucucugugaguacucccaucuggagcuccuuucugcucacuucuuaaaagacaguggagaacuccugugccuuccacuguuggggacugcugugguccuccccugacauugugaaagauucacaucuguuacacaccccuuggucagcuagacauuuuagaaucuaguuuuaguuacuaaguuacuuuuggaaacgucagcccuccugggguagaauucgagcugucuuauaacacauuauaaccucuaccacauccacuguggcagaaggugcaagggcaagcgaugcccucaggaugacugacccacucagggugccuacauuaauccaugcuccgcccucaugaccuaauucaccaccaguuaggacccaucucccagcagucacuggggacuaaguucccaguacgugagcccuuagggacaaagcaaacuguaucuggugcuaaagaaagccccucccucaacacuggacacagcagcagagcccacgugcugcugagcugacuguguguggaggguucccuacggcagugucaggguuuguggaagacgugccuuuccuuaaguggacucaguccacucugugcugugaccaagcacagaucccggcucacuccugugaauccaggaggaggucaguggagagaccacucagccucagaccccacuggcuaaacaaauaaccagugcgcauuaguaacagaacugcaaggacccuuagccgcuguccuuaaagauucagcgcgcgugcacgcacacgcacacacauacacacacacagaggcauggcuagggagaggcuagaccaugaauucaggagaacugugucugaccucacugucagcucuuacagaucuugucuucaguuaggaaagugcucuccgaggagucuuauuucagcuucacagugaagagacuggagcagauacguugacuggcauccccagacagcgcucagaguucuuuucuuagaggcuuugggaaaucugcuguccugugaaugacuguggucagccuguucucgggccguagcuccucucacaguugucucugcagacaucuuguagcuuuuaaccggugucuuccccagaauuaccauccaguucuccuagccugcuuuuaaaagaugucgcaugugucucccuguggcuggcuuauuuauguccauaguccauccacguuguugcaagugacagaauuuccuuccuuuuuaaggcugagccacccacuguuguaguuucuuguccagcugcugugauacaauuuuugaugagcaauuuaaagugaaaggguauauuuggacucacagucccagguucuagcccauccuauggggguggggagaggacagcaggaguuugagggaggggucacacugcaucuguaguuauacauaguaugccacaucuggccacauccuauguccugugaauugucucucagggacugcagcggggcuccacagugccauaugcacacccauauguaaauccauccagguucuauuuccuuuggacacgcacaugugugugcacacccaugggcugggugacugcaucacaagguaccucugugucuaacuuuagacgucauccauaaugcuuuccuuagacggacugaccucuuugcucacuaacagcacaagguagauuuuaagugguuuuuuaaucgcacacacaaaaaagggugaauauguuagagaucugguguagccauuccucagaacuugcaugucccaaauaugguaugauccauauauuagacagcuuuaaaagugacagauggaaacugcuuuuuguuuguuuuuuuuuuuuuuuuuaagaucccuguagcaguugguugaggcagcgugcagcugaggcacacagggccucuccuuguucucucaucagcagccauccugcucugccugccccguaggagcucacuggaccugugcaugccuuggaggcccugcuagggcagagcuggacuaggaccuggauccucccacuccacuucucuugugugcuccugugugcauggguuauuuguccccagcagauuucccagacucaaacauaaccacugcagggcucuguaggaugcggguggccacuccccaggccaccgcucagagcccucaauaugccuguguguggcauaggccguccagcuucauguggaagggccuggucacacuguguuagagcucuugguuucccuccaccccaaggccucagaggccuguuggcagcugugagaucuuaaagucacuucaggacugggauucccguaguguugagugacaggaaugugcccuucccuugaggcaggaaccucaagcuaguagccuguacacacacacacacacacacacacacacacacaagugcauguucuuaagaguugggaaugagaaugaagaugcucuagggagguagaaagguguggugaaguguucacguguccacuuguagagucaccuacugcaacauacuuccucgucuagcuguagaggcuuggcuuaccauccacuucucaggagcauggaacacacagugggucugguguuccguuggcuuaccauccacuucucaggagcauggaacacacagugggucugguguuccguuggcuuaccauccacuucucaggagcauggaacacacagugggucugguguuccgggaaagcauuuccagugggucucuggucugcucuguaagagaaugggguagggccugccuuaaaggucagggagaaaacuuaccggaagugccuuccguagcaucuggcuggcacgaggauccaccccuuucaccucucuggucaucuccacaacucacacugcccggcuugggaagccaggucaaccaacagagccuggcuccucuccuuggcuaccccaaccaggccaugaaauagggggcagggaccauuuugacuucugaauccuacuugcucacgucucccuuugucccucagugugacccagcacugcuuccggagcccaaccacgucaugcugaaccaccucuaugcacucuccaucaagguaaugaauggccugucuugccuccaagccguuucugagccugugcucugaggaccccacgugccaggguggccuuggguguggacaagcagagcagccuucgggggcuguguuuguagugaccguguagugagucuccuguucucucugacugagccccugacucugguccuuuucucccucuuaggauggagugauggugcucagugcaacacaccgguacaagaaaaaguaugucaccacccuccucuacaagccgauaugagggaaugagaggcagccauggaccacagggauggcaggcggugcugggcucuccgugugcaugcacauccucacucacucugggacaucucacccacccuaguccuccuugaaggucuguccaggcauagccaaaaauagggauggcacggccgccugcagccccagcaucgcagugcacgaggcuuugugcucuacgcaucauccccucugcuggccagagaugucuacagccagacccgaaccuggggagcagggacagaagccacacagaaguccucaucaucguuugccuccgugaggccgcuggccugucccuggugaggccuggcuggggaggaaagcaguguugggucuugccuguccuucugaaucaaagcaguagauuguagauccuauggaaauucagugucugauuuccggaugcagcuuugcaaucguuucccgacacugugugcacuaagaccucuuuaaccagaguggcuggcuggccacuccuacguaaggcaauaagucaccaggaugagacuagagaucaugugacuacacucagcaauaaucacucucaagacagacuucaaaccccacugccauuucuccauuaagccagaugauccugaggaccgaccacugcagaaagucggcuacaccuuauuucaguugcaauguuggccacauuaccauggcaaccuggucgaagcacccacccuccuuuuaguuccagcaugugcuccucagcuggggaccugcaucucuagugagcagagaguaucacggugguugcuguugcuuguuccaaaagaagagcucggaacccuacagcagacugcuggguuuccagcaggggagcaggaaugaaccuaucuuauacuccaucugguuuccauggugacaucacagcugugcccauugggacaagguccugucaccugucagcagaggcaggcacaguauuugguuaagccugaguuuuggguaccuuuuguuacuguuuucaaaacccugacuugcucuuaucuugauguacaaguuucaauaaagcuuuguaaaaauuacuggaguaac

SEQ ID NO: 2629 - RNA, 1672 nt, Mus musculus
cgcagguggcuuucagggagagcugugaaugcugguguuuacaaaaacaaguacaaauaccauagcaugcuuaaaguucucgagaacaguugaggucauagacuuauuucuucuucccuuucuccgugugguagggucuccccaccucccucagcguccccagaguccacccagacuuccuagguuuuugucccaguuuuaauuuccccaccgccuucucuugcuuguaucugcauugaucauuuggagccggagaaggaaccagauccuaggcaucuguauacccucuccaccccgcguguggaguaaaaauggccauuuuacguaauguggcuuucuuuucuaucuauuucuuucagcaaaucucaggcaagagcuuugauuuuuccaggaagccacccuaaagagucauacccuugugcuucuuccccgccccuacccccgcccccgcccccgccccuuguauaaagucaacaguuuaaguucaggaugcuguugucccgcccaccagaggaugcuggcuuagaguuuuuuugcagugugcaaagcacgugccaccggugguacucaaggcgauuucugauuuaaaaaaaaaaaaaaaugaugguaaauagcgcugaauuucgaagaaggcuuccugcuuuauccuuucucagucuuugcugcugcaaggagaaugucucucuuggguaccaguggguccuucacaccuucccacaacaccagucauugcccaccguagcaaagagacaguggccuucagguccagucuuggucuccauagaccucagugacauuguuucguucuuauaguauuuguuuauaggcuucugcacagacagacagacagacagaagcucuguaucauuuaagcaaguaaauucagagagagauuuaaagugauuaugguuaacaggugauauuuauggccaaauaaaaucuccaaaacuaaugucagaaacacagcgacacgaacuugaauagaaaagaggcaucccguuuuauugaaugagcaagugaucaagagucaaaacaccugucucaaugccuuuggggagggggggaucucaggcaacccaggcuggccuugaauugcuauguaaccagggauggccuucuucugccucugccuuuccagugcugaggucacaggcuucugcugccucucccagacccugcauuuacuuccaugagauuagcuacgagaguugauuuuagacaaguuucuucugaaaaaaauggagauaaaagcugcuaccuccuuaccucauacuguuaugaaaauuaauugcuaucaugaaugugccccugaggcggggagacucugugcacuaaacaaauaugaagcacauugauaguggauugaagguguuugggaaaacacuggguccuggggcggggggcuugguggcgaggggggagggagguuggugggcacaggacuccacccagguaugucaugagaaaacccuugucccagaaggagacugacuuagggacaggaauucucagcauacagggaugccaccaccauuccagcauauuggauccugauucuuauauccuguuuguguguuucagucccuggucuuuccccaaaucaaauggaaaggaaguguuguugagagagaacggaauaaaaacggcuuuaaguaagcccauuugccaugcu

SEQ ID NO: 2630 - RNA, 5499 nt, Mus musculus
uaauaggugcauuuuaauagaggcuuugguaccucccaaaaaagaagcaaaucacacguaagucucuaagaguagacaggcuuaaguauggauuggccuuuuacaggaugaccaggguaggggggcugugcacaggguaaggucaagagggguggaggaggaggccccgugggccaguucagauguccggacucuacucaauucacuaauacagccucagggacaccucugacagacuaaacagaauuaauuugagggcaguggauucaguaauugagguacacagaagagguguuugucuccaagucguacagaggggaaagcuccucccaggacguggacugacacuuagcaugcuccugccgaggagagagcaucacagaccaccgaacagcaagggcccaggcaaagcgcugggccugugugucguaagccuucuccugggaggcaaagucagaucugcucacccgcacaagauaaaaauaaauaagucuuaaaagagcugcugagccagaacgaagacuuuaaggacaaauggcuuuagaaaagcuacucaugccauuuacagagauguggacgucacucagcagguuacaguaagcuuugaaggccagacuacuagaauuuuucuauguagaaccuagacuguacacaaacacacacacacaugacaugaaaauuuuaggggacuaauugggguggggacaggagggguaauuggcgagaggcauggucagugagcauucuccucuugagccauuauaaacccaucucuuuauauauauaaugaauauacacugauggaauguuaagagauuaagaagcaaaugagaaaaaaauguaucuagcuggguuuucuugcucuccucaaauuuuccugggugaauggcaacaagaugagcuuaaaaucagcuuaagaucgaagccagaaacuggaguggggcccuuuacccccaaacaaccagucuggccugagguucaggucggugcggaauaacugagguuuuagauggcgaguucugcaucacuccaacgaggcucagacacaugccuuugagccacaacagaaaccauucugaucaacacauuuuuuucccccagugagacauguuugguuuuccaauaauguaaaaacuugugccuucauauccaaugaauucuuggaaaaugucaucuucacaaagccgguuacagaaguguuccccagccaaagagugguucaggugauggaagaagcagacauaagccggaagaaggucagaggaauacgcuggacgaacacaguccacgccuccacagccccacgcuccauagcuccaaaguucauagccccagauuccacagcuccaaacucagcccacuucauuuaacuuuagaaacacuggucuguuggcaaaaagcaaaugcauuagucaggguucuccccaacaacauggagagugaauauguaggagacccuucaggaugcuuuauguucuguaguccugcuaaucccagcaacggcuguccaccgacggaagguacgagagcccaguccuuauucagcucacaaggcuggacguccgagcugcucuucaaagaagcaggcucuggugccaguggaggaauggacuugccagccgaagugagggcaagauggcagagagaggggcuuccuucuuccguguccucuguaucugcugccggcaggaaggugugggugacccaaaucaaagguauuauuaacuucccacaucuaaagauccagauuaaaaguggauuuuucccccacuucaaacgauuuaauuaagaaaacuucccccacacggguaaaccccagcagcuugggguuuaguuaauuucagagguagccaacuugacaaccaagaagagagaccacagcagauuugagugguuuugguuuucucucucucucucucucucucucucucucucucucucgauuuauuuuuguuguacauguauacucacuuugccugugugcacauagaagcaccacaaguguacuugaugcccgucaaaaccagaagagggcaccagaucccccagggaugcccccccccccccccccccgccuguaauggaucagaaaagcagcccaacaaacagcagccaugauggguauugguacaagucugguuucugccuuagagccucuuucaguccuagcuacagagcuggcugucaucgcuugccuuacccuguccauguuuuggcccgugucacaacucacucgagaaauagcuguuucuacgcauaguaagcgaaacugacaguucaaacaacacuuuucuugagucuugugaaaaggaucaguuuccaugguggcucucaacaagcccuugucucccugaaccgcccugcgcuggacauucauuagccccuggagcaaacccacugucucuguugaauucaaauaagaacaucaaagggcuauggagauggcuccacaguuaagaucaccggcugcuccccauaugcucauucacaaccaccugucgcuccauuuucaggguauccgaugcccuuucccggccuccacaggcacacacagacacacauauaaaaugaaaaauaauuuuuuuuuccaaaaagaaacucauaucuguccuccgacuaacauagauuuccacaguauaaaauaaacaucagggcacaagucacuaccaaacauguaaaucaaggaccguggcauuaaaaacauuguaucacguagccaucagucuguauuauguauucuaacagugaugcaaagaaacucucaguuacuuuugcaccaaccuaaagaugagugucugagucaugggggggucaggggaggggggaauccuggaucucacaaagguuucugggaugucaaggagagguugggaguggcagucuagucuggcucucaaaccagacucugagauuaacacuguguuuaccccacaguuugugagagaacacauuauucauaugccccaggaagacuacaucaacuggcuacagagccgagucaacauucccuuccggcagcgcaccauccugacauagaggggcccaguccccguggaggaaagcaagccagcaccacaucccuaagcccagccugugcccguagccuccucucuucucuccuggacacacggcauggagcagugagaucagcugaagacacuucuaacaauaugacugucuggagaggguggucccagguggcccuccccucccccaccaggcucccuaccuccgcucacuguccaauguggacucuuguuuucucucccagacucuugucaccauuccccuuccccgaaagcccuggauaauaaaucuaaccuggauguuugacaucuucccaaggaagaauucaagguguggcauuugggugcggcaaucagaucuuaggagaacaagcuaucauuugugagcuuuuguaaauucgacaaccuagugccauguguuuugccugcguaauguaauuauuuauauuggcauaugacauuccugaguacauacagaugaauaaaugaauggauaaagagauggauaaauagguaguaguauaggcagauggguggguggauaaguggaugcguagagagauggauaacuggauggguggauagaugaaugaaugaaugaaugaaugaaugggcagaugaaugaguggguggaugaaugaaugcaugcaugaauggguggauggaugaaugaaugaaugaauggguggauggaugaaugaacagguagaguauagauucagggacagaugaaugguuaacugcgaugcacauaaagaaauggcauguaugugugcacacguguacauucaugcugugcaugggcacauguggaaggcagagguugacaucaggauaccuucugauaaaaugagaagugagaggagagaacggagcccugaggacagacagacagacucacagacgcaccacugacugauagguugcucccuucuacacaguguggaauggauuaucugguuccagcuccacagcccccacgguccccacagccuccacggcccccacggcccccacgcacuggcuuuuugcuguucugcaaacaaggagacagaggcucgaaaggauucuuccacucuuuuuaaauuuaaauuacauuuauguuuugcuuguauaagguuguguguauagaugugugugcauauguuugugugugcacaugcaugccugcaugugugugugcauuugugcaugugugagcauguguuugugcauguguuuaugcgugugugcgugccuguguguguguguguguguguguguguguguacauacacauaggccagaggugaacauugaguggccuucuaccacucugucuuuuucgugugcugcuaggauaaaaacuacucuacccugccagggaugguaguggacaccuuuaauuccaggccagccagagcuaugcagugagauccaggcucaaaaaaaaaaaaaaaaaaaaagacaaaaaaagaauaaauaaaacgcugacuaaaagcaacuuggagaggaaagggauuuauuuggcuugcagggaacgguccaucaucaugaaaaaagucaagauauuaacucuaggcagacacugaagcacgggccauggaggaacucugcccacuggcuugcucuuuauaaaucacucagcuagcuuucugcugcagccucggaccaccugccuggggacagcacccucacaauggauugggugcaaucccccacagacaugccugggguuacaguggugagagggacuccucagcuccgucucccuucucccagggcuguucagguuugugucaaguugacaaacaccauagcaugcuucacauuuaauauuuugagacagggucucucacugcacccgggguuuguggauucagcuaggcuggcuggcuaucaggcuucuaagcgcgccugugucugccucccaaugccggagucuguggcacauguuccccacccuggcuuuuugacaugggugaaaggagcuggacucagacccucacgcuuacacaguacugacuccccagacccugaacuuauuuguaacugauuccuaacuacauaaaaaaauugaaacugugcauacugugcugggugauuuuuauguguacgugguacuguguucaaucacaagcaaacacagcucacuccucaaaugguuuaucauuuauaauaaaaaugucccaaacccuuccuucccuguugucuuuuuaagcaaacugggucaucuguagcuacggcuguccugagugugccacccuagaacuccguaccuucauccagcuuuggaucagaacagagcccuuugguccaccuugcccaacugugguuggcgcuugaagucuggucucccugauguucaccgcaucucucugagggaaaauggagcauuacuuuauuuauaauccccauuuuuuuuuaauuaagcauacaaagacaccgacgaucuguggcagagcagagucuagaaugaggucugucuaggaca

SEQ ID NO: 2631 - RNA, 986 nt, Mus musculus
ccucaggaaacagaagguguucucucagccccucauaugucuuuuugcacguggagugauguauagaaggucggggagaggcaucaugacaagugaagaggaaggaagaagugguugggaaaaaggaagcaacuggaggaggugggaugggguaagggugagggggaaucuuacaacugugucaugcacaugaaggggugagugcucuaggaaagcugccacuuagugcacccaguacagggagguacacugaauacauacuaagaaaaucauaaacugcuuaaaacaaucaaaggaacugggccuggauguagcucaguugguaaaaaugcuugccuaguguguguucagccccacaggcgcccagcagaugauguaacagcccaccugguggcaugugccugcauucccagcaaccagaggugacagaaggggcacuagacacuuaggauuuuccacagacagacagacagacagugcagagccaguucaaauuuuaucagacccaugucaaaaaaaggaaaaaugagagagagggagaguaggaaggagggugugaggggaggaggggaaaggagagagagagagagggaaagagagagagaagaggagaggagaagagaggagaggagaggagaggagaggagaggagaggagaggagaggagaggagaggagaggagaggagaggagaggagaggagagggaggagagagugaaaggugggugggugccucuugcacagaugucuggagaauucucuagaggauuaucaaccacugauucuuuucucucaaagacuuggcaccauacgggcuugaccuuccagaggagagaggcuucugcaagaugccugauggguaauggcagcagugggcauggacuguggcauaauugcauuccgccugucuccuacauuuuucuggguugggcaccauuuguuucaaagcuccugucguguggccauuaaaucaccguuugcucuga

SEQ ID NO: 2632 - RNA, 1462 nt, Mus musculus
cucacuuaggcuccgugacucccucgaugguaguuacggucacguuguugugaccaaacaccugaaagaaacaagagagggcuguuuugucuugugguuucagaacaguucuuugagacacauggucaucauggcagcuaggaugccuguuugugagccucuguaccagagacuuuccacagagaucucuggcccagccuggggcuagguuccagcgaagggaagcgagugugggugugcgggcaggaaggggaagucgcguccaccacuucugcugcugcaguuggcuccugucucugccgugccuuccugccuuccgggcuacucaguuacucugcgcugcccugcacugagucaugucgggcuggaccaacgagaggcugacuagccagugaggagugcggcggagcuucagauggcguuucaggagagcagaccucuucccaaguguuacaguucuuaaaacagaaggcucggaugacagaguaguuuucucgcacuuucaauucccuggauaggauuuauauacaguuuugggagugauucagaguucgacagcagauaccucucauuggcuuggggaaaccuuauuugcaagugggaagacuuggugcugcuccuacgugacugagagccacacagcucuacuguggggagcugugggagccuuuaacugugaccggagccaggggcccaggaggugugguugaacaccuucggucccauccagggggaaaucaccacccacccggucaccgggauuccagacaaaggaaguguaugcuggugaauucucgcucuuuggcaauaccaaaagaaggauguaucuccuccagaggccacuccagugaaccacuuuugccagcuaugccccaucaccccaaauuucuagagcccccaaaccagcaacggcaguucaagaaacaccaucacccaagucugaguaagacacggcccaauuccaacuguucuaaccuucaaacacagccacacuggggcugagagcaugagguacagaucuuuacaaaguacgagugugugguuuccugugacagccagaagacagcaucggaucuccuggagcuugcguuuuuuuagaagccaccugacaugagcgcaggucuucugaaagagcagcagcugcugaucaccaccaagccaccucuccagccccaaggcauggguguucuuugaggaacgggagcauucagucucuagcagauucuuuuccaguuuuucucuucccucaucuggauucuacaccacacacacccuacugacggagaagcuguucacggcgagagcgaagagacagagagacaaaaaggcgaaaauauccagccaagcagcaaauauuuacugacuugguagaucuuuuccuuuacuccccucacaaaugaaaacagaccagagcauccacuacugucuucucggauuauugaacuaaaacuauuucccacca

SEQ ID NO: 2633 - RNA, 1169 nt, Mus musculus
uguguguuucagacuuuauuguagaugagacaggccuggggaggcuccuccaccaggaacaggcuggcacucaaguauugaccuucaugguaacuguagggagggcuggcacuaagauaguguugcccaucgggguaauucuaggaagccugaguucaggacagaccucaguucgcagaaaagggcugugagguugggucagggagccaaugaagaacgggccaugugaaagaaacuggggagaaugaaggcuguguggacuugacugggaagagggugaggagauggggcugacaaagcugaagagagcgggaaggagagagaaccaggagccacagugcagaaggccagggugcuguccccacccagggccugcaggauccccaguguggacagguccucccagugagugccuguguagcaagggccuacuuguuacuccagugggccaucuuugaaaauacagguguugcgauguagcagcuacucuucauguaggcagagaucuucuugaggcccucgaagcgggccaggaagucccucagguuugggaaggcguccaggcacuugggcucaaacauacgguacuaguaaagaaugucauaagcaaggaaauccacauaggugaccuuguccccugcaaaccauggccucuugcccaggaacucagaguagagcuucauuuucucagggauggccuucaagaacucuggcuucugcuucucaaagucaggguuguaacagagcaugaugagcugcaugcggguguccaugaccugguucuccacaaugucugcacggauccucuccuccucugucucuccacccagguggugcuugcuggcaagguagcacaggauggcauugcucugggugaucuugugugauccaucaaucaaguaaggcagauugggaaaguccaggcccagcuugaacuucucauucagccacuggcuucugucaaaaucgggagcaucacccauggugcaucucuucucaucauagcuugagucuguguauuccaggagcaugcagaucgggugugucaguccgcggacguuccaguaucccaguaucauaggcauggugcuggugcuguggucuuuucaaacuggcuucagcaggauuccauuucccuucuuuuauuuuaguuuuuuuuuuuuuuucug

SEQ ID NO: 2634 - RNA, 1169 nt, Mus musculus
cagaaaaaaaaaaaaaaacuaaaauaaaagaagggaaauggaauccugcugaagccaguuugaaaagaccacagcaccagcaccaugccuaugauacugggauacuggaacguccgcggacugacacacccgaucugcaugcuccuggaauacacagacucaagcuaugaugagaagagaugcaccaugggugaugcucccgauuuugacagaagccaguggcugaaugagaaguucaagcugggccuggacuuucccaaucugccuuacuugauugauggaucacacaagaucacccagagcaaugccauccugugcuaccuugccagcaagcaccaccuggguggagagacagaggaggagaggauccgugcagacauuguggagaaccaggucauggacacccgcaugcagcucaucaugcucuguuacaacccugacuuugagaagcagaagccagaguucuugaaggccaucccugagaaaaugaagcucuacucugaguuccugggcaagaggccaugguuugcaggggacaaggucaccuauguggauuuccuugcuuaugacauucuuuacuaguaccguauguuugagcccaagugccuggacgccuucccaaaccugagggacuuccuggcccgcuucgagggccucaagaagaucucugccuacaugaagaguagcugcuacaucgcaacaccuguauuuucaaagauggcccacuggaguaacaaguaggcccuugcuacacaggcacucacugggaggaccuguccacacuggggauccugcaggcccuggguggggacagcacccuggccuucugcacuguggcuccugguucucucuccuucccgcucucuucagcuuugucagccccaucuccucacccucuucccagucaaguccacacagccuucauucuccccaguuucuuucacauggcccguucuucauuggcucccugacccaaccucacagcccuuuucugcgaacugaggucuguccugaacucaggcuuccuagaauuaccccgaugggcaacacuaucuuagugccagcccucccuacaguuaccaugaaggucaauacuugagugccagccuguuccugguggaggagccuccccaggccugucucaucuacaauaaagucugaaacacaca

SEQ ID NO: 2635 - RNA, 3508 nt, Mus musculus
uaaauaaacaaggucccggaucgagaccugaggcuggaggagcgaucacgcaaaugcagacuacucggaccugaaaacaaaucccaaccuccccuuucgcccacuucgccguggcaggacacgauuccauugaaccccucccaaccuaggagaugaggacuccaagcuaccacgcaggagguggguaaacaagacagcuuuaaggucacaaagcugggggcgggggagaggugccggccaaaggaagacuuaucgccugucccauuccggcuccccaagcggagcuaggggcauuaaaacagugggaggagagaagcugggagcgagaaagccagggcgagcauugcuccgacccgagugcggaaaugagagacgcugggcuggggaccccuggcucgcaagagcucuggcgaccucugaccacccgcacccgggccccguccccacacccgcaccuucgucggacucucggccccggcagcugcgcucgucguccucggcgcucuccaacuccuccucguccuccggguaguacuccggggcggccggcgcugcagccggagccggcgccggagccagcagccccgcggcgcucaugucgccgccucggggccgcggcggagccggucccgcggagaucgcggccgccuggcugcguccccggagccccgcaaccucgcgcgguuccgagccgcgggcaccgggacuccccucggcuccgagcuccgccccccaccccgcaccccggcgcccgcgcugggcaacgggggccucgcgcagccggcuacuuccgggucgugggcugcucggugacagccugaucaggccguccucgagacgguaggugagacgccggggcuccacgguuucugacacggcggccgcggcggcgucacugucuuaagaauccgcgaucggccacggcggaaggggcggaggcgggagucucuggagucaggcauauccaggggcagccgcgccagcagucaggaccccggaguuggagguggcacuucuggcaguggccaccaggcggcgccuggagucaaaacuaaaguguggauggacucgaccugaugggcggaggcuuugcagagcccuggauagguagcauggucucugauucaugcaggugaauggcacgaacgguucccgcggugggcuuggacgccuggccagccagagugugugggauacagaaaauguugugcgugguugcuccccugccuuaaugggggcuuuauuaaaaauuaugguaaaggcaaguuguugccauuucauccaccggucaggugaaagugugucccuaggccuugccaguacuuucuuuugaguagauuuacuggguaagcuguucuaccgguuuuacaaaugaucaaaagaguugucauucuuucuccuuucaagaaaagaaaaaagaaaaaacgguggcgucagucuagcaucccagauccacagcuguccacaggauaacuuccuugugcuuccccaaacauaauuuuuaagguauuuuagccuaaaacaguaauuuaauaaccugcuaauuuuuacuugaguaaauagggcauuucccuccaggaacuacauuggcuuaaauucagaagccaacgcugagcaaagugaccuuuagucccaggacuagggaggcagaggcaggcugaguucaaggccagccuggucugcaauucguguuucagaacagccauggauacacagagaaacccugucuuaaaaacaaaaaaaaacaaaccaagccaugaaacugaaucucuccauguguuaaucuguguagcccugugaaacauaguguuacaguuuugcuuagaagaggaggaagaggaggaaagggaagagguggaggaggaagaggaagaagguggagaggaggaggaggaggaggaggaauaggaggaaucaucucagcacuugggaggcagaggcagguggauuucugaguuugaggccagccuggucuacagagugaguuccaggacagccaggguuacaccgagaaacccugucucgaaaaacaaaaaacaaaaagaagaagaagaaggaggaggaggagaagcagaagcaguagcagcagcagcaaaaaccuauggucucugccuaguggcucacaacaauaaucccaggugcucagaaagacaaaugcaagaggacagagcaacaucaaggcuugccuggauuucacaaugaguucaaggccagccaguuuaaugagaccuuguuugaaagcaaaauuaaaaaggaugggccauguaugccuguggcuggguagggcacuuguucggcaugcuggagacccuagcuucacucccuaauuggagagacagagaagauguguccagaggaacccuauucaguuaacucagaucugcagaaaacagaacaagcauuaaggcccggcagaugggaacacagcagaaagcgggguggaacccggggacaguauucuguuucucacagccucugugaucaaaugcauuuccaaaugggcccccagagagacuucuaaaaaugagaacauucguucugggucgcauuucuuuugacauuuccuauuugcuaccuuguuuuaauuaaaucuuggcucucuuuguaagaaagaguuccucucugcagaaaugcaagaauguccagaaugcaaagcugggacggcuuuuccagcagcucgggaucugaagccccuucucgacaagaguccuucuucaagcccagccucagcagagguucucggagcugucucuucuccagaggaugaggucagcuuccugcgugugcuuguucucucucucucucucucucucucucucucucucucucucucucucucucuguguguguguguguguguguguguguguguguguguguguguguguaaacuguuggaacacauguagacuauuuguaauccagcacacugugggaucgcagcucccaauacuauuaaagaagcaacaaauuaacaggcaucauuuuuugaacucagaauccauugauacaaugaaacaaaugacaguuggguuuguuacuaaacuguguguaaucuuguuuuguguuuaacuuuuauuucugucucccugauuacagacagccaguguuagucuucaugcguuucuguuuuacauggauuacagagacacaaaugguuggaugacgacaauuugucccuuaucuuccaugaaaauugcagagcuggcccaaggagcagcccuacuaagugcuacuuagugaggagggaaaugaacuuuuuaagaaucccuccugacuuuuagcucaaccaaauuuuaucauuguuuguaaaaccuucaaaaucaaguuucaccccuuaaaauucuccaccacuucucccaaauaguauauucagucagacuacccagaugaaguuugauaugcaauguuuaggauguaaauuuugcuggggaaauaccagagagagagcgagugagcgaucaguuuuuugacauguuugaaucucuaggaucaauauccaguacuu

SEQ ID NO: 2636 - RNA, 3508 nt, Mus musculus
aaguacuggauauugauccuagagauucaaacaugucaaaaaacugaucgcucacucgcucucucucugguauuuccccagcaaaauuuacauccuaaacauugcauaucaaacuucaucuggguagucugacugaauauacuauuugggagaagugguggagaauuuuaaggggugaaacuugauuuugaagguuuuacaaacaaugauaaaauuugguugagcuaaaagucaggagggauucuuaaaaaguucauuucccuccucacuaaguagcacuuaguagggcugcuccuugggccagcucugcaauuuucauggaagauaagggacaaauugucgucauccaaccauuugugucucuguaauccauguaaaacagaaacgcaugaagacuaacacuggcugucuguaaucagggagacagaaauaaaaguuaaacacaaaacaagauuacacacaguuuaguaacaaacccaacugucauuuguuucauuguaucaauggauucugaguucaaaaaaugaugccuguuaauuuguugcuucuuuaauaguauugggagcugcgaucccacagugugcuggauuacaaauagucuacauguguuccaacaguuuacacacacacacacacacacacacacacacacacacacacacacacagagagagagagagagagagagagagagagagagagagagagagagagagaacaagcacacgcaggaagcugaccucauccucuggagaagagacagcuccgagaaccucugcugaggcugggcuugaagaaggacucuugucgagaaggggcuucagaucccgagcugcuggaaaagccgucccagcuuugcauucuggacauucuugcauuucugcagagaggaacucuuucuuacaaagagagccaagauuuaauuaaaacaagguagcaaauaggaaaugucaaaagaaaugcgacccagaacgaauguucucauuuuuagaagucucucugggggcccauuuggaaaugcauuugaucacagaggcugugagaaacagaauacuguccccggguuccaccccgcuuucugcuguguucccaucugccgggccuuaaugcuuguucuguuuucugcagaucugaguuaacugaauaggguuccucuggacacaucuucucugucucuccaauuagggagugaagcuagggucuccagcaugccgaacaagugcccuacccagccacaggcauacauggcccauccuuuuuaauuuugcuuucaaacaaggucucauuaaacuggcuggccuugaacucauugugaaauccaggcaagccuugauguugcucuguccucuugcauuugucuuucugagcaccugggauuauuguugugagccacuaggcagagaccauagguuuuugcugcugcugcuacugcuucugcuucuccuccuccuccuucuucuucuucuuuuuguuuuuuguuuuucgagacaggguuucucgguguaacccuggcuguccuggaacucacucuguagaccaggcuggccucaaacucagaaauccaccugccucugccucccaagugcugagaugauuccuccuauuccuccuccuccuccuccuccucuccaccuucuuccucuuccuccuccaccucuucccuuuccuccucuuccuccucuucuaagcaaaacuguaacacuauguuucacagggcuacacagauuaacacauggagagauucaguuucauggcuugguuuguuuuuuuuuguuuuuaagacaggguuucucuguguauccauggcuguucugaaacacgaauugcagaccaggcuggccuugaacucagccugccucugccucccuaguccugggacuaaaggucacuuugcucagcguuggcuucugaauuuaagccaauguaguuccuggagggaaaugcccuauuuacucaaguaaaaauuagcagguuauuaaauuacuguuuuaggcuaaaauaccuuaaaaauuauguuuggggaagcacaaggaaguuauccuguggacagcuguggaucugggaugcuagacugacgccaccguuuuuucuuuuuucuuuucuugaaaggagaaagaaugacaacucuuuugaucauuuguaaaaccgguagaacagcuuacccaguaaaucuacucaaaagaaaguacuggcaaggccuagggacacacuuucaccugaccgguggaugaaauggcaacaacuugccuuuaccauaauuuuuaauaaagcccccauuaaggcaggggagcaaccacgcacaacauuuucuguaucccacacacucuggcuggccaggcguccaagcccaccgcgggaaccguucgugccauucaccugcaugaaucagagaccaugcuaccuauccagggcucugcaaagccuccgcccaucaggucgaguccauccacacuuuaguuuugacuccaggcgccgccugguggccacugccagaagugccaccuccaacuccgggguccugacugcuggcgcggcugccccuggauaugccugacuccagagacucccgccuccgccccuuccgccguggccgaucgcggauucuuaagacagugacgccgccgcggccgccgugucagaaaccguggagccccggcgucucaccuaccgucucgaggacggccugaucaggcugucaccgagcagcccacgacccggaaguagccggcugcgcgaggcccccguugcccagcgcgggcgccggggugcgggguggggggcggagcucggagccgaggggagucccggugcccgcggcucggaaccgcgcgagguugcggggcuccggggacgcagccaggcggccgcgaucuccgcgggaccggcuccgccgcggccccgaggcggcgacaugagcgccgcggggcugcuggcuccggcgccggcuccggcugcagcgccggccgccccggaguacuacccggaggacgaggaggaguuggagagcgccgaggacgacgagcgcagcugccggggccgagaguccgacgaaggugcggguguggggacggggcccgggugcggguggucagaggucgccagagcucuugcgagccagggguccccagcccagcgucucucauuuccgcacucgggucggagcaaugcucgcccuggcuuucucgcucccagcuucucuccucccacuguuuuaaugccccuagcuccgcuuggggagccggaaugggacaggcgauaagucuuccuuuggccggcaccucucccccgcccccagcuuugugaccuuaaagcugucuuguuuacccaccuccugcgugguagcuuggaguccucaucuccuagguugggagggguucaauggaaucguguccugccacggcgaagugggcgaaaggggagguugggauuuguuuucagguccgaguagucugcauuugcgugaucgcuccuccagccucaggucucgauccgggaccuuguuuauuua

SEQ ID NO: 2637 - RNA, 906 nt, Mus musculus
cgaugugacgaacacuuuuauuuacaaauauaauuaaaagcccugacaguuaaucaugcucuuccuugggaccugaaaaauguuuucuuuuuuuaagugcaugcaaaaggagcggagccuuuuucucgucaucauuuuuuauuguaagaaaauacacaguuugaaaggauggauaaugcaauauuuaugaccacagauagggggcguggggaagggaaggagaaauaaacagagaugauuggcagagaagacauugaacuccagagacuggaguggggagugggcguggggggcaggggaggaacaggaggaggaaguaaaaaaauucugaucagagaaacaguuaaaauacaauaugaaaauaagcaauuccucuccuuagauucccucuauacacaaaauacaugauuugccaaagcccaauuuugugcuacugggauucugugagcuccuuuaaguguccucgcaccaucugcaaccgcagaggaugcugggauacaguagaccaggcugacggcaaggcaaacucuugccggcagguucuuaaaaaccacaagaucucuucaccccucccacccaccccggccccaaaauaguaauaauauguuaccacuucguauguacaucacaauuaguuccuguaaaauguaucaaauuuucaaucuuuaauaaaacuuuguuuuuuuuuuaauuccugaugaauaaauaccaaaaaaauaaaauaaaauaaaguuaugcagcagcugguuaagguguaaggcugcggauuuugugucucucucccccuuggcauguauuguuuauuuagguuucuuuagguauuuucucuuuuuuuugcuuuacuuucacugguuggugacaacgagggauugcucaaagcaacauccaucuguguuccaucgccgu

SEQ ID NO: 2638 - RNA, 4981 nt, Mus musculus
gcaggucugaaugcaaugccuuuuuauuuguacuugacaaggaggaucaacacacucggcagcucaggugacuuuugccuaccccacugagaagcaaggggcuuaagagggucucucuccacagcagcacuguucuuuagacacuugauaccuacgcagccaccugaucuggacagucagggcucagcuaagaugggagucuugaguugucucaguugggggacagggcccuuaaagaccccacugugcccgguucuggacaguuuccuuguucaaccacucacagacaccaccagcuccagcucuccucuagaccugauccuggcggagugcuuccuuuuucagaguugcuuuuuuuauaucaacaacagaaugacuccaucagaacauuagaccccuccccagacggaaccuaaacucaaucaaacagaaccugggaugggacuauccagaaucgugacggcuggcagcaagagggaagacacccuaaaccucuauccuagcacagcuaagaacucccaaugagaggguagcaagggggcggggggaagagcaugcuuuacacaacuuaacaaggcugugggggccccugugcagcaccccuacuucccugacagcugcucguacagcuugggcacauagucaucccacucggcuugguagcacgugcccgccaccggggcucccagguuauacuucuugcggaaggucuccaccuugaacuugccgcgauugucuccagacuuguugcugagaaugggcucgucgcagcucagcggcuguuccugcucguacaccagccagacauagcgguggagaccugcaggggaggcaaguaccagccagccagucagucagggugggggugcaggugggggugggaauaggggugcgcuccgcuugggaccgcucuugccuaacauucacaaaucuucagccugguuuucccucacagcacagcauaaaucaguguaguggugcacaccuguaaccccacuucuuggaucaagaguucaggaucacucucaacuacccugaaaguucaaggacagccuaggcuaugugaaauaugucaaaaucguaugguucuuaauggcuuuuuaagaaguuaaauacgugccaggcauaguggcgcaugccuuuaaucccagcacuugggaggcagaggcagguggauuucugaguucgaggccugccuggucuacagaguuccaggacagucagggcuauacagagaaacucugucuugaaaaaccaaaauaaaaaccaaaaacaaacaaacaaaaaaagcuauuuacaaguaugaaaacauaaugagagagaaacggccaccauccaucagagugcuccacaaagaagugcagucccacacccgugucgcuaagcugccaggcugcacagacucacagcaaccuuacccgggcuaucagaguacaacacagccauuucagcggacuccagagcaauuccuagaccuagggcaucuaugcaagcacaaagaaguacaauggaaaccccugccuaggaauacagaaagcacacagugccucuauucauaacacccacauccuggcuacagcccaaggacccagcgagaggaaggcuggaccgugcaguccacagucacagggaauacuaauugaugaaagggaacgaacucguaacccaagccagcaucaagauaagucacacugugaacgcucaccagauaccacaccccgcccauccugcccauaggcacaugggauccaaagcgacccauggagacccauaucagaaaaugcugagcuccaagagggcaacagggaccaggccaccucuaagauauucaggguggcaagaagagccuccaucuuccugggguguccagauguguguaccucaaauccucugccugaaaccuucugagccaccaguuuaucaagcaagcuaaaucuuccaaacaccugagagcugcuaggguuuuauucuucaaaacagagcacagcuccgacuccagagaacugcucuacuccccagugccuccugccuguaauuaaaucaccugcuuuuguaggugcccuggagaaccuuaaagaguccccaggaaacuuaucuuucuauucucugaugaacacugagaggccuggaaagcaucuggaagccucugggccgacagacacaaggugagccgugagcaauggcccuuuuguccuuaguggacacuaguuaucccagucaguucucugcagggcaaugcacggaaguuggcauccugccaagcgucacccaccaccacgguggccuuguuccagugaaaggaaaacguguauaacaagcaaccggcaguaacugugucucccaccagcuuuggggugcuuaugagacuuugggagcacuguggggcuggacucucauguuccaugucaauacaaaacacagaaagacagaguaugugugaaugugacugugagugagugugagugugaauguguguguguguucaaugugucucacuacagucuuccaagucuuuucaaaguacccagacacauuuuggggagaaagggagaguuauaaagagauaugaaaggcaaucuuuggcacuaguaugaaaaguguuugcuucuuguucacaggaucagaaacuuccaugaucacccauagcagagauuacauagagauuagaggaggcucagagagcccacagagcccccagcagcccacugcaagccuccugcagcccuuccugcccucugugcccaggacacuugccagccuggcgacagagaccuugucuaguaugaggcccuggcuuugauauuucaaauccaccacaaaucauuuacagaccuagcucucuccgagucccagaagugguucuacagagggccuacccaaucagaaccaaaguucuggcacccacauccuacaggcugacugucccagaaaagacuugccugaggggaaaaacaagcaggauucugccguccuuacaguaaggcuuggaaagaacccagugguagccacccccgcccugccucauucucccccccaucccccccccccacacacacacacacagccuuuacuuaccugugccacugggaggcccggagcccacauaaucugagaggacagugccacugcuaaugucauuacccuucauguugaccaccaggaaguggugccacucccugcggagacagaacacgaggggcugugagcaccagacaccuaggacauucucaagcugggcaauaacaggcagaugauacacugggaagccacaagcaagcaugagggccucacaccaagagacccuguuccggggggaggggggcugagguuguggcucagggggucucagccugugcugcacgaggcccaggacuuucuccccaccacuacaaaaugacuguaaccccaggagguccacgcaucccuguccagcagggacuuccguguccggaugauagauagccucuccccaucuuuuccccaacuggccugaauuugggauccuuccugcugggagcaucggggucugugaggaccaggguguagaguuucccaggaucaaggccgucccaugaaaugcugcugggccuguucauaaccuguaggaaggaaccaguguggggguaaaaaucuagaaaugcucucaaaacucaacacucugccaccuuauauucccaaaagguaaaacaugaggguuauuauuuuuauuccuuucuuuuacuaccgagacaaaaaaaaaaauaguuuauagcaguuucacccaugcagauuagugguaauuccuaaguauggccgcuacuaaaagccugaagcuuggagcuggagagaaugcuggguuccaagaacucuugcaaaggguagacauuuccuggcacuccuguggggggggggugggggggugcaacuccagcuccaggggaccugaugccucuucugaccuccacagcucccugcucucucacacacacagccacacacucgcacauaauuaaaaacacaaaaccaaucuuaaagagccaggagucuaaaaaaaaauuuuaauuaaacaaaacaaaaccagauguggugcacgccuuuaaucccagcacuggagaggcagaagcaggcagaucucugugaguucaaggcccgccagggccacaacugagugagacccuacauguaacacacacaccaagccagccucgacaaacacuugcccacguuauuaacagaaaguggugagacaaggaaguccgacgguggcaacggguccuccuccacaaccucacugagggucccgagcuaccuaacgccuuuaaauaugguggccaacgguccgcuuggggccagcugaggaguaauccgcccucggaaaacgagagcggccaaggacacguacaaaguuugggacaagggagaccggccagggcuccgaauggaaaccuuccaagucaccaucucaaacccugcgcucuaaauauauaaagagaacgguuagacccaguuucucugagcuuggaaccgcucuugagcgucagcaucccacccccaccgccacccccaggagcaacacagguuaaugagaaagcgcuggccccggaaucauuaauaaagugcgggcugcucccugaggaggugauugcaagcucgggacauuagaagguuacagaagaggcuuucggcugucgggugacgcucccguccgguauacaaaggcugagcucgaggccugcuccgccccgcugucccccggucuccccggcggcgggcccacaccguaccugggugggcguuagcacuuugcccagcucguccaccgucaccccggcguagucgacccgcagggcgugcuggggcggcucguccaccuccugcaagcacaagggcccggcccacuggcugaugucggcggccauggcgauggagaguuggaaggcacgcgcacgccgagucccgagcgcuguuaacguaaagcgcuugcgcaguugacugccgcccc

SEQ ID NO: 2639 - RNA, 4981 nt, Mus musculus
ggggcggcagucaacugcgcaagcgcuuuacguuaacagcgcucgggacucggcgugcgcgugccuuccaacucuccaucgccauggccgccgacaucagccagugggccgggcccuugugcuugcaggagguggacgagccgccccagcacgcccugcgggucgacuacgccggggugacgguggacgagcugggcaaagugcuaacgcccacccagguacggugugggcccgccgccggggagaccgggggacagcggggcggagcaggccucgagcucagccuuuguauaccggacgggagcgucacccgacagccgaaagccucuucuguaaccuucuaaugucccgagcuugcaaucaccuccucagggagcagcccgcacuuuauuaaugauuccggggccagcgcuuucucauuaaccuguguugcuccuggggguggcggugggggugggaugcugacgcucaagagcgguuccaagcucagagaaacugggucuaaccguucucuuuauauauuuagagcgcaggguuugagauggugacuuggaagguuuccauucggagcccuggccggucucccuugucccaaacuuuguacguguccuuggccgcucucguuuuccgagggcggauuacuccucagcuggccccaagcggaccguuggccaccauauuuaaaggcguuagguagcucgggacccucagugagguuguggaggaggacccguugccaccgucggacuuccuugucucaccacuuucuguuaauaacgugggcaaguguuugucgaggcuggcuugguguguguguuacauguagggucucacucaguuguggcccuggcgggccuugaacucacagagaucugccugcuucugccucuccagugcugggauuaaaggcgugcaccacaucugguuuuguuuuguuuaauuaaaauuuuuuuuuagacuccuggcucuuuaagauugguuuuguguuuuuaauuaugugcgaguguguggcugugugugugagagagcagggagcuguggaggucagaagaggcaucagguccccuggagcuggaguugcacccccccaccccccccccacaggagugccaggaaaugucuacccuuugcaagaguucuuggaacccagcauucucuccagcuccaagcuucaggcuuuuaguagcggccauacuuaggaauuaccacuaaucugcaugggugaaacugcuauaaacuauuuuuuuuuuugucucgguaguaaaagaaaggaauaaaaauaauaacccucauguuuuaccuuuugggaauauaagguggcagaguguugaguuuugagagcauuucuagauuuuuacccccacacugguuccuuccuacagguuaugaacaggcccagcagcauuucaugggacggccuugauccugggaaacucuacacccugguccucacagaccccgaugcucccagcaggaaggaucccaaauucaggccaguuggggaaaagauggggagaggcuaucuaucauccggacacggaagucccugcuggacagggaugcguggaccuccugggguuacagucauuuuguagugguggggagaaaguccugggccucgugcagcacaggcugagacccccugagccacaaccucagccccccuccccccggaacagggucucuuggugugaggcccucaugcuugcuuguggcuucccaguguaucaucugccuguuauugcccagcuugagaauguccuaggugucuggugcucacagccccucguguucugucuccgcagggaguggcaccacuuccugguggucaacaugaaggguaaugacauuagcaguggcacuguccucucagauuaugugggcuccgggccucccaguggcacagguaaguaaaggcugugugugugugugugggggggggggaugggggggagaaugaggcagggcggggguggcuaccacuggguucuuuccaagccuuacuguaaggacggcagaauccugcuuguuuuuccccucaggcaagucuuuucugggacagucagccuguaggaugugggugccagaacuuugguucugauuggguaggcccucuguagaaccacuucugggacucggagagagcuaggucuguaaaugauuugugguggauuugaaauaucaaagccagggccucauacuagacaaggucucugucgccaggcuggcaaguguccugggcacagagggcaggaagggcugcaggaggcuugcagugggcugcugggggcucugugggcucucugagccuccucuaaucucuauguaaucucugcuaugggugaucauggaaguuucugauccugugaacaagaagcaaacacuuuucauacuagugccaaagauugccuuucauaucucuuuauaacucucccuuucuccccaaaaugugucuggguacuuugaaaagacuuggaagacuguagugagacacauugaacacacacacacauucacacucacacucacucacagucacauucacacauacucugucuuucuguguuuuguauugacauggaacaugagaguccagccccacagugcucccaaagucucauaagcaccccaaagcuggugggagacacaguuacugccgguugcuuguuauacacguuuuccuuucacuggaacaaggccaccgugguggugggugacgcuuggcaggaugccaacuuccgugcauugcccugcagagaacugacugggauaacuaguguccacuaaggacaaaagggccauugcucacggcucaccuugugucugucggcccagaggcuuccagaugcuuuccaggccucucaguguucaucagagaauagaaagauaaguuuccuggggacucuuuaagguucuccagggcaccuacaaaagcaggugauuuaauuacaggcaggaggcacuggggaguagagcaguucucuggagucggagcugugcucuguuuugaagaauaaaacccuagcagcucucagguguuuggaagauuuagcuugcuugauaaacugguggcucagaagguuucaggcagaggauuugagguacacacaucuggacaccccaggaagauggaggcucuucuugccacccugaauaucuuagagguggccuggucccuguugcccucuuggagcucagcauuuucugauaugggucuccaugggucgcuuuggaucccaugugccuaugggcaggaugggcggggugugguaucuggugagcguucacagugugacuuaucuugaugcuggcuuggguuacgaguucguucccuuucaucaauuaguauucccugugacuguggacugcacgguccagccuuccucucgcuggguccuugggcuguagccaggauguggguguuaugaauagaggcacugugugcuuucuguauuccuaggcagggguuuccauuguacuucuuugugcuugcauagaugcccuaggucuaggaauugcucuggaguccgcugaaauggcuguguuguacucugauagcccggguaagguugcugugagucugugcagccuggcagcuuagcgacacgggugugggacugcacuucuuuguggagcacucugauggaugguggccguuucucucucauuauguuuucauacuuguaaauagcuuuuuuuguuuguuuguuuuugguuuuuauuuugguuuuucaagacagaguuucucuguauagcccugacuguccuggaacucuguagaccaggcaggccucgaacucagaaauccaccugccucugccucccaagugcugggauuaaaggcaugcgccacuaugccuggcacguauuuaacuucuuaaaaagccauuaagaaccauacgauuuugacauauuucacauagccuaggcuguccuugaacuuucaggguaguugagagugauccugaacucuugauccaagaagugggguuacaggugugcaccacuacacugauuuaugcugugcugugagggaaaaccaggcugaagauuugugaauguuaggcaagagcggucccaagcggagcgcaccccuauucccacccccaccugcacccccacccugacugacuggcuggcugguacuugccuccccugcaggucuccaccgcuaugucuggcugguguacgagcaggaacagccgcugagcugcgacgagcccauucucagcaacaagucuggagacaaucgcggcaaguucaagguggagaccuuccgcaagaaguauaaccugggagccccgguggcgggcacgugcuaccaagccgagugggaugacuaugugcccaagcuguacgagcagcugucagggaaguaggggugcugcacaggggcccccacagccuuguuaaguuguguaaagcaugcucuuccccccgcccccuugcuacccucucauugggaguucuuagcugugcuaggauagagguuuagggugucuucccucuugcugccagccgucacgauucuggauagucccaucccagguucuguuugauugaguuuagguuccgucuggggaggggucuaauguucugauggagucauucuguuguugauauaaaaaaagcaacucugaaaaaggaagcacuccgccaggaucaggucuagaggagagcuggagcugguggugucugugagugguugaacaaggaaacuguccagaaccgggcacaguggggucuuuaagggcccugucccccaacugagacaacucaagacucccaucuuagcugagcccugacuguccagaucagguggcugcguagguaucaagugucuaaagaacagugcugcuguggagagagacccucuuaagccccuugcuucucagugggguaggcaaaagucaccugagcugccgaguguguugauccuccuugucaaguacaaauaaaaaggcauugcauucagaccugc

SEQ ID NO: 2640 - RNA, 11648 nt, Mus musculus
gccauguccaguucuggacagcuccccggguccuguccucacugaagcacuuaugcaggaaagcccuccgaaguuuccugacaacguaucaaguccuagcacugccaauccccaagaagaugaaagaguuccucacauacaggacuuucuagcagugccggcucccccaccuccugcagcagcagcaguacaagggacuggcuaggauggagucaggcagcucacacuggaccaguguggaccuuccuuccucccauggcaugugcaaguaggucugcgugaccccacuucuguggugccggccuuaccucgucuucauccguggugagcagccuucgucagucuaguuguguugaagccaagugcaguuguggauguugcugggguaauaaaggcaagcgggcuccagagccucucugguggcggccaagccacacucccuuaacugggaaguaccugccacguagggcauuucugcugccuauuuccagccagcggcugcaugguuugaaguuccuccguuguggucagaggaacucugguguuugguucccugcucagcugcgcguggacugggcugagcuccucaccauacacuagugccggcuuuuguuuccuguaaacagugguugcauguguaggaaguaacaagcgaguauucagaucauacgaggaggcguuccucggugcaugacggucagauggccauuuaucagcauauuuauuuguauuuucucagcagauaguaagguacaacuguguuuucucaauugucucgaagaaccagaguucuuaaguggcccaguuguggagccaagucuaagucguguggagucagugcugacaucacuggcuugugcugucugucacauguguuugucucugcugcuugaccucaugggauguacccuccaguucaacugcccaaaacagacagccccuuccaagcaccguucuuugacagcgguagcagcuaccuauucaagacgccucacacaaaaucugccuuagaaaguuaauauauuuuaaauuauuuuaaaagaaacucaacaucuuauucuuuggccuuucuuaauugaugcuuuauggaggcaguguuaacauuguacaguguaugcauagaggagucuccucuauuugaagaacaaugcaaaaugaggcuuucauugaagggagaaaagagaaaaaaagaaaaaaaaaaccugucucuguucuuuuuuucucucucucauuaagaagcaaaacaaaacguuuaaaccaaacauaaaaggagugcaguagcugggcagugauggcgcacgccuuuaaucccagcacuugggaggcagaggcaggcggauuucuggguuugaggccagccuggucuacagagugaguuccaggacaaccagggcuacagagaaacccugucucaggggaaaaauuuuuuuuaaaauggaaagcaggacacugguggcaacucuuccacauggcugggaugcugccuucacucagcuugaaacuugggagcaagcucuccauggacaagaaagucaguuucucccuuugacagcacacacugaaagcaccucccugagaugcauuuuacccauggugcaccgggugcccuccagugccccucauccggcccaagggaagucuggucccaagguaacaacagucugaaggccuagaaggaauagucucuaaggaguucccugugacacagugugacacagacaugcagguagacagcccagcacgguuaaacucugaacacacgcuuuauucuuccugugaaggacuugguaaaaacacagcccagcagugcggcaggaacgucugcagugccccauuccccccaacaagugaggugugcagucugaaggcaaacuguuguaguuucuuuccuauuuucacaauagaauuuggaaccugcuggcaagccuucuaaaagugggaaaggccacugcauuguuccugagacagagucugucucacuaggcugaccugcagcugccuggcaauucugccucagccuccuggguccugagguuauaggcaugucagcacuuugggcaaaagacugauuuugaaauuuuguaauaaaauauuugauuagaaaccuacuagcacccauuuagaguuggaagacaggacgcaacucagcugcagccaauuugucaucccagugacugauaguaaagacuuugaagcagcccucaccacgggacaggguaguuuccccuauaaagacaagcagugucgaucauuauggauuaaaguugcccuguccaucccugcuccaaacagccacagagagcaguaccuaaaugccugcagagagacuucugugacuggguuuauccaguggcccagggcagcauguccucuguccuccagucacccaggggccaggccucagagcuucuaggccucugcaacuaucaggucucuggugacuugaaaagcggcgaugagggagcucagcuguaucuucucacuggugccaacagaaagucuguaccugggaauaacaaacccaaguugaguauaaagcacccaggcccugccuauaagggugagaaugugggagcugcuauggccugccauggaggcacuggagcggacagacccacccugguuagcacugccgucuguguccuccaacguucuucuccccaacauucucuugguugaagcugccgaggccggauuagaaacccagcaccagcagguucugaguugcacucggcccucuacagacagacagggcagggugcacaggauggaggcuuaggaacugcuacaaggaacucugcagauuccccucggcuguggcacugcagcagagagcugcagguucacugaagggcaguaaagcaggacaccagcagcucaucuugucacuugucacucccaacacagugauaggaaaugaccuacuuugccugcaugagcaagugacagccuauuggagcuugugauacuaguauuugguuggagcccagugugcuguccacuuaaugacagcugccagaaucgcuggggaguaaugacaguguuuacugagcugggcaaagugaaaaauugagucuguuuguuuuucuccacugggcuccuguaugucacauugccuuaauaaguggaguagcuggccaucuccagacgaccugcaugcccggugugaggagagccaggagcucagcucaggcagggaccgcucugcgcucaucauccucacacagccugcuccacagugcaguuggcacuaccccacuacuugugugaauggcacacaagcugaaacuaaagagcuuacaacaggagaggggacagccaaagaagaggggacagccaaagaacugaaacugggaacacacucacucgaugucugccauuuuggucaauaaguguauccgaacugaagauggaaagucaacugagggaaaaacagaaucaaaugagugagauuaccuugcgggcgggcgggccgcacacacacacacacauacacacacauacacacacacacacacacacacacacacacacacacgacuucugacaagcccaagcaucccucagacccaugcauacagaucaugagacggaugagcugaucguggugugggcgccacugcucuuuaucacacacgugcugggggcagcucaggaaguguuccaucuccuaugccaccaauaaagaccccacaaacauacauggccccauccccaguggucauagaacaugaauaagucagcauuguccacagugggugacagcuauacacuaaccagaaagcucauguuacccaguuuugaggacaaacuuaagcaacagauuccacacaggcucacaguacuggggaccugagagccucuccauuuggagguggcggcugggagacaaaagcuuccgaaggcuggcauccccuccccacucugaaucaucucgggugauucucagguucugccuaugcugagacugagcccugaaaugaagcaggaagcaggaacuuaaaggcagcuuccuggagacugucgaguuugcaggaacacaucuuuuccccuuugugggaugcaucuuagaaugugacuuagaggcuggagucugcugaaugucuaggaugcaucaguccuggguacggaccccagaaauaagcucaguggagacagcccagugguagaccacaugucucccaugcgcaaggcccuggguucaaucccuggugugggaagcuuguaaugagaaugaaauguacaguacagccuccacgggcucauuuccacuaacccuaucaguuacagauauuacaaagauuuuggacagagccauucagaacugcucaagauuaagggucagucacugucuucccguuucugcucugaggcaaagaugucacacucuguagcuaucccaaagcugugccuccucccggcuccacauaguuaccucuguguacaaacaagugaaccucugucaggaugucaugcagcgccaagcccuucagagucuucagcuccaugaugucuggggaggagcagcuaaggggaggggaagcauuccagaaccugcugcagggaggcuuccacaccagccccuaguggcgaccuggcaguugggcucuucaucccaggacaguagcagcaggccccauucuaacucgccccaugugauccucaacaugcuuuucuaaaagggauagccccgccuuggcagagcagacagcucagaggguaacacagccgccuguagcuucucaucucacugcacaacaaggcagugaguccgcuuagacugugaacggggaagcuccggacagccauugaggaggagaagggcacucugccuggggaugacaccugucaccugggagguauaggugcuggcugcagccugggcuucuggccacccugagcccuaaaccuagcagcaguugcccaaaaggauacuuuuguaggcaguggugaaguccugauugagcauccaguccaguauauuggcaauguccgucuugaguggguguccggugcagguguagacagucuccucugucaccuucccaaaggccauauugguacucugcaggaggagggcccaggggcugucagcagcugcccugccgcagugacaaggcacaggccaagcacagugggaaggaaucuugaacucugugcacuggaagggcugcccucugcugugaacacuacagcauguggcgcccucccauagcuuagagcagcgcagagccuucccaucagaacacacaggcagggagcuagugcaggcaaggggaaucuuacuaggagucugaaugaacguguggacuagcuggcuggcuuuccuguaaaacuauuuugaagcaaugguuuaagugccugcagugugacuguaccugaaggauguucaaagcccuucgcauguccccacuggacagagugacaagggccuucauuccaucuucacuuauauccacacuaaaaggaaacaggcagaagaguuaacuaaagcccccucugcaagagcacagacuucacccaccacgugagcccugaaugaugaagcuucaaggaaggaaagcaccaaaauggaggggacagcacucuccugcacaucuaagcuacuugugcuuaggaacaugugucacaugaguggccagaccccagccagagcuuuacuauggaccaaggcuuuaaggaaguggcugccgagagacauuucugggaagaaagaggauauagcugggcaucucaucacccagaauggaugucucagagccuucccuucuagccagcuggcagcacguacaaaaggacucagcaacagucaguucccacgacaaaagagaggcgacagccugcaggaauauaggugggggucaagaacaaucaaaagggcucaggaggcagaacaccgagggcccgagcagccaggaggccccagccggggcuuucccugccugccgcucacuccccaaacccucccucuuccuucuuguaaagcaaacucacuucucuucuuguacuacauguuccagucgagggaccaugagcucgggugucagagggccaaaucggaaccucgugcaccgagacugcaaggcagggaugaucuuggacagguaguuacagaugaggcagaaccugguguuuucugugaacuucucaaucacugggagagaaaccaaacacuucacguaagaggacccagggaaggcuuaaugauacuaagugagaaagcugccuguaggguagaggguauuaugggacauggcagguucagcuuaacccccauccuguguagcucucauucugugaagcccacacugguucagacuccaggcgaucuaccugcuuccauuucuggaguacuuguacuggcacgagucaucacacacagcuugcaaagcuaguagacguaccauuagaugcacaaaugcaucuuuuuaucaucugccacaacacuagcaccccagucuuguccaauauucgcacaauucccugcagcccaugucugaaagucuaggagcagucagugagcaacagccagcacuuaggaaugcacagggcaccaguguccccacacagaucugcccacagacagucacucagcagaacaaggugcugaaggaugucagcacucuaggaccagaagaaauccuauucccucaacccacuuccuauuccucacucccaggucucgucuccccaggcuccugaagcuguucuucccucccagcagauucccuuacaguguuagugggagcugcucacaaagggucuuuaacaggcguggcuacagccccacuccacaggaaaacacagggcucacucgguaccacagucacucauacacucagucuuuccugauggguuuuucuuuuuaccaaaggcagaggaucugacagugaaugaggagcguaagccuuauuuccacugaaugccacagacuuccaacacagaacagaagccagcccuagaggaugagaugacagaggcuauccguccugagggcgcuacgggcagccuugucugcaucacugggacuaagaggugccuccugaugggaagguaaucucauacccacaaacccuggcccuccugcuacacuccuuggccaacccgucagauggggcagcaaaccucaccucgucucaaggcguucugggcauccugagucauggcgucggcuucguccaggaucacaagcuuaaacccuuuccuaggagaacaaaggcauguggagguucccucagcuuccuuccacaccaggcugagccuccaucuucacacuugggcuaccucauguccaucuuucucagaccccgaugaaggcugauaacugcauccacaccugccugucaauuucaucccuuagauguggcagguaaaucccucccugaguuguuagucuuccucccaguauccuagaucagcugcuugcuuguggggacuagaauccagggaugcgaguaggucaagcacaaacaguucccagggcuacacacacccccaagccuguuuacuccuguguguguuugugugugugccgaugccacaucacaucacaaauauggaggaggucacagaaugacuugagggaaucaguuguccccuuccccauguggguccuaagaacugaacucuugggucaucaggcuugguggcaagugcuuuagcccgcugaaccaucucaccgcccuccuccuugccuaacugagcuccaugucaguccuccuuccuuaucucuuaucccuguuuuaaacugagaccagcucauucaguacuggaugugacucccagcugaggacccccacagagcccaaggcucauggaguccucuaucccagcauccccaccucucaaacgcuggcccaccccugcuucuguccagguguucccuucuucccuuuauaccagccaagggggaccgaacagccaggcugugucccuccuaacccgcacuaagaccuguagggagagaaauccuacagguaauucuuacuugaagauuguccuugugcuggcaaagcugaggauuggcccccgaacaauaucgaucccucggucgucagaagcauucagcuacaggaggaagagaggaugcugugacagucacacccugugccagcuacaagcuaguggcuggaagugucagccagccauucaggucuaaugacagcuaagauacaaucaucaaaaacccuguacacagccucacaauaccaucacacaacauccuaaaaggaucauccacaaaaauguaggaaauaaacacggccuggugacccugacccaggaccucugccgugagcaauugauguuaacuuuaguucucaccaccugcaggcuacugugcuuugaauaagccaaagaaagaacucuggacagcaaggggcuaagcuucagauccacugccugagucaaaugcuuuucuucugauugugggucuucuguauucaaguuagccuugaacucacauagccuaagaugaccgugaacuucugaccuuccugcuuccaccuccugcaugcugggauuauagguguauagucuguuuauuaugcuaaggaucaaacccaggaccuugugcauaguaggcgagcacucuaucaaauaagcuacauuccagucccucaaaugcuuuucuuucaaauacagcauuuagguuuuuguaaccuaaggguauuaagguugucagccaaggucccaagaguucacagacagcauggcucagagcaguaaucuaagaagauccugaugaagagacauuuuuaaagguguuugucgagcagugguucucaaccuguggguuuugaccccaaggggugucgaaugaccuuuucacggguugccuaagacuaucaaaaaaacagauaacuguacuacaauucauaacaguagcaaaauuacaguugugaaguaguaaugaacauaauuuuauaguugggggucaccacaucauaacaaacuguauuaaaaggucgaaacauuaggaagauugagaaccacuagccuaaacuaaagagauaugcaguauucauuaucaccacgaaaucuuaagggguucaacaagagcugugggcagguagagcaggcugugugggcaggguacaaccucuaaguuggccccgcagaaaguagaggcugccagguguuaaugcccuagcaagucuaagcaguaucccccauuuugacaccccccaacuccccccaaaacacacacaagaucccauuggucaaacacagccaggacucagauggucagggaauaaaagaaggacaaagguuaagugucuggaggucugagcuguuguggagugagagugucuccuucaccuccaagaccauggagccaaauucuuuaucuuuguacaguugcuuggcacaggccaggaugguggaugucuuuccugucccuggagggccauagagaaguagguguggcaggcggucuucacugaugaacuucugaacugagggacaggaaggggugacaugugucagucucuggguccuacacaaucaccuuaggaccugguuaugcuaaauccagauaugcuucaguuuuucaguguccuagucggaguagacagggaggggaaguccugaagucacaccacaguuugucugucugucuaucugucuuccacacuagcuaucuugggagggucuauuaaguugagagcagaaguucucaaccugucucgacacuuuuaggagcuacauaucgcacacauacccugccuaucagacauuuauuuacauuauaauuuguaacaguaccaaauuccauuuauuaaguagcaaugaaauaauuuuaugguggggggggguggucaccacaacauggggaacuguauuaaaagggccacaucuuuaggaagguugagagccacugguuuagaggcacagccucauuggaggagucaggucaccaaacucgugccuuugagggucauacugcuugcucccccaccccuuuagcucucuacuuccuguccacuuuggagcagagugcucccacugccacgaaguugugcucaccaagggucuagagucaacagagccaagcacugugaaccaaaaccucuucaaaaucaaccaucccucuucuguguugucuucuugggacauggggggauugggaaggugccucaguuaagccgggugcucuugcagaggaucuggguuugguuccuagcaccuacauagcagcucacaacugccuacaggauccaggguccucuucuggccucuggaggagccaggcacacaaggugcacacacuuucauguguaaacaaaacaccuaaacaguaaaaccaaacagaucuugagacaguuugguacacuauggagaaggcgacacauggccgguucuauaaaggcucagagcauccucuaagggucacccagcagagacaucgucaucacgaaauggacccaacccuccacaaggacagcagcaacagacagauacuuacugguacucagaauguccuggugagaaaugagaucggccagggucuguggccgguacuucucaacccugaaauaggauucaccguuaaguuacaaucuauauacucaagccauguucuguuacaugcaaagaagccccuucacauccuaagcagcagaggaagagaaacccuucgcgucugaacagagcacuggcucucacaaccaggaguuguucuguccccccaggggacaucggucaggccaguuaucuguauuaacugugcaauggguguuagcagcaucuguugaguaggagucaggagguugcuaacauccuccagugggcaggacagcucccccuugccccucaccaacagcgcugagacugcgcaaacggaacucauacucaaauaccuauaagcaagagaacgggcaauccacuuaugauguggcuuucaagagggaaucgagugcugaaccaugcuacagaacagaaaacccuugaguucgagaagccagacucaaaaggccacacggucugugacuccaguccugagaauuuaaauaccguguggccugagacaagucuuccuccucaggauagaccagaagaaaagaaaaugaaagcauggcuaggcuugcuucauuuaaaacaccgcuaaggugcuguagggccauucagaaugcaggcgcuggggcccuggguggaagaucaggucccugcaaguuguccucugaccuccaccagggugcgcugcuacggucccucccccgcaaauaaagaggggauagagugcaagcgcugaauucggacacgaguucgaauccaaccaagccuacccacuccuccguccucggaaccuuucuaaagaaacccaggaucaauuuauuagggucaucggagcgcagaggcgaugcucgaggaccccgaggauggcuaagcugagcucagagcccguucagguauggaagcggaggagcggcugcggcgccaaggccgggagcggggaaggaucugcaaagcuccuaggaggaagagcgggaagcgggauguggggccgcuccuaccagggcagguuccgggcccgggccgccgcgggccgcugcugcgaaggcgcggccgccgucaugacugacagaugcugcgggucccugccacugacccgccgcacucggaguccgcgcgcaaaccaacccucg

SEQ ID NO: 2641 - RNA, 6678 nt, Mus musculus
guuguuuugugggguguuccccuugcuggucaaaggaguggaaagccaccuugcuguaaaugcucuuguuuucuguagcaaucuugaacucuuuuuuuuuuuuguucguuuguuuguuuguuuguuuguuuguuuuuucaagacaggguuuuucuguauagcccuggcuguccuggaacucauucuguagaccaggcuggccucaaacucagaaauucaccugccucugccucccaagugcugggauuaaagguguguaccaccauugcaaucuugaacucuugaccaauagaaauccuagacuaguguugcuaggcaacugacuguauucaggacacccagggugggagguggauggagcucuugccuaacacacaccaagccccaaguuccauccccagucccacacaaaccagauaugauggugugugccuaugucccccacacacgagagagcuggaggcaggaggaucagaaguucagggccauccuuaaucauacagugagcuugagagcaaccugggcuacaugugacccuaauaacuuuuguaaauucagcacacuuggcaccucacacuccauguccauauacugcaugugccacacacacacacacacacacacacacacacacacacacaaauggucuuuccucaucucccauauaccuugucccaauugcauggggucaccuaaggugcacagacaaagaagugccacucacuaaugcuucacugggggcaucaagcuccagccugcaaguggauuuuacauuauuuauaucugggauaaaaaaaaaaagucaaaagaaauaaaauaugauucaggcaaauucaaugcaacucaaaauuuccaccaaucccauauugucccuagcaaugacaaaauuauuugcaagacagacccugugaccuguagaggcaaaauauaugguggcuugccuggcuggccugugauauaguggacugucuuagugaucggacuucagggagcaaccuauaggaaaugcaaaggcuuagaggggacggacagcucccugacccuggauggccaggaauggugcuagcuagggugugagccaagcccuugaggcuacugugaguuaugagauguguccaacccucagcccacagacugcauaugccccaggacagcugugaaggugacccaauacaaaaucguaaacuaacuuaaaaccauuaaggguuuuuguuuuguuguuguuugcuggcuuuuuguuuuuuggguugguuuucuuuuucuuucuuucuuuuuuuuuuuuuuuuccaacucaagugugaacuuuguugaugaccguguuguugucuccgugucaaaggugugagaugcacagcuaguuagacuucaaggcugauuuggucugccagcgaugccagcacauaagguuggcuuaaacaacaguugcuccuuacucccagaucuggggugaucucuugaggugccuuccuguagucucuugugucaucuucuucuaagaccacuaauaacaccgccuuucuccuugauccgggccucagaccucuucagagauucuuucucugaauguacgugggggacuccaacagauguugggagaagacucaauaugagcauacggggucauuguucaauccuguaucaagaccuuggaguugucuaaggcuguggguuuuaaauaccugcugcaggccucccaucucuggcucuuuguuuccacucuggcccaaguuugagucuccauaugggcccuuccuguccucaugcccugccugucuucauuccacccauccacccuccuaaggauuggucuuguuccgagagugauccugguaacgccaagccucccucugccccuguguuggcuucugugacggacuaccacacaccaagagguuuuucacagugaagauguaugcucucaccauccuacagaugcaaagaccaaacacaaagugucugcaugaccuucccccucuggaauuugucuagaauuauuuucuucuugcuuuuugacaugucgugauaugugauaaacucauauucccuggcuuuuuuggaaaccucucuccaaucuuuaccuuugccucuacuagaugaucuugcaucugucuuugugggacucuuuuuaugaggaaccaguccuguugaaucggggugcucuguauuaguuauuuuuguaacuugugauuguaaccaaaugcccgauagaaacagcauucuggcucacaguuucaaagggcucaguccauagcugccugacucuguguuucuaggccuuucuugaggcaaguguucaucaugauagugugagggugaggaggaguuucuucauggcaaacaggaagcaaagagcaauacaggaaaaggucaggggugagaugugucauugccacuuccuccagcuaggaccuuugagcaucacauugugaagccauccagggacuuggggguuaggucagagguaucaauacaucuccggaaacaucgucacagauaccuagagguacuucauugaucccuugaaaagcaugucuuaauucuguuaagaugucaaucaagauuacacaucucacugcuucacaggccaucagggccccauucugagguccugggacacuacccaaacccuagcacucucccagugacucuccuaugaguacauaugccauccugcuuccuuuguggcaaaacccugggucacccagagacagauuucccagaaucccugggccacuucucaauucuacccaugacagacaugucccauccaugagcccagauagucaaagacuucagcacaaggguguuuagaguaggcaguguggaaguaucaauaagguuauugagaugaggauuuagaaagauccauguauaaaaggucuagaaggaugaagaucuaaaacaagaagacugcauguuaacgcuccugccacuguugccccuuccuuuacccuuggcagacauugcuaaucaaucucagcacaguuuccaaccacagucauagaacauuugccacaaaggcccuggaugugacuauaugugcugagaagggaagguaguuuucccccagaaagucccuucuaauaaacauugaugacuuuagaauccaugacucagaauuuuccagagacccaaucccucgggguccacuuagugaugggaccauacaagaguuuauuuccaauuagagaauugggucaacugggaaaggcuucuuuccugguaacccugcuacugauacuauguugaaacaggaaucgacucuaacugcuuuuuggccucuucccugcacgggagucucaaaaucaaguuuuuacccaguggccucugggauccacucucucuacuccugaacucuuaaaacgccccugauaacuagguuagugaccaagaagaccuuacauggcccaucucuucaucuccugucccauugcaucucuugcccaugugcugagaaagacuaaaagugcuaucaugcacuuauauuaaaugugcagaucagcacuccucucccuggagcuggcagccaugguugauggcuaugggauacaauguggaucuuuagaugugaaagucugaugacucaaaucaaaguuugguuuuucuuuucuacuacucugaaggaaaaucucagcuuggcuauuucuucauguuuuaaaaaugucuugacuucucucagcaaccaacuucaggugccaggauaugagaugcuaagguucaggggugguggaggugauucuauccaguggccagcaauacccaaaagcagccaaccaugaaaauagagguuuguaauguacagaaggcugggggagcuuucagggguguggccaguuauguacagaugugaagcugaggucugaaggaaauggaggaaguaggaagaucagacugguugaauuagaagucugucacucuaggugcuaagugaccuuggacccagucaguucuuggauuucuguuguagcccaggcuagccucgaacccuugauccuccuguuccugguagagaaacagccacuaaauggugggauagaaugugacugcucuauccccgaucuggcugaagcugaugaaaaguucccuuugucacaccccuaaucagaucuaggggacccaauggcccagaauuauagaggacagaggagaaggugggcauugcaagaugcuggagcuuggaaagcaugguggaauuugauacacaugaucaccaagcaccacccggggaagaaacugggucacugagucacugggucacucuguucccugaaggcccaccaaccacauccgcauccuaccuaggguggaacuuugacuguccucgggugucucugcuguauauaggccagucacaagcccuucuaaaagccugcucuugucugcuuuuguuucuccaccaugcccccugccaccucuucugacagugcucagauuuaucagccaccugacccacagacccauauggacacacuagaaagcccauccuaggucuuuccauggucucucacaccccuguccccguccccuccaccccccggcagcaugcuucacucuaugaaugagccgcugggauauugacauggagauguguugauggaaaaagccuccacacccaacauaacucuccagagagauauugaaagugaugggcagagagucugacaaugacccaggggucauugugaguccuaggcugaaucuguaaugggguccaaagugcaggagagacugcauucaccuuguuggugggguggggcuucuuucauuacuuuaaguaucuguaugggcuugaggcaugggaaacagcaccuugucuaacuauagaacccccagguguggggguggggugggggugggggugguaaauggaugaggcucacagcucaccuucagcuugauucaacucacaauucuccugccccuuccucuggcugacugugaccucaccaacaaguuauucucgcucuucuggggcauacuuuggacuuucuucguguuaugaagcccuuagcauuugccguguugcugggucccaggggauuggcuguaguuaauuaaaagcaccugucucugucaucucugcacccaacugaaucucccacccucaaguguaccucucaggauauccccaggcacacgaagauggaauggaaagccaguggguaucucccacccacuuagaugcugauggccugggacuauaaacagggacaguugggucuccuaaggaauagcuuccagguccaggaugcuggcaucucccagagagaacuccauccccugaccaccaaggccuuuguagaagcaggaaucucuuccuccugucccacagcccccaggucagagccaagcgcaucaucugcagcacacaugucugucuccacaggcaagcaaccuugccaaggcaggccagacaggacagcccagcuucccacuccagacauguuguucuuacaucucugacccagugaucuuucuaggggucugucacaugucccaacagguggacagcucuccaagucaccaaccugaggaaaauaucccuccuuguaaaaaggcuuucucuuuguaaaugauucuguugccuuuuucuaaacacaaaguauauauaccuauaaaugcuauauauauuauauauguguauauacauaaagacuacuucuuguacagcccuccacggaccucaggcccacuguuuucuccaugucugucuguacugacuguugcagaaugagcugauguaugaucuugauucuccauuuuccuucuggaccacaugucucuuccuuuuccuuuuuagaucugucuugcucucugucucucucacucauugccaacauguugcugggaaagaauauuugauuuagaugccaaucaggaaggcaaguaggauggauggaugagugaguggauagguagguauauaaauggauggaugggugauggauggguaaaugaauggauagguaugugaaugaauggaugauggaugaauggauggguagguggguagauagguauaugaaugaauggaugaauggaugggugaauggauggauagguaugugaauaaauggauggauggauggauugauuugugaaugaauggaugaauggauggguagguggguggaugcauaggcaaguagaugaaugaauauguggguagaagggugaguggguggaugaauggauggauagguugguagguuaauguauucguggaugggugaauggauggauggauagauagaugggaagguggauggacagauggauggauggauagauagauggacaggugguugguggauaaaugagugaaugauuauguugauagauauguggguaggcugaaugggugaauggauagaucgaugacuggauggagggugggugacuguauaggcagguggguagguagcuggaugggugggcguauagaaagauggauggauaggcagaugggugggugggugguccacuauguauauuuguauagaucauuuauaaaguuuucuacacuucucaaaaaaaaaaauauuucuaaccuuggcuguuggacagucugugagccugugagccggcaagccuguuguuucuuguguuuagugcaauguuagugagaauccagugucugaguuauuaaugccaauaaagaauuugagaauuacugca

SEQ ID NO: 2642 - RNA, 17890 nt, Mus musculus
agccaauuugaaagugacauucguguuacagacuuggaguggauauagacgaccacucugcccucuccugucugggauaauggaaggccaucugcucuuagggggagacgguauggaggugauucugcacuagaggacaugggggugggauucaagacaaguuccugugugggucuguucauucugucuuggcuguggcucuggagggccugucucuugcaauguccucaucaauugagugaagcacgagcagacuggauucuugaucaugacggcacagacuauaaacucacaaacgcacacagcaugcguuucuggugccaagccggggagagcuggcaacagaugugacugcucauacuaaaacuugggucaacacucuaaauaugaccaaugccacuggcaaccaaggguggacuccucccagggcaggagagucaggaguuuaaggcuggugucaaacgcauauagcacaugucagaacgugccagaacauuccaggaugugccagaacgugcaggaucacccaguucuucuaucaaguuugagucaacacaccgugaaguccagagcaaacagaagagaaucacuggcaucuaacacuaaaaaucaacucccuggccagggccguggcucaggaacagcaaguuugccaaucccacacaaaguccuggguucgaucccagcauggcaagacagaacaagggagcaacugacagucaguuuguccuucuguagagcugagagaauacaaauccgaugugaacagcaagaggaagcaggagggagcagagggaaauuccauccugacgguacaaagagcuguguuccauguggccccgauaggaaaucuugagacucgcggcccguccaucccaggucaaccugaaccaaaaccacaaaacaccgugguccacuggaagggugggucaaaggucuugggaggaagugugugcuaaaggcuggccuguaaacaggacaggagaguacgggaggaggugucuugaccuuaggcuucaaaccuccguuucagucgcugguaacaacuguccugugagcacuggacauggaccugccuuugggacgcucccuagacuguggcuaccacauucgucucccacugaugguggaugugaaacuugcgacagauuggacuaagagcuggggcuuuucuuuauaaaugccaccgggcguggagagcagccaagaaugaauggccacugugcaugcacacagucgcagucccccuagccucugugacagacaagggaagggcuccccugcccugaggaugagggguuucaaggagacacagcaaacuccacugggagagucagccugggauucaggcuuccugucuaccauuucaguauaugagcacacugaggcagcucuaugaaggcucaguggggaccagcaccucccugaggcuucagauaccccugaauguugggguauggauacaagggccugcuggucagauguuaaaacagaaccacaacugagucuguacacccgcacucccagagacuaacuuucauccggugaaggagcaugcacgcacauccaugcgacgcucaggaaaugagagcaacggucaccuccuccaauguauucaucuggacaggcagagguguccugcaccaaaaaaauuaaaaaaugaccguaccuuccaccacucugaaaagucaauaaauaacuacaagguaggagcaaaacagaagcaagugccuggccucugaccagcagucccaggggccugcaaggugccaggaccucauccagccugcucuacagaacagcuccgcccaucagcuccagcugucggugagggagcuggagacacccaaagccacaaggacccuuguguggcuuucuccuucuuuacuccaguggaccagccugguucuggguguguaucuccgucaggccucacgccgggaagaguucaggcgggcucucuccauagcaguacuuggcuauggggucacgguacguguucucguguugcacacucuguuggcgaaggaagacagggguguguuagagagggucagcugcagugacagccacagucccugccagaccucuagcaugccuagaagguacuauucuagcaugacguaggauauuguuggcucugagugccaccaaauagauaggacaucccugugccauuucuucuucugcccaccagggagcuucucaacaggcgcacugcgggcugcagauucugagacugcuccauccauccgaaaagagcagaugggauggccagggcuaacacagugcuugcucccaagucugagagccucagcuccaucuccaggacccacagaggagaacgagaagcgagcugcuguucucugaccucccgugcacaugguggcgugucccggccacaauaguaaauaugaagagaacagacaaacaaaaucaaucugaaacagacaaggagauacgguggagcagcgagaucggccgcugacccugugguuggacagacccagucccuggcggaguccugacacgucaaaaugcagucaggcccuaagggccugugcacaagucaagcauccaccccaagagugcccuggcugggcacagcaagugagguugagcccagaugaugucccguccccaccccucuugacagauccccccgcccccagcaauuucuucucauacaaacaauuugaggcuuuggcuggucuagagcucauuaauuauccccuaccaaagccauacauccauauuaauuccaccuaagagauucgcagccugggcucugggcacucgaaccaaguggccauugagaacuaucucuauuugcacaagaggaagugacuugcggcuuggacagcggcaggaaccucccuagucaguucccuuugccagggugggucaggaagagcaagugacccgacuuccuuucccgcccacucaccugagaagcccccuccucauggagaccaguggaauuucacauucucuccgcucccucuauccugucccagagaugggaagggggauuaacgagcacaaagccggaguguauccuagaagggugugcuuguguaagagacgugugguugucugagaaagggcagagacaagcgcuuagccagaaagacuggguaggcaagauggcuuagccugaaaggugcuggcugccaaugcuugguccucgagauauacauugguguagacagagaacagacucucacaaguuguccucugacuugugucuguggcucugagcccagaauaaacggaaaagggaagauaaacagagaugggguuggugaugguggcagaggcccuccagcgcacucccugcuaugagaacagacagucaauggcaggcagugugugcccacccuagaagccucagauauauccaugugccugacucuccuauccccuuggauccuaauucgaaccacaacucugcccuagagcaaguacuacugccuccucucaauggcugguacuggaucuaacucucucacccccuaacacagcagaacgucaaugaagccccuuuccucccuggcucuacccagaucggucagcuaggguucuccagcucugucucucucuuccauccccagcaccacuucugaccugggaggagguccugcauuuagccaagcacaguucgaaguggucuucaacugccaugaagagguucuggaaggccacagcugcccgguugaggaagcgcuccaggagaaguugcuauggaaacaaggcauuugguauuaguaagugcuggccgagcuggcccacagggagggcaaggagccaggucucucucauucaccagauaccuaguuagcaauagcauuguccucucugcagaaggaacugugaggcagggagaccagcuccucccucgggagaggccacugcaccaucagaacacugcaggagaugccuagcuaccccccuaaaaugcacagaacacaagggaugggacccguaccuugcugggcugcaggcagcaggagacgcaguacucguaggcuucacagcagccauuggccaggcacccaucacagcaguacugcuuugugcuggggacgcugacgucgcaacagccauucgccagcagguccuuccucucgcagacauagccugaaaccagaggcagagcucagcgggaagcuagccaccuguguucccucugaggaugaagaacugcacaggaagaaggcaggcaggagccagggcacccugagcaucaggaccagacauggaaacgugucuagggcuggcuucaccugggcagaggaugacgggaaguuggaccccucagucaucgauagaucugaguuguuaccacgcuccgccccuuuccagucuacugcuugagugugagcuucuugccagaccaugcccugucugugcagcugggaugcuaauggaagcacgcagccuuucaccugggcuuuaacaaaacaguccaagacaggaaacgaggcacccauucacaaaaacaagugccuugcggauuuaaaaagcaaacauguggcuuuugauggcucguggcuguuguggucauuugaaggggcugcuaaaacaggaggccacagucaaccuucgugacucugcuuccgguguuugcauaccaacagggggagacacaaccacaagcaccccccuagaauuagggguguucucaaauccucaaaagagagaaaaaccuaauucgcuccacaacugugaaacugcaucacguagauaugugcacaucgagcgccaugucagucaggcucccucacugagacuacuuaacugcucagggcuucuaggcagacuguucccugcacugugaggaacaggacagaaaaauauguaagucuaugagggccaccacccaaccucgaacacgcccccaguggccauuuagguccucagguaugugugcaugugagagagccucagguguauggggaggugcggcgggggcggggggggggggggaucagguguguauggacccucggguguaugcaggagcccucugguguguguguauguacccuaaggugugugcaggggccuucuguuaagaauggggggccccucgggugugugcagaggcucucagguguauguguguguguagacccuaaggugugugcagaggccuucuggugaauauggggggccccucgggugugugcaggggcccgcagcugugcagcagcuguucccaaccagccagucugagcaccccagcucuguccucaagagaacaaggcuggcggaggaugacuuguuuuuuagagcugcucuggaaaacaaggucugugugggagcuggcagaacacuggcgaucggggacaccagagggcccucaauacuugggagaccaggggagacgccaaccucucccagugcagggaaaggcuggcgucuguuguuucugcugcugcugcugcugcugcugcaucucacggguagugaugaacauucugauguccugguaaacacuuccuucccagaugcccugacucacgcuguugacaaggcuucuaaacagaauucccagagagcccgugcguuccucaggauucuacccuggaugagagcaacacagcaacuccgucugugucaagaauacugugcaccccaauaacaccagcugacacuaacaccccgauaucacccacugacacucacuguccuuuccuuugggaagcuggaagcugacaucucaggccugguccuaccguuaccaacucccagaucucggcuuugaacucugguacucaccucuccaugaccaggucuaaucucugggaagagagagcaagcucacccaggccucucuccccaugugucaugcaaaaauuaccuuuuacuuucugaagucauccuuauguuuaauuggaugugugaguacaugugagugcagauuccugcagaggccagaagagggagcugccuguccuggaugccgggacucaaaaccagguccucuggaaagagcagucagugcucuuggccacacacccauuucuccaaccuuucuuaucugauacacacacacaaacacacacacacacgcacacacacaucauacauagaacugggucaucaugauguuucaaaacacauauacaccagccggugugguggcucaugccuugaaucccagcgcccaggagagaugggcauaucucucugaguucgaggucagccuggucgacagagcgagccccaguacagccagggccccacagagaaagccuguggugcguaccagcucuaaggauguuauucuuaccaaguccugggagaccagggcaggcaaauguguuggucuugccugggaaauuaacuuccagcuuuugaaaaguuugugacucuaauuggcuaucuuguuuaacagugcuguuacccuggcgacacgguggcaucucguugcuaaacagcaucaacaguugcaaguuuucuuuauuaaaccacuucccccauauuuauaauggcaaaguaaaaccugcugcccuugugggauuuuuauugauuaagaagcugaaggagugugagucuuugucugaccuaaauuaacaauuuguagcuauagcuaugauaaaaacugccaucuaacacuaaaacagccuguuguccucugacugccacauacaugacaugguguaacagacacacacacacacacaaacacagaaacacagacauacacagacacacacacacacagacacauaaacacauagacacagacagacagacauacauauauacauagagaccacacacaaacacacacagacacacacacacauacacacacaaacacagacacagagagacacacacauacacacacauauacacagacuacacacacacagagacacacacagacacacauauacacaagacacacauaucacacacagacacacauauacacacagacacacauaucacacacagacauacacauacauacacacacacacacacacacacacacaccaauuagagagacaagaugaggaaccccaugccugugccugguaggcgguggccuggcucugaggcuaaggcuggugcuguaggcagagggaaaugcuaggagucuggguguucagccaagccucccagaugcugcagggagccugggauggagaggagagugugaaagacagacagggaaaucccugaagacuagcaagaagggcaaaagcacugggagggaaggcuaucaaacccagagucucugcaccuugagugcagggagggagacauacccagcucaucagugaggagguguuuuccuuggacagaguuccggcacugguugcugggucggcugcuguugccuagguuaaacugcaccuuccacgggaugggcuguucccggucuugaaccuggaggagguuccggucucucacagcccucucuuccugcaaggagaccacagcgagagaggaggggucaaggcgcuuuuccugcauuuucucacuugcccuaaaggcaucuauaccuccaucucucuacccucgacccaacccuugggcacaggugccaucuaugucaucagggaaaccuggcaaguuaaagcuacucuccccaguuacugcauugaugugcagggccccagaagcagacaaaagauucugugaaauccggggugggguggggggagcaaaaacuuuucucucugcuagcaacuuaaguuuuuagauacuaauacacacaccauggaacagaacacaaagcccaaauacuuuuacaaccaggaggaaacuauguaauucuaaucaucucaggcugucugauaccucuagaccaggaggccucagccgaauaagugacaaguacucacauacaaaacuucuaaaugggacuggggaugacuucaggaccagacgaagccugacaaccugcaaggcucauccuuugugugacagcacacagcagucacccuuaugauuacuuucagaugccuuucugccuacacggcccuuugccuugcugagccaggagaggaguggccccugggugagagccuggaucccuacaggauccacaccauugagcuaggaggagaagcccagcugcuggaaagauagagaagcacaagguggucacaucuuuggaagcuucuagccaugaauguguaacaaaagaccucuaaaaggcccucuccuguugcgcuucucauccuguaguucaggccugccugaaacucauggcaaugcuccugccucggccuccuaaaugcugugauuauaggugugaggcaccauggccuguugguuuuggagguuuuuuuuuuguuuuuuguuuuuuuucuaauuaauuaauuaauuuauuuauuuauuauauuuaaguacacuuagcuguagcugucuucagacgcaccagaagagggcaucagaucucauuacgggugguugugagccaccaugugguugcugggauuugaacuucggaccuucagaagagcaguggggugcucuuacccacugagccaucucaccagcccccaguuuuggagguuuuaaggcagggucacccucugcaaccccaaauggccgcagguccuccugcaacagccugccaggugcugcugggacuacgggauuauggugugcaccaccacgccugcuauccccauggcugguguuuuuuaagccucaauaauguugcucaguaacuauggagacccugcgcauugcaucggauggcaacacagacaauucagggaaacagacaggaucuuuguaguuacugugggaaggcaaucugggaaguuguugaaguugaauaugcauaaaccuugcucuaggaaacuuuacugagugccaucccacaggaaccauacacggagguuucccauagcucucuguuucaaugguaggaaaaacauaaacaaaacaaaaaccccaaaacaacaacaaaaaccuagaaacccaacaccacggaaaugucugacuaaacacuagcagggacacacuaucaucagagcuaaguucucaugacaccuccccacauguucaccucugaccugugaccucugacccagggcauacuggagucaccaucggcugaucucaacacuaaguggauaguaaagcauuuccaaggacccacguuaucuagauaaucacauugccauggauccaccaugucaaugugccaucauuaagaacacagccuccacaggccagcaacagcccccugguucugcacgcaggaugacccugcaguucggugugggggugugagaaaguccugucaaucacuugcagauggaagugccagacagugccuagccuccccaaaguuugaugaacccucugagguaucaucagcuggccucucuccuaccacaagcccggcaggucuagguuccccuuuuucaguuugcucaauguaaaaacagucucuucaagauggcuuuccuguggccugccuuuccuuuuuugguucuuuuaaaggcuauggcuagguggcacaggacaggacagguagcuguuaccucaguuacagaaagagaagggcugagagcaagaacccgugggagacaggggcccccuuaggcgcagccuguggaucaggagcagaccuuagcugaagccuggagcaauggaccccagaaggaccucaaccauggacccuguuccuggugaacaggagggcaguucuccagcaccugaacgugucaaacaugaauauucgaaaccucuaccguggcuaaaucguggcuguggugcacuuuuggaggcaggguggaagggacaggagaucuucuuccacccaguggguuacuggacuucccuacugaguucccucugggcugucuuaucuuugagcacuucaccaaguauaugauuuucuucauuccagacccauucaaagcugggcguggcaguacgaauauuuaauccaguacucaaagaggcagaggcaggugaaucucugcagauucaaagccagccuggucuaucuacacagagaugauucaggacagccagggcuacagugagaaaccuugucucaacaacaaggaaaaaauauccauucaaaggggauuuucacagagugccauggacacuuuagacaagugcuccaaugggcugcugacaaaggcuuccgugugaaucagauccacccaacccucgagguguuagcuguccacagauccugcagaggaaagaugggauccggaguggggggagcacaagagaauguucucuguaaacaguuguguagccugcauagcuaauggacauagccucuccucaaauuuucaggagguuaauuaggaagugggcuguguuaguuuuuauggguaaucauaacagucaaaugagagacaugucccauggaagacagugacagugacaguguacucacauucauaaaauaauaaucauuuuuuaaaaagauguuuuuaauuuauuuuauguauauaagugcaguguagcugucuucagacacaccagaagagggcaucagaccccauuacagaugggugugagccaccaugugguugcugggauuugaacucaggaccccuggaagagcagucagugcucuuaaccacugagccaucucuccagcccccccccccaauaaagaacucuuaaaaacgagauuuacuuuuauuauuguguguaugugggggugaggguuugcauacagaagccagaagaaggcauuaaaucccauggaacuagaguuagcaggugcugcuggcugggaacagaacccagguccucugcaaaagcagccagcacucuuagccacagcgccgccucugcagcacccuccccuucccccagagaguuuguaaagauggggaaacacuuguacauuaauugggggggggggaauggggggaacaacagcacaccucaagugagagaagcaaaaccauucagaugaaacagaaggaagaaaugacacccaaaugucccaguagcucuuccugugggugaccccgugcccaugccaugccucgaaaauguugcagagcucaagucuuuguugguacccaauuuaaaauugggguuggguaaggggaacaacacagggggcagcucucuacacucaucacgucuuauacaaugccuauauggugguuugauuaagaaugcccccccccccccgcgccccagguucaaguauuugaauacauauauacuugguccccaguugguggaauuuuuucggaaggauuaggagguguggcuuuggaggaggagaaguaucacuggggguggggcucugagguuucaaaagcccaaguuagcgccccagccaaccaaacucuaagcugcccaggucacgguguauaaucagagagauagaaaagcaacaaagacaacaaccuuagacaaucugcaucuucccagcagaacucacugaccugcccucccucccucccacuccugcagcaggcacccagggaguagacuucagugcccgcuccgccuccaucccccgugcauaggccacucggcgccacucaccauccccaacacucuccccugauggcauccucucugcccucccaucucuccagcaauuuaaauuauccccuaaagcauuaauuaggauaaaaaccaaagaaaagaggcaucccaggauccaaggcaacgggggucagcagcugucugggcagagaccguuguacaagcuugagaagucucagggaugcagagccaaggacgggggggggggggggagggagggaggggggggcgacacuugugcgcaccacagccuccucucuaucugggaugagcaucuuuucuuccuagcccaccuccacgucagagauuugaggggaaggccaggccaagugagacccaccgggcacccagcugcagguggcagguggcagucagccaagcaagaaaccaagucaggaugggacugacucacaauggcagagcacagagaagaaccugugcaagaacgacugguccaagccagugaggacccacagugagagcucgugccuacagauggauucucaaaacucagugggcuuagugggugaaaggugcuugccaccaggccggacaaccuaaauucaauccugggggaccaacaugauggaaaggaaggacucccccaaacuguccccugaccuuaugcacucuuuccuuucccacaacacuacacaaacacacacacauaaauaaauaagaaugcaauacauuuucagacaggaaguugacuggagacuguuuaggucugagagggagagcaaguccaugaagguguccucaauugugacugugguaacaguuaccucacugugaccuuacuaaagccacugggauaugcacucgggugagcuguguauggcuuuggaaggugaacuguaggucagcgugugcacaugggcucugagcauggccuacccacucacaagcacucagaaauguccugcucugugaagagaucuucgcagaucugccaaauggugacacacuucugucacauuauauaccacgcuuguucuugucacagcuaauggaaguuaacaacucaggggaggaaacacagucuccaaaagucugauuuuucucuugaauuccauuuuaugucuggcaguggagaacaucaacugucucugagggagcaggcucucucccaagucuuuuuauuuuuuuuuuauuuuauuuuuuauuuuauguauaugaguacaauguugcuggauuuagacauaccagaagagggcaucagaucccguuaaagauaguugugagccaccaucugguugcugggaauugaacucaggaccucuggaagagcagucagugcucuuaaccacugagccaucucuccagccccucucccaagucuuauaaacaaaccauugaccgaccacucauuccucuaggugagauguggggagggguggggcugacuaguuuaacugguaacucaugugucagcuagcguucaguaugcagaaggcagcacaggcugccuaccucccaccucagcagaguaguugaaagcuuucaaucggucauuuucccagccuccuccucagugagccagcaacugcaucuguccaggcaacagggaaagaaucuacucuaaggcaaaugcuaauggcucaugcccuagugugcugaaagcacuuucuaccaugaccgguuacuacuaggacaagugucaccacagcugaacacagccaacaugguuuauuaaguguucuuucaaaacuaacucggaccucacagacuccuugaagcgggcucucuuggggugugcaaacuaacuggcuaaguuacucugaaaagccccaagagcuuaacacaauacacauuucuugucugugccaccaguggugucccucggugagcaaagacagcacuacagggugggaacuacagauguaucuagaccagacuccuccccucucccaccuccucaucuuuaaggaacucucccugcagacugggaucuauuacuauguagucacuauguagucacuauguagacucauagcgaucugcaugccucaaccucccaagugcugggaccaaaggugagugcuuccauucccaacuuuaaaaacacuucacucgggaugcuggcuuacgucugucaccuugucacaaaagaagaaccucaguuugaaaaucccagcuggucugcaucacauucacaauccacaccuccucaaagaagccuaaucccuaaccacacccaaguccuaagaaaaggacuucgcuccacagcgaaguaguuuggccacaggacaugaagaugagacagaugagugacauccagacugcggcuccacuucacaaacagaaggucaagcaacacagguagaaaacagccugaaaccagagaauggaagacaugacagccacaaaugagucuuaggcaaagcaacccuaacagucuauagggaugccccaagagccacacaggagagugcuccaagaaccaucaggagagugcucuaagaaccaucaggagaguacucuaagagucaucaggagggugcuccaagagccacacaggagggugcuccaagaaccaucaggagaguucucuaagacucaucaggagagugcuccaagagccucauaggggagugcuccaaaaacagcacaggagagugcuccaagagccaacaggagagugcuccaagaccuucauaagggagugcucuaaaaacagcacaggugggugcuccaagagccaacaagagagugcuccaagagcugcacaggagagugcuccaagaguuaacagcaaauugcucuaagagcuucacaggggagugcuccaagagccaaaaggagagagugcuccaagaaucaguguuaaaacacaggugagggcuauucucuguacccuagguagggcaagagcacaaggcuggcugagguaucagccacucucuuaaagguaucacaucccaaccugauaguacaccccaccaaccacuucuaagaccuccacugcacaggugaaagccagguagacgugcaacaguuccaggaccaacagaguugcauguagcuauccaguggugaacugacugccuacccccaucccaaaaucaauguuaaacccuucacacccaagaugacauuagcagagcagugaaaacacagacugagaaguggggugucuccuauguaaccagaauucugugagaucaugggguggaguccccaugaauggacugguagccuugaaaggggcugaagggaccaggguguauucuccacuaugcgagaaugaagcaggccagggggcaccaccacacguggaaucaguuggcauccccgucugauaccucccagcugccagagugcaugugugguguucaggccaccagaguccauggugggguuucaguugcccacacucagcacacaguucuucucacccucauggaacuugaucucacacagguucuccacauguccagaguguuuagucaucuacuggccaaaagccccaucaugacaaggggacagcacaggauggcaaagauaaucaguacucuggcuucagaggaaacagaacaaacaaauaaacaaacaaacaaacuagagguuucauaaugacccuuguauagucuuaaaucgcaagcaaaaaaaaacaaaaauaaauaaauaaauaaauagaugcaagcaaggcagccagggguggugcaugcccucagucccagcacucaggcagaucuguggguucaagaccagccuggucuacagagugaguuccagaauagcuagggagauacuuauaccuacccuaccacagacagacaggaagacacacacacacacacacacacacacacacacacacacacacacacgugucaaguaauuaaaauggggcuguaggaaaggucacuacguagacaacaucugagccaagauuauuaaaaauaaauaaauaaauaaauaaccuggcuuaggagaaaagucgucaccucaaccaagacucacuugaaccaacaucuggucaacaucugguccccaggaagugccugggggguucggguagagaugaaggcugcaguguccgaacaaaacacgcaggucucuguucucaaaaaacauuauguugagcaagagggugagguaacacacaagcaaacacacaaacaagaaaugcuggguuaguaauuaccacaaaggcaaguggccagacgaugggcaggagacugcacuacagugaggcaccgggcauggcccgaaucacugacuacggucaguuagauccaaacugaccaaaaguaguucagucacacagacaauguagaugaacccucuucgcuugagcaaaggauuacacauuugagaaggccugugguggaaaccuugucuagacuaucacccuaggacagacugugagacaaagcagaagcagacuggccaggcuauggcaccagaccaggaacagaugacagugucuugccccugaaggggcaucagaaguaauucaagcaaaugagugucuuaguuagcauuugacugcugugaacagacaccaugaccaaggcaacucuuauaaggacuacauuuaaaugggcuggcuuacagguucagagguucaguccguuaucaucaaggcaggaacauggcagcauccagacaggcaugaugcaggcagagcugagaguucuacaucuccaucugaaggcugcuaguggaagacugacucccaggcagcuagggugagggucuuaagcccacauccacagugacacaccuacuccaacaaggucacaccuccuaauagggcacuguagagccagaguuuuggggccugaagugacaggaagaaaugaacagccuaacugugucaacagugaugacauacgucacuuagugagaugcugaggacuggagagguauaaaucuggcagaagaaaggcaagaguucuguuccaggugggugcaauggagacaauuaucagaauguggaaaagccaauggagacaauuaucagaauguggaaaagccagacaggauuacaaggucaaaucugggcaagagaguaagacacgcccccccccccccccaggagugacugugcaaaagcgcaaccauucaaaagacggacugugauacagaaaaccagagaacuauauucguaagaacagcaaaacaggaucaaagggugcacaggagcaggaaaggcggaggggcaggugaccuacaaaaugcaacucagucaagugugguuucuaggcaaaugcugggaacugguuccuacuacagugggaugccaggucucuaggaacucucuaccaggacaaaaacgggaaagggagguugagaaauuaaaaauaaaaaaauaaaaaauaaaaaucuacccaaccaaguugugccccaaaagggagccuguugggucacccaggugaacaggcacagagagcccuuggccacuuccuggucuagccaucucuaccuccugcccaucaagaagccuggggcugugcggagcagggaacgcgacagaggagggugcacaggucugaggaccccauucugccuggccuaccagccagaucccgcacggaagaggggcgguacaaagaccugcagugggacgccucccuuagcggccuucgauucacaggaggacaggaggaggaucacacaaucggagggaggaggacuagaggguugaggacuagagagcugaagggaggaccaauggaugauccagggacugaaaggaagaggcucagaggcucagagggaggacugaauggcugcauaucaggaggacuacaagguggaggacaggagagaggagcaucagaggacagaggaucaagggagggaggaacugugaggaucgaggaggagggguuggaaaagaacagagggugagagguaagaaguuggagggcagaggagaacagaggauggggaggcagagaauucgagggaggaggaggaguggaggacggagggagcuagggaggggaaaggagaagggcagaggacaacgcaacggagggagaagggcugaaggaggauuuuagaucagagggaggagugcucaggaggaggauuagaagaacgauggggagaaggacauaguauuugagggaggaagcaggaucggaaggacggagguccugagagaagucgcuuaccugcuugaaggugcugcugaggaaguaaacuagcgagaggccgaaaaccagggcgagcacccagcgcuugcgcaggagccggcgccacagcagcgccgccagguucagcaucccgguagggcgcaggcgcagagacgaccccacggcaugaccccugcaauccgcuuccagcacugcuuuaccuucccgcagccaacgcgccggccacgugauccgccgcacgccccgcccca

SEQ ID NO: 2643 - RNA, 1347 nt, Mus musculus
uaaaaauguauagagcuccagcaacucuuuccuggcgguggcagugacauuuggugguaaaugccaucuuugcuuuuuauugggucguauuaccuagcucugaaaacauucgcguuguuaaacccggcgcuuacgcugauaaugggagugcauggucuuuaaauacgcgcuuugugccugaguuacuguguguguguagcuaugugcccgggagaguacgaauuuguuuaaauauugagcaaagauuuguaaacagauguaaggcaauuauguuucaagcguagaauauaauuggaaaauugguugaacggccuauuuaauuuagccuuaaaaacucaacuuauuuuaguugugugcccaauuuugguggggagggugcugggggggagggugcugacuuuuggagagcaugcauuuauugcaaauuauuuucuggaaccccugcugcagauagaagcuuuauuuccuuuuaguccuuguuuacacuggauaaauaauuuaguguucaaauuguaauuaguuacauuuaauuauggguggcauagaugcuuuuucuccccuuggagacuaguggagaaagaggaauuguugccaacuuuggaagugucauucuguuuucaugcugaugaagaaaucaagcaugauuuuggccuacaaagacacaggagugacacagucccccugcucccacucuuguaagcaggcugauuccugaucaccccgaauuuuauccugaggcuguuucgagguucaguuagaaguuggggguccuuccuuuuaccccugugguaauuuaccguugaucuuuugaugugaggauaaaacuacuucugucucuuuuuucaccccccccuucccuugucugucauuuauuauuagguucagggaccuucauagaucagcaaauguauugacuaggcgguauuuacccccccccccaaccaauuuggugacugggugaccgcaaugacacuuuuauagguaauuaaaauaaccaagucagcugguguuagcuggggagagcucccacuugcugugcaucaggcugagagcagugcugccugugugcauguggcuaauguauacacaguguguugugcaggcaaaugcaugccugcugacugcacagcuccacucucagcuucagggaucuaugggguagagaugagaugguccggauucuuucuuuaauuucuggacuuugauuuugacugcauucuggguauuucuccgcuuaaaccaaaaaguugacuugaauauaaaguacaauuaacuuuuuuggguaacuccauugaaaugcagaaauggcuuagauuaguuuuaaaauguaacguauuuccugauacc

SEQ ID NO: 2644 - RNA, 6312 nt, Mus musculus
ucauugagacauuggcuuuguuuaccguguguguuucuccaggucugcauucauucauaaggcagauuaaagcaaucaggaggacucacggucgcugccaccccuaacucuguucuugauaaaccuccagggcuguuugccuugggauuacagaggaugugagauccggaggcuccaccaccagaccucccugcuuggcccagcagucuggaugccuccaucuggcuucaagccagcuuccuccacuccugaggucuuuugugcagcucagguaggagcguuuuuuucccagcaugcucugggccccuggguuugugggaggagccuggguuuuguggaagagagagaaaggagaaagcauuacacuaugacagacaggugcugagccucgcagcuggguaaauagagccagcccgggggggggggggcaggggggcgggggggauguuuuuacccauggcuuacagucacugaagaugcaggcugaaagcgcagggcgagucaugcccaucuccggaccugcacugaucuuagcccucagcucccauuguuuuguggguaauucucauuguuuuccuggguuguauacucagcuuugugucuucugguuuucuuucucugggauuucucuagaaaccuguucuugcacaccgugaccagucagcauuacagcgucuauuggggggaaaaaccaacuugguuuucaagcagggaauagaaaauggggaggggagggguaauaauuagucuugaaguauggaggauggaaagaucuauggacaucgaccucacaguuaacgauuuugaagucacuggaaaccaauggugcguggguccaagagaucggaguucaaguucaggcugaccaacuuguaaggugcaaguuguggaaaaucguucuggaaaaaaaaaaccuagacuaggucuggggaauauaguuccuuuaguagagugccugccuaccaugccugaaguccuggguucaguucccagcacuccauagacuagguauaguggauugcaucugucacuccagcacuugggagguagagacaggaggaccagaaaccccuguaucuggaagcuggcacagcagcuccugauggcagccaagcugagcagagggccuagccaagauggaggccuacggggagcugggcuuggcccuggaagcuuaguuuggcaaaugcuuuauuugacauuaaugaccuagcccuaaaauggcauaucuuuuuuuuuaaugcacuacucagccauagagccuaauauccacacagauucacauggaagacucauaaaccccuuuucccugagagaaaagcugguguguguguguguguguguguguguguguguguguguguguguguguguguguucaggaguacgcacauguggguggccugcugugccuagacacacgggccugcaaauggccauaguguugcucuguguuggguuccaagcugaaauguccucugauguugucccaggauugacuucagucagggcugcagguaccacucugugcaaagugccugccuugcuggcacacacaaagaguucaguuuuauucccagauuucaggggaaggaagggagggagggaggauggggggaggaaaggaggaauggaaggaaggaaggaaggaaggaaggaaggaaggaaggaaggaaggaagggagggagggagggaggaagggaggagaaggagggagggaagggagggagggaggaaggagaaagagggagggaagggagggaggaugggcaggcuagcugggggugacagcuucgaaucccacugcuggagacaggcucauggggcucauggcccacugucuuggcuuaagcugcaaguuacaggcuggagagagacuaugucuaaaauaaacaaacaaacaaacaaacaaacaaacaaacaaauaaaugugacugacaagcagaggcuauccucaggccuacacacaugcaugcaugcauccuugcagacacggagacauacaugcacgcacacacacacacacacacacacacacacacacacacacacacacacacugaugcagaggccgugacccaggugccuguguaacuucucagugcugacccagcuaccagcuccaugguguuaacagguuccugguggagaagcccgagcugcuuugggguuugcugucacuguuuacuuuuugcuuucuuuugguuuugucugcggaacuaaggauugaagcagagucuucaugcacccgaaguaagcacucuacagcuuagaugcacucccuaggccugacucuguagcaccccccccccaauaggcuugagcuucagaucuucccaccucagccauucaaguaguugggauuaugggccugcaccaccaaacucagcuuguaaacuggacacaaugacgucugaucucuacagugacccaaagaaguagggacgaccauuugaaugcaguuauaaggcaaggagaguguuguccaagaccagcagcuagacaugauccacgcaugucagaagcuccaguguccccuuaaccacagagcccccggcacccguaaaugagcagauauauacagggacgaagagguggcauguaaugagagaaggagggugcaaaagacauggagaaaggaagaaggaaaaucagaaaagaacugccgacaaugagagggauuuuugauagaaguuagacaggugacagacaacuggggaaagaguagaugcuaacccuggguugggugguguugagagcaggguccccaggagcaugccucugucccaucucucugagaagaagagacucuuuaagagacacaagaacacagaugccccaagauguccccguggaacacuggccuagugcagacaagccgcugagcaucugacuauuucccaaauauuugcacagcagacuaccguacuuuggcuagcuucccuuccuuuuguuugauaaacacagcuggccugcaaaggagggaugagguaguccuauggagaggguccucaagggcaucuuuucucagccaaagcccacuuuacaaaauacagauaaauacguacacaugggggaccacguagaauucccucugaguggcuuugacagcuucauuucaauuugacuugaguuaacucucaaggagaaggcucguaggucucgggggagggggaggaggcaguggggggaagcacaugggaaagauuugcaccagucuuggugugcuagaggggagcugggaagagaggaguagcaagggggagagugaaugcugucauaagcugaagacaaagggucagaguauagaugagugugugugaguacaucccagcagcuauagggagagguucucaacccuuggcugaaaugugagcagaauggaauuuacagaucaaagacugucaucuacauuaacuacacacacaaacgcaugcacacacacacauacacacaugaacucacacacaugcaugaauucacacacaugcacacacacacacacacacacacacacacacacacaauguuuuagagaagggaagggcuuaggaguauauuucaggggaaagaguucagaauagggauggggaagguuacaugucuguacacacaugcaucaugcaugauacauacaaugcagggcaugcaauauaauguacccaauauacacaauaggauacacucaacacccucaucacaauaaccaauauaauauauacaauaugauaauagaguggaauacaugcuaauaccacacaaacacacagcauucauacaaugcucacacuucagugugcacaauacccacguauucacacugcgugcagcacacacaguacauacucuagaauccauccugugcauaauguacagcccagcacgcacaacacacacaggacccugugucuccauggagugaugugaccugggacagguggucauuugucauccccuaauaagcaugaucaccucuggccugugucugagcugaaaggaaaccuacccaugugucaacguggugaccucugugggaaaggccagcagcuagcuguagcaguuucuggucccagguugguugagccgcauccaggguuuccuucccugaaggaaaccguuuuuuuaucauuccuaauugggcugagccacaugugacaagccugcgguuucgccuuucaggccuggggagccucgguuuccucccuccagucuuagggauucacuucucagcaggugcccauccuguggucagcaagggggaucacuuuucagaugugucuuggaaaugauggauggauuucccucuucccagaggagagccuuuucccagccaccggccacacgguccugaugucaccauccaccaucauuauugugcaaaauaaaaguccucgccaccucuaguacugacagugccugcagcacccucagaaguuguggaugguuagggaauuauuacccaugaaauaaauaauaagaauauuccacaaaacacccgcagucagacacacauacaugcacauguguacacacacucacacacauucacacacuccacaugcacaugccuuuugaauccugucauaaauguuucccagauacccucucaugcaauauuugcaauucuaccauuacacaauaauaacaauuccaucaaguuggggucuagugcucacaaagcccuggguucaaucuccaguagugugaugaugauuaaugguaaaaauaauguuguggguugauucauugucaaguccuucauaugaagcugauagugaaugucgaugcccaguaauauccuguuuguuucacagacagugacauggaggaguggaggcugagucacucauuggcuacagcacaaguaacaugugaugauggugguguaacagccuugcucucagagacagucuuacccugugcugguuggacaaguccauaaaacaaagcaaauaugucauguauuauauaaagagauagacacauagacagaugauagauagauagauagauagauagauagauagauagauagauagauaugcagacaggcagagaggcagauagaugauagacaaaugauagguagauuuauugauagauagauagauagauagauagauagauagauagauagauagauagauagauagauagauagaguuuggaagauuugaugaacaaauagacaauagauacaugaaauauggucugguagaugauaaaugauaaaaauauaaaauauagauacauaguuuauagauaguuauguagaaucauguucaaacaaaaauauaaaauauagauacauaguuuauagauaguuauguaggaucauguucagaugauagcuaccuaacuagaugaucaacagacagauagacacauggauuacaaauagaugacucauuccagugacaagucccuugccagcuccaaccccaccgugaugaaguuaucauuuauuuuguaaugguagaauucgacuauccauaucuguucagugacacaaccauuaacuguucacugagcccccuuuaugugccaggugucauaggcaccuuggugaggaacugcaagaugguaugacaaagaauaaacguucuuuggaacucuagauuuagcaucacuuaaccaacccaagagugagacuuaagcuuagauguuacucauuuguguguguauguugggggggggggucaagaagggagauugaggcagcccagaaauguguugccacugauugggccccuggagaguguagagcuguuugaaaccagggaggaggguaccugaggcuaggcaagcagugccugaggcuaacucaccuuguccaagaggcccccagaaacgauguucccacuuucaaccggcaugcuguagaaugacagucuguugucugaugugccucauucuguggcacucaaaguaaagaugugcaggcagaaggaagguguucacugaguggcucugggcaaagagaaccuaagcaucucaucucggugagggacagucagaguccaccuagagccagaugcuauagagcagcuugaaugaaagagagucgaagcaaggagauaagaagccccugacccaauuaguaguaaccuguugaguucaguauucagauaucccuaggaaugacuguaaacuugucacagaugcacagguacgggaacacacaauagaaaauaauuuucccacaugcagacaaacucacuggucuucaccaugacccuaggaaccaagcagugcuggggacgaccuaucuucauguacagaagagaauagggguguugagucugagucug

SEQ ID NO: 2645 - RNA, 5736 nt, Mus musculus
guguaagacaguccagccauuuauucagcacuccacuaagaacuuaaaacacauuauuaaucccuugaugguuaaucuuaacugucagguuuauggauuuagacucacuuaagggacgcaccccuggguaagucuuugaaggaauucccagagagguuuaagugaggugggaagacccacccucugggccgcgugcagcgccauucccugggacaggauccuggacugaaucaaaaggggaaaaccagcaucucgucucuuuccacuuugcggccauggugccauguggcuaguuacaucacacucuugcuaucucaaauguaauggaacuguccccucagacccccccccccaaguaaacuuucccuuccuuucaucagauauucaguccccaucacgagaacagcagcugaugcaaaccuaccuacaaaucauaugggaagaugguuacauucauuuuguaaguaagaaagcugacagcgaggacaggagcugugagaggcuacacagccagcgagcgccagagcugggcaccugguccuggcucguuugauuucauccgaccucuugacaaggaaacaguaaacugcucagggguuggcagaucuaugacuacgaugaagaguuaccauucacauggcaguuuuaaggcagugguucucaaccuggggggggggucacgacucuuugggggaucaaguggcccuuuugcauggggggguuagcauaucagauauccugcauaucagauauuuacauaaggacucauaagaguaucaaaguugcaguuaugaaguagcaacgaaauaauuuuaugguugggggaucaccacaaaauggggaacuguacuaaagggacccagaauuugcagguuugggaaccacuggcuucaggcaacugaaagucacuugcccauaguacugaaagccagaagcaagaacucauuaucacugauguggaagccaauguccagcagggcugcacauccugugggagaccuggaguggguggggacucgcccuccucuuuccagccucaagggucagaggcaucuuugggguguggcugcaucucugaucccaacauccacuggaagaccccauguacugugugacaccucuccccccagccucucaaacuuccuuucguauuugucuuauaaagaugcucgacugggcugggaaucucacuuagucagcaaagaguuuguuucccaagcacucggaccagaguuuggugccacagaaccuccauaagauggugccugguguggaggugaacacgugucaucacagugcuaaggagaugagcauccaugccugucacugcccggccacacaagucaaaucguagagcuucauggugugcaagaucugucguaaagagcaaaguagggagucuccugagaaugagaccagagguuaacaucuguccuccuccguaaacacacacauccauaaucacgugugugcccacacaagcagguguacacauaccccccagacacuugucauugaguucaucauaccuacaagguuaguuuaaucucaauauuccuauuuaucucugcaaggaugcuucuuuuaaaugucuuguagauucugggggaacauugucauauguaaggacaucaacauugagucagcuguguggugucgaucaacugugaaguagacccagauuuaaggccagucucacaugauuugacuagcguggccggacugugacaacugaggacaagcaagacccacucaguggaagggauugugacuggcagguuagcaggaaguagcugguaccucauuccuauaaugaaauggcuagaaggagaucugacuucaggcacgccccgcacugugucaucuuuuggaccagcuuucucuguaaacucccaguugaaccuguaggagacuuccuuugccaucuaggaggaaagcacuugggaaaggcuucucaggccuacccacuucugacucagcacuagguacucuugcucgggaagcugcucauguccugacucagcaggcagagcucuuauacuuuuggguugggagauggucuuggauuugguguuaucuccagucucuccacagaguacuugggaaguagauggcagaucugccuacccuaguugggaggaugggauuuaaauggagagaugaaccagggggugaauuaacuuugccuggucucuuccgaucuuccacacaugcuccuacuugguccaagcaggaacccuuguuugggaagggaggaggcugaugagugacauuuuccuuuuucccuucuuucccucucagaggccccuagguggauggucucuggccaaggcuggagggucugaaauaccacaagaaaguagaccuuugaaguccccucugcucagccaggaagcagugguguugccccaaggcucacccaggaaugaaaucuucaggaacuuuaggcugaggacuuaggaggcccccagagacuugaaguuggaaccuuaauguugguuuuaggggaaaaaaauaucugaacaucuggauggggcugugggaggaggcuacaggauccuguagaugacugugucuuucccaguauaggaagccacagggugaagauugaaacuacugggccaacacuauaauugagagaaacucaggagcaagaugaugcuaaaucgcccuucuagaauccccguggaagcccucacucuccgacacggagauuuagcucacagccuauuaaucuguugugacugugauuccauaugaggucauguaacacaguauggggguugggagaaaugaggcaauaaugaaaggauucucagugccugaugaucagaaagaaauuaauucagaaucaaacuuguaaggcgauuuaggguguuuggggauagcccuagcccguguugcaucaugggauugcacuggcucugaccacauaagccuacaagcuuuguccugugcugguugucacagcacacgaugccagcagacacucccuggaacaccucagcucagauuccagacuaaagcggaauacagacugaaguguuccaaccgugcccacaaagcuuucugcucuuacaagcacacaacggcugaaucacagaaaacaaagacuucuaagguuucuccgcauugauuccuuauuaaguauguuuuuggauugaaccggauuagaaucuuugauguugugguugcugacuugaguuuccuagaggggaaaaaauuuauucacugaauuuugccuugagauuaguacagaauuuccaaaaauuucugaagugacuuuaaacauauaccugcccucucccucugugguuuuuauucugaguagcauuuuagcauuaagaauucuaaaauccaaauaucaaucaacucugaaagucuucaaacauucagcugagaucuaauuauguaaaauaaacaaauauauucaucucauuaguauguaaauuugucuucaucuuuaauaaauaaagugauaugcauaacaaaaacuugcuuuaaaaaaaaguucuuucugauuuuuuucccugcauagucggucaguauggcuacacuuguagggucauaugaaaacuucucaggcaaaaagaugucuuagguguauaaaauguguaaaaagccuugacuuagacaauguuauuuggccaagugaaugaugggucuggugauacgguggugguuuugcuggucaauuuugccaggugcuuauugaaccagcaacccagcaacagcugugaaccuucuaggaacagacucucaggcuucccucaccugcuacaucaguguguaucacucgagaucccaggcacucagcaugcacauuaaguugaagaguaccauuggauaagcucagugcuaagugucuauacugugcccagggcagacaucaauaaucaauuucagauuuguuuucuuccuuucuuuucuccuccuccuccuccuccuccuccuccuccuccuccuccuccuccuccucauucuucuuuugcucagaaucucucugugccaugcauggcuccaguuagcaccugucaggcaaugggagcaauggguauuggcuccaaauuaaaccuaucuugcacacugaugucaacauuuauuuucuccaauauucucuagcacaaagaacagugauuggugugucucagguuucugggaaugagcuguagaguggauguauuuucccucuccucagaucuuuucacugauagcauucacucuaucuuuggcccaugcucccagaaaaucagaguuuucuccaggcccugguacccaggcuuaccuguuguagguguugguauuuauggugggccguugccucuugcagagcugaaaugaaucuggaaagauacugauaaucauaugaagagcccaccguaucagguaucauacagguaucagacagggcaagcuuugucugggaugcagccccuguguucagcacuaagaaugaccaccacauaaacuggguuacaugcaguagugggggguggggguggggacggacagggaagagcauagggcuacugagacauaacaguaaugauuauaaauagcauccuuuugaugucccauccaaggccaggugggaaauccuuccucccuugcuucccccaccuaaucaccuuccccucauuuuucaaucaagagucccaagucgggcccguccuucacauuuguuuccuauuagaauaccuucagcgacuucgguguguuauguuagauaauugcuuuaauaacaaaccgaggaaagacuuuugaacacuuuaggaagucauuuuuuuuucucccacgagaaucuaacagaugcugacagaggacuugggaacaggggaagagaaagaauucaggguguguguguguguguguguguguguguguaagaguguguguguguguguguguguguguguguguguguguguguguauguggagucuaucagcaggaagugugugcaggcagaagcaagggauauuuuucccacugugagaagacucagcaaggccuugaugcucaugaauggaauggaggggggaugcauuuggccagcagggcaggugaagagagcacagcaugcccguugcaucuuuucgcgggaugaacuuggagagugaugcagagauauauguaucaguuugcauggaugggcuggagagaaaagcauuuguguggcucagucuugguagagcuuucucgcugugccgaaaaggauugaggaauuuucuacgugcaauucguuauuuuuaaagugagaugaucaagcccaccagaagaacaacuuuuauuuugcgcgcuaugucagguuaaacauaaaccagcucuggcuaacggucuuggggugcucucuucucugcugaucauccaaacaugucaacucugcagcaagccuacaggggaagaauaaauuuuauugaccuguugcggcugaggcagcuaaggcacagaguguuugucguuaagaacacacagugaacagaccagucaugcgauggaacuguaacaccugaaccuguuuagcccauccucacaggcuuccugaggaugaguguagaaacccuaaugucaggcugugaaaugagaugaccccccacccccacccccaacccaacauacacacugccaaaggcuuccagguugaaggcuugcuccccagaugcagugccacugaacggugagagcaggcagagggaugugccugcaugagugggcggauccacugacagguucaua

SEQ ID NO: 2646 - RNA, 1341 nt, Mus musculus
ggccucuggggaagguaaagagcgggagucacuuucuguccugcgugcuugggaucucugggccacggggcuuacuuagcauuaucaaaacagaguccaauuucccagcugacacccuagcugucuucuuaucugguaaccuaagggugcugccaucccguuccccucuucaucgcccccaccaccacccccaaccgcugcccagcagucugggcaggaggcucagaccugccaggcucagauauuggaccagguguuuuucagacuaaacacuccuccgcugucucgggaaacgucuuacugguguaucucccaacccucgaagguaaagaggaugaaauccuggccgguucggaaaugucccaggaccgccccgcacaguuuaaaaggcaguuaauuccgaagguuucauggugcaggaggauccagagcccuauaacgaugcucuggaaacccaguaguccauccacaguguugcgcuagggcacaugagccuucccaguucugucacccgugucccucuuaggccagaacacugucccuacuaggaccuggucuccgaacuccguucaggucuguggggccugcuagagcccaagaauucucauccacucgcaccccaacucacucuucucggccugaccuugacccacacagaacagcaccggagugcacccggcugggcuuggaaacccaagguuugucguuccuauggcagagacuagagacagggucauccugaaguaccaggcgggcgcuucacuccggccuggucuccacgcccgcuccuaccccgggccuaugccucugggcggcgggccgugcgcgacgggaugcugagugucugugcgcggggccgccuauauuuacacccaaaacaaaauaauuacacucuugucggagggagaaagccagugauuaggcgcaggcucuuugcggcaaagcaguuucucagugguacaccaguauaauuuuucacggcuggcugaaaucaaagaggggaaguaaugaauccggagagcaauuuaaauuuacaauuuguaacgccgccgccgcugccgcgcagacccggccgagagcgcagcucccaggcgcucgcugcguuuguuuaauguuaaagcuucgcuggcucuuggugggggaguuggggggggggaugaggauacgugauggggggggggguaaaugaucaaggucgggagaagaccggcugcugcgacaccugagaugcuuccgggagaaaagggcaggggcaaagcuccuggauuuccccuuccccuuccccacccccgcccccgccccgcgcgcgcgcuguuggagccuccagucugccccuucuca

SEQ ID NO: 2647 - RNA, 7404 nt, Mus musculus
cuuugcucuauaaauauauauuuauuuuuuauuuacaauggaaaagugcacauuauaaacacagguaaaggaggguggggccauugucaaguguaucccaccccacuagggggugccggugaccccucugagggaggccagggcagcagcagauaucacucgggcagcccguucaggcccagcugcaccuugagugccugcagcugcgccaggcuuauguugcugccgccacacacgaugacaaccagcgaggccagugggguuugcagccggccuucauccugcagccugcacaccacgcggcuguacacagcagccagcgccgcgccgcacgcgggcuccaccagaaucuucucaucgucuacggggggagggggaggcggcugguaagcucucaacaucucccuauggcuggaacugcuuguuccuacagccugugcuaagggcacucaggcaccugagaaggucacuccuguguggcagcaagcugagaugauuaacagcagugcguguucuuacucuuguucucuuuggcuaucuucaaggcuggccccagagaguucugcuaaagaucaucuccaaguccagcucaucuugguccucuccccuuugaucccagcuacugcuaucaugauuaccagacucacauuuuugugaguggcuuuugcauuuaccagggacuggcaugagagucuaggcugaggagggagaaagucaaggggcaaaaagauuccacagaacguacccacgaacuucucaagagcagacacagccuccuggucugagaugaccucggagaaaaugggguguucguaaaacagcuucagggucugcgccccgacaguguucacgcccaaggccuuggcgacacugggagguggggaugaggaggggggugggcacagggggagagacaagguagaagggugcaugugagaggugaggacuuaaggugaguggugggaguggcaaccccugcccagcccugggauccugcacaguggucuagggcaucaaacuggccugacucaaaugccugaagacccugcugccccccgccccagcuuguaaccucugccugcuuugcucacuugccuccucuuccgggaagccccccagagggacuccuuggucccauggauuaguugagguucucagacaucccucccacacccuaaugaacagggagagcuaguccuuccuaaaaugccaggugucaugcucuuuccaagcucaguuguacagaaugggaaacauuaggcaauagcugcuccaggguuauauuaacuuaggguccaaaauggcugcuggagugccaacuauugcacccguauuccaucuggcaggaaagaauagugguagcagaccagcaucagucuaauagggacauguugcccagaaauccagaaagaaucucaguguucccuaccuaugacagaagcugucuucucccuugaaaucccuucuagccguacuuguggaugucuacggcaaaccuuaccuagccucccuugcagcuaggugugaccaugcgacccagcucugcccaaugcaugauaggagcaaguauagauagcucugaauucugauggaucgucuaugagaguucaacauugugguggcacaacaaaccaucuacacuugguacaagauagacuuugagaguugaacugugacccccccacacacaccccaacuauagguuugugguacaguucacucucgggaugcuggguagcagcucuccaucagccugucagcaagaaacggccaguuccauacugugugccaaacagcuuagguaaggugcccagcagaccagguucaacucguucacaacacucucagcucuaaugauugguuugcugggugugaccccgcugucagcuggggagcagcuccacuuagucuuuaaaguuuaggagcauccuucugcucucccucuucucagauggagugugggugugguggcuggcacaaaagcagccauuuuggacccuaggucagcauacucagagugauaggagaagauacuccaggaacucagcuuccugcucuaaggaguugccacuaauagaacuagaguucaauuugguuuaagcuacugguguggggguugguuauaaauucuuugcaggcaaagagggcguuuccccccccccccacgcuguguuagacgggcuacacauaggcacgcagcucccgaagccucaaucccacugcucaugugauggagagaugccccggguuuaccuggugaucuugggcagggugaccagcuuuccuuccuugauggcagcauggaagcugugggcgccaaaggucuccauggcgaugaugggcacauccucccagcccaccucccgcagccccuggaccacuccgcacagcaggccuccaccgcccacagacagcacgauagccccgggcuuggcgcucagcgucuccuucagcucuuucacaagggaaguguggccuucccugggcaggagaaggguagcagggucaggccagggcuucacgaagacacaauggcuggccaaagaugcugacuaaggucuuuauuuccuucuaucccaggcaaugaugaaccuggcuucugaccuuccugcuguccagccugccucacaggacacugauuguguaggagacaagccccccucccccacucauggagagaggagauggcuguggggguugguggauaaaucuccauuuccugcccaccaguggauacauccuuggaugcuuacuccccaccaacucccaggguucccagggacccugcuucaguugcucauggcagacagaugcuggcacucgagagccaccuccacggaugcuucccuagcccguuuguuccuagucacccccagaugagcugaucuccccaagucucugcaucuggggaccccucaucgcugauguguacaucugugcguuuguguguucucuccugcacacauugggugugccggagagggcaggagcagaagccacacauggcagaucggagugggguggcuccaacuuaccagaugagagggucaucaaagggggaaauguacacccaacccggguuguucuuuuccagagccuuggccacuuggauggccucauccagcaucugcaaggggcggggcggggcggggagacugagaugaugaggaucuccaucuaguuaucagcccuccugcccacgagggauccgcacucaccucucccaccacuucaacuguggcgccuucauucuugagccgcucaauggugagggcaggugugguguugggcacaacgauaguggcugggaugcccagccuccuggcagcguaggcggucgccaugcccgcguugccagcugucaguggagagggcgugucagggaggagggucugggaccccaggugggacugcucaucuccagagggaauucugcuucauucuggaaccucaaaucugggugaugacgaauggauacacuggugcggagucccggggcccagagagaaacagugccugguacugggccacaggacgcacagaccaggguaggaagggaaagaaagcuaacugggcacuuaccugaagaacagacaaaaugucuacagccuuguuuugcuuucuguggagacaagagggagggucaggccaccccccagucccagccuagguucaucucucccacuggaacaucuucuaucuuaagcugagcuuacccacuuaguaucugaaccauucucucucagguauaucuuccccaaggagauuaacuggggcaaggaggcaggugucagucucuagggaccuguauggguggacaccccuuagccagagagagcccugauauguguaaccuauucuaaaaugauuuucuuaaaaaauuuuuuuuuauuuaagauuuguuggggcuggagagacggcucagcaguuaagagcacugacugcucuuccagguguccugaguucaauuccuggcacccacgugguggcucacaaccuucuguaaugccuucuucuggugcgucugaagacagugacaguguacucaucauauauauaagaaauaauaauaauaaaagagauuuguuucauugagcuggugagauggcucagcggguaggagcacugauuguucuuccaaagguccugaguucaaaccacccauaaugagaucuggcgcccucuucugggaugucuaaagacagcacauaaaauguaugugcuuacuaaauaaaucuuugggcuggagccacucacugacuuggaugcugagggugagcaugguucuucugaaagagccccaagcauuccuaacagcugagcuaucuccccagcccaauguuuacuuauuuuggauuauauacacggaagugcaguugcuccuggaacucagaagagggugucagaucuccuggaacuggaguuauaggugguugugagcccccaugugggugcugggaacugagcucagguccucugcaaaagcagccggugcucuuaagcgcugagcugucuaaaccccaggcccuaaaauuauuauuuccguagagacagggucuugcuacacacucugggauaccguucacuuucuaccuuccugacucgguuuggaauccugggugucugucugcacaccugccucuacaacugucaggugggagggacugccccuccugccaggaugccacccugccuuguaccaucuugcagagaugcccaaugccucggaucuugaaggagccugagggcugggagcuguccauuuuuaggaacacgcuggugccggccaauuuggacaacgccaugcugucacgaaguggggucuucacaugcagggacuccugggcagccauggcugggggcagggaggagauacagagggucaagagaggcugcccuccugggcucuaugacuccucuuucauacccauaaugauaaagaaaggacaccgaaucaaaucucagcucugacuaccuaguggccaaauaggaggucaagcccucaacuuugacccccaaaguuagaaggucacgaggucaaaaacauccuugggcaaguucaggggaaggggcuuguuuaaacugucucagaaugagccacaagauggggaccaagcaaggucagagucagcuguggucuguuccugcaaaguccccaggaaccaaccccagcugaccuauucccgugagcucagagcacgucagcagacacaaaagaaaugggccaaguggaguaccugugaagagugguucucggguccacagcaucccuccaugcucagcagugugcacgugugugugugugcgcauauguguguguaugugugcagaggccagaggucaacauaggucaguaucucccucaguugcccuccaguuuauuuuuugagacagggucuugcauugagcugggagcucccugauucaguucaacuggcugaccagggaaccuuagagacucccugaggucccuugagguccccugagguucacugagcucucccaagguacacugagaucucuggagguccccuaaauuuuucuggaggcucccuggagguccccugagguccccagagguucccugagguccuccagagguccccugagguccccagagguucccugagguccuccagagguucccugagguccuccagagguucccugagguccuccugucucuugcucccuagugaauggauggcaggcauuuauugcugagcucagcauuuuuaugugcuccauucugggaauaugaacauagguccucgcacuuucaugggaagcccuucgcagacggagccacaucccaaacccacaaaugcuuuuaaaaaggaaaaaacucagugcguucuuaccaugugaccuaggcuaguuuugaacguuggguccuucuaucucagucucccaauugcugggaucacagguguucccugcuaugucuggcguucaacaaauacauauuucgggggaaaaaaacccaaaaaccaagagccuuugggguuuggggcaggccuguaaucccaucacuuggcaggcgaaggcaagagaauuagucauucauaaccuuggcuauguagggaguuugaggcuaucccgggcuacguaggacccuguuucaaaaacaaaaaaaaacccaaaagaccuggaaguccaguaucgagcucugaaaggcccuuguucuuuuaaaaagauagaguuauagauuuuuuuuucuggcauggggaagaggcaacagagaacccuggcccaccccaucacacagcugccacacugagagggaaccuggacacaggagagacugcaugacaaguucaagucuggcuaaugacaccccaaggucccuucgguagccauggcagugaggaagccuuugggcuaacacuggcucagcuacugucaccucggggcccugugagaagcccugagagagauucagagccaagugggaucaaauccaggcagauggugucucuuccgagcauccacauguauucaagggcaugugugugaguguaggagagacucaaacuccuugugauccuccugccuuaggggagagagagagagagagagagagagagagagagagagagagagagagagagagagagagagagagacucaaacuccuuguguucccccugccucagucucucaagugcucucagucucucaagugcugagauaacaggccagcccaccagacuccucuuucuagaagaccucuugaaagacagcugccgggaagaauggcacacaucaagaguaccuccaaauguguuugcuuuguccuagcuagucccauccugguauagugggucuucucuggaccuaaaaggcccagcuguugcagccucuggcuaguggauagcuuccaccacgcaaaccccuuccagguggcuuuggggagccccaccagucccugucccaggcugcagcauugggaaccuuuggggaaaugggcaggguacucuguucugauucccaccccagaggccggucccaucuggcaccauaaauaguaugaccugcaagagagaaaaaaagcacugggggucuuggcaaagguggcuagugcgacaucgguuccagaacagaagucccuucuuugucauuuggcucaugcgagcauucagcaaagauagccugccacaugccaccccagcgacauccugaucuagaagguccuaccacuucgucccauuuuacagaucugaacacggagacuugaacuggaugagucccaguuccucuccacuucccggguacccugcucuggcugucccugacuguuaaccuuggggagaggcugaagcugggggccacauacccggcacaggaggagcuggacagagcgagcgagaggaguagauugugucuguguccugggagaguaca

SEQ ID NO: 2648 - RNA, 1055 nt, Mus musculus
augagagggucaucaaagggggaaauguacacccaacccggguuguucuuuuccagagccuuggccacuuggauggccucauccagcaucugcaaggggcggggcggggcggggagacugagaugaugaggaucuccaucuaguuaucagcccuccugcccacgagggauccgcacucaccucucccaccacuucaacuguggcgccuucauucuugagccgcucaauggugagggcaggugugguguugggcacaacgauaguggcugggaugcccagccuccuggcagcguaggcggucgccaugcccgcguugccagcugucaguggagagggcgugucagggaggagggucugggaccccaggugggacugcucaucuccagagggaauucugcuucauucuggaaccucaaaucugggugaugacgaauggauacacuggugcggagucccggggcccagagagaaacagugccugguacugggccacaggacgcacagaccaggguaggaagggaaagaaagcuaacugggcacuuaccugaagaacagacaaaaugucuacagccuuguuuugcuuucuguggagacaagagggagggucaggccaccccccagucccagccuagguucaucucucccacuggaacaucuucuaucuuaagcugagcuuacccacuuaguaucugaaccauucucucucagguauaucuuccccaaggagauuaacuggggcaaggaggcaggugucagucucuagggaccuguauggguggacaccccuuagccagagagagcccugauauguguaaccuauucuaaaaugauuuucuuaaaaaauuuuuuuuuauuuaagauuuguuggggcuggagagacggcucagcaguuaagagcacugacugcucuuccagguguccugaguucaauuccuggcacccacgugguggcucacaaccuucuguaaugccuucuucuggugcgucugaagacagugacaguguacucaucauauauauaagaaauaauaauaauaaaagagauuuguuucauu

SEQ ID NO: 2649 - RNA, 20344 nt, Mus musculus
aaaugugagucugguaaucaugauagcaguagcugggaucaaaggggagaggaccaagaugagcuggacuuggagaugaucuuuagcagaacucucuggggccagccuugaagauagccaaagagaacaagaguaagaacacgcacugcuguuaaucaucucagcuugcugccacacaggagugaccuucucaggugccugagugcccuuagcacaggcuguaggaacaagcaguuccagccauagggagauguugagagcuuaccagccgccucccccuccccccguagacgaugagaagauucugguggagcccgcgugcggcgcggcgcuggcugcuguguacagccgcguggugugcaggcugcaggaugaaggccggcugcaaaccccacuggccucgcugguugucaucguguguggcggcagcaacauaagccuggcgcagcugcaggcacucaaggugcagcugggccugaacgggcugcccgagugauaucugcugcugcccuggccucccucagaggggucaccggcacccccuaguggggugggauacacuugacaauggccccacccuccuuuaccuguguuuauaaugugcacuuuuccauuguaaauaaaaaauaaauauauauuuauagagcaaagaucuuuugagcuuuguuuguucuugacaugagggucuaugugcagcccaggcuggucucaaacuggagauccuccugccucaucuucugagugccgggcagacaggcguuagcuuccuugccuuguucagucucccucuacacccagccacaucgucccuggcucucagagaaguggugcuccccucuggggucuugggucucccaguggauugacugguggaacccacacauccguaagucaggagagaggaccagagcuaagccacacagggaucuaggguggggucgcaaagcagcugggagaugcacaggcaaggccaccacaugcuaauaugaaguccuuagggacaggacaaggccauccugagacaccagcggccccacccuggugucuggaaaaccaaccccgugcaggcaucugcagagcagggaagguggagugaaccugacaggaaaccaaccccugacuaccaacgaaacucagaacacauggcaggcccggacuggcucggguaaagcuacccacacaucuuagggccucugguucacaggcugugagcucucugggccccacacaggggacuugguuucaugugggucucugggucuaggauuuagggucuuaguggucagcagguugggccaggcuaggacccagaauacagcacuugagacagaugcugagcagaaggacuaacagggauaaauggacagagagaugagugggcugaugaaaagcagaaucaaggcacggcggccuguacauggaaacccagcaugugagggugaaggcggccagcagauacaauaaccagaggaugacuguggacuacaaggcauucaaguucaaggccacacugaguuacagagcaaaaccaaaaugaaaagggaugugcaguucuggguggacagacugacggacgggcagguggaugggugggugagaggugaggacguucagaugaaaaggcaggcaaguggacggguagguguguggaccgcugacugagugaaaagacgguaggguggacaggagaggggauggacgggcagggggcuggugaugcaggugaacaguagguacguggacuagagaaaggacagauggaaggagacagccauggacagacaggguguggugccgccccacaaggcuuguuuaacagaagcacagccugggcuucgcugaccggagcacacagccagagacaccuaccaggaggccaggggcaggcuuggcugggaguagggguagaaguguggggugacgguccauuccuccugcugaaagaagacucaaggcccuccagcuacaagcagccagaaacuuugguuuuguucucaagcuccugcacuuagaagagcugcccagaagggcacagggcugccuccugaggcgaugggcccacaggccagcagugacaaccauaauguccccugucaguucacacauaugcugagggaccagcacuaggagaaugugugccccggaucccaccaggcccacagccaagcauaagccccagccugcuggugacagggacagggaggaugagccaugaaggggcagagggcucagagacagaggcaacucugagcccacuggguuguguccuugcgaaggaagccgcuaggaccagagucuagugaagacagaagcccgagggguggacggcagguguaugacccacuggccacacaaaaugaaggcagcuaggcggaggcggacucucucucagucccauggcacccugaugggugagaacauccagaggucgggcuggcccaugugcagcaugcuguggaauggcgauuugcuccacuggaacggaggacacuggucccacguggggccacuggccgccagcaugcucauguacuuggccaggguaaagcuggucaccugggggggucagagagcacacacucagcugguagggcccaacucucaccacgacuuuucuucaaaacaccauucugaagcugaccccaaagugauauccccuuaaacugacccagcuucagcccaggucugaccucugacccugcaccugucccauccauccuuccccggggcaugugacaacuggcuuagguggccgaccuucacaucaaugccaccaugggcgcgcugaugcagggccugaaauggguaggagccauuggcgggguugaggucagagcgggcagagauggcauucuccgcauuaggcuuuggguugcaggcuucacacaaugacagagggucauggaggaaaucauuguaccuggaugggaaggaagggauggcagucaccccagggagaggccaagcuccucuagccucauaguggcccugaaacauccugaacuuucugggcuuaucccaacaccaccuuuggcuugagcagggccagauguagaccacccucaccccuccaccgacugggucacuccagccuuccugaggagguuucucuaggacccuccuccacgcaggucagaccccggucuguucccugacagcaucugcagggacucaggaugcccugcacacuucagcuccagccuggguucugggcaggcaucuccaccgccuaggagaaaggcacuccccaaggaugguagcgagcagguccccaucugcagaccaaggcuggcugguggcaagguucagugguacuguccugcagaggcggcucucuguaccaaaccuggggugugcugacccaccucaugagccggaccauggcguccauguccuccaccagugacuggucccucuggaagaucuuggcucgaggguucuuaguguaagagaaccaaucuccauacugggccaccagggccugcagcccacuagcguugaauacagucucaaaguaccugcugggacaaggguggucacccacgacucccacuggccacauagcugguuguggcuggcaugggagugggggucacagugggacagcugucacuguagucagguuguggcaaggcccuguuguccuguaggggaugaaccugggcucuagagucaacucucacuucacuauucucuaagcauggaggaucccugccucaguuuccacaucuguggaaugggaagagacagcugcacucacguuaucauggucauaaggacccaacgccagccugggaaagcacaggacauaagguagcucugaaaaauccagcuaaaacuagcuucauggaacugaggcuaccccagcacacuucaacuucagccuggguacuuacugcaugggcaucucuaccuccaggagguaggggcagauacagcugaaugccugucccaagguguggccaccccaacccgcccugcagcaggugcuauaaaugaaggucacaagacgauguggggcuuucccagcaggagagagacuguucuccuugcucagcauguuuaaaaugucaccuaaggaaggacccugccucagggagggcagacuuggggagagggggcgacaugaaaaaacaaggccacauacgggauguuguagcuagcccaguaggucguuuuguagagcucugcagucuugucagccaccaccaccaugccccugagacagagagagauggaccaagcaagucaggagacacucgggggacucggccagugggagggccucggcacccucggcaggaacuguguugugugccacaacuccuguucccaucaggggcaccccuccuuuagccuccccuuccucccuuugccccagggacucacgggaucuguucuaggauagugagcacccggcuuccagggcuggguccguuggggaggaaugccuuguaguccacaaucauccacugguuauuguaccugccaggaacaaggaaggagucgugccaagccuggaagccuucuccagcccugucccgcaccccauacagccgggucucagggacgacagccuaauacugcagcuugacugggagcccacaaaacccucuugcugcaugccuguucaaguacagcacacggcucccuauuauuuccuaaaggaccggucuaguuaagcacucaaagucauacuacuucuggugccugauucccaggccccgccccauaggugcucuugagaccuacccacuuccacuacacuugguucccaggccccgccccauaggcccugccccauaggugcucugaaaccuaccuacucaccccgcuccccugaacuugguucccaggcucauucccuuccguuaucugagcccaaacguuuaucuucuuccaaggggacagccccaagaggaggagcuuacagaagaagaaaaaagaaaacccuuucuuucuugagccucaguuuccccacguauaaaacaaggaaggggcucgagcuaccccagugagcaccugaaagaaggggcugagcacagggcccuggagccccauggguccccucuggucugaguacuaaaugguccgaaaguagaggccggggaacaggaucgcacucacgugccgcuguugaaccgcuugaagacgucugcccagguggccccguccaaggccaggcgguuggccacgacauuucguauccacuccagcacacagcccuggggcugcacguacuuccacagggcuggguucuuguugccaaugguggucuccagggugaccugugagagagacaaggugggcugggaacuccauguggcagcccugcaggucuuggcucagaagucaaauauuuauguuuuccucacaacucuaagcugcuuugguacauaccccucagggguuccuuggaaaaguacuuggcuugggagacucaggaucuugcacccagcucugccuuggggaccagagugccauuccuaggugccucaccgucguaagggagcacuccccugagagacagcauccuacccuuccauucucucagcucuacagggagaggcuauucaacuggagccccagcagccagagcccuugggaagaccucaguccaccuugcucugucucagagucaccagccauccaccacugcuuaugaagccucucuccucaaugucccuggagcccucguguaucugcauaaacacaucuugucucauuaguuaaagccagcagagcacuggccaagcgugguggcacaugucuauaacccaggacucuagagguaggaaggacugccacaaguucaaggugagccuggucuuaaaccaaacagaacuuggaucaacagagcccguguuaaguuaagaaccuuaacuugcaaaaggccaccuccuggcagcuaguggguggcccugcagugggagaaucuagacagccgaaucccagucagcucuucccaccuuccccagagacacaguagggcgucaagaaccagcugucugugacugcugagcagauggaccagguuccuaccaauccccugcguuuaguccccugugcaccugaagggugcuggccugagucuuccuuuacacaggaggcuaaaaagagccgaaggcuggcaggacccaccuaggagaguguuuucaaguuuuacuuauuuuggaggcauuuacagucucacaccauagcccauguuagcuucaaacucuucuugguuauucuccugccuccacgccccaagugacaggaauucaggugugagcuuaagccaguguuuaaaaaaaaagccaugaagggcuggagagaugguuuagcaguuaagagcacugacugcucuucuagaggaccugaauucaauucccagcaaccacacaguggcucacaaccaucuguaaugagauccgaugcccucuucugguauuucugaagacagcuacaguguacucauauauauauauaauaauaccuuuacccuagcacuagggagguggaggcaggaggaucaggggcucaagaaagccacagcuagccgggcgugguggcacacaccuuuaaucccagcacuugggaggcagaggcagguggauuucugaguucgaggccagccuggucuacagagugaguuccaggacagccaaggcuacacagagaaacccugucucgaaaaaucaaaaaaaaaaaaaaagccacagcuauauaggccagccugggcuacaugagacccuguuuuagaaaaacagaaugaaaaauauaaagagaagaaaaauaaaaacgacaucuaagccaggccuggcacgggucuguaacuucagucuaccuaagagguugaggaaggaggguugccggcuggagcuacauacugaguuccuggacagcccgagcuauagagagacucgcugccuuaaggauaaaagagccaaccaaucaaaccaacaaguauacgaaaagaaaaaagaaaggcuggguuuaguggucuguaccuuuaaacccagcauuugggaggcacgggcaggucgaucucucuguucaagaccaaccuggucuauagggcaaaguugaaggcaaccagggcuauguagugagacugugucucauaauaaauaaaauaaguaaauaaauaagagagugugaggaggucaccagcguccuacguuguaaaggggucuaggacacaaacacaaggaaaggcagugaguucccuggccuccugugcugggucaauaacgagacccaagguuccauuccccaccucuuucucucccucucugccugucucuguuugucucugucuuugucucucucugucucucuccaacccuaugggaggugagggaagcuuguugguccgggaguccugugacuaagguccccaggggcugccucugccacaguaggaacacagggacaugagccccaccaugccuaacagugccccucgcguaucuaaugcgcccagggcacacuacagcugagugagugagucucuuggcagcaucagugugagaucucaggcgccagccaggaacagauuucuaaaggggccuggauggcagccagaggagaaggagaaacaaaaugcuguaaacagcuccucaggacagggccagguuagggguggggggagggaaaggcagggcagagcaaggucacugaccaaaaaggaguugucugcacugaacacagaaacaaggucacugcacucaggcucugcaaagggccccaagggccugagugcucucagagcucaaaagcccugcaagccucaucuucucgcuguccccagagccucuaugucccauguccccagggagcaugugacucagccacucaccaggccacugcccaggauguagaagucaucuccggagaagauggugcccggguaggacgagaaaaccaaguuguugccagcaaccaggggguacuccucuggggauagugggggaggaguuggucaggugggcucuguaggucacccaucccccaucccacaaggcaggggccucaagugagagauaagcaguccucgggaggccacucucaucccuucaaaugaaauguguagguggcaccugacuggaaugccaccaucaggaggacccaaguucaaagccaccugggcuacauagagagacucugacucagaaaggaaggggaggagguggaggaggaggaaggugaggagauagaggaaugagagaaggaggagagggggaggggagaagggaggaggaagaaaagagggcagguggaggauggaggagagggagaaggauugggggaagcacccugcugcaggggauugcccugcugacugucucuacuggucccuuaacaaacuugcaaugugaugaacagcaagauacuccucaguguagcuggaaacgaguuuuccuuaaacacugcugaauggagaauuagauuuuaaaaggugcaaauagauacauucauuuaaaaguguagauggaucuaacuucaucaaaagggucugugguggggcgacuguugacaacugauacuacaggagaaacaaagcaaugcaaaaucaaaagggaccuuaggauagcacaagaaaacaaucagcagugggggugcacgccuuuaaucccagcacuugggaggcagaggcaggcggauuucugaguucgaggccagccuggucuacagagugaguuccaggacagccaggaaugcacagagaaacccugucucgaaaaaacaaaagaaaagaaaaaagaaagaaagaaaacaaucaauuugcagcaaggaccucccaagggcugugggcagcacauacaagagggccucacugcuuggcaggauuuccucuacacacggcuuccacaaaguguccugguacuguuucagggagaccugcucaggcaggcaggcauucugccauggaacucuauccucagcacucaaacaggguuuugaaggguuaaaaauguaagaaaucuuggugagugccugucaucccaguaagacagaagcugaggcaggaggauuucuaauucagugccaccccacuaugagcaacuuuuuucuccccauugccucuguuugccugccucacugggcgauggucuauguugggcacacacuagaguucaaggccagcugagguauggagcuccgaggcacagcgcuuucugggcaagaggcccaggaauagauagagucaggagaagguaggaggguaggugcaggcagagggguagaugguggugguaaccuugagagccagcugaaagaaacgccuugcuugccaaguaagaaaucccccagcugcuccagaacuucgcucaaagccuugccccugugcacaugcgcaugcccacccucccucaaggaugcucccuccucccaccuugcggccccucccggaacugcagccuguacuucuugaugaugcguaacauguucugguaggaguuccacguguugugcgccaccaggaggucaugcccgccaggcagcagcuugaugagggcagagcaugaaccggagcccagggaaggcuugguguuggucuuauucagggcuggcucuaggucuuccaggucuccagagaucugcagcaggcuuaagagggaggaugggagggccagcagcuacuuugcgccaugucacaacugaggcuuucuggguucugggaguaggaaguggcagagcuggcauggaacugggacaaguaugaaguucaugguuccuuuacccacccugcgcaggcugggggggggggggaggcacuuacaggaaccccaaggguuugauggugaaccucccaguugggaagguuaaacggccuucauagcuguccuccaggccuuucagcugcaggagggucagccgcaccuaggggaggggcagagggagaaugagccccccgccccccaguuuaccaauucuacauaauagcaggggcucugaccuggcucaggggugcuccacaggcuccagccaacccugaccccucuccugcuuucagugaauaaacacuaugacacauccucaugcugaucccaagucacccucaauuaagaaccuggucaaaagccaucucuuccucaaagccuuccaguuuggccagaaccccugucaacaccucccuagucuuagaugcuggcuguguggcugccccggcaccugugccugcuccaccucagcaauugaacuggaggcaucacagugauccucacuggguccugacuggugcugggcauacaccaggaucuuaaguacagacaagauagaugggcagacaggaugggaauggaucaacaggagggagaggauagacagauggacagacagacagaaggguggguggauggauagacugacagaugaaugggacagaagggagcaggcacaugggauagacggguugcuauguguugguggguaagcagacauacggaaggguggguagguacgugagggaagagaaucugaagcagcgagggcaggagaugggucggcagggagaaccauguguguguguguguggggggggaaacagcaugaauacuagagggcacgcaaacaggcagcagggucauccacagaggccacucacugccugugcugcacagcuaagcccucaugccuguagagaauucacagucuguggcuuuugcacugacaacugcgccagcagcccaggaccugagccuuagcauccagucugucuaagucuaagcucagcccagggagggaacgccaggcuuggcuaugcugugugcuuucaucucucucuucccucuucugaaauagugcucgcccguguccagccuucuguugccuuccugacagugagagccacaugccgccacuuagcuagguucucugacagcaggaaagcaggacugggcaucugggccagaaugggcagcuggagguccgucaagcggacagauggaaggaugauggcuugggggggaggggugcagaugcugacagacacuagauugggcuggguuucugguucacucagggccagccagggacugacugcacaggagacaaguacacucaaaagagccaccuucccucccgagagcaggguggccuggcccaccuggugccaguacggagaguccggguuaagcuccauuucccucugcauccacuccagguuggccuccaggaaguucuuaagcuucucacaguagccgacuucguauucgaaggggccgcaguaguugaccaccguguucauccagugcauguagaugagcuguggagagaggacaggccagcugcucucugugcagggcccugaggagcagcccccgggcuagaggacuaccacuucuacuccgaggcucccagccccccuccucuuaggucucccuacucuggggccugugauuuggaaggucuagauuacacugcaccgccucuguugcuggggccuggauugagcagugugcucugccaucaaacaugggggucuuggguuguuucugucggugguaugguacuggagauuggacccugggcuucagggaggccaagcaaauguucugcaaggccagcggcuacuggaccucagcccagcccacgaggucugauuuugcuuuccucuguucagaguuguuuagaggugcggucguccacaugcgagcaggccuuaaauaccuaaucuugcugccugcaccugccaagugcuggauuacaggugugcacuaccaagcuuauacaaugcuggacauggaacccgugcccggcaggcaaacucuccgaaugcagccacauccccagccacugcugggaucuuuagacaggcucacacaccuuagccuuagccucuggccugcuagggugacuccagacacugcaaacgaguaccaaacucucagucagaggaaugugugugugcagcuccccgcucuguuccaagcacggaggaaacaaaaacaagucccccugcugacucacugggccagagaagugugccaggcugcuggcaugcccaggugcggugugcaugagcucgggcuugccugcuaggggaaggaagccacagccagcauagccugcccuccagcugcugggugugaaugagguuaucccagaccacccagccagcugauugcugcagcacgggugagcccaccaaggucagccugacccagaacggccagggcucacagcugaugcuuccugggagugggagugggggcugcugacccguggcucaggccagugagcagcaucagacaguggacauacugcagccuccagugcugagcgaggcaggguaggugccauccccacacaguggcccagccugggcuugcuguucagaagcugcgaggggucaguccacuggguggcauugcugggaggcaagggcuagaggcacagccuaagccuaaggucucugaggcuuguccuggaggggacucugggacccugcucucguccuccuccguguuugccuucuggcccaugaagggagcgucuugcucugccaggaaccguaagagccacgaagcuuuaugagcuccuuggcuuggguauuuccuuacagugaagugaaaccaacacguccacuuuacagcugcagaaacugagacacacuugggugggcaaguaccuguguccccaaaacaccgagacaucacgucacaggccugacuggggcccacgccaugauguggggguuguuuguuuuuuauuuguuugguuugguuuguugcaaaaugccaaauccccacacucucugggccgcugccaaagguaacuucuggccacaccccaccccaccagaaaccuccccacagggacacgcaccaaauccugcucaugcccaggccccacuagcgcucccugccuccuuguacuuugcaggccacugcccacuguccugcccuaccugaggggcugcacaggagcccuacccauccgcaggaugcagcaauagagcaaacugcccugacuggaggcuugggccagacagagcuggauucaaaugcuacucccagcuugguuaaaaggcuguuuaaccuuaaugagagccuucaccucccaggacccaugcccugccccugucacugucagucacugcuccaccaggacaggccuucagcccagucccggcuacauagugaagaguuuggaauuuugguuucuuucaaaaaaaaacaagaauuuuuguuaauguuuucauuuuaaccccaggugcggggauauggggcugcuucagacuguccacagcagcugacuaugauuugccucaugaucuagcaggggugugauuuugccagcagccaguugucuacaauagugugacauuuggaauucugggaauuuuucagagucauuuaaauacuagagcccugagaggcagggugggugguuguugguugaucaggaguguugguugcagcuuguuaguaguugugcucaaagaagaaacaagaaagaaauuagauucagggaucucucucucucucucucuuuucuucccucucccucucucucucuuuuucucccuccauccuucccuccccacccccuucgggggcgaggaaaaagggugagaaaaagaagaacccacaaguagcaauaaccagcuacacaucugccacauuggguguucuuaaaaccacuugggacaccccuugcauguuccugggucaccaauggaauacaaagucaaauaguggccacuggacccugaguggauuucagucuauaaguugauaacuaguaauuucucaaaaugaguauccacuucauucaguguaggcaaagcugcuacccacagccaggcugauuucugaaagguggaacaccagacagggacugcuguuuugaugguuccaaaccggauaagcaagagauugugcucuuuggggacuugacacaugcaggaaagcuaguuuaacaaaaguaggagcuagcuggugaugucuaucagugcccgggaggcugaggcaguaaggucacaaguucaaggccagucuggacuacagagugaguucaaggucaggcuaggcaagcuugugggacugccucaaaacaaacaguaugaagaugccugggaguagagaucaguaggagagcgcuuccccaacauguaggaggucccagguuuaauugccaguaucaggacagugguggugggggcacaccucuguaaucccagccuaggaggcugaggcaggaggaucucaaaaaucagccugggccaccgucucuaaacaccuuaaaaugggacuggaaagauggugccguggcccuuucuucucuugugaaggaccagaguuugguucccugcaccucuaugaaauaacaccagcuccaagagaucugacauucuucuggccuccuugggcacccaaauuuuuuaucuaucuaucuaucuaucuaucuaucuaucuccccuuaauauaaauaaaucuuuccaaaaagcccugaacugggggaacagacaugaaggcagaggggaacuaugggccacuuaguugagaagggggcaccaggggggugcaaagaagaauagagaaugaagcaggggacacggguaaaauauggaagcauguauguauuaaauguuguauuggggccacugggacggcucagcagguaaaggggcuugccgccaagccugguguucugaguucgcucccuagggcucacauacugaaaagaacagacuccagaaaguugucuucugaccucaauguaugaauccugauauacaugcacucacccacccacccacagacacaaguguacccacccacgugcagacacagaaaugcacaaaauaaguuaaaaggcaaccaucaauuuuaaaaugucaucaagaagccuauuauuuuguacaugagcuaaaaaucauaccuuuauaaaucuauaaauacaauaacaaaaaaagaaaacauuaugccaagugacagucauaaaaagguuuucacuucccggcacacuugauguacccugggcuccauccccacacuguagagaccgggugauguggccuggcacuaaggagaugagaaucaggagaaucagaagcucugagacguccuuagcuacacacaaagguguggccagccagggcuacaagaacuccuaucucaaaacaaacaccaaggccaggaggagguggcaccccguacuucaaugagaugucagaaugacagaauccacgugauagcgcuggccguaguggauagagccugaggcugguguuuguuggcuggauaggauuuccuucugcagugaugaagacacucuagaacuggacagugguccaacuguacaaccuuagaacuguaccccaaaccaauagauuacacugguuccccuuuuuugggggugggggaguagucacagcugguucugaucuccugacccuugucuucccuccaucccccagugcuaggacaacaggcaugaaucauagccuggaaguuuuuguuguuucuugucucuaacccaggcuaccccugaacucagcagucugucucagccucccaagucaugcaauuguggguguguuucaccagguccagccuaugugcugucuuugaagaacagggcucuuuuucuccccuaauggaggacaggagauggggacccuuucucaacacaugcaucaaccccacugacggcccucaggaugucugggcuuggccaggggcaggcagcugggacccuggacucccacacuggccuuaccuccucagacacagaggccuccaccacaccagcugcauaggccugcaggcugucauuguaccugccauuugugcucagguccagauaggcccaccuggaggggagaagaaggacagucaguuagcagcagggaccccugaaaagacagccacacagccagacccacggcugugggcagacucagguguggcuuuuuauuccuuacacuacacauggaguucaggcccucguguggcaggcaacugcuccagcccuaguuuuguuccugucccuuuuucaaacauggucucacucuguagcccaggcuggccugggacuccaauccuccugccucagcuuuccacgugcugagaucacagaugugugacaccaucccugccuagucucuaguuuuagaccaugaaaacagccuggugagcagccgccacccauacagauguuggccugccugucugcaccuggugagcagcagcugcccauacagauguuagccugcaugucuguaccuacaugccugcugggcuacauaccugagacaggaagugcuggggcagaggaacaaagacuaaaccagccuccucucccgaccuaugccaacugauguucccaaucaugcuggccggcccuucugaguuugucugauuuguccaguggcaacucacaguccuuccagguagcaacuguuaacuggccccaccacauggaggaggggacugaggcacagaccucgucaucacagugauggaugcccuguguccuccugcuuugugaggcucugcaaugucccuacccaugacugugugcccuuccauguguccaucuaugcugggucacacauguggcuugcuuugccccguugggacagggaagaacugacacaucgcuguuaagaagaacaagaggccucaugacuccccaagguccuucugugccucugcugcuaucauggaaggagacugugucuuugucuguggguuccagggauggaaaauacccagagcagagcaggucugccgaccugaagcucaauggcuuuaggagcucagcuccuugagggucagcaaccacugggacuguuauuauggagcacugcugcccaaugccuggaugauauaggaucagaggucaucaaggauagaacaagauuccugucaagucaggcuaccaucuuuuuuuuuuuugagaugaagucucucacugagaucuaauuuccccaaaucuccaccuccccccagcaugggggguauuauaaauuauccccucccuccauuguucucaguuccuuuauagacuucccuuuaaaauauuucuccagaggcuggagaaauggcucagcaguuuacgaucauaacugcuuucagaggacccaaguacaguucccaacaacccccccccccaaaucagguaacucacaagagcaugugaguccaguuccaggaaacccaaggcccuccucagaccucucugcaggcaccuguauguacgugccacacauaagcucacacagacaaaaauaaaucuuuuguuuuguugucuuuuuuuaaauaauuuuuuuuuguuuuuuguuuuguuuuguuuuuuuguuuuuuugagauaggguuuguuucucuguguuccccuggcuguccuggaacucacuuuguagaccaggcuggccucgaacucagaaaucugccugccucugccucccgagugcugggaucaaaggcgugcgccaccacgaccggcuuuaaaauaauuuuuuaaagauuuauuuauuuauuauauguaaguacacuguagcugucuucagacacuccagaagagggcgccagaucucguuauggaugauugugagccaccaugugguugcugggaauugaacucaggaccucuggaagagcagucagugcucuuaaccacugagccaucucuccagcccuguuggguuuuuuuguuuauuuguuuuguuuuggagacaggcuuucucuguguagccauccuggaacucgauuuguagauaggcuggcuuugaacuccuaagugcugggauuuaaggcauguauuaccacaccaugcuuaaauaaucguuuuaaaaaggagaugaggggcagcucagguggcaccaagcccuggguucuguccccagcccugcauaaacugggcaucauggcacaugacaauauucucagcauucucaggagggggacauauaggaucacaaguucaaagucacugagaacagacugaguucucgaaacagucucaggauuguguuggguggugggccaaagucagacucaugggccagcaagauggcucaguggguaaagacgauugccaccaagccuaaugaccugaguuuguuccccaggacuuacuggaaggagagacaugauucaaguuguccuccacauacaccauaguucaugugacaccaucccacacaccccauaaaucaaucaaucaaucaauagaaagccaaacucuagcagcagaaagggaggagaagggggggggggggcgguuaccaacaaaaaucccagaacugacaaggggggauacuaacuccaggagaaucuagcuccugaccucugccucaaaaaaugugagccagacacccccaggcuggagcucccaucgaccggggaccaggccaggccagaugacuucuguuugacccaagucuucaagggucuguuccccugccuguaaacuggggucucccaccaugaauucccuauagugcuggggucucacagugaaaggaccggagccauaggagaggaaagagaggacaggaaauaugccagcauggugaugggccucaguuuccccaaucgaaaaauggccgaagggacccuuacuccuuuccuucccuccucucuccuuacauccacaguggagcuuucuaagucccauugaaacugggggacccuuugaaccccaucucgggcaagaaaacaggcucagagaaggggagccacucacccuggaucacacaacaguggaucggaggcugcaggaaauucccaacacaaccaaggaagacccguccccacucccaugaguccuguaaauggaagcauucucagucugagugcccccacgccaccccacccccguccuucccccuccacacaccuccugugccucugcauccaagcagggguucgucauacccucucagcucugcuaaacaagcaaaucuggauugagucagcagagaacagaccgccagaucgagucacagggggugccccugaugccggccagagcugugguucccuucauauagcagacaaaucagcagccuucucucccuggaagccuucccagauugaccccacccagcugugaugucuacagcaaccaaccauccaaggaccaccaucaccggagaugaccaaaccugugcgaacccaugcugcaggagacuguggccccugagaaugagcacaucgaggucugauggggacacacagguucuggaugcuccccuuacacagcccaaaucuggguuuccaggcagauugcuggcuccgguuucccgugggauuugcccaugugucuucccucagccugaaucuuguuuggcucuggguccuugugaccacaugccaagauaagaauagcucagcacaagucguuauucccggugcagaccccagcaagaacccacgaucaaguucuggguucacagcagugaugugggggacccagagaagcaagggaauuagugagacaacagaucacagggccagccuauguuccgagagcgauagggaucacacugagcaccuaacucagugaagcaucgggccaugaauucgucccugggaugggcagggacagcaacaucuaacaaggauacuguccacgcuugugaauuuagggaccugcaacuuucccucuggcuuggagccuggcucacuccagccgcccuggcucuggagggagacaagggccuggggcuacugacaacugucauuaucccuuaggcuagggacaaaugggcagcagaguaaacauuuaguaccagaaguccggaggcaaaggcaggcgaguuugugugaguuccugggcagccuggucuacauaccgaguucuaguccagcucgccuuaagugcggggacccguguggacagagggcagguccccuggccccucggggagaaccccugugguuggggauaggaguuacugagucagccaccagcccugggccagaccuggcuguggacuccccagggaggcaguccagggccccugucacccgccaggccguggcggggauggcuaacccuuacccggucucgcggauggcguuggugagguuggcccaggccaccgcgucgggguggaagccauccuccaggcgcagcuggcccgacgcggcguccagcagcagcgagcgggugcgggagaccggcggguccggauuuuggcgcugccagccgggccccaggguagggagagcgcccgccgggccgcucagcaacagcccggucagcgaggccagcaaggccaguguggucagggaggucagcgccagugcccgccguagcgcccgggccgcccagccgccggagcucccauccacgggggccgccaucgcgagccgcagccgggccacgugacugcgucccg

SEQ ID NO: 2650 - RNA, 20344 nt, Mus musculus
cgggacgcagucacguggcccggcugcggcucgcgauggcggcccccguggaugggagcuccggcggcugggcggcccgggcgcuacggcgggcacuggcgcugaccucccugaccacacuggccuugcuggccucgcugaccgggcuguugcugagcggcccggcgggcgcucucccuacccuggggcccggcuggcagcgccaaaauccggacccgccggucucccgcacccgcucgcugcugcuggacgccgcgucgggccagcugcgccuggaggauggcuuccaccccgacgcgguggccugggccaaccucaccaacgccauccgcgagaccggguaaggguuagccauccccgccacggccuggcgggugacaggggcccuggacugccucccuggggaguccacagccaggucuggcccagggcugguggcugacucaguaacuccuauccccaaccacagggguucuccccgaggggccaggggaccugcccucuguccacacggguccccgcacuuaaggcgagcuggacuagaacucgguauguagaccaggcugcccaggaacucacacaaacucgccugccuuugccuccggacuucugguacuaaauguuuacucugcugcccauuugucccuagccuaagggauaaugacaguugucaguagccccaggcccuugucucccuccagagccagggcggcuggagugagccaggcuccaagccagagggaaaguugcaggucccuaaauucacaagcguggacaguauccuuguuagauguugcugucccugcccaucccagggacgaauucauggcccgaugcuucacugaguuaggugcucagugugaucccuaucgcucucggaacauaggcuggcccugugaucuguugucucacuaauucccuugcuucucugggucccccacaucacugcugugaacccagaacuugaucguggguucuugcuggggucugcaccgggaauaacgacuugugcugagcuauucuuaucuuggcauguggucacaaggacccagagccaaacaagauucaggcugagggaagacacaugggcaaaucccacgggaaaccggagccagcaaucugccuggaaacccagauuugggcuguguaaggggagcauccagaaccuguguguccccaucagaccucgaugugcucauucucaggggccacagucuccugcagcauggguucgcacagguuuggucaucuccggugauggugguccuuggaugguugguugcuguagacaucacagcuggguggggucaaucugggaaggcuuccagggagagaaggcugcugauuugucugcuauaugaagggaaccacagcucuggccggcaucaggggcacccccugugacucgaucuggcggucuguucucugcugacucaauccagauuugcuuguuuagcagagcugagaggguaugacgaaccccugcuuggaugcagaggcacaggagguguguggagggggaaggacgggggugggguggcgugggggcacucagacugagaaugcuuccauuuacaggacucaugggaguggggacgggucuuccuugguuguguugggaauuuccugcagccuccgauccacuguugugugauccagggugaguggcuccccuucucugagccuguuuucuugcccgagaugggguucaaagggucccccaguuucaaugggacuuagaaagcuccacuguggauguaaggagagaggagggaaggaaaggaguaagggucccuucggccauuuuucgauuggggaaacugaggcccaucaccaugcuggcauauuuccuguccucucuuuccucuccuauggcuccgguccuuucacugugagaccccagcacuauagggaauucauggugggagaccccaguuuacaggcaggggaacagacccuugaagacuugggucaaacagaagucaucuggccuggccugguccccggucgaugggagcuccagccugggggugucuggcucacauuuuuugaggcagaggucaggagcuagauucuccuggaguuaguauccccccuugucaguucugggauuuuuguugguaaccgcccccccccccccuucuccucccuuucugcugcuagaguuuggcuuucuauugauugauugauugauuuauggggugugugggauggugucacaugaacuaugguguauguggaggacaacuugaaucaugucucuccuuccaguaaguccuggggaacaaacucaggucauuaggcuugguggcaaucgucuuuacccacugagccaucuugcuggcccaugagucugacuuuggcccaccacccaacacaauccugagacuguuucgagaacucagucuguucucagugacuuugaacuugugauccuauaugucccccuccugagaaugcugagaauauugucaugugccaugaugcccaguuuaugcagggcuggggacagaacccagggcuuggugccaccugagcugccccucaucuccuuuuuaaaacgauuauuuaagcauggugugguaauacaugccuuaaaucccagcacuuaggaguucaaagccagccuaucuacaaaucgaguuccaggauggcuacacagagaaagccugucuccaaaacaaaacaaauaaacaaaaaaacccaacagggcuggagagauggcucagugguuaagagcacugacugcucuuccagagguccugaguucaauucccagcaaccacaugguggcucacaaucauccauaacgagaucuggcgcccucuucuggagugucugaagacagcuacaguguacuuacauauaauaaauaaauaaaucuuuaaaaaauuauuuuaaagccggucgugguggcgcacgccuuugaucccagcacucgggaggcagaggcaggcagauuucugaguucgaggccagccuggucuacaaagugaguuccaggacagccaggggaacacagagaaacaaacccuaucucaaaaaaacaaaaaaacaaaacaaaacaaaaaacaaaaaaaaauuauuuaaaaaaagacaacaaaacaaaagauuuauuuuugucugugugagcuuauguguggcacguacauacaggugccugcagagaggucugaggagggccuuggguuuccuggaacuggacucacaugcucuugugaguuaccugauuuggggggggggguuguugggaacuguacuuggguccucugaaagcaguuaugaucguaaacugcugagccauuucuccagccucuggagaaauauuuuaaagggaagucuauaaaggaacugagaacaauggagggaggggauaauuuauaauaccccccaugcuggggggagguggagauuuggggaaauuagaucucagugagagacuucaucucaaaaaaaaaaaagaugguagccugacuugacaggaaucuuguucuauccuugaugaccucugauccuauaucauccaggcauugggcagcagugcuccauaauaacagucccagugguugcugacccucaaggagcugagcuccuaaagccauugagcuucaggucggcagaccugcucugcucuggguauuuuccaucccuggaacccacagacaaagacacagucuccuuccaugauagcagcagaggcacagaaggaccuuggggagucaugaggccucuuguucuucuuaacagcgaugugucaguucuucccugucccaacggggcaaagcaagccacaugugugacccagcauagauggacacauggaagggcacacagucauggguagggacauugcagagccucacaaagcaggaggacacagggcauccaucacugugaugacgaggucugugccucaguccccuccuccaugugguggggccaguuaacaguugcuaccuggaaggacugugaguugccacuggacaaaucagacaaacucagaagggccggccagcaugauugggaacaucaguuggcauaggucgggagaggaggcugguuuagucuuuguuccucugccccagcacuuccugucucagguauguagcccagcaggcauguagguacagacaugcaggcuaacaucuguaugggcagcugcugcucaccaggugcagacaggcaggccaacaucuguauggguggcggcugcucaccaggcuguuuucauggucuaaaacuagagacuaggcagggauggugucacacaucugugaucucagcacguggaaagcugaggcaggaggauuggagucccaggccagccugggcuacagagugagaccauguuugaaaaagggacaggaacaaaacuagggcuggagcaguugccugccacacgagggccugaacuccauguguaguguaaggaauaaaaagccacaccugagucugcccacagccgugggucuggcuguguggcugucuuuucaggggucccugcugcuaacugacuguccuucuucuccccuccaggugggccuaucuggaccugagcacaaauggcagguacaaugacagccugcaggccuaugcagcuggugugguggaggccucugugucugaggagguaaggccagugugggaguccagggucccagcugccugccccuggccaagcccagacauccugagggccgucagugggguugaugcauguguugagaaaggguccccaucuccuguccuccauuaggggagaaaaagagcccuguucuucaaagacagcacauaggcuggaccuggugaaacacacccacaauugcaugacuugggaggcugagacagacugcugaguucagggguagccuggguuagagacaagaaacaacaaaaacuuccaggcuaugauucaugccuguuguccuagcacugggggauggagggaagacaagggucaggagaucagaaccagcugugacuacucccccacccccaaaaaaggggaaccaguguaaucuauugguuugggguacaguucuaagguuguacaguuggaccacuguccaguucuagagugucuucaucacugcagaaggaaauccuauccagccaacaaacaccagccucaggcucuauccacuacggccagcgcuaucacguggauucugucauucugacaucucauugaaguacggggugccaccuccuccuggccuugguguuuguuuugagauaggaguucuuguagcccuggcuggccacaccuuuguguguagcuaaggacgucucagagcuucugauucuccugauucucaucuccuuagugccaggccacaucacccggucucuacaguguggggauggagcccaggguacaucaagugugccgggaagugaaaaccuuuuuaugacugucacuuggcauaauguuuucuuuuuuuguuauuguauuuauagauuuauaaagguaugauuuuuagcucauguacaaaauaauaggcuucuugaugacauuuuaaaauugaugguugccuuuuaacuuauuuugugcauuucugugucugcacguggguggguacacuugugucugugggugggugggugagugcauguauaucaggauucauacauugaggucagaagacaacuuucuggagucuguucuuuucaguaugugagcccuagggagcgaacucagaacaccaggcuuggcggcaagccccuuuaccugcugagccgucccaguggccccaauacaacauuuaauacauacaugcuuccauauuuuacccguguccccugcuucauucucuauucuucuuugcaccccccuggugcccccuucucaacuaaguggcccauaguuccccucugccuucaugucuguucccccaguucagggcuuuuuggaaagauuuauuuauauuaaggggagauagauagauagauagauagauagauagauaaaaaauuugggugcccaaggaggccagaagaaugucagaucucuuggagcugguguuauuucauagaggugcagggaaccaaacucugguccuucacaagagaagaaagggccacggcaccaucuuuccagucccauuuuaagguguuuagagacgguggcccaggcugauuuuugagauccuccugccucagccuccuaggcugggauuacagaggugugcccccaccaccacuguccugauacuggcaauuaaaccugggaccuccuacauguuggggaagcgcucuccuacugaucucuacucccaggcaucuucauacuguuuguuuugaggcagucccacaagcuugccuagccugaccuugaacucacucuguaguccagacuggccuugaacuugugaccuuacugccucagccucccgggcacugauagacaucaccagcuagcuccuacuuuuguuaaacuagcuuuccugcaugugucaaguccccaaagagcacaaucucuugcuuauccgguuuggaaccaucaaaacagcagucccugucugguguuccaccuuucagaaaucagccuggcuguggguagcagcuuugccuacacugaaugaaguggauacucauuuugagaaauuacuaguuaucaacuuauagacugaaauccacucaggguccaguggccacuauuugacuuuguauuccauuggugacccaggaacaugcaaggggugucccaagugguuuuaagaacacccaauguggcagauguguagcugguuauugcuacuuguggguucuucuuuuucucacccuuuuuccucgcccccgaaggggguggggagggaaggauggagggagaaaaagagagagagagggagagggaagaaaagagagagagagagagagaucccugaaucuaauuucuuucuuguuucuucuuugagcacaacuacuaacaagcugcaaccaacacuccugaucaaccaacaaccacccacccugccucucagggcucuaguauuuaaaugacucugaaaaauucccagaauuccaaaugucacacuauuguagacaacuggcugcuggcaaaaucacaccccugcuagaucaugaggcaaaucauagucagcugcuguggacagucugaagcagccccauauccccgcaccugggguuaaaaugaaaacauuaacaaaaauucuuguuuuuuuuugaaagaaaccaaaauuccaaacucuucacuauguagccgggacugggcugaaggccuguccugguggagcagugacugacagugacaggggcagggcauggguccugggaggugaaggcucucauuaagguuaaacagccuuuuaaccaagcugggaguagcauuugaauccagcucugucuggcccaagccuccagucagggcaguuugcucuauugcugcauccugcggauggguagggcuccugugcagccccucagguagggcaggacagugggcaguggccugcaaaguacaaggaggcagggagcgcuaguggggccugggcaugagcaggauuuggugcgugucccuguggggagguuucugguggggugggguguggccagaaguuaccuuuggcagcggcccagagaguguggggauuuggcauuuugcaacaaaccaaaccaaacaaauaaaaaacaaacaacccccacaucauggcgugggccccagucaggccugugacgugaugucucgguguuuuggggacacagguacuugcccacccaagugugucucaguuucugcagcuguaaaguggacguguugguuucacuucacuguaaggaaauacccaagccaaggagcucauaaagcuucguggcucuuacgguuccuggcagagcaagacgcucccuucaugggccagaaggcaaacacggaggaggacgagagcagggucccagaguccccuccaggacaagccucagagaccuuaggcuuaggcugugccucuagcccuugccucccagcaaugccacccaguggacugaccccucgcagcuucugaacagcaagcccaggcugggccacuguguggggauggcaccuacccugccucgcucagcacuggaggcugcaguauguccacugucugaugcugcucacuggccugagccacgggucagcagcccccacucccacucccaggaagcaucagcugugagcccuggccguucugggucaggcugaccuuggugggcucacccgugcugcagcaaucagcuggcuggguggucugggauaaccucauucacacccagcagcuggagggcaggcuaugcuggcuguggcuuccuuccccuagcaggcaagcccgagcucaugcacaccgcaccugggcaugccagcagccuggcacacuucucuggcccagugagucagcagggggacuuguuuuuguuuccuccgugcuuggaacagagcggggagcugcacacacacauuccucugacugagaguuugguacucguuugcagugucuggagucacccuagcaggccagaggcuaaggcuaaggugugugagccugucuaaagaucccagcaguggcuggggauguggcugcauucggagaguuugccugccgggcacggguuccauguccagcauuguauaagcuugguagugcacaccuguaauccagcacuuggcaggugcaggcagcaagauuagguauuuaaggccugcucgcauguggacgaccgcaccucuaaacaacucugaacagaggaaagcaaaaucagaccucgugggcugggcugagguccaguagccgcuggccuugcagaacauuugcuuggccucccugaagcccaggguccaaucuccaguaccauaccaccgacagaaacaacccaagacccccauguuugauggcagagcacacugcucaauccaggccccagcaacagaggcggugcaguguaaucuagaccuuccaaaucacaggccccagaguagggagaccuaagaggaggggggcugggagccucggaguagaagugguaguccucuagcccgggggcugcuccucagggcccugcacagagagcagcuggccuguccucucuccacagcucaucuacaugcacuggaugaacacgguggucaacuacugcggccccuucgaauacgaagucggcuacugugagaagcuuaagaacuuccuggaggccaaccuggaguggaugcagagggaaauggagcuuaacccggacucuccguacuggcaccaggugggccaggccacccugcucucgggagggaagguggcucuuuugaguguacuugucuccugugcagucagucccuggcuggcccugagugaaccagaaacccagcccaaucuagugucugucagcaucugcaccccucccccccaagccaucauccuuccaucuguccgcuugacggaccuccagcugcccauucuggcccagaugcccaguccugcuuuccugcugucagagaaccuagcuaaguggcggcauguggcucucacugucaggaaggcaacagaaggcuggacacgggcgagcacuauuucagaagagggaagagagagaugaaagcacacagcauagccaagccuggcguucccucccugggcugagcuuagacuuagacagacuggaugcuaaggcucagguccugggcugcuggcgcaguugucagugcaaaagccacagacugugaauucucuacaggcaugagggcuuagcugugcagcacaggcagugaguggccucuguggaugacccugcugccuguuugcgugcccucuaguauucaugcuguuuccccccccacacacacacacacaugguucucccugccgacccaucuccugcccucgcugcuucagauucucuucccucacguaccuacccacccuuccguaugucugcuuacccaccaacacauagcaacccgucuaucccaugugccugcucccuucugucccauucaucugucagucuauccauccacccacccuucugucugucuguccaucugucuauccucucccuccuguugauccauucccauccugucugcccaucuaucuugucuguacuuaagauccugguguaugcccagcaccagucaggacccagugaggaucacugugaugccuccaguucaauugcugagguggagcaggcacaggugccggggcagccacacagccagcaucuaagacuagggagguguugacagggguucuggccaaacuggaaggcuuugaggaagagauggcuuuugaccagguucuuaauugagggugacuugggaucagcaugaggaugugucauaguguuuauucacugaaagcaggagaggggucaggguuggcuggagccuguggagcaccccugagccaggucagagccccugcuauuauguagaauugguaaacuggggggcggggggcucauucucccucugccccuccccuaggugcggcugacccuccugcagcugaaaggccuggaggacagcuaugaaggccguuuaaccuucccaacugggagguucaccaucaaacccuugggguuccuguaagugccucccccccccccccagccugcgcaggguggguaaaggaaccaugaacuucauacuugucccaguuccaugccagcucugccacuuccuacucccagaacccagaaagccucaguugugacauggcgcaaaguagcugcuggcccucccauccucccucuuaagccugcugcagaucucuggagaccuggaagaccuagagccagcccugaauaagaccaacaccaagccuucccugggcuccgguucaugcucugcccucaucaagcugcugccuggcgggcaugaccuccugguggcgcacaacacguggaacuccuaccagaacauguuacgcaucaucaagaaguacaggcugcaguuccgggaggggccgcaaggugggaggagggagcauccuugagggagggugggcaugcgcaugugcacaggggcaaggcuuugagcgaaguucuggagcagcugggggauuucuuacuuggcaagcaaggcguuucuuucagcuggcucucaagguuaccaccaccaucuaccccucugccugcaccuacccuccuaccuucuccugacucuaucuauuccugggccucuugcccagaaagcgcugugccucggagcuccauaccucagcuggccuugaacucuagugugugcccaacauagaccaucgcccagugaggcaggcaaacagaggcaauggggagaaaaaaguugcucauagugggguggcacugaauuagaaauccuccugccucagcuucugucuuacugggaugacaggcacucaccaagauuucuuacauuuuuaacccuucaaaacccuguuugagugcugaggauagaguuccauggcagaaugccugccugccugagcaggucucccugaaacaguaccaggacacuuuguggaagccguguguagaggaaauccugccaagcagugaggcccucuuguaugugcugcccacagcccuugggagguccuugcugcaaauugauuguuuucuuucuuucuuuuuucuuuucuuuuguuuuuucgagacaggguuucucugugcauuccuggcuguccuggaacucacucuguagaccaggcuggccucgaacucagaaauccgccugccucugccucccaagugcugggauuaaaggcgugcacccccacugcugauuguuuucuugugcuauccuaaggucccuuuugauuuugcauugcuuuguuucuccuguaguaucaguugucaacagucgccccaccacagacccuuuugaugaaguuagauccaucuacacuuuuaaaugaauguaucuauuugcaccuuuuaaaaucuaauucuccauucagcaguguuuaaggaaaacucguuuccagcuacacugaggaguaucuugcuguucaucacauugcaaguuuguuaagggaccaguagagacagucagcagggcaauccccugcagcagggugcuucccccaauccuucucccucuccuccauccuccaccugcccucuuuucuuccuccucccuucuccccucccccucuccuccuucucucauuccucuaucuccucaccuuccuccuccuccaccuccuccccuuccuuucugagucagagucucucuauguagcccagguggcuuugaacuuggguccuccugaugguggcauuccagucaggugccaccuacacauuucauuugaagggaugagaguggccucccgaggacugcuuaucucucacuugaggccccugccuugugggaugggggaugggugaccuacagagcccaccugaccaacuccucccccacuauccccagaggaguacccccugguugcuggcaacaacuugguuuucucguccuacccgggcaccaucuucuccggagaugacuucuacauccugggcaguggccuggugaguggcugagucacaugcucccuggggacaugggacauagaggcucuggggacagcgagaagaugaggcuugcagggcuuuugagcucugagagcacucaggcccuuggggcccuuugcagagccugagugcagugaccuuguuucuguguucagugcagacaacuccuuuuuggucagugaccuugcucugcccugccuuucccuccccccaccccuaaccuggcccuguccugaggagcuguuuacagcauuuuguuucuccuucuccucuggcugccauccaggccccuuuagaaaucuguuccuggcuggcgccugagaucucacacugaugcugccaagagacucacucacucagcuguagugugcccugggcgcauuagauacgcgaggggcacuguuaggcaugguggggcucaugucccuguguuccuacuguggcagaggcagccccuggggaccuuagucacaggacucccggaccaacaagcuucccucaccucccauaggguuggagagagacagagagagacaaagacagagacaaacagagacaggcagagagggagagaaagagguggggaauggaaccuugggucucguuauugacccagcacaggaggccagggaacucacugccuuuccuuguguuuguguccuagaccccuuuacaacguaggacgcuggugaccuccucacacucucuuauuuauuuacuuauuuuauuuauuaugagacacagucucacuacauagcccugguugccuucaacuuugcccuauagaccagguuggucuugaacagagagaucgaccugcccgugccucccaaaugcuggguuuaaagguacagaccacuaaacccagccuuucuuuuuucuuuucguauacuuguugguuugauugguuggcucuuuuauccuuaaggcagcgagucucucuauagcucgggcuguccaggaacucaguauguagcuccagccggcaacccuccuuccucaaccucuuagguagacugaaguuacagacccgugccaggccuggcuuagaugucguuuuuauuuuucuucucuuuauauuuuucauucuguuuuucuaaaacagggucucauguagcccaggcuggccuauauagcuguggcuuuuuuuuuuuuuuugauuuuucgagacaggguuucucuguguagccuuggcuguccuggaacucacucuguagaccaggcuggccucgaacucagaaauccaccugccucugccucccaagugcugggauuaaaggugugugccaccacgcccggcuagcuguggcuuucuugagccccugauccuccugccuccaccucccuagugcuaggguaaagguauuauuauauauauauaugaguacacuguagcugucuucagaaauaccagaagagggcaucggaucucauuacagaugguugugagccacugugugguugcugggaauugaauucagguccucuagaagagcagucagugcucuuaacugcuaaaccaucucuccagcccuucauggcuuuuuuuuuaaacacuggcuuaagcucacaccugaauuccugucacuuggggcguggaggcaggagaauaaccaagaagaguuugaagcuaacaugggcuauggugugagacuguaaaugccuccaaaauaaguaaaacuugaaaacacucuccuagguggguccugccagccuucggcucuuuuuagccuccuguguaaaggaagacucaggccagcacccuucaggugcacaggggacuaaacgcaggggauugguaggaaccugguccaucugcucagcagucacagacagcugguucuugacgcccuacugugucucuggggaaggugggaagagcugacugggauucggcugucuagauucucccacugcagggccacccacuagcugccaggagguggccuuuugcaaguuaagguucuuaacuuaacacgggcucuguugauccaaguucuguuugguuuaagaccaggcucaccuugaacuuguggcaguccuuccuaccucuagaguccuggguuauagacaugugccaccacgcuuggccagugcucugcuggcuuuaacuaaugagacaagauguguuuaugcagauacacgagggcuccagggacauugaggagagaggcuucauaagcagugguggauggcuggugacucugagacagagcaagguggacugaggucuucccaagggcucuggcugcuggggcuccaguugaauagccucucccuguagagcugagagaauggaaggguaggaugcugucucucaggggagugcucccuuacgacggugaggcaccuaggaauggcacucugguccccaaggcagagcugggugcaagauccugagucucccaagccaaguacuuuuccaaggaaccccugagggguauguaccaaagcagcuuagaguugugaggaaaacauaaauauuugacuucugagccaagaccugcagggcugccacauggaguucccagcccaccuugucucucucacaggucacccuggagaccaccauuggcaacaagaacccagcccuguggaaguacgugcagccccagggcugugugcuggaguggauacgaaaugucguggccaaccgccuggccuuggacggggccaccugggcagacgucuucaagcgguucaacagcggcacgugagugcgauccuguuccccggccucuacuuucggaccauuuaguacucagaccagaggggacccauggggcuccagggcccugugcucagccccuucuuucaggugcucacugggguagcucgagccccuuccuuguuuuauacguggggaaacugaggcucaagaaagaaaggguuuucuuuuuucuucuucuguaagcuccuccucuuggggcuguccccuuggaagaagauaaacguuugggcucagauaacggaagggaaugagccugggaaccaaguucaggggagcggggugaguagguagguuucagagcaccuauggggcagggccuauggggcggggccugggaaccaaguguaguggaaguggguaggucucaagagcaccuauggggcggggccugggaaucaggcaccagaaguaguaugacuuugagugcuuaacuagaccgguccuuuaggaaauaauagggagccgugugcuguacuugaacaggcaugcagcaagaggguuuugugggcucccagucaagcugcaguauuaggcugucgucccugagacccggcuguauggggugcgggacagggcuggagaaggcuuccaggcuuggcacgacuccuuccuuguuccuggcagguacaauaaccaguggaugauuguggacuacaaggcauuccuccccaacggacccagcccuggaagccgggugcucacuauccuagaacagaucccgugagucccuggggcaaagggaggaaggggaggcuaaaggaggggugccccugaugggaacaggaguuguggcacacaacacaguuccugccgagggugccgaggcccucccacuggccgagucccccgagugucuccugacuugcuugguccaucucucucugucucaggggcaugguggugguggcugacaagacugcagagcucuacaaaacgaccuacugggcuagcuacaacaucccguauguggccuuguuuuuucaugucgcccccucuccccaagucugcccucccugaggcaggguccuuccuuaggugacauuuuaaacaugcugagcaaggagaacagucucucuccugcugggaaagccccacaucgucuugugaccuucauuuauagcaccugcugcagggcggguugggguggccacaccuugggacaggcauucagcuguaucugccccuaccuccuggagguagagaugcccaugcaguaaguacccaggcugaaguugaagugugcugggguagccucaguuccaugaagcuaguuuuagcuggauuuuucagagcuaccuuauguccugugcuuucccaggcuggcguuggguccuuaugaccaugauaacgugagugcagcugucucuucccauuccacagauguggaaacugaggcagggauccuccaugcuuagagaauagugaagugagaguugacucuagagcccagguucauccccuacaggacaacagggccuugccacaaccugacuacagugacagcugucccacugugacccccacucccaugccagccacaaccagcuauguggccagugggagucgugggugaccacccuugucccagcagguacuuugagacuguauucaacgcuagugggcugcaggcccugguggcccaguauggagauugguucucuuacacuaagaacccucgagccaagaucuuccagagggaccagucacugguggaggacauggacgccaugguccggcucaugaggugggucagcacaccccagguuugguacagagagccgccucugcaggacaguaccacugaaccuugccaccagccagccuuggucugcagauggggaccugcucgcuaccauccuuggggagugccuuucuccuaggcgguggagaugccugcccagaacccaggcuggagcugaagugugcagggcauccugagucccugcagaugcugucagggaacagaccggggucugaccugcguggaggaggguccuagagaaaccuccucaggaaggcuggagugacccagucgguggaggggugaggguggucuacaucuggcccugcucaagccaaaggugguguugggauaagcccagaaaguucaggauguuucagggccacuaugaggcuagaggagcuuggccucucccuggggugacugccaucccuuccuucccauccagguacaaugauuuccuccaugacccucugucauugugugaagccugcaacccaaagccuaaugcggagaaugccaucucugcccgcucugaccucaaccccgccaauggcuccuacccauuucaggcccugcaucagcgcgcccaugguggcauugaugugaaggucggccaccuaagccaguugucacaugccccggggaaggauggaugggacaggugcagggucagaggucagaccugggcugaagcugggucaguuuaaggggauaucacuuuggggucagcuucagaaugguguuuugaagaaaagucguggugagaguugggcccuaccagcugagugugugcucucugacccccccaggugaccagcuuuacccuggccaaguacaugagcaugcuggcggccaguggccccacgugggaccaguguccuccguuccaguggagcaaaucgccauuccacagcaugcugcacaugggccagcccgaccucuggauguucucacccaucagggugccaugggacugagagagaguccgccuccgccuagcugccuucauuuuguguggccagugggucauacaccugccguccaccccucgggcuucugucuucacuagacucugguccuagcggcuuccuucgcaaggacacaacccagugggcucagaguugccucugucucugagcccucugccccuucauggcucauccucccugucccugucaccagcaggcuggggcuuaugcuuggcugugggccuggugggauccggggcacacauucuccuagugcuggucccucagcauaugugugaacugacaggggacauuaugguugucacugcuggccugugggcccaucgccucaggaggcagcccugugcccuucugggcagcucuucuaagugcaggagcuugagaacaaaaccaaaguuucuggcugcuuguagcuggagggccuugagucuucuuucagcaggaggaauggaccgucaccccacacuucuaccccuacucccagccaagccugccccuggccuccugguaggugucucuggcugugugcuccggucagcgaagcccaggcugugcuucuguuaaacaagccuuguggggcggcaccacacccugucuguccauggcugucuccuuccaucuguccuuucucuaguccacguaccuacuguucaccugcaucaccagcccccugcccguccauccccucuccuguccacccuaccgucuuuucacucagucagcgguccacacaccuacccguccacuugccugccuuuucaucugaacguccucaccucucacccacccauccaccugcccguccgucagucuguccacccagaacugcacaucccuuuucauuuugguuuugcucuguaacucaguguggccuugaacuugaaugccuuguaguccacagucauccucugguuauuguaucugcuggccgccuucacccucacaugcuggguuuccauguacaggccgccgugccuugauucugcuuuucaucagcccacucaucucucuguccauuuaucccuguuaguccuucugcucagcaucugucucaagugcuguauucuggguccuagccuggcccaaccugcugaccacuaagacccuaaauccuagacccagagacccacaugaaaccaaguccccuguguggggcccagagagcucacagccugugaaccagaggcccuaagauguguggguagcuuuacccgagccaguccgggccugccauguguucugaguuucguugguagucagggguugguuuccugucagguucacuccaccuucccugcucugcagaugccugcacgggguugguuuuccagacaccaggguggggccgcuggugucucaggauggccuuguccugucccuaaggacuucauauuagcaugugguggccuugccugugcaucucccagcugcuuugcgaccccacccuagaucccuguguggcuuagcucugguccucucuccugacuuacggauguguggguuccaccagucaauccacugggagacccaagaccccagaggggagcaccacuucucugagagccagggacgauguggcuggguguagagggagacugaacaaggcaaggaagcuaacgccugucugcccggcacucagaagaugaggcaggaggaucuccaguuugagaccagccugggcugcacauagacccucaugucaagaacaaacaaagcucaaaagaucuuugcucuauaaauauauauuuauuuuuuauuuacaauggaaaagugcacauuauaaacacagguaaaggaggguggggccauugucaaguguaucccaccccacuagggggugccggugaccccucugagggaggccagggcagcagcagauaucacucgggcagcccguucaggcccagcugcaccuugagugccugcagcugcgccaggcuuauguugcugccgccacacacgaugacaaccagcgaggccagugggguuugcagccggccuucauccugcagccugcacaccacgcggcuguacacagcagccagcgccgcgccgcacgcgggcuccaccagaaucuucucaucgucuacggggggagggggaggcggcugguaagcucucaacaucucccuauggcuggaacugcuuguuccuacagccugugcuaagggcacucaggcaccugagaaggucacuccuguguggcagcaagcugagaugauuaacagcagugcguguucuuacucuuguucucuuuggcuaucuucaaggcuggccccagagaguucugcuaaagaucaucuccaaguccagcucaucuugguccucuccccuuugaucccagcuacugcuaucaugauuaccagacucacauuu

SEQ ID NO: 2651 - RNA, 1310 nt, Mus musculus
gugacuggcuguuuuccuuuaauccucuacugacuauauaagugaggcgacaggauccucaaaguagaaccucccaucucacuuucagggaccggaagaagaagcgguuuguggggcagucaggccaagaagacaagaaaaagaucaagacagagagcggccgguuuaucagcagcucuuacaagcgggaucuguauccugagaggcugggaugcagaggggcagggccaggcggcuaccugcugcugcuccuauaggcguggccaugucugggggcggggccgggcguucagcugcugcuccuauaggaggggccaggucuaggggcggggccgggugucaugcugcugucccuauaggaggggcugcgccugggggcgggggcgggugucuugcugcugcuccuauaggagggggcgcugcgccugcgaugggacccagugguuuccucagcauccccguaauaaggggccuuucuccaacuugggugcuacuugcuacuuccuuaacgaggcuuucagcuaccagaaguggaagcagaagcagaaaauugaugaccgggacuccgaggaagaagggccauccaaccagcgaggcccugggccccgcagagguggaaagcgaggucguagucaaggugggcagggcaggugguauggugugaacaggaagaaagccaggcauggugaggcacagggaugagcacgggcccaaggcugagcuccccccaaaucccuguguugacaggcacaucccagccccgagcuuccaguguacccgcaggccgcaugcgcucggaacucaagaccaaggagcaaauccucaagcagcgccggcaagcucagaagcagcgcuuccugcagcgagggggccugaagcagcuuucagcacgcaaccgacgccgagcccaggagcugcgccagggcgccuuuggccggggugcucccuccaggaagggcaagaugaggaaaaggaugugaggagccagacgcagcccuggggcuuccugguagccccggguguggacgucagggacuauguccaugugcuguuggaagauccuuccacaggcgcugcucugugaggaguagugccauauggccacagagcaacagcugcuuuugacugggacauugggugaccucugaaaggaugcauaggagucuagcuaugcaaagcaggcagacccaaguccugacccugcaagucacagcggcuucugguuccacaccuucaggauucagagaucagggccguguggaugccucugacccagcauugaguuuuaauguaauaaacuuuacugccuc

SEQ ID NO: 2652 - RNA, 1833 nt, Mus musculus
uccccagccgcuaucuuuuauuuguuuguuuauuuauuuauuuauuuaucuauuuauuuauuuauucauucauuuacuuauuuugguuuucugagacaggguuucucuguauaagccuggcuggccucgaacucagaaauccacuugccucugccucccaagugcugggauuaaaggcgugugccaccacugcccggccgcagcaggcccugaaucugcuuccucucauucacuagcuaaacaaagguucacagaggguaagaaacuuaacgcacagucacacagcaaccaaguggcagaggcaggauuugaacccaaguagcccuucaaacccucaucuucacacuuagggcaccugauuuuaccucuuuaaccaaaaagccagcaccuuagauugcccugugaaaucuccagaucuuuaaucgugggaacuaauucacaaacugacucuuuaguacuaagaguggggucuaagcccugccuguacuaaugacaggcuccgaaagaaacagaauuuuauguagugaauggaugguguaauguaacaggcauaaggaucagacugcccguuacauucacucccaucccccuauccccccccccccaaggugcugagauugcucaucaccgccugggaacgcagacucaucuucacuaucggaacauccaacaccacgggcgagucggacaccgugguguggaacgagauucaccacaagacggaguuugguuccaaccucacuggucacggcuaccccgacgccagcuaccuagacaacgugcuggcugagcucaccgcccaggggguuucugaggccauggccaaggccugaggccugaguugcccgccuucccuuuugccuugccucuagccuggcacaugccucccuccgcucucggcgggaggagccagaagcgcuaaggggaucuggcugguggcuguggggggggugaugggaguccaccaggccagcuggcuccaaccuguggcuuccggcaagagcagcagagauaggaccaccagcaagggcgacuucccuauggaaaacgauggcgcuuugcccuucacaccacacacaaacgcacacguguccuguugcacgcacgcacucacgcacguacaccacgugccucuccacuucucccagcuuggggagaaagagacagaaaggcccccaugacauguccuguggaaauaccugugucuccauuacaucuguauaggcucgucccuuucccaggacuugagucaagcacgggauagugggggggacucuguaaggcuucaaggggucgcucugccccugggccucaaccccuuaacccacgucagcgcugccaccugcccacugagcacugcaaagccaaugggguagaaaccccagguuauuaaguagcuuuucgcaggccacuggggacgaggcuaucuuaacuuugugcuugugucuaucuuucccgggacccugacuucuucuucuuccuguguccaucucuugaccucugucuaucccaggcaaagacaucguccuugccucuguaccggcuucucccccacuaaaccgcuccggacauuugagacccacuucuggcuucaggagcgaggggaggaggccuuguucaggcuauacacgcaucaagcugagcaggcagcaaagcguuaaacuucucccugcuugaaagugggcggugggcggcugaucgucucaggccaaccagaggcccguugcccaggcaacucaccagcuccgccucugaggauuggcugcugggauggaagucagccaagcuuuaaagggacgccagcaauugcucuuuuggaaaaaaaaaaaaaau

SEQ ID NO: 2653 - RNA, 1275 nt, Mus musculus
uccacaauccugagaaacuucuggguuacugagcccuugaauggccaccgccuaaccauuuucugacaagauggagauguacguacacccacaugaugacauucccagaaagguggcaucccugggcccuucccaucuuaggguuugaaggugaacugucccuacagguucauguguuugaacacuuggucccagcuuguggagcucauuucagaggguguggagaggaaguggagggcugggaagugagucuuaagggugguaaccccagccugcuucuggccccacucccauucuguguuuucuuccugguccaagacggcaucaugcagcaucaccuccugcagccauaucuuccccaccaugauggcuauacccucuaacagggagccaaaagaaagacaucccucuuccaaccagaaaagggacugacacaugacccccugggucccuugucaccaaaucuaagaucaaaggaaccagcuaacagguucguuuaguuguaauggugugccugccuugaaagggcugcaggaaauucuggguucucgcuucugauacacagagucugguaguaggaguccaguccaacugcugccuugacccaaucaaggaaacugcugggagaagaaacucuccacauguaguacuguaugaugccaccagauggcgauagauuugcaucuuccaaaauaagauuuaauuacaagaaagcaauaaauguugcugaaaaaauaagacccuacgggggcucugaaaucgcuuccuuuacuaaauaaaaaggccaacuagccugguauacuugucucuaccaggucaggcagacuguuguugccaugguuucuguaguuuugccccacaugaggcuuguaagacuuguuacauuguugcauaaaggacuucaguuaugccugguauagagucacuagucaauaaauggcaagggcacgugcccaguacuugcuggggaguccauaugguuccuugcccaaagcuguguaccuaaauaugaacagcggaacucagugagcaaguguggaaacuaauugguccguacaccucucccuuuccugguccugucaccuccaggugcccgagucuguguaagaggcauugguagaaguguaacacagacguauguaguugcacacaaacauuuggcuuugguauuauccagaggccuucauuucucauguguaauuuacugccucaugcuguguguggcuccacugauucugucuugggugcacgcgcacacgcacgcacgcacgcacg

SEQ ID NO: 2654 - RNA, 12456 nt, Mus musculus
cagguaccuccccauccaagccugagcuuucuuaagauccggcccagggaagaauguguaaggaaacugaccuggcuuucucgggauuucuucuggaaaaaaggcuguuacacgguacguuuuaggaacaaucugugcacguagaagaagggaaacggaaucaggaaaccacagaagguggcugguggcuccugagcucggcuuccaucuccugcaaacguuuuaggcggaacugcuuuuuuuuuuuuucuuuuuaagaacagcaccuccccagguuuuguuuuuccuuuaccucuggacuugcaggucuaggauuacagacaauucuaacagaaagcucagacuucccagaagcccccucuccuacucacacccuacauuuuccccuguggugcagggggucugggugaggguggggucugggcauccccaagggugaaguacaggccguaccaccaagcuggggacaguacaggucagcagugacuauuaaaaugagcugucuuucagggcccuggcaagguugaaaaucaccuuugggugacauacccaaggccucaucaaaacaguuugaugcccuccaaccccugccuccaucuucucaucucuuguuuagagggcagagagagggcucagaguuuaagagcucgggcugugcuuccaguuccaauucugagaacugacauggcaggucccaaacacacacacacacacacacacacacacacauucacaugcacacgcacagggcaugcacacacuaaauacacuccugagcuugccugugcacauaugcacacaaauacacaaacaaguguauacucacaugugcacacccgagcauuaaccaggauguacuucgaugaggaaauaaagagucuggccuucugcaagagcaggauuggccuuuaugcaucuccaggaaggaagccauugcuaguggagacugcucaccgggcacagggagcuccaggggauuaggguggaaaugggaccuuugggggucugcagaccuaguccugcuuccccaagcugguggauuuugguggggugcuuaccccguuggccucccugauccucacugcacacugacaucagcaccauaucuccuccugcagggagucacucagacugccuggggcuucuaggucauuagcccuucacaugcaggaaaacagggaagaaaaacagcauuguggguggcccuagcaguucagcaggcagaggcugaugcaggaggauggauaguggaggcugguccauccugggcuacacuacagcuggauucacuccagagugugagggggaaaaaacccuaaaacagaugaagaaaugaauggaaaaaaaaaaaaaggauccugcccaaugcuguggcugagagcacacucugggcaguaacacaguucuuuccuuaaagaaacaggagcgggaaguuccacugaccaaaguugugucauuccaggucagaggugagcccucagcacaaagugucagcugcuuuaaauuccuuuuggucagccagguguagugucacaggccuuugaucccagcacucuggggucagaggaaguuggaccucuguguuuuuuuuuuuuuuuuuuuuuuuuuuuuuuuuuuuggcuagccuggucuacagagugaguuccaugauagucagagcucaguggugagaucccgucuugaaaaauaaacaacaacaaauuguuguugguuuuugugagccaccaaauaaaucugggaagugagcccagguccucugcaagagcauccagugccuggcccuccucugagccaucuccccagaccccagguacaaucuucuuggccucauugggaggcaugguggauucugagggaacugggaugcugaaggccccucccacaagugccaggaugggaggacgggaggccagcugagaguccugagcagaucugggggagcaccaagcuaaucgugcuuuagauagucuauacauuuauuuccugugugugaguaugugaggucagaggacagcauguagaagucggcucucucuccuuccaccacguagguccuggggaccaaacucaggccaccagccuuggugacaaacaccugugcccucugagcuaucucagugacucagugacccuuuuuguucuugguuugggagacagucucauaggcuaggcuagccuucaacuugcagcaaucucccugccuccgugcugggauuauaguguguccagcucaucucuacuccgccgcccuccuuccccccguauccuagcgaguaucauuaagcccagugagaucaaugccccugaaagccugacugagucugggagugcccagaugacaagguuuaagacccugaaccacccucuuggccacauagccagcuucugcugggacacacugcuuucuucaugagccccaugaccccgcccacacugugucagcucuaucuggccugauugggcccagacucagcucaccuccagcucccacucaggauuuaaaaaaacaaaaacaaaaacaaacaaacaaacaaacaaaaaacccauggcuugcuggagauugagaguucuauggacuagacacauucaacacuuccuccuggcuugagccugccucuccugcuuuuucccagccuccucguggggugggguuggggguggggguggggguggggguguacccuccccagcucaggagcaucgucuuggauggguguuguacaccagagcccaaguauagggcaggcaugugggaugauguugcugaagccugugccacaggucaggguucuucauggauaaugcaacugcaaggccuuggggaugucccaaaaucuuaaugucagagacagaauaaggaccuggccaacgugagggaaugaugucugugggaacagcguuuccugccaugucacccuuugcagucugcguaguaacugagagaaaagaacaauuagccugcucaggagucccaguguuaaugaaaauucucggccugguaggcguguccuaugcugguaggcguguccuaugcuggccugguaggcgugucucaugccaggauaaggggucugccuccccucuuggcuguuuggcaauggcugcauggagcacugugcacagaaggguucugaagccuuuggcaguggccuuuguccuuuauggacggacagacagaggugggaguaaagggcagaaagauugguuuggauuaggccuuggacgauagccacaucaugggugugcaucugagaacccaaagaacugugaggcacuaagucugaacuagaagcuagccaggaccuugcagauuacaauauccagcaaggaccugugacaaauccaccacagcugugcugaaaugggugccuaccauuuucuggauuuaucuaacuugaucuucauguuuuacugacgugugugugagugugaguguguguguguuuaucuguguguguucuguuguuaaaaaucuagaaggcaaucaaaugauuuuucuuuaguaacaauucaagaucaagaaggaggaacaacagaaacuauguuuaggaugcuucaugccuccugguucacagccugcugugaugaggguuugacaauccaaagaaaugccagcagguaaacagaccccagagggucagggagcccaggagccagagguggccugugcagaggucugauuugcauagccccgcccuuccugggaagagaaagcagcuauggauauaaggggcagcugacucaugaggcaaggcugcagucagcaaacacuccuggccucaggauggagaauggucucugcagcauccaagccagggagcuggacgaguucauaugugauuaccucuuuccugacaccaccuuccuuacugagcucagagcagacaucgacuccauaagugcuuuccugaaggagagaugcuuccaaggugccgcccauccugugagggucuccaggguugugauggugagucccauuagccugagcucauugggauggggugggagaggacucucagaagccagacugcaguccuuaguggggugugaguuaccuaccugcucugugcccaguguccucaugugcaucccagcuauggcacagggcuuaucuccuguaccacaaggagauccagaaccaucuauuauccuacagagaugccaauuucauucuucagggcugaauagaauuccacuacacaugggugagcucucagugguggacuccuacucuauucagcaucuggacugcccagcauggcucuccuauucuuuguuauucucaucuuugucuuuuagggcggcuccuaugaugaacacacugcacucaagggcaagucagaggccaaaaugguguuguucuuuaacaaucucaccagcuuugaggagcaguuaaagcgacggggagaguucguugaggaaauucagaaacaccugugucagcugcagcaagagaaaccauuuaaagugaaguuugaggugcagagcucagaggagcccaacuccaggucucugagcuucaagcugagcucccccgagcuccagcaggagguggaauuugaugugcagccagccuaugauguccuauguaagucagccagcagcagagccucagccuacccuuccucaugccugaauccucucuucuauuccuucucucucucucucucucucucucucucucucucucuguguguguguguguguguguguguguguguguguguguguugggguagcauguucucauguaugcagaugucuguucacaugucugcauguguagguaauggucagacgccagccuuggagguugguuacuuaagagccuauuuugguugagagguugaccuggaguuugcugccccaccuucauggcucuugcaguaaggagcuggggucaggugaggugugugcucugauggagcugaacccacaaucucuggcaccuggagccucaggaugucaauuagguacagcacagggcuggggggaggggaugcuuggucuccuagaagugucuguaggcuaugagucuccacuuguaaacaauuauacucaaacauauucaggacacacuugggcuuccuccaucaagccaggcagguuuguuuucuuguuuguuuugagauagauggaugggccagcuucaugucaacuuaucuagucagacagugagccugagggauucucuggucucuacuuguccagcucugagauuuugguguggacccucaucaugccccucaaucacagcuuuuaucggggauacucaaaaucugauuugaggguccuuuuaguucuuguaagaagcccuuuacgcauagagccaucugcccagccccuggggcauccagaaaacaacugcauggugaacagcugucuacauggcugagacugggaacugugugucucuaaaagugggacaaaaaaaauggcuaaaaauuaacaucuguuucuucuucuaucaaagaaugagaccucaaaccuaugcagccgccuggguaucugcacauggggguuggggugcaagaugcagaauuuccgaaaggaauucuuucccccucuagaaaacuagaaacccagagcacacaccccgaaucccucaugcacacacauguuauauaauugcacauuaacgaaucucuacauuaaguucucucauacuaggccugacugacacaaaguaugucuccaaaauuacaaauuucccaaccuacucccucccugcccccugcccacccaccccaccccaccccacccaccccccccaaaaaaaaacaagaacagccaugaaagaccaguauggggagcuuagagaauacuugaggcuuuacauuuggaggaagcacagcacccccuguuggccacugugugaacuguugcuuuuacuuagagacaaggccacaagcccuugguuuaggagagccauggaaucaguccagagucucaggcagcaaggacugagagggccagccugggaguaggaccagggcaucauguugugggaagcugcaagaggcuuagaacccugcucagugaagggggcucauggcagggggugggggaggcggggguagcccagaaaugagcugggagggcggcuccagcaguagccugucuugcucauggacuucuccagccuguggcagcuuuccagugggauaggaacucgauccuagaagaacugccuugggaaugcucguguggauagcagcccaaaagaggaccccagccacagcccuuacccagguaacuuagcacaguucuggggagacagcuaguagauaagagugauugcuguacaacugugaguccugaguucaaauccccaaugcccaccuaauguuaggaaguuccacacguugaucuuuaucccuguugcuaugggaacagagauaggagagucucuguggcaugauggaugccagccaagcuccauguucacagagagacccugcugcaaagggagagugugacaaacuauaaaggaagaugccccaucuccucuuguggccucugaauauguguuuaccacauccaugcacacaaaauccacccuucaucucaaaacagggagagacuguaagcaggagauacgauauacaaaugcagucgagugcuccgugcuacaccagagcaugguuggccuuugacagaugacuguguagcucuccugugagugaccacugugugcuguuucuucccaccacugucuucagaccugugaguaaggcuuccuacuaauagcaguuggagccacagauuuucuaggucaauucacuuacagagguguggugggcucauggcuguauuggaagcaaugcuugcugaggacaaacuuugcccuguucacugaaccgaauacacaguaauugugacccuagggagaaggaagaugcucagagcaggggugagucuaaacaugagagaugcuuucuuuauagaugaacugagaaacaacacguaugcugaaccccaauucuacaacaaagucuacgcccaacucauccaugagugcaccacccuggagaaggagggcgauuucuccaucugcuucaccgaccuccaucagaacuucaugagguaucgugcgcccaagcucuggaaccucauccgucuggucaagcacugguaucaacugguaaggcauccgacccagauccuguggacccuauguguagagagugggauucaggccagagaagaggucuagucuagcuggcugucuauggacaugauagcuuuaucacaugaccaagagugccuugggaaggaaaggucucacuugguuacacaucccagucacagggcaucauugagggaagccaggacaguaacugaagcagagaccauggagaaauucugcacacuaccuugauguccauggcucacucagauauuguacaguccacaugcucaggcauagcaccgaccacacccacaccuaucaugaauauuuccgcacagaucauuaagggagcccuucccuaggacugguuucugaacuaguuugcucugacugcugugguaaagacgcugcugcugcaaaguaauuggguggaaagggauugucuggcucacguuccugcaucgcacuccaucucugagggaagcagaggcaggaacugaagcugaggccauggaggaacucugcuagcugccugagacccuugggcgaucagucugauuuuuacaaacaucucaggaccaccugccuaggacaggcaaugcccacaaugggugggacccucccacacugaucauaaaaugcccacaggcuugacuccaggucaggcugauggaggccuuuucucaguuguggguccaucuucuccagauggcacucucugugucagguugacaaagacaaaucaaaauggcaccaggugagaaaauaaaaaauggaaaaggaaaagugguuagaaggggggcagaucagagggguucagagaaacagggugugguagagcaguaaaggaaccugaugcuguaggagggagagggaauggggagggagaggggaccuaagaggagggaggacuuuccaugcuuguucuaagugauuucuuugaguccacuuucuauucagcuaacucucucuucagccgugucuaauccgcuguuccauggcagcggcuucauuugugucucugccucucugcuuccuucuucagcaaacacuucauguuacuuucuaugguuucuauuguucggauaguaccucuuuuaaugggugauuucucaauauuuuccuggacuauucuuuaaauguauauguguuguuuguguguguauagcagcaugcugauacuaaagucugauucccuacuugguucuugauuuagucaauaaagaaggugggagccaauugcugggugaaggguacagugguauuuccauaucccggaaugaaaaagagacaaaggaaaaagaaagggcuuuucagccaggcuuuggaaugaggagcaagcaacaaccauguaagaucuuaggguaacuagaacuggcugccgccuccuaugguagaugucugauauaggcuagcugauaguuaagggcaggagauucugcacccaggaauuguuaucuggcaaguucugucuaaacgaguuucuuccacagaguaaaaauggguagaaaaagagaggagccagauccuugaugguggcuuggcaaagcuaagccagaaggggcugagagcacaaucacaggggaaagucugugguuggugguuggaaaaccuaaccagggaaaaccaagcaaacugggaguggggccagcuguagcugaucucagagcuacacuacacugaaagcaagggccacagucccaggagaggcagagccuguuuuaaaaagaacucacaacauauaccuguucaugggagcacauguauuugugugugcauaagauuguggcggccagagagugagagcaggucaccuacccaccuucuauaaucagucagggucucacacaggacacacagugugcuggaucagcaagucuagagaguccugcagccccuggaagcacaucuccagccuuuugagcuaggauuaggagacagcuuccucaagagccugacacucauguggggaucugaccuguaguucucaccccuacauggggagggaggcgauuuaccucugagccauuuuccuggccccuucccaguuacuucagagaccaugagaaaacuuccauacugagcacuccuuaugucccgcccccacccucacuccuggcugucacucaugaagucuugauuccuccugugccuacuagugaaugcugucuuuguggagcacacaggaucagucucaaucacucagcucuugccuauagcacagaaggggacagagacagaaucuaaauaacugacauguaaugacaacacgaggaggcaacugaauugagccuaugagaagugucccccacaccagagcuaagagccccguuuuccucauuaccuuucucuucucaguguaaggagaagcugagggagccgcugcccccacaguacgcccuggagcugcucacugucuauguaugggaacauucgaauaaaaaucaagaaaaaguaaccacagccaagaacuuccggaccuucuuagaacuggucgccuauuacaagaaucuucgaaucuacuggacaugguauuaugacuuccgacaucaagaggucugugccuaccugugcagacagcucaaaaaagccagguagcuuguccccacauggcuuugcuccucgagggugucgggcugcaauccugggaaaagagagaggugggagccuugugucaacucggcaucuccugcacugggcgcugucaucugacugacaugagguccuaaugcccugggagauggggagggaggauguuuaucuugucuguggugaggagaccaaggcucugacuuuguccugaccaaaacagcaaaggaaggggaggacauggaguggggacugagauuuuccaacagugacagcaucauaagggcugugaugcaccaaagaccugcggugaaccaaucaccuauaaauaauagagugcuaugucacccuagggagugacauguccugauccauguuugaucagcuuucccacaucagagacccugagggaccugccccaggacacauagcuacuaaaggguagaggauucgaacccaggccuucugggucaugcccaaggaucccuccagucuugcuguaugcuguggggcagggacacugggcaagcuuuggauagggaugcagugcugggcuccuccccugccucugugaaguggagccugaggcacuguucagcugcucaauucccucccugaauguugcucugcaggccucugauccuggauccagcagacccaacaaggaacguggcugguucagacuuacaggcaugggaccugcuggcaaaggaggcucagaccuggaugcaguccucuugcuuuagaaacugugauauguccuuugugcccaccugggauuugucggugagacccugucaucaucuuauccccuugcacacagcuuuggucacucuauuuagagaauauucucacuaagaugugaucuguuucuaaagaucuccacaguccugggugggggcugcugcuugccuucuuuuacagccauuuuuguaacauucagagcuaucaugggcuggcaagagagcucaguggauaaaggcacugccaacacugaagaccuggcuuugauucccuaggacccauaugguagauggaggaaaacaaguccccuaaauuguccucuggccuucaucucugugcaguuacacauguggacaugcacacacacacacacacacacacacacacacaaagauggagauucagaacugaggccacuggcucagggacacuccgcuagagaguguuagggcugggaucccauggacucugaagccacugucagguccaugaagcagccugucuccccugucacaucaucauguggacaaugggacucaguggggcugugucacaggcacagagggaccugcacuuggaccuuucccuucuagggcagggucugccugaugguagggaacugaugaugucacgugugaccucaggguggugaugaacaugggugcauugauguugggaagaaaccucaggagaucaggaaggaagugagagggggcauggagggaggcagcugagggaacaguggccuauagugaugucccgcagcagagagguggcgaggccaugucucccaauuggcagaccuaauaguaaagaagggccugccuguggggccauauggacccucaauggacauagucauacagguguccugauggccaucuuuccuaccuccauuugugcugucccucuucugaggagcuccagguacccaguugugguucccacccacagggcugguuuacaucccccugcaaggaaugcaggcuccugacaugauuguauguuauucauugcagccagagagacaagaaugugccuuccagugagcagugcagcgcuugcucugaaggcuccagagucaggggcauaccuuccucugcugcaagaccuugaccuagagaggacaggauggcacucaaggcuccagugaggggcauccagccugugaucagacuccaggcuucugaucccugacugcccauggauagccuuccucacaggcugcuucaucugccuuagcuuccaacaguguucucugggagucagacugugauggacagagaagaacgcaagcucgacuuccaucuguccaccuguugggagguucuguccaacaguggcugauugucaucaacaaaccacagcaagccaugggggagggugcacucugagagaaggaaccuuuaaguacacuugugugucuguguguuuaaggaugugguguguccauaugcaacuagaaaccuugagcacguguuacaagcuccacaugggcccagguaauugccagaaagggguggacagagaaaaaccaaacuguuacacguauugauguuggguagcuugggauccuucuagaucucugaugcaagaaacccagacuagaauccauggcuccugcuguccauucuccugugacaaaauuuuaggccuuccccaucccacacagaaacuguucuccaaccacacaugacccuggagcccugggaaucuggccagcgugcaucguggugcacugauucugcagcaugcaggcugagguccacagcagugugggaaacuaugugcaauuugugaccagugaugacuugaaagcuuagcugucugugugagggugagauuugaagcacugaauuaaaucacaaugcacugacucgaacucaaaacuaguuuauuaucucuccuuccuuuacuaucuuaauuucugucuuucuauauuucauucuuuuuuuuaaucuucauuuuacuaaaucuuauaugucuagccu

SEQ ID NO: 2655 - RNA, 13910 nt, Mus musculus
caaugggcguggcccucggcgacggugggaagcggcugggcagcugggcgguuguuggcuccgggcggcggaggcggcgguggcggugcuguucccgcugggcucggaggugaacgggggcggcgggguggggcggggcggggcgggagguggcggcggugacgcaggcucgcggcgggaggcggaggcucggcccgcuccaaccgcccgggcccgcggagcgcagagcggccgcuccccgaggcgccgcgguggcguguggcccggccugccuccgccucccccggccucccgguuugcugagucuucccugccgucgcuagaggucugucuguccgucccgccgcccucuuugucugugugcuuucccgcagacacucaccuuagguuauugaaaacgaaccuuugcuugguuuccgggcuuugcuacacuggacucuuggauucguuaaacagugucaguuugcccgggcgcugaggcugcuggcgggugacuugacaguguccagaucagccugccgcuuuguuagcagucggugccgaagucuauuucugugucgugggaaggagugauguaaacaucggagcugccuuguauccuggacgggaagcgagagaaagggcuggagcugacugcucuugcccugcgagcccgggugggagggccucagauuugaccgaggagaaacaccuaaguaggcagugucguaccauuugauaagauguccaauauuagcgcucugcuuacauuugguuuugcuuuuuuuuuuuuuuuuuuuuggaacuagggucgaauccaucccacguuggccuugaacugacuaagucgccaagaugguuuugaacuugugauucuucugucucuauaucccuagugguaaauuuacaggcauguaccaucaugcccaguuuuaugccuggucagggaacacagagccccguaucgcuugagccccugcuaguuugaugaauacuccugccaaauguguagagccugaauuuaguccaagaaaacaccagacaacccccgcccccaaauggaaggauugauuacaaaauagcuagccaguagcuagaaacucuuaguaacugccagucuucgcuagcaggcucugauuaagguacuaauuagccgaucaaggcugugagagauuagacacgagagagagcuuucaaauuagaguaaguaguaacaucuaagagcuuuaugucacccaggacugaaacugaaccaagaagggggauaguggucuccucacugacauuugaagaaggccugaggauugguuacauuuaauuuaaaaaaaaaaaagaauuaggguuuaauaacauuaacuuuuacugaaguugggugaagggcauaagggaauucuuuguauuuuaaggcuugggggggcaacauuuuguaagucuauuuuuuuaaauugaaaaugaaaaggcaaugaaaaggaauacccuagguuuuucuucuuuugcuugucaucccgagagcagaaaugaaacagaaagugauaccuguuccuuugcaguuuucaggaagagcugagauggccgaguuucgagaugaccaggcuucuaggcugugugacaacugguaagacauagaaucccaugguuugaggacaagccagcucuguaaagacuugggugguuuauuggcaggcuguauuguguuuauuggccguaugugauucuaaacuaugcaagucacuguaacuacagccuuuuaaucauuugggcaaauggcuuguuuagaauuuggcaggaagauuucucuggguagaagagggaguggaaugauaaaacugggacuugggggcucuguucugucuuuaauaacuuaauaagauggguccagggccggaggaguggcucagugguuaagggcacugccugcucuuucagaggacccagguuugguuuccaguguccagugguagcugacaaaucucuggaacucguuuuacaugagauccaauagccucuggccucucuggacaccagggacacagacacguaugcaggcaaaacauccauacacauaaaauaaaagaaauaaaacuuuuuuuuuuaaagauacuuagcuaggcguggcagugcacaccugagucccagcacucagaaggcagagacaggaggaucuuugugaguuccaggccagucugaucuacaguuugcuauauagggagacccuucuuaaaaaccaaacaagcaauacuggagugguuuggacucucacucaccuucuuugggaguggggguggguagugguagggacagcagacaguccuguggccagcucagccaaugagcuacccucagcccuuauucacauauaagaugacuuuucuuccccagagacccucuuucucuggguagcccuggcuguccuggaucucacuuuguagacucacccugugcccuugauaacuccuagggauauuuaccugccucuggguccccagcgccaggauuaaaggugugugccagcacuggcugagaacugaugcuuuucauauguccaaaaaaaguguggucauuuuuguucguuugcuugagaccaagcugucauugagcuucauagagauccacaugugucuugccaguguuguagaaggaaggacuucccucaguggucacgaggcugucuuggggugccugggacggagucuuccugaccuggcucuauguguagugauggaaaaauuugcugagcagcucaggacgaacuuuuucuuucuuuccguuuuuuguugugggggguguuuuaaggcagggccuuccuacauagcccaggcuagccugggacuggauaugugggcuccagaguaaagaugaccuaauuugaagaccuucugucuuaccuuccaagcacugggagccgccauauguagugacaguaguaacuggucuuucucagggguggggaggggacccagggcuucucagcaguccaccugaggacugacagcaugcgugugcaccgcuaugcugccugugagugggagggcauacgagcugugcucaggagacugugcaggacucgggucuaggaagcaucuuuaccugcggggccugauguggcuucuucaggaauuuaucuugcuguuuuccugcugguacaugcugcauuuuacuuaguuuggcuugguauucuuccuuggagacaagauuuugcuguagccuacaagguggguagccccagaauagcuguacauuugguucguaggcuaguauagcuccggguccucccuccugccugagccucccgagugcucgcaucacaggcuugcaucacugguccugggucuacuaauucucucucuucucucuuuuuuaugauuuauuuauuccuuuacuucaugugcauuguguuuuaucugcacauaugucugugugagggugucagauccaggcucuuuucuucccuuaagauuugcuuuuuuuuuuuuuuuaaauguaugagugcucugcugcauauacauuguacauccauaggcaagaagagagcaucagaucccauuacagaugguugugagccaucaugcaguugcugggaauugaacucaggaccucuggagaagcagccagggcucugccaucucuccagccuuguaaugcucuuacuuaaaacuaacggagaaagaacuguguauuccguuugugugcaugcaugcacaugugugagaguguggcuugccauuucagcaaaacugguuggccaugagcccugagucugccugucucugccgugacuccuggcauuuacaugugcccggggaucugaacacagguccucaagcuagcauagcaagcgcuguacccacuaaguaagcgcagugcagcaguugguuuugggcuucccuuaccacgugguguaguggggagacacuggugggggagacugcccugcugauggggaguuugagcagagcuccguugcucgcccugcccucguggguggcugaagggcauaguuuagagaguagcuuuucacuggugcucccugcuugccacuucagagaguccccaagugucauuugcaugucugcauaagucaguggcuuugucaccauugauguggauaaaauaagaaaaugucacuugagaagcaaaauggcauguggcugagccauccugauucccagucuguugucauucgaaggagucugggacaguguauaaauaacugcuaagggauucagaaggcacagugcaggagcuagugagaacaagguuaccuggugcagagcaacguacagaagaaaagcagcuuagcagcuuagcguggacgacagaccuagcuacaccggccugucugaggaacuauucacacugcagguuuugaaagcugcucugggggugcuguagagauggcucagugguuacgagcugcuacuacuccagcagaggacccaaguucaguuccuagcacccacaucugguggcucacagucaccuauaacucaagcuguagguggaaucggaugccucuggccucucggcaccagcucuccugugcacauccccauguaugcaugcguguaagaguauuaacuacaucuuuuguaaaaguuuuuuuuggggcuggauagaugguuugguggguaagagcacuugagcacccguugcucuuccagggcaccuaggcucaguuuucccaggguucaguucccacacuguggcucaaagcauccauaaauccaguuccaggggaucugaugcccucuucuggccucuauggguacugcaugcauguggagcacauacauacauguaggcaaaacauuuauacacaacgucaguaguacaucuaauaaaacuguuggucuuugagccagguaugguggccacaccuuugauucuaacacuugggaggcagaggcaaguggauggauuuguuaugaguuuguggccagcccugguccacauagagagacucuguuucauaaaauaaaggcaauuggucuuuggagccuucucugccaccucucguuuuuccccucgguguuuugagguaggguuuuucuguguagcccuggucauucuggaacuugcucuguagaccaggcuggccucaaacuuggauccucuuguuugccacguuguacgcuaccaugccuggcucuggcucucugucaucuuaagaaaagggucuucaggacuguaauugcauuagguacaacuaggcaguuaguaggaaagaaaagucuguugugauuaaaaaugcuuuuuuccuaaauggugucuauuuauuauacuauauguauguauucuguaugcacgcacaugugcaccacgaugugcaagugaagggcaaaggauagauauccuuuggggaccaguccucuccaccuaccguggauccuggggugacauuuggguugccaggcuuggaccaucacaccaacacagaaauauuuugucaccucuucucuucugguucuggacauuccaggccaugggaggaucagcgauaggagccucccgguaccuggaggcugaggaaggagcuccaggccaaucggagcuacacuagcaagagcaugacuugaaagucaaacacacagagauaacaaucauuaggcgggccagggguuuuccauucccagcgcucaguaagcuagggcaggaagauggcugugaaugggaagcuugucuauaugacagugacagcgugagaaccagucucaaaacacaagcugggcaugcugggccucgccuacaggccucaccuuugcgagguggagagacgaaaauccaggucuuuucugcagagugacuugaggccagccugggcuccaugaguuccugugugaaaaggcaaacacaaaaccaaaauguggcuggggaccaaacacugacaggacauguguccaugugguggcacugugugagagagggugugggucacacaguaacgcuugccuuucuuuccgcuuacuucugcagcaagaaggaaauuccuguauuuaauuuuaccauccaugaaauccacugucaaaggaacauuggugugugcccugucugcaaggaaccguuccccaaaucugacauggacauucacauggcugcagagcacugucaggugacccacccguccccagauguccccggggaaaggugucgugacagggccacuggauugacucuuuucauccuaggugaccuguaaaugcaacaagaaguuggagaagaggcaguuaaagcagcaugcgguuagugucaccgugggaagggaggagggaugcacuucuggggccaggccccgcugagaccacagagccucguugcagcaagcaagccuguauaagccuguucuccaccaccuugcaggcagaccuuugcucauagcccaguugaaacuuuuacugacccugccagaugggcuccuagcuccuguacuccuuccuuggacugcguucuugccccuauuggugccuuccuggcuuguucuauauguugaggucauauauaaugugugcauguggaggucaaaggguaucuugugggagucaguucuccuuccugggccucaaauucaggcuguccagcuuuggcagcaaguaacuauaguugcgaaaccaucucacugaccuccagcuccuccuuagaaagcaaggcauuccugcccagguuagagaaggcugaagucgauacuuaguuucuugcccagugcugaacuccagccucuguguguguauaauacauccuggccaccuugccuuacaggagacagaguguccccugcggcucgccgucugccagcacugugaucuggagcuuucuguugucaaguugaaggagcaugaggauuacuguggagcccggacagagcuguguggcagcugugggcgcaacgugcuugugaaggagcugaagacucaccccgaagucugugggagaguggaggaggaaaagagaacggaggcugccaucccuccggaggcuuacgacgagcccuggagucaggacagaaucuggaucgcaucccagcuccucagacaaaucgaggcucuggacccgcccaugaggcucccuggaaggccccugcaagccuuugaggcagaccccuucuacaguaggacuaccagccagaggagcauggcagcccaguuuccaguucaaaauaaucuuugugaguugugcuuggcauuagaaagugguccaccaucccaggaccaaagggcaacaggacuuuggagacaaauagaucuugaugcuagaaacaugacagucacuggguaacaauggggaggauaccacacuugccuguacagcaggaauaaugagccuuguggugguacacuguugcuguuaggauggauggcgaugggcugacagaguccuuagucucugagacaccuguagcgugcucuuggguuguuaccagggcucauuagcacagggaaggggcaggcuacuucugccauaaugcagaugagaugagagcaguguugagcccagugccagucugucucauaguuaccaagcgugacccugcugauuggucacuuguaugaucccacuggcuuauuguuugauggcacaugucaaguucagagauuccugaaggcagagggcucagggugccaguggguuggcaggcuucugcuggucuagacagccugucaggcuuggcuugugccugucucuagugugcucaugcaugcuugcuuucuuccccaguugaagaacaagaaaggcaggaaaggaacagaagccggcaguccccaaaggacagcgcugagaauaacgcacacuuggacuucauguuggccuugagucugcagaaugagggacaggccaccagcaugguagagcagggcuucugggagucugugccugaggcugauccggcucgugcugggcccacaucucuaggugacauaaaggguaagauugcuucuuuugcauagucuuuacaauuuuuuaaauuaauuuuuauguauguucugcuugcuuguaugaucauguaucauaugcuuucagugccuugggagguuagaagaggauguuggaucucccagagcugggguuacaggcaguugugagcuagcaugcaggugccaggaauugaaccucuauaagaagagcaagugcccuuacccccugauccaucucuccagccccuagucacuauaauuuuuguuagucuuacauuauauaacucauauagaauugaaaauacuggucuggugagaaggcucaguggguaaaagcacuugucuggguuuggaguaacucccauaguuggucuuugacaccacgagagcugcacauggcuugacugugccccuuucccacgacagacaaacaucuaaacucaggaggcagaggcaggcaggucucugugaguuccaggauagggugguuuagugagacacuguuuugaaaaaauggauuguuuuuucuuuuuuaaagauuuauuauuauaugucuucaguugcaccagcagagggcgacagaugucauuacagaugguugugagccaccaugugguuucuuucuuuuuuuuuuuuuaaagauuuauuuauuuauuacauguaaguacacuguagcuguccucagacacuccagaagagggagucagaucuccuuacagaugguuguuagccaccaugugguugcugggauuugaacuccgaaccuucggaagagcagucgggugcucuuacccacugagccaucucaccagcccccaccaugugguuucugggauuugaacucaggaccuuuggaagaacaguuggugcucucuucaggccaaguuccucauucuuuuuuuuuuuuugaguuuuuccacuuaucuaucuaucuaucuaucugucuaucuauuuauuuugguuuuucaagacagaguuucucuguauaucccuggcugguccuggaacucauucuguagaccaggcuggccucgaacucagaaauucgccugucucugcaucccaagugcugggauuaaaggcgugugccaccacugccugacucaaguuccucacacugauauauuguucuguagcacuuuguuccgaguuuuuaugcauuggcacuuuuggguuuuguuguuuuaaaucuuuuuuuguuuugagucagagucucacuaugcaguccuggcuggccuggaaauaacagugagcugccuguccuugccucugggggacagacgggaugaaagucgugugccaugccagccacaggggcauuuuuggaaaguccauggcagcuguuuggaaaguccacagagcguucucccugugucuggcugguucccaugucucaugucuggauccaguucugucaggaccuccuuguacuguuguuucuacagcuuucucucucucuuucuuucuuucuuuccuuuuuuucuuucuuucuuucuuucuuucuuucuuucuuucuuucuuucuuucuuucuuucuuucuuucuuucuuuuuuaaagcuaucucuguguagcccaggcuauccuugaacucacuccccugccucauccucuuaagugcugaggcucuagcgugugccaucgugcccagauucuugcuugguagcucuuuacuggguucuuccguaucuugagcucauucugucuuuaccuaauuguuucuuugccugugaaaccucuccuugaaucgguuuuggaauauauauuguguccuuuucauuggcaguccaacacccaccuggccccacgucagacuugggugucacauacucuucaggguggggagggugaccggcacuugcuuguuuguggcuccaggugcugcugacgagauucugcugccgugugaguucugugaggagcuguacccagaggaacugcucauugaccaucaggugugugguacucgacaacgccagacaggaucgugagcaggcucuggucaguguaacaagcugcaagaggccuuacugagaucaguaaggugugacacaaguaccucaccuuguggcugugguacugagcgucccaggcaacugggaucaugggcacacagcacugugucugguucugagggagucaugaacccuuuccaguugacuggucuaaguggugagcauaucuaaaggugccauguagucucugcuuugggugacaggacauauccugcuuugagaaacgggguugaauacuuuaaaugcaucuaguguuugguccucuaguaaggaugaaagacuauuuggccccuauuuaugguauggucccgugugugaugguauggugugauggauggcacaggugcaggagggagcaguagaguggagcugaacucuggccuuuccagcaccgcagcacucaggggcaguaguuucuuggcgaaaguguuuacugauguaauuuuuccuugaccucucuuuacuuuuaacaugucuuuuggaugacagacaagcugcaacccuucucaugccuuacguucacucaauacgggcagcucuuccaucagggguguggaagauccugguaccaucuuccagaacuuucuacaacaagcaacaaguaaccaguuugacacuuuaaugggccugagcaguucagcugcuguggaagacagcaucaucauccccugugaguucuguggggugcagcuggaagaggaggugcuguucuaccaucaggugagaaucccuggggugcucuccacccuccagcuacacucuguccgcagagcccugcugagcucauggcaucacagcugaguagaggguggagaaagcaugucccugaguggacagaugcagccugacugaccggcaggcuuuccugugcuccaugagaguugugcuccaugagaccugggcuccagcucugccuuuguggugcccuggcucugaacuccucccggggcuucuggaaagaagggugcuacacugcauacucgaaaguccuuuuuucaguuucuccagucugggauccuaugugguuaguggggggaaaaaugcuccccacccgcccaaagccaucaguuguaugaagagcuaguggggcaggcgccagccuuucauugcucuuuguacaucucccacuucaaggacaaaaacgcugcuugucaccuaagccaugacacaaacacuauagacagagcaugcucuucugaccaccagccuuugcuucuuccuugcccagagccucaggagcccaugguggcuccacucuaguuccaggacucggcuuccuccugguuuccaggauguguaagcugguugucggggucugcuguguguggggcgggauggucucccaaccugcugacaccucucuucccagcaucccggguacucauuuucuucuuucuuuuuccuuuccuuuccuuuccuuuccuuuccuuuccuuuccuuuccuuuccuuuccuuuccuuuccuuuccuuuccuuuccuuuccuuuccuuuccuucucuucucuucucuucucuucucuucucuuuuuuuuucuuuuuucucucuucucuucucuuuucuuuuuuuucuuuuuucucucuucuucucuucucuucucuucucuucucuucucuucucuucucuucucuucucuucucuucucuucucuucucuucuuuuuuuuuaaaggaccagugugaccaacgcccagccacagcaaaccaccgugcaguggagggcaucccagcccaggauucgcagccagaaaacacuucagcagagcuguccaggaggcgggucaaacaccaggguauccacuggggcugagcuagggagugaggcugcagccacugccuccuuagccugcuucgcauuccugcucccugggaggcuugccugugccucccguucccacgcacgagggucucuugggggacucugcugaggcuaagugguccccacauuaccccaagcugaccuaagugcagacuuuauaggcuauggcuuccaagacagcugugaaucacagugccgcaguaagcuguggcuccugacuccuuuuuuaaaccaucuugcugggugcguguuucugaaacuucacaccacaaagccaagugcaaacggcuuuucaucguuugcugacaucuguuugcugagcaguuaggaggcuggccuugaggaucauaacaucagcauguagagugggcugucugccaugacagucugcuaguaacagcuagaguagccuucccccuaaagccacugccaccuucucuucccaggagaccugucaucugguuacauggaugaugucaagccggaaucagugaaaggccccaccuacucgaugucuccuaacaggaccaugaacaauguggcuuccugcaaccgacuguugaacuuaccgucagggcccaggucugacugccagcguagcccucccggugugcugaaacucaacaacucugauagccaggacauccgugggcagaugcggggcagccagaaugggcccauagcauccgggcacgcuccagugauccacucuauucaaaaucucuauccagaaaacuuugcgcccucuuuuccucauggauccccugggagguacggagcuggguaagcagcagccccaggauggagccgacaguggcugaggaaagcaggggcagguagucuggcgcugcugggagggcucugcucaaagcacuugccauggaagugugauggccugaguuugaucuucagaaacugaguuguccucuggccaccacacacaucauagcaaauguauccacccacauugcacacaugcagaauaaugcggggagguuagaaaaacucauaccuuuauuucuaugcguggucacagacauuaggaaagagccauggagggcuuugccuuuuuuucaccaguggugcuaagggaggaucccagaaccucacccuuguuaagccugugcuuuaccuagguggcccccaccaggcucacugaggggucuggguuugccugauggcgccgccucccuaucuccucugaguucccacgucagcaugcugacuccugcucuuuguuuacagugggaggagugaagguggucggagcucucgggucagcccugcagcugcuggcuaccacagcagagcagcaaagguaaccgggauccugcagugacguucagggcagaugcacacacggcuggggcuggugggguuacaaauucagagaaugugcuggguacacaccuaguagcuuaggguccauucuuuggcuuuuuucgagggaagcucucuuggaaccaggcagcuucaacaugucuguccuuucacuacuuauccaacaggccaagccuccaaagcagcagggagcaggcgaugcggaggaggaagaggagugauggugacucugggggcucuugcagcccccaccccaccccaccccaugcauaacagaacaugcuggugcaauguccagcugccucucgggcuuacugggcaggagagacaccagauuguaauuuuuccuagguuauggccauuuugugucuuugcgauugugcuguguguguuuggguuugagggagggcuagcugggaggcccgagcugccauuguugagcagccuugaaaucagcgcugagugucuguggcccuccuggcccauaagggcuccauccuuagugaugucaucaccacugcuucuuggugcuuugugguccugauggacagagacaaggguucugggaucucagagugagaagcauccuccugguggggaccuaagcuugagugugcagcguguuacacaggcacaugucuggcagggacacggacuggaggccaccuucguccuugcgggucacucacccaccucucucuguucuugaugaggaauguacugcuuuguucaugcugccccuaccagggccacuccuacucaugaggacggaggcgccagccccuccccuuuuuauuuuacuguucuaauugucuauuuccuuguaauagaaauaaaguuuguauuuagagcucag

SEQ ID NO: 2656 - RNA, 6430 nt, Mus musculus
cgguggaaugaagccugggauccuggucuguccuguuucgcucuuguccuccggcuaggaggaccccggacaggaaaguagaaggaagugaggaggaggcaggaagaaaaggaagugaaggauucugggaggugggucugugugauuuuuggggagaggggaaaccccggccauuccuacuuacugggagcgccuguaguugagccacacccuguaaacaccacgcuugucuuuauauuuugcauagaaucccagcgacuccugggaggucacgcaggggugcagugggucggugggccucuaccucugcucacuucuagaacucucucuuaauuuaggcaaguguuuggauggcucgguauccucugcguuuuaaaacagacuuguguugauuuucucuggaaacgcuguggguugaacguuuucuuuuuucuuuucuuucuuucuuucuuucuuucuuuauuuauuuauuuauuuuuuguuuucgaggccaggauggucucggacucacuagauauccuguguguaccuugagcaacuggugggaggcgguucccuggcaucuuucacguuauauuuccccaggcuuggcgacaagcgccguugagccgucucgccagguugcuccgggaccgaauucugggaacucccgacccuggcacggucccuuuaagagggauuuuucaggcgcgcgugugggggcgugguaaauucgggggcgggaccuugcagggcugaccaaugggcaggcgcguguggcucggaggcguucccccuccugggcgggccgcucaggguuaaaggggcgcccgcgggucgccgccacucggccuccgggagacaaagggcccugucgucgccggcccccgagcuguuccgggccaugggcaggacagaccgucgcgccggucccagagccagguaaagccgggcgggacgggaccgcgacggggucggcagccgcgcggcugucgcccgggacccgcccgcggccuccaucgcggcccggccggcgcaccacgggggcuugagguuccgcgguggugaugcccugccuccguuucccucgaguccuagccgcggggccagcugugaccccacgaauggaggacucaucacuugucuuaauuuuuuauguauuuacuuuuguuuacgugugcguguguggaggucagaagacaacuuggggggaguccgggcuuuccuucuucuacuugguuucuggggaucaaacucgggucagaaagcuugacagccagcgucuuuauccgcuaaacuguuuuauuuuguuuuguuuuuggugggguuuguuguuguuuuuuuguuuuuuguuuugguuuuucgacacaggguuucucuguguagcccugacucacuuuguagaccaggcuggccucggacucagaaauccgccugccucugccuccccagugcugggauuaaaggcgugcgccaccgcgcccggccgguuuuguuguuaaaugagacagaagcuuaauguguacccuuggcuggccuggaacucaauaaugcagaacaggcuagccucacagauagauccaccuaucuuugcaucgcgagggcugggaucaaaggugugcaccacuauaccuggcauguguggcguuuuuugucugccuuccaagugcuggaaugacaggugugagcgccacauugggugccuucgccugcuuuagaauacuuucccccuauaguuugucacaggcuguccuuaguuuagcucaucggugccuccaugaagcccauugaggcaaacugaggucugggaaguguugguaacugggcuuccggccugggccagcccagacaagaauuuggucccuaaagcaucgugcuuagacccuguugcuuguagcucggagcccucagcagacuuugaaccugaacagagcagagacgguugaauagcagggagcacucccucccuccaaggggaagcuagagccugcuuguuugccgagccagagcaggcaagggcuagggaccuggcugggccuucugucugcuggugaccuuggccagggugcccccaucugggcaguugggggaggauggcugaugggcaccagguaauauugucagucuugguggggaagaaggaccccaagguuucugccccauggggcuguuuguguggagcucuguucuuuggccaggucauuuuuucccacaucuauaagugugcgauuaggcaugaccccuugucacaguccucacguugacaaagguuugcuuugccguguaggcuccccagcacaggcuacacacuggacacucaaagccagacagaagcccccacacccccucucuggacugacgcagguaauccccagcugguggucuguuucggucagaggaugcuuccuccuaggcaacggcaaagcccgccuugugguagggaaaggcaccucagggaagaaaauguuuguugccuuugagcaagguagccagguggcugaggcccgcugacaaaggcugacaaaggcugacaaaggcgggcagagguuggggaaggagcugagauuggggguuugggcugggcuaagcaucagguacaagucacaggagggaagagucccgcuguggucccaggggagggcccuagggaggugaucuuaccuugaggcggccagauaggaaggggcaaagguggaggcagcuggggagggugccugcggugccuccagcaaacuuagguggggaucuugaaaugggagcuaaacaagcuauguguuagaagacagccaggggugggaggaucaccuggccucagugauuagaugugggggugagagagacagcaggggccacuugcugaagcaggauggacuagaaggaagccgaguacaccgucaccugcugccauggccagaggcccugguucccuguguucugucucauugucauaaccuugacguggauaauuuugcucuuacauuauagaugaagagcuagagguccagagagacugacugugugccccugaagugacccagccuggagacugugagcugaccuucaaagugauugagcagaacugggugggcagccugugguagguucugggagaaguaggccugucagucucgugcaauugauuugggaggggugugugagucccuugugcagagaaaaacagaggcacagagaggugcagcuggcauaaaaagcuacacagcagccagaggcaaagcagggauuaaacucaccugagccuucaggaccccgaggccccagccccaaugcucugggccaaacaagucuuggccucugaucuggcaggaagcuguccccaacuguaacguggguggcaugagguggcaaaaauuaaguauuugucuggcagcaguuucucucuccacccaggucagguggcgcagccuggcccuacagagccaccacccugaccucaucccugcagaccaaggguaaagcacggcacaggcagaggggcuggguguuaguggggugccugcuacagacauuccaggcucuucaaaaguaugccagccaucugcacgaagcaaggcugugacggggacccuacgggugcagggccugccuccuccaaguggccacacugguaacccacgugccacuccccgacaggcccuacugcccgcugcugccccaguguguacuuuucgggaggucuauguuagggcgcccugucccuuccgcccugacagucugggcugagccugcauuuuaucuagguuauuuuccaacaguugcuccgguacucugggguuuccuccacuccugcccuccucuggucacccucuccacagccggaggauuuaacuuuguguuugcuguggugucccuauccuguugucccucuguccauguuguucccccucaccucacccaccccaccucgcgcccucaugcucuucccuacagcucccucucucaccaaccugaccuacaaaccaaggcugagucacagaccugggaucuccaggcacgagcaaaggcucuagucagcuuguuuugugaccuuugcuugguggcugacaaagguugugccuuuguuuccccaucugacacugacacacagaugcaaacauaaaaccagcacacaccacccaaggucauugcuagauagagcuaaccuaugcaaaaugucuggugagcugacacuuaaugcuaccuucccuggucaagggcagcaggagcccuccagauggccgugcgagauccugguuugaguccugucucacugugcucacugaggggccuugggguggguguggugggaggaggcugcugguggccugggaguccuggaugauccuaguaguaacaucugcucccgcgcaggggacagguugcagcuccucgugaccaugaagcucaacgagcgcagcuuggccuucuacgcaaccugcgaugccccgguggacaacgccggcuuccuguacaagcgugguggccgugggaccggcucgcaccggcgcugguucgugcuccggggcaauauccucuuuuacuucgaggcagaaggcagccgcgagccgcugggcgucauccugcuggagggcugcacgguggagcugguggaugcccgggaggaguucgccuucgcagugcgcuuugccgggggccgaucccggccguacgugcuggccgcugacagccaggcagcccuggagggcugggugaaggcacugucccgggccagcuuccacuaucugcgcuugguggugcgggagcuggaacagcaacuggcugccaugcgcgagggaagccccgccaacgccuuacccgccaacccgagcccgguuuugacccagagacccaaggagaacggcuggguaguguggagcacgcugcccgagcagcccucgguagccccucagcggccgccgccacugccaccccgccgcagggccucagcggccaacgggcccuuggcauccuucgcccagcugcaugcgcgauauggacuagaggugcaggcccuuagggaccaguggcgcggaggccaggcuggccuagccagcuuagagguccccuggcauccugguucugcugagacucagacccaggaccagccagcccuaaggggacauaguggguguaagguauuacauguauuccguuccguagaauggccuguuugcaauccaggcucccaggggacauaggacauaugacucaggagaccugugccccuggggucagaggcacuuacuucugagaagaaucuggaacgugaaccugagggugcuucuagagcccaaggagcugguuucuagagaacuccgcgccaggguggccugugugaccuugacagccccgaagcuggccacaggcccauggggcccaggguuuaccuggugccucucaaggaucuaaagcuugaaccuggaagcugcugucugggcugcugugggccuacaccaguagguggaaugugggacuugaacuggauaggucccccaggcuccuggccuggaaccagcuaagucaggacuguguccagcuuuguaggugagcccgggcagaagcagggccuccccugaccucgguccuggccugggacccagcuuccucccaguuucaccuggaggagacaggccuccgacugauuccaugccugcagcagggagagcccaggcacugucccuagccacugcaggugaccagugggccucaggacugggccuacuucucucucaccacagugcuggcugucuuccagaggguugggcaggacagccggccccaccuggguucuuguuuacaguccuccucagugcccugcccugaggggacacuccaaucgcugcauccuaugaacagauuucacccuggccccucccucuccucuggggggugggguggcugggucccaugggugcuucugucugucgccagggccucuuggcucucugcuggcucaggggccagggcacuuggcuguggguuuuucuuugaaguacagaggcuacugucuuccaccagugaaguuaaguaguccagucucaccccugccacuuuuguuacuguuggcugcaagggguggcauugucuccagggagccaggcccucgcaggagacacacgggcgccuagcugacuuggcccugacuuggcccucugucuccugagcucagcugucugcacagguggugccucuggggacuuggucugucuccucaacucucccacuggagucauacggcugagguguagacucuagucugggacgggcuuacaaacucuaaagguacggggcaggaggugggggagacaagggcagaguuguucccucuccccaaagcacaaggugaacaccagcugauucuggggcuaggagaguuaucaaucauggacaggguaugagggccaaaauaaaagccggucgagaaauggcuggguguauuauuguucucccugca

SEQ ID NO: 2657 - RNA, 4372 nt, Mus musculus
uauaaagaacaacauuuaauugggguggccucacagguucagagguucaguccauuaucaacaagggggggacauggcagcguccagguaggcauggugcaggaggagcugagaguuuucuauuucgucugaaaggcaaacagaagacgggcuccacuuagcaaggaggagggucugaaagcccacccucacagugacacacuucuccaacaaggccacuucuacuucaaggccacaccuccuucaacaagaccacaccuccuaauagugccacuuccugggccaaguguauacagaccaccacaggcagccaucuauaagauggugguacaucucuggucugcccugagaaccagcuuuuuggacacagucaaacuggggcuggauacucugugccagcugcuagcuggcuagaaagaaucccuuauaagucgcugggguugggugaucugggguacuuggugguggccccugcauaugagcaucacagucccccuaauauacugauucaugguggcaucuugagcugcagacccguggcuggcaucuaacggcucccucugaacccucuggacuguugauauguacugcccauuuuuaagaguuggguaaauguguguuuaugucaggauguguccaguauuggccacauuggcaucagggaggauccgggcaagaugcucugggacaggggaacacacaccuuucuagaaggggccagcucagccccaauggcguuggagacaggcuucuaacaugcaggcuagaguuaggaagggaccugccuccaaaagucaugacagagggccuggggagauggcacggcaggacaagcguuugucacacaagcacucggaucaguguuggagucccaaguacucauauaacaaccaagacaucccugugaucucagcucuggaggugugcgggcuuagugagaaacccuuugcuuaaaaagaaacaaaugauggggcagaaagauggcucagugguuaagaacccugacuguccuuucagagguccugaguucaauucccagcauguacacccacaugggagcucacaacugucuguaguuccuguuccagggaaucugacacugucuguuugucucucucugucucugucucuguuucucugucucucugucucucugucucucugucucugucucugucucugucucucucucucucucucucucucucucacacacacacacacacacacacacacacggugggugccuggugguggugacacacaccuuucauuccaguacuugagaggcagaggcagguggauaucugugaguucgaggccagccuagucuacagagugaauuccaggacagccagaugcacagagaaauucugucucaaaaaaccaauauguaaauagauaaacaaauagcuggagagagugguuaaguaagaaagcugucauugacccucucccagccccauucucacacacauaaacauguauacacauaugucacacacauaaauaaauaaaauagaggcaggaagagccuggugcuuccaggggugggaugagaaaaaacgacccuguaugucacaugguugguucugacaguggcuggucauuaggucguuccuuguuauauuccaugcuuucucagucacauguucccugugguaggacagccgagggacuuuugacagggucucuguggugucaacaaaugcaggaagucucgaugcagaauggcacaccaucucuucacccugacaggccuuggacuuuuuuuuuuccagauuuauuuauuauauguaaguacaccauagcuguuuucagacacaccagaagagggcaucagaucccauuacagaugguuaugagccaccaugugguugcugggauuugaacuuaggaccuuuggaagaggagucagugcucuuaaccacugugucaucucuccagucccuuggauguguguguguuuguguguguguguguguguguguguguguauguauguguauaugaaguugaacaaguggagagacccaucucugugcccgaaucuuuaaagauuucucgauuuuaugguauuuguaugaguguuuuagacguauaugcaugugcaccauaucugugccuggugccuggugccuuagaagccagaaagagugucagguucccuagaacuggaguugugacccaccaccucuguccucugcaagcacauugcucugaacugcugagccaccucuccagucugagucuuacauugccaucauaugggaaggagggucugggacaugggaagcgcugggcucagugcuggacacauaguaggugugcaauaacggucacugcuauugucauuaugagaguaaagaauggaccugccaugcauagauuccgcuccugggcugcuuuuggaauguuauggauuacauaagugggucucagccugugggucucgaccaguuaggaguaacauccagauauccugcuuaucagauauuuacauuaugauccauaacaguagcaagauuaguguuacauaguagcaaugaaguaguuaugggggggggggucaccacaacaggaagaacuguauuaaagaguugcagguuaggaagguugagaaccacucauuuagcuggcaaacgccccacccauccccaggcucaccguguuccaacacuuguucuccaaguguccagcuggcuguucuaggucauugugaaaccuuuuaagaggcggagccuucuaggacagaguggguugcuggggggugggguuggcgguugguuagcuuuuucccacuuccugcucaguucacuuauugucccacccagaugggaggaagcgaagaggcuccugcuucccuggugcacggccacggcggccugcaucccccuuugacugugagccagaguccgucuuccuccccuaaguugcuuuuguuguagcaaugagaaaaguaaccauuacagagucuguggguaauaagccgguucucagaggcugccuggucugauccugcuuuugugguagguuguaacuuuggacggaaaguucacccuagguaagaugguuuccugcugaauucuauaaucugggcggaccuacaugccuuaagucaaccaagugaacauuuuugauuuuguuacccgaauaccaucuugcacaacggcuuacucgacucugcucugugggaaagcauguguaaauaaauacugggugagccagagauggggugggguggggguggaggauuuggucugggagauaaagcccaaagaucagaggucauucacccuggugguguuuguuuuuacuaaacguccagugguauuagcaaguaagaacguuuuucauuaauuuccuggacaagguuguuuauuuauuuauuuauuuauuuauuuauuuauuuaaucuuugagacaaggucucucuguguagcccuggcugucauggaacuggcucuauagaccaggauggccucaaacucagagacccaccugccucuaccucccaagugcugggguuaaaggugugagccuuuaacugccccagcuuggcucaagguucuugggaccugcagcagcaucuaugcugccugggaaucaguuuguucagggccuuuuaaaaaccuauugagucagcaucccuggggcagucuugagccuaacaggucacccgggugaucccacugcaccuuguagaguuccgaacccacgugaguggagagccggcuccacgugagugcacucacggugccuauguaugaccuuucgaucccaguagagaauucucuugccucccuagggaucuugagcccccaaaggguuuucccucccaguuguggggucaacacauggguuaagagcagcgguccagagucugcuggugucagguuccgcuccagcuccgacuuuaaacaagcuguguguucucugcauggcucugugccucucugagccucagcuuguccuccugugggaugggaugggaugggaugggaugggaugggaugggaugggaugggauggggugggguggggugggguggugggguugcccacgcauggagaacauacuaaguucucaguguguggcccuaucuguggcuggccuggccuuguaagguagcuuccaugaucauggacuuggggaucucuaccuggugaggugggcagauccuugcgcacguuaggaccagcaagugggcaggggccacggaguggcagagaugccuuggcuuguccccaugccacccccacuccuggagugaccaucacacauccuaugucuccaucaauucugugacaaccgaaggagauuggggaacugucguucccacacccauuaugugcucccagugauuggcuua

SEQ ID NO: 2658 - RNA, 17025 nt, Mus musculus
aaagaagucccggccgggccgcugcacucccgcgcgcgcauccgugcgccgcccgaggcuggccugaggagucggcggccaucuuguucuucucgugguucccaguggcgagaggaggaggaagcccggagcggagcggggcggcugggggggguggacccgccgcggcugcugcugccaccgccgccgccgccaccaccgcucguggggcucguggcgugaggaaggaggacgagugagaccccggggcgagcgggcggcggcgccgcugcugcugcugcugcugcgggagggucggcggcgggacggcgauggcggauaucgacaaacucaacaucgacagcaucauccaacggcugcuggaaggugagcggcgcgcggguggguggcggggcaggcccggccggugggggaucaggcccaguggaggggccggucuuuucucggaagccgcuuuggaucuggggcgcgcauacaagcgccuccggguuuggggaccccauuauuuuuuaucacuccccuguccuugcuuucacauuuaucaucuggaguccaaggacucaucagagggacuuggcuuggcaggacgacgucccagugcgaugagaguccgucuccugcauuuuccuacccccuccacccuccccucaaagccauccauccuccagcguucuuucccccuugaacgugcauccgcacacggacccaguccgggugacaguguggcucucucugaucaucagauuguugugucccugaggacagggggacgcugccgcguucagcgagcacccgccagguaggugcuguguuguuauuauccuggaaguggguuucgcaagagaaacucccaagaccucgcuggaccaagaauuaacaguuaaaagucagguuucaaaccccgggguagcuaggaaccuagagagaaccugccgccuuccaacuguucaccccgugggaacccaggauguccagugguugaggagagguucaaaaacaaaaacccagcuuuccuuuuguccgacuuggggguuucugccgugugguuuccuacuuuggagauuucaaauuugacauaggucuggauccugcuaaucacagaucccacaacauccgcugaagcuaaagaggagaagauccaguaaccuugauuugggcucuugacacuagcuugcuuuggcccaaaauacuuuuggagugguggacagcugcgcaauucuggugguagaugucuucaaguaaaucacugacagaaaagggaaaaggugucuuuuuaaaaucugggcauuuccccggggggcggggggguguuuuucaagacaggguuucucaguaugguccuggggcuguccuggaacucacucuguagagcaggcuggccucaaacucagaaauccgccugccucugccucccuagggcacggauuaaaggcuugggccaccacugcccagagcauugccuccucuuuaauguuuuguuuacauaggguuucuuggcuuugguuucauuaaaacauggucucuccagucgugguuauccuggcacucuuuguguagaccaggcuagccucaaacucacagauccuucuuccucucccuccccaauuaaaggcauuuuuauuaccaugccuccuuuuauuacagggucucucucaggggccagagcugaguuaaccuucugauccuucugcuucgucucacauacuagauuuuauaggccacucagccugacuuauuuuuuuccuaugcagugugugcauacauacagaccaaagcacacgugaggagguuagaggguaguugggcgucuuuguguggauucuggggaucaaucucaggucaggcuugcaaagcagauuuucuacugacuaaaucaucucaccagcuucccuuucucccucuuuuaauuauuuuuuuaaauuuucuguauguauuuuguuugugugcaugugcgcgcacaugcaugcaccguacgcaugucuuacccuuaugaaugucugaaaagggcauuggguccuuggguauuggaguugcagauaguuguuagcugucacauaugggugcuggaaauggagcccaguuuaucuccaagaacaucaagcacucuuagcggcugaaccaucacuucacucccccagcacccccuuuucuuguugguuuuuuuuuuuuuuuuuuugucuuuguuuuucgagacaggguuucucuguauacucuguauacagaguuucucuggaacucacuuuguagaccaggcuggucucgaacucagaaauccgccuuccgagugugggauuaaaggcgugcaccaccacgcccggcuucagcacccccuuuuuaaaugagacaguuucauuauguagcccaggcuggucucugucucaacuauccagaguacugggauuaaaaacuuuuuaccaccccugucuucucauaguuucuuaauaguuuuuaaguucugagacuggguagcauuguguuagcaaaggcuggccuggauuuucagagaucuaucugccucugucuccugagugcuggcauucaaagcugaacuaccauguuuggccugguuuauucuuuucuguugaacuuaacagaguaagccacuguuuaaacacguugagaaugacuggcugggugguauauguauuuguuucuaacuuauggacuugcuugacggaagccacaggaucugcucaggaugcguauaguucucaaucagaggacgcuggcauugggguugugaugauuucaaaaccuuuaaaucuagagauagcucagccgguuuuggcucuugcccuuaauccugaaguccugauuugauccucuggauugacaugagauucaggagagaaccagacuuugaggguugucuccaccccacccccaacagcuccagcaagcauggccuugcacacaugcauauaacagaaugguauaaaaaaaauaaggguuuaauucugaaagggggagauaagauuugucccuuggagccgggugccuuuaaucccggcacuugggaggcagaggcaggccgguuucugaguucgaggccagccuggucuacaaagugaguucuagaacagccagggauacacacagaaacccugucuccaaaaacaaacaaacaaaaaacuggaaagcugucuuagggcuaagaguacacaguacucaucuagaggauccaagcucagcuuccagcacucaucccagguagcccagugcuugcuacuccaguaccaaggagucagacaccagcuucucaaggcacacacauacauggcuaacccacacagacaugauuaaaaauacauuuuaaacugacagugguggcacaugccuuuaaucccagcacugagaaacagagacaacuuaaucucugaguucaaggccagucuggcuuacagaagaagugccagacuauccaacgcuagcuacuguagucccuggcacuuaggugggggcaggaggucgaggcaguagcauaaugaaaugaguuccuaagggucuagccugaacuacagauucuguguaaacaggcagguuggguuggguuccuaggcacugcgguucuguggcacucugaaugcaguggguuucccugagugucacccuggguggucagccacacuggcggaagaucuguguuaguccucagcacaguguuagggacaugcuagagcagaaaauagacuagcugugugugaagguagcacccugcucugcuguuuuaguggaaaaugggaauuggggugcuuucuucaugaaaccucuaguguuuuuucuugaguagcaagugguuuuaauuucuccacauggcaaugugcaagaacauguuucuguaaaugaaggucauugucagcgcauggugggaaguagcucugcuaauacagauugcucuccaguccucgucucugaaggcaucugacugcccuaccguucucuaaggacuuguguaugugucuuuucggugcuccugagggccaggguccuaaaugaaagacaggugagggugaugggcuugugggucuggaagcagauccuagacugagcagagggcacacaacacagcaagaucaucauuaacgggcauccugcccucccuccacaccaacagguauauguccccauacuuuaccuggcaggcagggcaggacccucuccucaaucuguagauguuugagucuuaaaaaaacuuaauuugggugagacaucgguggcccaaaccuuuaaucccaggacuuuggaggcagagugaugucugaguuugagaauagcaugaucuauagccaggcauaguggugccuuuaaucccagcacucaggagacagaggcaggggcaggcggauuucugaguucgaggccagccuggucuacagagugaguuccaggacagccagggcuauacagagaaacccugucuccaaaggaaaaaaaaaaaagagagaauagcaugaucuacagagauaguuccaggacagcuagggcuacacagagaaaccaucuccuuccuccuccacccuccaaaaaccucccuuugucagguauggcuccuagagccuucacugccccuucacuuuugcaaggccaggcugcaggucaguccuaggcaggugggacacacaggacagccaccucucaaaggaaagcagcuggccugugugaucccacaguggcuggguugggguggucagugcacuuuaauaucugagggaaaagagcuauguguguuuuuuacugcuuugauucaggcugggucacaggaagaaagguugggugggaacugccucauagcugaggaagccccacaggcccacugaaguaaagcaaaucccgguucccugagcuagaauucugggagggauuuuugucuucagucuuggucacaguuguaucgggagugugaaggcaagguacugauucugaugauguuucccaccucugugucaggguugcugacauccuuguuuuugaaggguguauuuuaggacuuacaggaaguagaagcucaugggguccaaugugcaaggcacugaugcugagaugcggcauucagcuguggaaagauucucaggcugcccuccaacuuccuucacagcugagaugaccuugaacucugcugauccuccugccucccggugaaauacaguguucaaauggcuuaguguucauuauagaaaacaagauacguccuugggacguuuuuugguuggagcuuuuuuagccacauccugguugcccacguagaggagaucaguguugucaugcaugacagcagcagugccccagcgaggugggaggguagugggagacaguggggagagccaugcacuuuugcuguuggggggaaaaaggaguuguugaggaguuucuuuagcuugcauguuuuguagaaaauaauucaguuugcaagaaaguguucaguguggcgaguacuaaguuuguuugguuugagaucuuuuucuacauguuuuuaaaauaccuugaagguagucuuucaccaaggaaugacuuaaauuuguuuuuuauuuguugaaaaaaaaggucucaucacuauguagaucaggcuggccuuggacucagaucugccuaccuggggcuagauguaugcuuggccuuggcaguggcugcuuagguaagguuguggucagacagcaagggcugcugacucgccccuucugugcagcucuuagcuccaaaucacauuguaauucaucuagggcuuuguccuguccuuuuauuacuuauuuuuuaauugagauggaguuuccugugccucggcuggccaggagggucuguguagaugaggaccuugaacucccgauccucuugguacacagcccaguuuuaaugcuggggcagaaccccagggcuuggugcauuacgagccuugagggugcuaccaacccuguggaggcuuuucuaucccucaguacaucuccuuggcuuccuucugucaugcugucuugcuuguugcuagacuguggaaaguuacugcugccuagagaggugcuagggcugcagacuaccagcagcagcaguagacuaccagcagcagcaguaaccugauuaagcucaggguuuaugaacuuugggguuuguugucagugagauuuuuagugaaauuucucugugugcugauguuagugauguuccagguaagugcaguaucuacagaacagccuuuguuguuagcugccagccgaccuaaauaaaugucccuuuucuagguacacacaagagccucauugggaacagcaggcugacccagcaauaguaagagccagagaauaagguuagauggacagguccuggguguuaauugugggaaagucauauugcuugauacugagagcuaaaguagaucuugccaauuuggcagcuuuaagacauacccaaugcucacuggcaaaaaaggcuuguaguccuaugcuuauuuugacaaccacucccccccucccccccccaaugcccuaccccugacuuuugaaucaagguuuucuuggggcugguuggcaaccagguguugccagccauucaggaaguauaauguauucuuggggaaggggacagccucaguugaagagaggucugggaaguccugaagggugagaaguuguugccagcuguggaaugugcuaugucagugaaugcuacauagacaggguguuguuagcuagagaagaggggugaagcugcaggaggaucauaaauuucaggguuagacugggcuacauaaugagacuuggugucaaacaguugguuguggugacauacagcuuuaauccuauuaucgaaguggcaggcagaucccugaguugaagaccggccagggcuacauaggaagaccuuguuucaaaaaucuuuuaaaaaaauugcacucaaacugucuaaaaauggcaguggauguuuucagaaucaaggaauauuagcaacacccagcuagcucucugcaguagaacccuguauguauguaacaaagcaagccugugggcuguaccaggagaagccagauacgaagauuaucaccaaagacacaagagugggccacucgugcacaaaugcagagcucuccugaagaaaauuccuguugagaccagaagcuuccaggaguucccuucuaaccaaaaauaagccuccugcugggcggcaugcccagguuuuuggccggugaggcaggaauccuccugucucuccuccgagugcugcuugucuugucuggcuccaguggcaaaggaaagccuuuguugcuuagcugcuguccugccuucccucaaagacucacugcagggcuaccuccaucucagaauuggccaugccugcuuagccuaggcugcauagccccagaggggacugaugagaggcucgguggauaaagugugcugcauaagccugacaucugaguuuaauuccuggaaccagcaaaugggaagaagagagccaacuccacaaauuuguccucugaccuacucacccucaaccccaacccccauaaaauuuaaggggaggacuggggaagauaguucagccuguaaaauugcugcagaaacaaggcccuguauuugaccccaccagaaacaguuugguuugguuuauuugagacaggguuuaucuccauagcccuggcugucuuggaacucuccauguagugcugggguuaaaggcaugugucacuaccgccaggcucagaaccuauuuucuaaggugucuguuaccccaguacuaggggauggagaggcgggauccuaguguagccaaagaaugaaauagaaaaaaaaagacgagaguacacccgaugucaauucccaguggccacaucuuuugucuuacagcccaguuauauuugggggggacugaagcugcucagagggguccauuccuugcuggcucccuguccuaucucauaauguuuuuuccugcuuugagggcccauccuuuucuugucuuuucccugaaaaacuaauguugcuuugcauaccauuucaucccugaucagcuuguuccuucggagaagcggggaugucuaaagucguacaggcugaagggcagcuucccugaggcucugguuuccaagcauggguacagcuuugcagccuugaguggacucugcuugguccauagcaggccucucuugggagugccauugcucugcugcuacagggucaaaagcuguguuugccuguagacuuuucugcucuuaccuagcugucaggacagaugauuuuaugaccgagccugcaauuggacaaaauuuaagcuagugagaucagucagauuuaggauucugcuaaaagcaaaucuguugacugguuuaugauagacagaugcagucuuaaaugggcugcuuagccugggucugcugaacucaagugaagugccugcguccuuugucuucuguacaaaagagcagagacucagauucuagcucacugaagguggucaggccccugugccaggcagccuugcgguaagcagggccugcggcagccguucccugaagcugcugccacuugagagcuguggggaguucagauccuuggcaguuggaguuguucuucagucugcauaaugauuaucugaucucgaguaaccggaacccacacagaugucuccacugcugucacccucgccuccugaggagagugggcuguggccagaccuuaccgaggccgugaacagagagggcucaggagcugccaugacuggugcuaggcugggaguuguucucuuuggaugccugggaggccuuuuucuuaauaggcacugacuuaaugcugguguccuauuuggauaugaaugccagaggagaaccucagggugugucauuaauucuucaagggugauuuggcuuuggguuuuuuuuuuuuccccuuuuagcuaggcuuucucacugacucacuagguagauuaggcugccugguuggcuuuccagaugugucuguuucccucuccagcacugggauucuagaugugugccaucaagccuggcuccccaugccccacucccucuucugugaguucuggaacuuaaacauaaguucuaaugcuugcaaggcagucuuuuaucagcugggccaucuaucuagcuucuaggacauuucuuaaaauugauuuaugugucuggugguugugccugcauguauguuagugcagucucaucggaggccagagggguauuaauagaucccuagaacuagaguuagaguugugacugacugacacguugcugucggacugaaccuggguucucugcaggagcagucagugcucuuaaccagugagcucagcagcauuuuaaagugaaaugcagacaacacgcagaaauuagggaccauggaguugcacuugguccugaaacaucauugcuggagacauguccugaacauuucugaggacauacuuggugauaugacugugaccuuucccacugcaaacuugaguccauucuaaaaguagagaggccuggaagcagaagggaccgucuugguacagggcacgaguguguccuagggacucugaaacggccagauacgggcagggucagggcaaccuuggagcugcuguaaaggagccuaacauagcuugaaguauacaacugacauuccagaucucaguugagaccauacuggccagccagaaaacugauuucaguuacauuuggccaacuccuaucuaacagguguuuauuaugagaaaaaaaauauucaauaucacaccacgccacccuucucaaguuaacauuuuuucuaagauucauuuuuguuauugacgugucugugcauuugagugcaggcggcagccuuggccagaagcuacaagcaguaauuaguuagcugcuugccguggguguagcugcucuuagcugcugcuguccugaauugaacauuuccaugugaggcuguguccugacugcuguuucucuccacagugagaggguccaagccaggcaagaauguccagcuccaggagaacgagauccgaggacucugccugaagucucgggagaucuuccucagucagccuauccuuuuagaacuugaagcaccacucaagauauguggugagugugggacucccguuacucagcugggggcacacugguggccuuugauguucucugaaggagcaugggcaugggggggugcgguggggggccuggucuaguuuggcucacucugcuguaggagcagguacagaccguccucuagagucgcacagucuagguggguauugcaucucugacucagaauaaacuguguguuuagagcgaggagaccuuggcuuugaccuugcagaaguugaaaagccauggccaaggugggugucuugaauguaaguguugugagggggcccgucucacuggacagugacaaaggauguguucacauaaaucccugaagcugagcucaggggacugcaguacuuggcaggaaacaggugagacaggauacucuuuaccacaaauaaauuaauuaguuguaucuggggggagcucuggaccugugcauuuaaauuuuacauggucaguugaacuaaauaugcuacaaccgggaaauucguguuggcggugaacguuguagaugccauugucauaugagaugagugucugaggggcgucuugccaagguuuugucuguuugcugauuugugacacugauguucucacccuuaggugacauccacgggcaguacuaugauuugcuccgucuguuugaauacgguggcuuuccuccagagagcaacuauuuguuucucggggacuauguggacaggggcaagcagucccuggagacaaucugccucuugcuggccuacaaaaucaaguauccggagaacuucuuucuucucagagggaaccacgagugcgccagcaucaauaggaucuacggauuuuaugaugaguguaaguacuuugccucugaggaaccagggcuagaaggcagcggguagcaggccugggaguuggagcugcugcagcauaccuacccacguccugguuuagggagagcagccugaccugggugcugaugggguuggacggaaauagucuugauggcacacggcuuugcucuuagugcagaccccagagcuugcuccaucugcucugcuuuucacagcuuugguuagacugguucuggauagagagagcaucugcugaaagcaugggucaguggcuugugaguugagagcagcaccacaguugcaggcagugcugcucugcuguccagccuuauauguggguggaucuugcagugaacagcuugguuuugaaauggauguuguaguuuucuuguagugcagcuuuauuuaggaaagggacaauaacuuuucuggaagaugcauaauggagaaaaaacgcuuuaaaaacuacauuuugauuuagugugucugucuuugcuggagccagaguguagagucagcugucuccacccugaccuugguugccaggcuugcaccuuuccuucucagccccgcgcuggcuggcuggcuggcuuccuuccuuucccuuucuuucuuucuuucuuucuuucuuucuuucuuucuuucuuucuuucuuucuuucuuucuuuguuuuuuguuuugggguuucucuguguaucccuggcucuccuggaacucacucuguagaucaagcuggccuugaaauccacccaccucugccuucuggagugcuaggauucaaggugugccacaucaccuccacccucccccuucuccuuuuuguuuuuccucaguuuuuguuuguuucgagacaggguuucucuguauagcccuggcuguacuggaacucacucuguagaccagguuggccucgaacucagaaauccgccugccucugccucccaagugcugggauuaaaggcaugcgcuaccauggcccggcuuuguuuguuuuuuuauuuaaaguaugugaguacacugugguugucuucagaugccccagaagagggcaucagaucccauuacagaugguugugagccaccaugugguuggugggaauugcacucaggaccucuggaagagcagucaguacucuuaacugcugagccaucucuccagcccccaauuuuauuuuaaaauaauacuuuguacauauucucauauuugagguuaucucauuuuacuuuuuuuucugaaguguagaccacaaccuuggcuccaguugcagcuuccugaccuugguggggguggggggugcccaccccacacagcccuggauuguuuaguagaacugcacuuugaacucaucauuaauuaaaaaugauuccaaagccuuagaaagauuuggugugggaaaaagaacuggcuugggggagggcuuucaugguuucacacaaacauaaaauggcaggaguuuugagacucugggcuguuuccgccagaaaaggguuuggacuggauuggcaggugcuuaagggaguccauugguuuagcacuugcuaauauggggcacacacacacacaugcagcagcuuguaguuagggcugccccuguuuucuagauugcuagagcgagcuugaguucagcauggagucuucucaccucagacaacacagaguuuuaauccagcccucagcuaaggcaugagugacauugggcucagcagagaaugagagggaccggauggauuuuggaguggagucaaggccaucuggccucaguuuccgcauugaaguucuuacuauuagcuauugguaauuggagguguugacuguguucauugaaguuuccagaauuauccagggaaucuguggccuccccagggcugaaaugcaaguuuccucggaaggaucugaaugcugggugcuggugguggguggucugcccagcuuagaaggcguggcuuaggaaggcuguugcuaggugccgcugaacucuaaaaggcauaccguggcccuuuagaugucccuguguucucuguuaaagaggacagaguccuaguguaguggcaaacucaacauacugcuacucaagugugagauggcccaggagcagaggcugcccuguggugcgcaguccuuggccaguuagagaauguaggaggggcuacggcuuaugaacugugaacuccaaccauaguuuucauacagugguuuuaaagggcacacgcucugacaccccguuauaacccuggugcuuaagagggaguauauugaguguagacuguuaggaccaagcaccggaugugcccagauugagcuuucugauugcccagagucccuggcccuccugaagucaggguggggcuccugucuggcugcagcagcuucacagcuaaggcagcugaaggaagagcugacaacacaggaggacguggcggccuucagaaguagaaguucccucaaggucaagguuccacaaaccagaugagguuucaaguagagugggugcugugcgcuaauguggcuggcugaggugcccugucuggagcucuggggacgcguuugguucuggaugaguccuguaccccagcccugugggccugugggugcccccauguuucaguugcuugaaagguggccuuagagagcaaaggugaagagcaguagggcgacugucugcguucucacagguaaaagaagauacaacauuaagcuguggaaaacguucacagacuguuuuaacugcuugccgauagcagccaucguggacgagaagauauucugcugucauggagguaugugacauggagguguugccuucaccuaggcagcucuaccccuucugaaaagucagcugggcacggugacccuggccaggccacuguggugccaaggcuucuucacagugauacagcccggucauuuggaucaagugugaggaagcagggguuauagguugggaagagaacgagacuuuaaauacaggacgagcccuagugcccucuucucagccaugugucugccugaacccugacugugcucuucccaaaagcucugcuccguuccucagcuguucugugugugagguaauaaaggcauugcaaagauguggagguuugggggugauuggaaaugaagcagcuauccaaaaacccacauaauguauuaaggcguagucucuaugcccucuuggaucggguacuuagagaacaagacuguuagaucuguugagugacauuuggugguccauggaccacaggcucggaaggagcugccucacagcugagcauugucgugccugugcccggccauugcaucuggugaugguggcacccucuguguucccuuccugccuucuauugggagaaguguggauucagugguuggguguugcggggcucuguguugaggugacugucucugaccagcacaccaacagcaguacaguacauuucgugcauuguuucccccaaaaccaaguuaaaaacccacagguuucaccgcagcauggcagugccagccuccucagcaggaggggcuggccacaugcucaggccaaugcugucugcacuucaggggguuuccuuucucguugaauagguuuaucaccagaucuucaaucuauggagcagauucggcgaauuaugagaccaacugauguaccagaucaaggucuucuuugugaucuuuuguggucugaccccgauaaagaugucuuaggcuggggugaaaaugacagaggaguguccuucacauuuggugcagaagugguugcaaaauuucuccauaagcaugauuuggaucuuauauguagagcccaucagguacugacuuugacuuuacauguacacuuagagcaugggugugagccgaggcuccuuguugauuuugguggguagguauggcuugccacacagugugccuccggggcgagcggcagcaggccgagcucaguggggaaggagaggggcagcucgugccccagcugcucacacugacacggucucuccacaggugguugaagauggcuaugaguuuuuugcaaagaggcaguuagucacucuguuuucugcacccaacuacuguggcgaguuugacaaugcaggcgccaugaugaguguggaugagacccucauguguuccuuccaggugagacuguggccacuuuucaugugcuugcaccucugcugagcaggcugcccuuucuuuuuuaggaauauuuaucccauggaaaaagugugugggcucuuccuaaagaaaggaaaaauaauacggaaccuuuucccaggauugacguuagguguaguugaauucuuuaaguggguggaagcaagcgguguguuacagugucacuuauagucagugcuuuuggugagaagagggaguuggggugccucuggcuggccuggaacacacccuguagaccaggcuggccaugaauguaagagagauuuacuugccucugccucccaagugccaacacaucagcuugugccaugauaucgucuccugugcuggccccugguucuuacauuuccucccuauagugggcuugauccauuucaagcucacgcaguuguuaauguuacuguagcuguggaagucccgaggcaggccucagcacuccccagagacugcagacuccagugccuuccacagagcuucaagguugugggaagcucuagacuugaguuugucacuuggccccagcagaaacuguuuuccagaucacauauucuggcuguaugucauggcacuucuccaccaaaaugcucagggaccagucgguccaggguauguucuagagggcuuuucagcauuuagggggcagcagcauuaggcagaacuucuagauggagaucugaacagagcugagguccagguauagcucuccuaagguucuucuuucuuuccucuuuacagauuuuaaagccugcagagaaaaagaagcccaacgccacgagaccugucacaccaccacgggguaugaucacaaagcaagcaaagaaauagaugucacuugacacugccugguugggacuuguaacauagcguucauaaccuuccuuuuuaaacugugaugugcuggucagcuugcccagguagaccugucugucgggcccuccuccauuugauuacugcuggcacuugcugguuauagcagcaagccaagcacuucauucucaagagagcauuuuguuuugaaccucuguucccuuuguggacagcucugaugaugguguuaagcuguacacccuggcagguuauccugucugaggagaaaguguacaauugaucuuuuuuuaauuuaguauaagucaugaauaauguaaaugccuguuuucuuuaggauauaaagagagccuuagagugcgugagucucuacauguaauugucauaaaugcauucuguugauacaaaccacugugaacaauuuuuuuuccaguuuguuugaaagggacugcuuucccucauugucuugucauguacaaacuagugucugcagcuguggcagcaggagugaccugccugccgccagcccugcccagacuaucugaagcacacuccuucccacugcacauuuaauaaugauuaaagccauucuuuucaaugucugugauuccuuccuaaagccaaaguuucuguuggacuguauggcacgcccuggggaugagguggccagggcaucgaggcugcgugcacaggccgccucccuccguggggccucagaagcagguuauuuuaacuagcaauagugguauagugcugaguaagcuauuaaugauggaaguuaaugacacuuuguacaguucccauauagucuauucacugagugaucuuuuuacaguuggaucaggccugaacccguccauucagaaagcuucaaauuauagaaacaacacuguccuauacgagugaccgauaaugcuuucuuuggcuacauucuuuauucugcggugacauugaggcuuauaaaucaaaaggaacuaacuugccguccaccgguuuauacagaacucacaguaucuaugacuuuuuuaaacuacgaccuguuaaaugaaucuguuugcacagaugcccguguacaaugccaugugcugagaaugguuucagacuuauuaaaugcaagcuuguuaacuugu

SEQ ID NO: 2659 - RNA, 11478 nt, Mus musculus
ucacacagaccucugcucacauaggccugcacuccuaguccuccgggguuuguuguuacuggugguuuuguuuuaggcagggucugacucugucuagcacagacuaacugauaaccaagugcugggacuuagacuugugccagcguacccagccucacauguguuuuguagaugccugccaagcauaugcaagguccuauucuaaaacaucagggaaagggcagggagguuguuaaagucugguuuaaaaaggccagggagaccuuggcagaggaaacaucgauaagguccuuaaaccaugagggaaaaaccccccgauggauauggagacauugaagacauaacugacagguuaccuuagcuccuaauucccucaaccaaaaaacucugaaaaucagagggaacaguguuuacuaagugugcuacccacacuuacaguguugugacucuacgguaaaagagacugggaaguggaggguaacuaaguugaaaacaguaggggauuuugccugcuaaaagcuuucuaagcugggcuauucugaaguaguguugagcauuuuauucccaagcaugugugguggugcacaccuuucauccccacacucacggugcacaggcagguggagcucugggaguugaggccagacugguaugacauaucaacaccgucucaaaaaauaugugaaugaggcugaagagauggcucagcaguuaagagcacuggcugcucuguauucaauucccagcaucuaccacucuaguuccaagagaucugaugcccucuucugccaucugugggcaccaggcacaccaacacaguacauagucauacaugcaggcaaaacacccauacacauaaaauaauaguaauaaaauuaaagaauuuuauuuccagaaugcauuauaaacacuuaucuucccuguaguuccuucuaaugauucucagucaugcccgagugaagaaacacaggaggaggaucugcugaauaagugcaugcaguccauguccauccaagaacaaggcccagcucacgccagccugacggucuaguccuccacaccaagcucagccaucagcuaacauccacaugcugagugcacagggaagaguggaccauguaugggauaguacuaguaguaacgguauguuauuuugguuguugagaaauuuauaauagccgccuucgucugauauauuucuguguuaauguguaauguaugcuuguuucuagcuagaacaauuaaaauuuuacuugcaacauaaaacugaauuuuaaauuaucuuuauuuuaugugcauuggugcuuugccugcaugucugucuguguaaagguccuggaacuuauggggcuggaguuauagacaguauagcugccauguggaugcugggaauugaaccccauccugggaaagcaggcagugcucuuaaacugccacugaggcaucucuccagccccgagucuggcaaauauauuauuucuccuuuuaguuuauaaauuuauaguuuauaacuuuguaaaugugugcguguacauguaauuguugguuauuccagaaaguuuuucuugauuaaaccaggaaacuggaaaauauuuacacagaauaguauuugcagaucucaccuucaaaagcagauuggucaauauuugcuaguaaauauaaauuaaaaaccuguggcuaagauaggcauagugauauacaccuuuaauccuagugcuugggaggcaaagacagacacagauuucugugaguuccaggccagccugagcuacacugugaauucagguauauaguaagauacugucugaaaaaauuguuaaauccaaacaaacacucgugcaacaaggcuuaagaaucauugcugagggcuggagagaugacucagccguuaagagcacuggcugcucuuccagaggcccugaguucaauccccagcaaccacaugguggcucacaaccauccguaaugagaucugaugcccucuucuggugugucugaagacagcuacagugcacucacauacaugaaauaaaugaaucuuuaaaaaaaaaaaaugaaucgcuguugaguuggacagugguagccacaccuuuaaucccaacacucaagaggcagaaguuugucuguguagcccuguguguccaggaacuuauucgguagaccaggcuggcuuugaacucaauagauccaccugccacugccucccgacagggauuaaaggcgugcaccacaacccaucuaauaucuauuuucuaacagucucaggugaccccuguaaaaggguuguuacaccccaaaggagucucagacacaggaucauaacugcucuaacacaucugcaguugugugcccuucacucuagcacaucggcaguugcauuuggcuucucauuuuuauguucuuguguuuguuuuguuuuugagccagggucuccuguguagcuuuggcuggccuagcauuggcaaaaaaugcuuaagagauccaccugccucugccucuugagugcugagauuucaagucuaugguuuuuaaauuaaacacagguuuucaagaaagucuaaauggaagguacacauuuauuaccagagaagagaaaacauacacacaaagucuggauucuuucucuucaugcgcuaguuuuguaaugaaguccaaauaccaacuaggaggcuauuuacaaggacaacuuccuaacguggcccugcacuguugggugggcugcuucuuauagaaaccauacacugcaaacuaaauauauucuuaacaguuuacaagaagcuuuagagcaacuauggauuaacagagaagacuuuuuagugcaaaguauuauaaaagugauacaacugugugccucuuaaguguuuaauuauuugauuuaaacaaugaaaugaggacaaaauaagugguggagaccagccuggcuuuacgacuuuuuauacucaauucguucuacuuugacgucaucuccaauuaguugauagacguaagugaccacaguagaagccuggauguccaucagcacaaacgauggaauaauguuucuggaagaaaaagaaacaaugucaguguuuuauacuaaagugauagcucuguaaauuucaacucaggguacugaacacaggagaaaucugauuguuaccugcacacuacaaagacuaguagcugggcagugcuagugcacuuuaaucccagcacucggcaagcagaggcagguggaucucugaguucaaggccagccuggucuacagagugaguuccaggacagccagggcuacacagagaaucccagucuucaaaauaaauaaaauaaaaaaggaaaggaaagaaaaaagauuguugauaaggacuuauuuaccuuuaucuauuuaguguguuauuugagacaggaucucacuauguagcacugcuggcauugaacacaaagagaucugccugccucuaccucuggaacacugggguugaaucugugcaccaccacaccagcucuuauuuaaacguauuucucuuuaugaaacaucacucacauaauuaccaccuuuucuagagcucuaaaugccuacgcugugguacuuacguuuccaaggcauuauaggccccaguggcagaaccuggguuaauguagaauuuauuuucaugcucaaaugcuucaaauuuguguguguguccugagauaagaauguccacaucaaacugccucugcagcagggcuaagcuagccaugucuccccacggaauaacuugguguccguggaucagaccgaucuugaacuggcccacagucacaaccuuuuguucuggguaauucagauucuaauagagaaaagagauaaagaaagcacacauuucagacagaaugaaauguacucaguuuguuuaaauauucaaccucauagguaucuucaggcagcacccuacaacaaauacacuuuaagaaguuucucaucaaccugugacacugcaauggugcuuaaaacauaauccaguugauguaaccuggaagcugucaaacugcuuuacugacuuaauuucuauaagggaucuuuagggcaugguuuaagcaauaauuaauccucggcuggugagauggcuccgcagguaaagguccuugccaacaagucuggaaucuaucacuggaucccacaucauggaaagagggaacuccuguccacaagcuguucucuuuugaccuucacacaagcacuguacagacaaaaaugcacaaaugcuacaauaaucccuuaaaccugugauuuucacaacuuaagguauauaacuuauaagcugggauuuauucaaauuauauuccagacuuuaauaaucaugauacccguuuuauggaugcagaaacuaaggcacaaagaagcugaaacagcuugcccaagguuauaugccaguaagugguugaggugagauccaaacccugguuacauggcucuagaguuuaugcauuuagcaaacaagaaaugaaauuuagccuuguuaauuaaacugguuuuuaacacaaauacaggagccuuaauuuuuuuuuaaaauaaacuagaccuacauucuaaugaacaaguaggcugucaacgggcagugguggcacauaccuuuaaucccagcacuugggaggcagaggcagguagaucugugcucuaagccagccuggucuacagaguccaguuccaggacagccaagaguagacaaacucucaaaaaacccaaagaauaaaaccaaguagacuguccuuucuugucuccuuagucuuucaucaccguauuuuaccccaaaucuuuuuauaucugcuaaauaagaacacuauguucauuuuguaugauauaaagaaacucuuugcuuuuuuuuuucuuuuuaguuuuaaauguuuauuuucugugugucaguuuaugugccauuauauauauguggcggucauaggacaaccuagugucaauucucuccuucugccauguggguccuguggaucacaccaggucaucaggccuuuucccacugagacgccucaauggcccuuugaaagcaucaaccaaauugaauaauuuuugaaaagcuuaagauuccuagaagcacaaaguaauuucuucauauuggaaucagguuuauucuugugaauuaugcaauuccaauuauauuuacugagggucagaagaaaaguaacuugucaagaaucacauuauuuagugacuaaugggcaaagcuuaaauuuaagagcuacuucuuuucccauaucuuauuucauaaacucagcuagacugaaauccauguuguaccuucaggcuugcagauaagguauauaggaaugaaacaacaaugaauuacuguuuagaccuggcucucauccccaauaacucauuauauaugugcccaaaccugagaacgccugaguccagaacacuucucacugcaagcuaauggacucuucaccuggaaguuuauacuugggggacacaauugugaugcugaggacugagcccaggcacuguguaugcucagacgaguguucuaccacugcauggcuaguaccuaggguacguuuucaauggggcaggggaggacgaauggaaaaacuugagucuaaaggguaagucuacacaaagaagugaggaaggagcacagaugggagggacgggauggcggcaccucaucgaagucuccucucacgauguggacgucgccagccagagucuugagauagucguagcucuccuuggugcagagguugccggugcagaggaugugcuggauuuuuccuggcaccaggaguuuuuuaaacuuggccggcaggcuguugcaccggugcggaaugugcagaucuccuaguaccaacaccaacuuucaggggucagaguggcaaaacacagcguuagacaugacgucacacgauccucccacaccaccccuuuaaaaggagauccagaacagagcagaagucacucagacaguuccuaucaugggccaacaaacacuugguaccauaucuagucuaagcuaauaucaucuuggaugucaaauuuauauuauuuaccaauaaauaauaggauaaaaucaaguauucuaaaaugauucgcuagccaggugugagagcaugcaucuauaaucccagcagagagagagaggcaagaggaccaccgcaaguucaaggccuaccuagcucuauaggaaguuuuaggucagccaccacuauauacagguccuuucucagaaaaaguaaaaaauaauuuaaaaaauugauuuagaaaccuauaaauuauauugaauaaaaugaaaccgcaaaaugaauaacauacuacuggaaucuauagcaugugguaguuuugaugaaugacaguaauucuuauuucugcuauaauauaaaacauguauuauagaaacaauauaaaaccgauuuaacugaaaaaaagcauuguuaaaggaaauuauuggaaaugaaaaugggccuagugagaugguucagauguuaaaagccuuggcugcucuuccugaggucccagguucaguucccaacacccacauggcaguucagaaccauauggcugaguauggcgggucacgccuuuagucccagcacucaggaagcagaggcaggucgaucucaugagauugaugacaacuuagucuacaaagagagcgccaggccagccuaagaaaacagugagacccugucucaaaaaggagaaagagggagagagaggaagagagaagacaggaggaaagggaagggagaggagggggaggagagauugauugauugauuauaugggguauggugauucauggcuguaaaugcagcacucaggaagcugagacaggaagguuauuacuucaaggccaaccugggcuacauggcaagcaaguuccaguucuaggccagccaaugcugccaagugaaaacuaucacacacacuaaauacauauaucaauauauauguguauguauauaaacauacaaaugaaauaauagaaaaaaaugaaauaguagggaaaagguuaauuuuauaguucaugcuaagaacucuuuggagaacauuagccaaaaauaacugaacucuuagcaguguguuuguuacagggcaccaacaccugugcuuagagacucaguagauucauauuuacaucugauuuuuaaguuuuaugaucuuugcuuucuuucacuaagaaccaccacugucauaucuguauaaccuggauuaacagccccuucuguccccucaguauagucuguuaacgucaaacaacacuuucacaaucguuuauguucaucagagaaguaaaacaaacggaguggugaguuuggcaguagguaguuuggcaguagaccugccacagucucagaugacaaaaguauuaucugcucugaaauaucaaagaacuaaaaaucaaauccuaagacaagcauggugguguacaccuuugaucccagcccuaaggaggaaaagccaggcagaucucugugaguucaggaccagcccaggcuacaaagcaaguacacagugaaauccugcccaauguguguauguggggguguggggggaguccuaugaaacuuuaacuuuaaauuaaaaaauuucaagauugaacaaaguagacagagaauaguuuaaaaguuccuuuaaggagaacacacauccccugagagcgacagaugacugcccugcugaggaggacgagcaccuuccaggagcuccucacagccuugccaugcaucaguacacauauucuuuacugcuggucaaagcauggcuaccccugaaccauaucaaaggaagcgcuacauguuuaauaugauaaagcaaacaguuuugccacuauaauguuaaaauuaauuuaaaacguuaauuuuaguggcagugguuacaagagcugauuguucuuccagaggauccagauucccgcacgugguggcucacaacugucuguaacucuaguuccagaggaucugacaccuucucagcuggccuuggaggguaccaggcacacauguaguacagacaggcacaaaagcaaacacauccaacauaaaauaacuaaguaaaaauuuucauuaauuaaaauuuagacuggauugaaaacuaaaauguggcugggcaguagugcuguaaguacacuuuuaaucucagcacucaaguggcagaggcaggcagauuucugaguucaaggccagccuggucuacagagugaguuccaggacagccagggcuacacagaguaacccugucuugaaaauccaaaaaccaaaacaaacaaaacaaaaaugugugaaaugagaugauuacaaaaacaaacuugauucaucucacaacaaaaccaaaagcaacaguuaucaggacacagaguagcugaauuaauagguguguggguggucacaaaaugagcacaccuuugacagcuaaaaccacuacagaguauccacccucaauagacaugucuugacacaccaucuucauuuuagggggggggaucccuucagauuuggacugugggaugcugacauuugaggaaaagugaaagaaagaaaaucuauauuaaaagaacucugaacuccuaagagggguaugucuaaaauagauucaaaucugagacuaaaaaugaauuguucacugagaauguaccagaaagaacagaggugagagacaacacuguuauccuuauugaagaugucaacucuguaaggugccacagcaccccugacaauuagugugucaaaacugugacuggaugaauggcccugcaggcagcaucauggcuccacagugagauggaguccucugcuuugcugcuggugacaaaguuaugggaaagaaauaacaugucaagaguguccuugccuaaauuccacaaugacaaaucagguuagacagacaguagaggcagcaaaggaucuggaagccaaagucuugucaaaaaucauguaaaagcaaaaacccaaacaagcauggggauuugauuacucccuauuugacagagcuggaaagaguaagaaauccagucaguuaucagccacccaaccaccauuguuaguaggagcggagaaaaacuuacucugugcccagccuuaguggaaugaagaaguugauugcagacaggggaauggaaaaaaaaagggggugaaacaugaccaauguuaaaagaaagcaacaaaaguuaaaagaaaagaaacaaauaaaccaaaaacccauaccaaauaugcaaaaauuguuaaugauuucugaauguuaugaaaggaaauguuaaaaaucagcugugccgaaaauaauuccaaaagaacuacugauucucuuuuuaaacacaggacaaacacccacacacagcaaacugucaaugucguucuacauuuucuugcuuuguacaccaacuccuguuucuuuacuucucaaucugucuacucuuuauaauuugaguagauuauaaagauuugauauuuauaauuugaagaauucaucaggaaaagguuaaaguuaguauuuucucauuacuggggucuuguuaucucuagauauacuggagguauauguguauauguguauguauauauauguguguguauauagauauguauauauguguguguguauguauauauauacacauacauacacacauauauauauuuauuuauuuuauguuugagguucuaguauugaaaaaucacacuccaggguaaguuaugugcuauagaggauauuacuagcuggaguacuuuaucaugugacaaaaaugucaagaucaagcucugugugguggcacacuccuuuagugcccacucucaggagacagaggcaggcagaucucugauuuccaggccaguagggcuacaucguuauaaccugacuuaggauggaagagauggcucagcaauuaaaaagcacuugcugaucuuugaaggacccggauuugguucccaguacccgcguggcaccucacaacucccuguaacuccaguuccgggggauccgaagcccucuggucuccaguagcuccugaacuuguuuggugcacauaaacucauguagagacacauacacaaaaauucaaaauaaaaauuuaaaagaaacgugaugcccagcauagcaacugcccuuaaacauaagcguucaccccucaaaacgacuucagagacaugaauaugcaaucauuccagcaaauucuucuuccuugcaagugucuccaaauugccaucaaagaacuagucuacuuuaaacuggagucuaaagcaaaauaauucucuuuuagaugccaaaauccagugaauuuaagcauauaccuuuggaacggcuuauaaagccaccuuuuuuuuuuucuuuuccauuuuuuauuagguauuuaucucauuuacauuuccaaugcuauaccaaaaggcccccguagccacccacccccacucccauacccacccacucccccuuuuuggcccuagcguuccccuguacuggggcauauaaaguuugcauguccaaugggccucucuuuccagugauggccgacuaggccaucuuuugauacauaugcagcuagagucaagagcuccgggguacugguuaguucauaauguuguuccaccuauaggguugcagaucccuuuagcuccuuggauacuuucucuagcuccuccauugggagcccugugauccauccauuagcugacugugagcauccacuucuguguuugcuaggccaccuuuuuaaaagguugucugcacaaggauaaucugugaaaaacgcaacgcgugcccagcagccagugaggugccuucacuuuaaccuucaucaggacaaacagcaguccccccccccaacuuuagagagcaaagagugccuucgaaaaucggauuacaaggacgugucugcacagaaaagucguagggacagcaaucuauugggggggacgggccuaaaggucugaugcagacuggguaagcuaaggcucuccgaacaaccccgcgcaucuccgcaggcuccaaacgauccccacgacaucgcucaauggggccgcagcggccacaggagacgagcaguccccuuuccggguccccguccggaguggcggccagugcgacggcuacuucgcgcucugccccgaggccggcuacccccagcaagccgggaaggaccaggagggaagagacgugcggucacaccgacugccggagccgaucucgugaccggguccggccgccggguccgccucgcacgcccucuggccgcuggggcgagggggcgacaucaggccgagccgcacccucaaccagccgcgguccucccguuccaacuccgcggccacccggauccuccucgcgcccccaccccacucccucaaccggacgccgcagcaucccggccccacccggguagcagccgccguggggcucaccauccugucaccagggcuccguucaaucaccacgaacgccgccgcccucuuccucaggcuccucggucgacccgcccacuucuuccgccaccaaugagacgcgaaguug

SEQ ID NO: 2660 - RNA, 1063 nt, Mus musculus
cucuaccucuggaacacugggguugaaucugugcaccaccacaccagcucuuauuuaaacguauuucucuuuaugaaacaucacucacauaauuaccaccuuuucuagagcucuaaaugccuacgcugugguacuuacguuuccaaggcauuauaggccccaguggcagaaccuggguuaauguagaauuuauuuucaugcucaaaugcuucaaauuuguguguguguccugagauaagaauguccacaucaaacugccucugcagcagggcuaagcuagccaugucuccccacggaauaacuugguguccguggaucagaccgaucuugaacuggcccacagucacaaccuuuuguucuggguaauucagauucuaauagagaaaagagauaaagaaagcacacauuucagacagaaugaaauguacucaguuuguuuaaauauucaaccucauagguaucuucaggcagcacccuacaacaaauacacuuuaagaaguuucucaucaaccugugacacugcaauggugcuuaaaacauaauccaguugauguaaccuggaagcugucaaacugcuuuacugacuuaauuucuauaagggaucuuuagggcaugguuuaagcaauaauuaauccucggcuggugagauggcuccgcagguaaagguccuugccaacaagucuggaaucuaucacuggaucccacaucauggaaagagggaacuccuguccacaagcuguucucuuuugaccuucacacaagcacuguacagacaaaaaugcacaaaugcuacaauaaucccuuaaaccugugauuuucacaacuuaagguauauaacuuauaagcugggauuuauucaaauuauauuccagacuuuaauaaucaugauacccguuuuauggaugcagaaacuaaggcacaaagaagcugaaacagcuugcccaagguuauaugccaguaagugguugaggugagauccaaacccugguuacauggcucuagaguuuaugcauuuagcaaacaagaaaugaaauuuagccuuguuaauuaaacugguuuuuaa

SEQ ID NO: 2661 - RNA, 11029 nt, Mus musculus
cgccucacccuucaccgccuuccguccgggccaaggcgggcggccccgcgaccccgggccaacggcucggcaucccguccacacgcgugcaccacaccggcucugagucggcggccuccggcucuccccacuccgacccugcucaaguggccgccggauggugcggaggaagacccgaguuccuggagcuguagacccgagggcggaggaaccucagguaaccaggcuccugcgccugggcaucucucgcugacaaggacgcgucagggcaaauccauccacacgcacccuaaagcaaguauuccuuauccaccucaguauucuagacccucagaggaccugcagaccuucgguugucacccuaugugucaaacccaagcaccggugcugcggcccgggggcgcggagcguaauucgcgauccgcuaucaccuaggcaaccgccuucgccggaggcccaaccgauaacggcucucggcucuuucucuuucucucucugcgcacgcgugaacgaacucguguccccgccuccucucugagcacggcacgcguuucggaaggcauuuuggcccuggggacgcuccguagucuaugguguaguaaauacccgugcugaacgagcgaucugugguugcgauuggcuccuacgcacauuccccggaacgccguggcugucgcgcgaaggcugaagggaguguggccgucggcugugugugaaacccccggagaggcggcaugccucgauaugcgcagcucgucaugggccccgcgggcagcgggaaggugagccuggaggagcugcggugcguggguggcugggcuccggggaaacccuggguauacggcuuccugcucucugcuuguaccuugcuuuuuuuuuuuuuuuuguuugucugggagugauagcagcuuuaauagcucuugagcggcuugagagagggcugagcgcucaagagcuuguucuguccucccaaaagacuucaguucuguccagcacccagacagagcugcaggacaccuuugcuccaggaacugcccuggucguuccaggugucuucauauccauucugugugcuugauccuauacccauucuacagauuacaaacacagaaagguuuauuuuguucaaaaucauacgcuuacuuagguccgccccggaaucugagucuggguuguuggucuuuuuguuuuuuugguuuuuuuuccccugucuaauuccagacaaggcccccugccacgcacccaguauggggucuuuucuucccuuuuucucagaaguuuggaguauggguuucagauaaguuuguagauaugcacuguuugugggcauuuuuuucuuuuuccuuugagacaggguuuuucuguguagcccuggcuguccuggaacucacucuguagaccaggcuggccuugaacucagaaauccgccugccucagccucccacgugcugggauuaaaggcgucugccaccacugccuggcucuaguuuuuauauuuauuuuuuuugugugauacaguguuucuuuguguacauauuaagagaaugaugcuaaggacacuuaagcacaguagaaacggcaauggugacauuugagggaugccuagagucuauagagguguuuguaucauuuuaauauuuaauaaauacaauauucagaguacuagagauggcugugugacuccacagggccugucaucugaucuggaagguacacagcucaccugucaguuacagugcaucuguaugguggggcuguccuagguagagagaacaggcugucaaaaggaagcguggagcguggaggaggucauuucuguaaccuacguuaauuuguagacuguguuaaagaaacauccugagcccacgcccugcaucuagaucugcagcucuggucucaucgccuucccaggguuucccuggaggugcaguuuggcuuggguggacacuggcucagagaggggagaauugucugggcauguggagggcgguacgcuacugccuugggugcuaaccccccaccuugucacguuacagagcaccuacuguuccaccaugguucagcacugugaagcccucaaccgaucuguccagguggucaaccuggacccggcggcagaacacuucaacuacccugucauggccgguaagucccggcagggccaccuucuucaggcaccguaaagcucagaaggcacuggaagccggcugcucaguuauucacgugcucagccccggggugaggaggagcaagaugaggccacgggccauuucauggugguguuuguggguguggaugccauggccuccuuuucuggucuuugcugggagacucuaaggugagcgggcuccugccucccugccuuucccucugguccccuuguugcuuacucuggugaguuggggguaagaugguuuguccacaguaaauagcaccugugcuggcuuaaaaaaggugaggcucagccgggcaugguggcacacgccuuuaaucccagcacuugggaggcagaggcagguggauuucugaguucaaggccagccuggucuacaaagugaguuccaggaaagccagagcuacacagagaaacccugucucgaaaaaccagaaaauaaaaaaaauuuaaaaaggugaggcucagggcugggcuggggcuuggugguggagugcuugccuaggguaugugaagcccuggguuuuacccucagcaccacauaaaaccaagugagguaguacacauuugucaccucugcucagugaaacaaaacaaagcuuuuuuuguuuuuuaauuaaaaauaguaauccucaaacagaagcugcucacugagaugacggugcaaauguuugagccaucagcuauauacauacacacauacauacguacauacauacagacacacauacauacguacauacauacagacacacauacauacguacauacauacagacacacacauacguacauacauacacacauacagacagacagacagacagacauacguacaugcaugcauacacacacauacauauauauguacauacauacauacaucucgguacauuaaguuccgggauggaugaccucacauggggaaggaguuugguuagagaagggggacagaggcagagcccugaagcugugcguucucuggaggcuguuagaggagacgaagcagcaagcuucagaaaggccaggagggaguguuucaagaaagagguguuguuacauagaugcaaccgaacauuuguguaagacggugacagaugugggaccauagugacauuggcagcuuugaccagaauuaguggagcaguggaccaacagcuggugggaggggauggagagcuggaggggugggggcugugcagugugggcacugacugccauggaagguuuuuauuuuacccugaguuuuggaguagagccucauggaaccagagcugcccucaaauucuuuauguagccaaggauggccuuauacuuuuuugaaucauuaaauaguauuuauuucuuccuuaauuauucacaaaauaauucuucacuacuuacaguuuucauuacgugagacacugguacuuuuguauuuuaguggaaccuugguaaaaggcaauggagaauuuuuugaaaagucucuccaaagucauuauucuaagcuugauuuugagucaaugucaaguacaguggugggaaauaauacaaaggauuccuguguaccuucaccaaauuuucugcaaugguaauauacuccauagugaaguucaguagcauagucagguguuggcauauccaaaaacguuuuuuuuuuuuauuuuuuugagacaggguuucucuguauagcccuggcuguccuggaagucacuuuuguagaccaggcuagccucgaacucagaaaccugccugccucugccucccaagugcugggacuaaaggugugugccaccacugccuggcuagauauuuucuuuauuuacauuuaaaauguuauccccuuuccugguuuccccucugaaaacccccuauucccuccccacucccccugauccccaauccacccacuccugcuuccuggcccuggcauucccucacacuguggcaucgagccuucacaggaccaagggccucuccucccauugaugaccaacuaggccaucuucugcuacauaugcagcuggagccaugagucccaccauguguuuucuuugguuggugguuuagucccagggagcucuggggguacugguuaguucauauugauguuccuccuauggggucuuauacuucuaaccuuccugccuuugccuuugauugcugggaucacagaugugcauucuugaggaguaaggcccucuaguagguggagcuggggagcaagcuggggaggaaguggaaaucaucuucucuuaagagaaagguaggggccuagaaacacagaaguggaugcucacagucagcuauuggauggaucacaggacccccaauggaggagcuagagaaaguacccaaggagcuaaagggaucugcaacccuauagguagaacaacauuaugaacuacccaguaccccugagcucuugacucuagcugcauauguaucaaaagauggccuagucggccaucacuggaaagagaggcccauuggacuugcaaacuuuauaugccccaguacaggggaacaccagggccaaaaagugggaguggguggguaggggaguugggggggaguguaauguggacuuuuuggauagcauuggaaauguaaaugaggaaaauaccuaauaaaaaaauuaauucuaaaaaaaaaagagagagagagaaagguaggcuggggcuggagagauggcucagagguuaagagugcugacugcucuucccaagguccugaguucaauucccagcaaccacauggugucucauaaccauucauaaugagaucugaugcccucuucugggaugucuaaagacaaguaguguacuuauggauaauaaauaaauacuucuuaacgaaaagaaaagaaaaggaaaggggaaaagggggaaagggaaaggaggaggcaggcuguugcuuugggaucauguggcggaagcacucgguuuccuuaagcagaaagauguuugagagacccccgggggccucacagaaggugacuuguuuagauugaauaccuuuuaggaagucagucacagaguucccauccucccaccccagucggagugcuccccuccccaucuccaacuuguaaucaggcuugggaguuaacuggcuucuuggucaucaagugaagagauagcaguuggcuucauuucagcugacuucuugauauaggcacuacauagccaagugguucacacugugaccagcucagagcaggaaguguccagaauuguggcccagcagucaagccugcuuccuucaguagccaaugucccugguuucugauguguuccuccauaagcaacugaguguacacauaaagucugugcaguggacuucuguagcuguauagcccucuuuccccacucucccaagagcugccuggcaagcacaccugauucuuacaggaaguucuaugcacuaaguuuuucacuuaaugcuauaaagagcauucccuccaagcuggguguggcaccgaaugccuuuaauuccaacacucacgaggcaguggcaggcagaucucugugcucuaagacagccuggucuaagaccuugccucaaaaaaaaaaaaaaaaaaaaaaaaaaaaaaagaugaaaaaacaaaaaccccggauuucugaguucgaggucagccuggucuacagagugaguuccaggauggccaggcuacacagagaaacccugucuggaaaaaaaaaaacaaaaaaauacaaaaaaaagagcuccccucccucuugugucugaaguguucuacugugugauaucucugcaguaaugcucagucagcugucugggucucucacucuccaccuuugaggcagggucucugucuagucaggguuucuauuccugcacaaacaucaugaccaagaagcaaguuagggaggaaaggguuuauucagcuuacacuuccauacugauguuuaucaccaaggaagucgggacuggaacucaagcaggucaggaagcaggagcugaugcagaagccauggagggauguucuuuacuggcuugcuuccucuggcuugcucagccugcucucuuauagaacccaagacuaccagcccagagacggucccauccacaaggggccuuucccccuugaucacuaauugagaaaaugccuuccaguuggaucucauggaggcauuuccucaacuaaagcuccuuucucugugaacccuggacauaauucccccccgcccccagcagcccuccugucucugcccacagcacugcaguugcagaggugcggccaggcccagcuuuuccauggaugccagaggcucacacucugguccuuaggauggugcgucaagcacgcugagucacugagucguugucccagccccaugugugagggguguaucuauauauaccuguugauuaguuuuccaaguggauacucacucuggucccugccuggcucugcagacauccgggagcugaucgagguggacgaugugauggaggacgagucucugcgguucggccccaacggaggccuggucuucugcauggaguacuuugccaauaacuuugacuggcuggagaacugccugggccacgucgaggacgauuacauccuuuuugacuguccagguacagcaacaacuugaguguacaaucugccuggagcugugacacuguguccucguggggacguagugaacaaguaccugcagaacccaguuggauccgguuuaucccuuggguugaucaagugcuuacugagaucaaccuuaagaguaaggggccauagcuuguggcucagugggaagcaagugcgaucagcaguugccccaugauuuguauuuuuggcaggugacccacagagggaacaggaggcaacuggucaguuguccguuaaaauaggcuaugggacaacauggagucaguugugcaggcaaagggccucagacaagaagcuaugagcagacugaggcagggguggcuauuugaccagaggugcugugaggugaaauugggaagggacaggugacgugugagcuguggaccggagccagccuuguucaugugugugucacgaguguggauucccaagccaccccuuuaugcucguaucacugguuuuccaugcugaggggugagugcugggcuacuucaugccagcgagacaaucuaccacagggucaccuccccagcccagcacuggcaaaaagaaauguagaaauauagucugcuugcugggcgccguggcgcaugccuguaaucccagcacuugggaggcagaggcaggcggauuugcaggcggauuucugaguucgaggccagccuggucuacaaaguugaguuccaggaagccagggccacacacacacauauguauguauguauguauauauguauauguauauauguauguguguauguguguguguguguguguguguguguguguguguguauguauaguccgcucgauaucccugugguggccauaccucagguucugugauuguccugggaggcugugauguccccgugacagcugagagcagggagugggcggugccucagagguuaagagcacuugcuccuccagaggguucaaguucaguucccagaaacuuccggaacuucaacucugacacccuguucuggucuccacaggcaacugcaaacacaugacauacagacacacagacauaaaucaaaacaaugaagcucaggaauaaaaugcaaaacccccacagaaauccaagggaaaagggcauagucugaggggauggacaggcugcaguucaguccugcaccacagaugacacagagcaaaacagcuggauguguagcagggucugauguccuccccuuuuagucccggggccuggacagacauguguccacggggugggugcccuuccugcucuuacucaucuuugcagccuccuggcuugugugacugcugucgugugcucccccugcaggucagauugagcucuacacccaccugccugucaugaagcagcugguccagcagcuugagcagugggaguuccgagugugcggaguguuccuuguugauucucaguucaugguggagucauucaaggucugcggaugaaucucuuguagauuuuucaguccuggguagaaagcaagugacauucucugcucggucugggugagccuccacauuucauaggcuguaacauuuauuuagcaucuccaaugaucaaaugacuaugugaaugucugcuuaccuaagagauagauuuagcuggguguggugacuuuaauccuagcacucaagcgaaagagucagaaggaucucuuuugaguucaaggccagccuggacuacaaaucaaguucccuggcucaaaaaaauaaggagaaaaauagauugggggaccuacuuaugaaauaaaaauugaggcaaaugggcauuguauuacauaguguauuuaaaaauacugagcuggccgggugugguggcgcacgccuuaaaucccagcacucgggaggcagaggcagguggauuucugaguucgaggccagccuggucuacagagugaguuccaggauaaccagggcuacacagagaaacccugucucaaaaaaaaaaaaaaauacugagcugggugagugguuugugccugcaaucgcagcacuccggagccugaggcaagaggguugcugcaaguucaaggcuagccugggcuacagaguaaaguaucucaaauauaaagauuaaaaauuagcagaaaaaaaacuacuuuuaauuuucugaggaccuguauuccuguuuagaaauuacagacuccauuuucucgucaguagucaugagggcuguuaguggaaaagaaggccaguucauggucaaaauccagagauguggucaaggcagagcaagggauucauugauggguuugguacagaguauguguaacaaagacuggccuagaacuggaucuucaucugcgcagcugggauuaaaggccagccacuccccuacggucaguagaugagaucacaucuucccuucucuccuucaaggcuaggagggccucaccaccuuucuagcaagugucuuucccuguaagauuagucucuuggguuggguaccaguaucccuccugugaguccaggaggcccuguggcgauaacuggucguuuguguucuuugcuucuccaguuuaucuccggcauccuggcagccuugagugccaugguuucucuagagaucccacagguuaacaucaugacgaagauggaccugcugaguaagaaagccaagaaggagauugagaagugagugcugaccccagcagggcucugugggccgauccuugugcccccugagacaggcuccuguucuccuccugucucccucuccuuuaaagguuucuagauccagacauguacucucugauagacgauucaaccggugacuuaagaagccaaaaguuuaagaaguugacgaaggccguguguggccugguaagcgcccuuuaaagcccccuccagugauuccucgggugucugcccguguccagcccguguucaccugugugcagcacuguccagugccauccccuauaaaaagcuggcgguuggggguggggaggggugugaugguuaguuugggcagucaggugguuggggccgcucaguuccaguggguucgaggucagaaaggucagccaaagggggugcugucucuccccagggcuccuuuuuccagccuagugcaggugacugcuugcguccuuguuuuuuaccuuuauuugugugcaugcuugcaagugugcgugugugccaggaagacacucuguaggaguugauuucuucuccucccgucauguggauuuugaggaucgaggccagguuauuaaguuuagcaagcuuggcagcaggcaccucacuccugagccuuccugccagccgagcgcuuguccuuuucaggagguauaaaugauuaugcuauaaacaagcccgcggugggcauggucugaagcacugucagggccgcuucucuaacccguguuugcagguggaugacuacagcaugguccgcuuccugccauacgaccagucagacgaggagagcaugaacaucgugcuccagcacaucgacuucgccauucaguacggggaggacuuggaguucaaggagccgaggguaagcugggcuucccugugucagcucaagagggguccccagaggaggggaugcauggucugcucugugcugccuuugugacaggagcaugaagaagagucuuccuccauguuugaugaguauuuccaagaacggcagaaugagugagguugacuacguaggaagccaccaucccgcuuguggccaagugcucuccuggaggauguaaccgcgggaagccgccgcugcgucugggaagcgugcugggcucuaggcugagccgcugcgugagcaagugagugagcgagccuggcuugugcucugagcucugaaacugccgcucuuucaggagacuuuauccugacacuauuguuuggauauuuaaagaaaaucaaaguagaaauuaaugcacaaagacuuguguauaauauaaaccaaccuagccacacacguacaucaccaguguguaugugugcaugcgcgcacaauuggagccaauguaaccucauuuuuacaauugaauauuuuguuuuuugaggggucuucuuuugauuuacuuguuuguuuuuggagagguacaaauuauuguaacaaaaaacauagaucuauaucaaaauaaaaaaaauuggaaggauauacauguuauuuucacaaaucaacauguauuauuuauacaauuaaagcugaaaacugaaauguaaauaaagaaaauaucuaauaaaaaguauauauauauuaagaagaaaac

SEQ ID NO: 2662 - RNA, 23208 nt, Mus musculus
uuuguuuguuucaauguauuuuuaugaguaucugcaugccugaguguguaugucugugcaccacaugcauguaugugcccauagacgccagaggaaggagucggaugcccuggagcuggccuuucagacuguugugagccaccagguaggugcuaggaaccgaauuccccugcaagagcaugcaguuuuaauuucugaggcggcucucucccucuauggaaauggcuucagcauugcgauuugugaauaugcaaugcaguaacgaguucguaaaggcuugagauguugacaguggggcgaucagagauccagcucaucccuguaacuaucuuuucuucgcacuuggaucuagcgggucacuuggacgggcaagccaugccuugcaccaaggaaucuauucccagugacagggacaagagucgccaggagaggggggcgugccaccuucgccuaggacgcucccguaguuggagaaagccagcccuugcgcgccugauucgaaaauucaauuuuuaacuguccguuuuccgccuccgcuguguuuaggaugaacuccugugcauuguuacuagccuccgcgaggcauccauuccucucaggcugucuuuagcgcagcaaaacuacgauuccuacugggauggcuuugaagaugaugaugauggagaaaacccuuucgccgcugcuucuuuuuacucaggcacguccguggcuaccuccaucuucggggggcggagccgcgucuggaccggaaggaccccggcgccgucuccauuuuggaacuuuccccgagccucugcucucgguucccgggaguucuguccgccgcugccggugccgcggugucgccgggggccacgguguugccgggcaggaugagugugauagaccacgugcgggacauggcggcugcgggacugcacuccaacgugcggcuccucagcagccugcugcucaccaugaguaacaacaacccgugaguuggagaggcggggagguggcggucccgggagccgggguuggcgguggcggggggacgguguggucccgcggagggcugcgcgggauccggccucgguggccucggaguucuggcuccuuccagaacgacgaaguccccugagucccggggacccaguccaccgagugucagccgugggggugccaccccagcggagggaggggaccccacuuuccgagacugagagcaucgguggcgggcgcgguggcgccuuuuuuuaauuuaaaaggaacccuggcagucuaauguaaggcccgacauugccgccggggagugacugguuuugugugguuguguuuacaaacaggggucuccuguagcccaggcuagccugccccaggcuguguguguguguguguguagucaaggaagaccuugaccuucuuacccuccugccuacgccucccagaagcugggggggggggguuaacugguguuuuacacccccaccaugcucucagugugcguguggaccuuggggaucgaaccagggauuucaggcgugcuaggcaaaacacuaccgauggagugacaguucuaucuagccggguuuacugcgucucaaaggaagcccgggacaguuguaggcuugaauugccuguaagggccuugcuuaaaaauuuccccaucauugcucacucuucgacguggcuccgcaagucaaccuagucauuccuuuucucuaauuucuccuccugcccgagcgcucucagagcaagcauuggcaccgguggcuucacuuuagaaccgcugccugagccgggcagugguggcgcaugccuuuagucccagcacuugggaggcagaggcaggcggauuucugaguucgaggccagccugguguacagagugaguuccaggacagccagggcuacacagagaaaccuugucucaaaacaaaacaaaacaaaaaaaaaugcuaaggaaauguguuuauuacagggagguccaguaggucgaccaagaucacacccuggagaacauagaggagcgaguggaucugucuaugauuggagauaguuuguauuucaguccaccacugucuagugcuuccaaagaacauuacaguagccuucuacuccgugcagacauuugcauuuggcguggcugaggcuagucuagugagacagccaaagggcugugaggggccuguaauucagucacuaccccccacuccaauucauuagugugcuuuggaccgacuaggcacacacaucauuuggucaccagcuucuuuuuuuuuuuuuuuuuaaagauuuuauuuauuuauuuauuuuuauuuauuauauguaaguacacuguaacugucuucagacacuccagaagagggcaucagaucucauuacgggugguugugagccaccaugugguugcugggauuugaacuucggaccuucggaagagcagucgggugcucuuacccacugagccaucucaccagcccggucaccagcuucuuagugugacacgagggacacuggucucugucagccuucuguguugauguugaggacuuuuccccagaaucuuaguggugcuucauagcaaaugguuuccuguguuggggauaaugcccuaaucuuuacucuugggucgggacaacguucuagcacuguuugaacgcuauagagcguccuccucuaguuagacugaauugggcuaacccaugcuuuuccacguuagguuagauuggcaaguucuuagcuacaggaagcagauaaguucugaccuucauccuuuauguuuugauauuuguugaagagacaguguacacacuguccaaaaacaaaauaagacugauaacauaguucagugguagaauucuuaccuaaaaugccuugcagcuggaucuagccuuuacaguuaccuaagauaucgcucugcccgggaaauggucauuguguacuggcugguuuugggugucaacuugacacaggcuggaguuaucacagagaaaggagcuucaguugaagaaaugccuccaugagauccagcuguaaggcauuuccucaaugagugaucaaguggggggggccucuuguggggugguaccaucucugggcugguagucuuggguucuauaagagagcaggcugagcaagccaggggaagcaagccaguaaagaacaucccuccauggccucugcaucagcuccugcuuccugaccugcuuaaguuccaguccugacuuccuuggugaugaaccgcaguguggaaguguaagccgaauaaacccuuuccuccccaacuugcuucuuggucaugauguuugugcaggaauagaaacccugacuaagacacacuguaacauacuugccgagcgaguagugucucuggagugauacaugaaaagcagugcucucuggagaaggauggugguugggucagguucaaaaccgaggaagcaguacuuugcuugccucuguuuuucccaccucacagcuucacuguguagcccuggccguccuggaacucagagauccacuugccucugacuccacagugucggaauuaaaugaugauugagccagcacaccggucuucgugaagcugaggcugaccuugaaccccugauccuccugcuccuaccuucaaguucugagauuauggacuccaucuaucccauuugacuuuuuuuuuuuuuuuuuuuuuuuugguuuuucgagacaggguuucucuguguagcccuggguguccuggaacucacucuguagaccaggcuggccucaaacucagaaaaccaccugccucugcccccccacccccccacccccccagugcugggaucaaaggcgugugccaccacgcccggcccauuugacucuuuugaaugauuuuguuguauguaccuguacacagguuccuaaguacacauacauaauaauacagcuuauuuuuuaagaagguacuauagauuaccaaaugaagucacauuagggacugacugcgggacugacugcuaauagacuuggaauuacuuugguuuuuauguuuaugugccuggugcauuuggaggccagaagagggcaucagauuccuuggagguguaagcuggaguuacaaagagcuguaaacugcccgauguaugugcuggaauuuagacuuggauccucugcaaaauuccugugcucuuaacugcugagccccucuaacuucccuuuugagagagggucauaacucaggcugauguuggauugauuauguagccaagcauagcuuuuucuuuuuuuuuuuaaagauuuguuauuuauuauauguaaguacacuguagcugucgucagacaccccagcagaagacaucagaucucauuacagaugguugugagccaucaugugguaguugggaauugaacucaggaccucaggaagagcagucagagcucuuaaccucugagccaucucuccagaccccaaggauagcuuucugaaugccugguccuccuaccucugcuuccauaugcuaggauugcaggaauauaugacccuaccugguagugguaccuaguuguuugguuuuuuaaaaaaauugucucccauuuuguuuguuugagacagugucuauagucuuaacuguucuggaacuggcuacguagaccaaguuggcuuugaacucaaagaucuuccugcuucugucucccaaaucucagugaauuaaagaucuacaccaccacauauggcuuccccuguguuuaaaauacuugggccaggcaugauggcacacgccuuuaaucccagcacucagaaggcagaggcagguggaucuccgaguuugaggccagccuggucuauagagugaguuccaggacagccagagcuauacaguaagacccugacuccaaacaaacaaacaaagaaacaagcaaaaagcccaaacaaaauaauaauagcaugaaauaaguaccuuuuuauagacuuccuugucucagucuguucuuuaccuuucagaggaaaauauauaccauuacuuaauuugggaaggagugggacuggagguauaaacacaagagugguaaccaggguugccgauaagcuguggguggacugcuuaccuaacaugcagagaccuuggcuugguaccccaugcaggacggaaauaaagcagugucucggcauuaaccuugcuuauaaggacuauugcaucuuuuugagguuagagguugaaguucugugauaggcuugccuagccuuugugaggcuuugggcuccaucgcgcacacacacacacacacacacacacacagagagagauagagagagagcgcagaggacuguuugaagcaugggauucccacacagugacuuuagacaccugagaguccaggugacagugugcuucuagugcuggcaagcuugcuuugugucuguagaauugaacgagccuuuagggccuggggagaugaaauggcgccauaguuaagaguguuugcugcucuugaggggacuugaauuucuuagcaugcaugucaaguuccuagggggguguguguccaaccuucucuucugggcagcagcgugcaccugugcacauacgcauauaaaucacaguaaugacucuaagauagacuaauccguuaucacucugccauucuggcuuuccaauuguguucucuuacuggcuuuuuucuuugguauuugaaguuugcaggagccuguuuuguugaguuucucaaugaaauaauucagagugguaaauuuucuuucuagagucucuagcuuuuuuguaauuauugcuauccuuuggcaauauuauccauaaaauuugauguuaaccuaagauaauagagguguauguaaaacaguacuaaauuaagaggucuuauugaguaggcauagcgguccauucugugacccaucacuuccaaggcagaagcaggaagauugcuguaaguucagggcuaccuggacuacaggugagcugcugucucaaaaagccagaaaagauggaaggauguaaaaaugggaaggaaagccuguguucuccauuuguucauuguauugauuuauagguaucauuagcuucuguaguaagaaaacacacauuguacaaaaccacaauacaguaagauaguguuuuagauguuuuggccauauuugcaugguguucaaaugcugugccucucauuaagccacuuaaauuuaaggaauauuuuuuuuucuuuuugguuuuucgagacaggguuucucuggaacucacuuuguagaccaggcuggccuugaacucagaaauccgccugccucugccuccucagugcugggauuaaaggugugcaccaccacgcccggcuguauucauguuuuuuugcaagcuggcgugauagaagguuuuugugguaggcuuagguacaccaaggugcucuuucuaauuuucaaaauaacccauguaggacuuguuuccuuuauguucuagugagcuguuuuccccgucgcagaaguaccagcucuugguguaucaugcagacucucuguuucacgauaaggaguaccgcaaugcugugaguaaguacgccauggcuuuacagcagaagaaagccuuaaguaagacuuccaaagugcggccuuccacugggaauucugcaucuacuccacagagucaggugaguaagagcagacucagucacucagucagucacucagucagucauuuauuguguuuuuggggggcagaguuucucuauguagcuuuggcugucuuggaaguagaccaggcuagccucaaauucagagagccacgugaaaggguggccaccaccgucugacgugccugugacugucuauguguauauauuuauugauuuauuuauuuggguuuuuuuuuuauuuauuuacuuguuaaaggaaauguacguuauuuguuuuauauauuuaaguacacugucacuaucuucggacacaccagaagagggcaucaaaucccauuccagaugguugugagccaccaugugguugcugggaauugaacucagaaccucuggaagagcagccagugcucucaacugcugagccaucuccagcgcguauacguauauguauauguauguaugcacauacuaagagacaagauugaaguacuuguuucagcacugagcugguugguuauagaaugaaacaguucuauauucuuuguuauuaucacaugauauuccaugguucccgagugcugcuuuucuuucaucuuuguauuaaugaauacugggguucuccugucccucacagcugaugcugcuggggugcuuuguguccugguuaggugagcuuggucucuccaacucauagagaucccccugccuuuuccuccugagugcuacaauuaaacaugugugccaccacugccggguuuuauucucauuucuuuuuuuuucuuucuuuuuuuuuuuuguuuuuuugagacagguugucucuguguagcccuggcuguccuggaacucacucuguagaccaggcuggccuugaacucagagaucuaccugccucugccucccaagugcugggauuaaagucaugcaccaccacgccuggauagcccuggcuguccuggagcucacuuuguagaccaggcuggccucgaacucagaaauccgccugccucagccucccgagugcugggauuaaaggcgugcaccaccacgccuggcuuuauucucauuucuugauuguauaucuaggagcagaauugcuauaagauuauaagacuuauucuuuuuauuuugaaaaacugucauguuguugauaucauauuucaaaagguguuuuguuaacucguagugucuuccaucugaaauugaagugaaauacaaaauggcugaguguuacacaaugcugaagcuagacaaggaugccauugcuguacucgaugggaucccuucaagacaaagaacucccaaaguaagcucgcuguuccucaucccaguuucuguugguccugccccaucaucucuguccuccacauuucaggaagucugaacucuuuacuuuucccaguagaguuaggguucagacagauggcaguuuacuucauuaagggacccuaagauaagaauucagccagguguagcgacacucaccugugaucccagcacuugggaagcagaagcaggaaaaccaggaggucagggccaucucaaaacagacaaaugacagaaguguucuguuagguuuugugguacuagagacccacccuagggucucaggcgugcucagcaaguacucuggcauuaagcagcaaccucgacucuuguccuuuuauuuaaaaauuucaccuggagacaugggcucaccaacuuacucaggcuguccuuaaauuguguguuuucuuaggguuuauugcugugaagagacaccgugggaaaacauucaguugggguuggcuuacaguuucaaaauuuugcuccauuuuaucauaguaggaaacauggcagugucuggggaaacauggugccacagaaggagcugagaguucugcacaggcagcaggaggagacugugugccacacugaagccugagcauagaccucaaagcccaaccccacugugacacacuuccuccaacaaaaccacacccaccccagcaaggucacaccuuuuuuaaaauuuguuugguuugguuuuacgagacaggguuucucuguguagcccuggcuguccuggaacucacucuguacaccaggcuggcauugaacucagaaacccgccugccucugccucccaagugcugggauuaaagguguaagccaccaccaccuucuaauagugccacucccuacgggucaagcauucaaacacaagagacuauggggggggggcauuccuauucagaacaccacccugaauaacccagaaugccuugggcuuugacucuuccuaccccagccuaucuaguaacugggauugcaccaccaggaccagcuguuucuuacuuagccuuagaguccagaggcaguggauuccuuggaguuaaaaaggucauucaagucaccugauuggauguugugaacugaaccuaaguccucuggaagagcagcuagugcucuuaaccacuaagcuaucucuuuagccccuuaaagauuuauuuauuuauuuauuuauuuuuggauucaggcuuaguguauucuuuuuuuuuuaaccuacuuuuuuuuuuaauuagguauuuuccucgagagauuuauguuuuaaauuaaaaaaaauuuaccuguuuggguauuuugccugccuauaugcauguaugcauauauaugcaccauguuugugccuggugcccacaaaaauaacaagagggcauuggauacuuagaaacugggcccuuuguaagagcagcaagagcucucagccacugagccaucucuaacuucccaggugugggguuucugaggcuagguucucaauacauagcccgaguuagccuugaacuuguugugacauccugagccugccuccucauuguugggauuauagacauguuccaccauaccugggauacaauugcguuuauuuaaagaaagguuucuugccagguggugguucacgccuuuaaucccagcacccaggagacggaagcaggcuucuugaucugccaacaauaaaaaguuauuuaaauuuuacugaaaugcggaugucuuaucucacuggauuuaaauaguguaguuucuauuugagucauuguuacauuuggaggucauuuugaguuugauuuuugucucaguuuggugagucgacagcucuggugagucagaguugaaguauuagaugggccaaauuccagcuacugguuugucggaagccagguauuuuaauuucaacugauucuuaaauggcuaugccccgcaguguaaguugggcguuguggcucacacacacugucguauggcucauucccagcacuuaggaagcugagucugaggauugcuguaaguuugaggcuacccuugaucuacauaguaaguuccaggccaggccgagcuaagaaccagccagauaauguaaugcuacaugccuguauccugcacuugggauguagaggugauucacgaaggucagcaauucaaggucgucauccucagguaugcagugcguuugaggccagcuugagcugcacgagagcuugucucauaaaaccaaaaacaaaagaggagcuugagagauggcucaggaguuaaaaguuuuuucuucuucuggggccagaguuugaaacccaacacccacaucagcagcucgcacccaccuguaacuccagcuccagggacuccuccgccucugcuagccuccacaugcgcgcgcagacacacacauuuaugcacauaaacuaaacuaaaagauuuucuucacuuuguuaugcaauaguauugaccucugcuugggcuggagagauggcucagcaguuaggaacauacacaagucuuucagaagaucugaguucaguuuccagcauuuaggucagguaguaagcgguaaaucuuggcuagagguaguggugcacaccuuuaauccugacacuuaaaggcagggcagguggaucucgaggccagccugguguacagagcaaguuccacaacagcugaggcuacacagagaagacccugucuggaaaaaaaaaaaaaccuuuggugacacaugccuuuaaucccagcucuuaggaggcagaagcaguuggaucuuuaugaguuccaggcuagccuggucuacacacuaacacccccaccccgucucaaaaacaaaucaaagaaauccuuaaaauauaucugcuugaaucaagguaucuaaaauuauggaacauuucucaaugucccagaggcagcaucuuugggucagauauuaggagguguuuugcgaggaucacauggcuaagaaaaacaaggauaauaguacuuuguuuuaaggagccggucuuuauuugcacagggcuguggguugguuuuucugcuagaaaguagaauaguagucgggcaucaaaugagcgcgcgcucacggcgcaguguuugcugugcggauacucuugcuuuaccguucucuguuucguguguguagauaaacaugaugcuggcaaaccuguacaagaaggcuggucaggagcgcccaucagucacaagcuauaaggagguccugcggcagugcccuuuggcccuugacgccauucuagguacagaaaguuuucucccuggugccugggguguuugcagucuuagaugaugguucucagucacaacuaugguuagauagagcaggguuuuuuuuucagauuuuaauuuuauguuaaugugaaugaggguuuugucuguaugucuguauguauguagugucuaaugccauaaugguuggaggggggcauuggagccccaagagcuggaguuaggggauggugguagacaugaguacugggaauuaaacuuggauccucugcaagaccagcaagugcucuucaccacugagccgacuucauggcgcauagaguaaguuuacaccauucugagcacugucgguuaugaacuagaggagucgcugucuuggacaggguacaguugaguggcugcaaugcuugagcaugccugaggcgcugaccuuugaguuguguguaucuugcuuagaggagggagggcagcuguguagcugcugggguugcaccgugggaagagggugcugugccucacguuucucuugcucuuggggccagguuuguuaucccugucugugaaaggcgcagagguggcaucaaugacgaugaaugugauccagacugugcccaacuuggacuggcuguccguguggauuaaagcguaugcuuuugugcacaccggugacaacucgagagcaaucaacaccaucuggugagagccaaggugucaacucagugguuauuuuggugggaggcacagucugagauaagucacaucuuacuacauacccagguugcccuugaaauugccucagucuuccagccuaggugucccuagugcuaggacuauaggcacgagccaccaagccuggcugacuccagggaucuuagcccuuuccucaucuagagaugugauauagcuggugacacagaagagcuaggugugauauagcuggugacacaaaagcuaggugcugcuuacugcuugacauugcagcauuugucuuuggguuagguuuuuuuucuaaugcacuaagugauugcauauguaauaaacuguuggaaccugugaaaaugaacagccggacugaguucuguacuguucauaugaagauggccuuccuuaaagagcagacugcugggggcuggagagauggcucagccgguaagagcacugacugcucuuccaaagguccugaguucaauucccagcaaccacaugauggcucacaaccaucuguaaugagauuugacacccuuuucuggaguguuugaagacagcuacaguguacuuacauguaauaaauaagucuuuaaaaaaaaaaagagcaaacugcugagggugucauguucaugccuuuucgacuugguagacauguuuacuguauaccugacauaggcuagaucucuuugcaguuagggauuucuuuuuauuuauuuaaacaaaguucuaggaccaaaggcugcaugcaugugugcaucuaucuaucuaucaucuaacuaucauuuaucuaucaacuaacuacuacccaccuaccuaucugucaucugucauguaccuccuugccuaccuauuugucacaaguagcuaucacuagugaaugcuguauuaaaagucauuuuuguuuaaaaaauuauaaccgugcuguugugguagugagcacuuuuaaccucagugcucaagagacugaggcaggccugccagggcucuuuagugaaacccugucuccaaaaaagaaaauuauaaccacagagguuuuuauagauauuaagugauauauuugagauaugugcauauaaaguaucauuauaugacuuuuaaguauuuuauuuccuuucauguauauagaugguugucugucugcauguaguuugcauggcaugugcaugcauagugaacagaggccaggagagggcgucagcuucucugagcugaagucacggucacccguaagcugcucugcuagugcuaggaaauggaucuggccccuuugcagggacauacgaugcucucacugcugagccuucuuccagaccccugugugacuuuaaagcugagguuaagguccauuguaccucaguccuuuaaaaaguuuuaggccaggcaugccuuuaaucccagcacucgggaggcagaggcaggcggauuucugaguucgaggccagccuggucuacagagugaguuccaggacagccagggcugcacagagaaacccugucucaggggaaaaaaaaguuuuaaaaauuagauuuguguuuauuuguuguaugugggcacacgugcuuguguggaggucagaggacaacuuggaggugucgguucucuuccaccacagagguuccagggucaaacucagaucaucaggccugguggcaagugcugcucuuaaccugcugaggcagcucacugccuuacugacguuuccuuccuuuaauuauuacuauuauaguuaggaguuguagugccuguguguacugucaggacuuggaggaggagguaggaggaucgugaguucaaggcuaaccuggggaauuuagugcgacccuacuucaaaaaucacccccccccccaagccuuuuuaucaaaaauuucacccauauagaaaaguaugucaucuguaagcccacccccagauggaaugauuaaaaacagauuguaacagagucuaaggguuaguauuuaucuuuuaaguucacuagagaaaaaaucauuacugcgagacaacguggaccugcuggggagccuggccgaccuguacuucagagcaggggacagcaagaacucuguccucaaguuugagcaggcccagaugcuggaucccuacuugauaagaggugaguccgacugaguguguuacuguuuuuaggcuuuguguguguguguguguguguguguguguguguguguguguguuuguacgcauacaggugaggacaggugcucuuggaagucagaggcguuauguuuguuucccaggggucagaauuaugacccuucugauguggggaucuacaaagaacagugcaugcucuuggcugcugagccccccccccccccccccccgcgcuuuuuuuuuuugaagacauaguccauguagcgcagguuagccuugaacuuggcuuugauuucuugauucuguuuucaccucccaagugccuggcucacagguauguacuaccaugcucaucucugcuccugguuuccaagccgcuuuuguaaggcuuccuguagugguucuuucuccuauccuggcauggcuuuuuaacacuuagguaauucuguucugaguggcuguuuucucuucacagaccauugcuuagccuucuuguaagggccuuuguggcaucuccaccucccugcgaguuaauacaugugugauguggcugacuuauggcaucugagaacccuaauguccuucuaggagcuuugguuuuacuguguccuuguaugauguugaggaagcaggggaguggcuauagagggagggaaggugccuaccgugucaucagggcggagugaaggcacaaggcacaggggcuugagaagccgguggggccagugagugaaauuuguaaagacucaacagaggucaccagaaaaaugcgccucgggauaauaaacaggcuuuagauucuaaagaguaaguuaccaauaauucuaacaggcugaagcaggcuugugagagcgagguuagcuacacagggaaacccugacucaaacaaacaagaagggugacugagugugggaauagaucuagaguguuuguuuguacaaguucuccucuggcguguauuccucuuuccaagcuguccaaccccacuugugaucucagcacuugggagguggaaaaaggagucaaaggcucagcucaaccuaccacugaagacccagacuaaagaaacagaccagggcguggugucccagcacucagggcucugaggucaggcuggucuacagagugaguuccaggauagccacggcuacacagagaaccucugucuggaaacaacaacaacaacaaacaaaagaagaggaagaagaaagacagagagagaggaaaacaauaauuuaguguuuuaggaauacaagcuugguggcauugguagcuugguguuggauguucauacccgggcccaggcgagcaggaguguggcuaugaacuugcucugagaguaauggggauuugaagggauggagaggaaggagagugguaggaagaggugcaugagagccaguguggggccucauaaaccaugagggaggaguggaaggggcuuggggagaguaaugcgaggacuggcauuuuagaauggagcuacagcauuugggggcauaggccaucuauuuuugagacugggcauucuuagcauaguaagcuuguacugagggcugggggcucauuuaugugcuggcuuuucugggcugcuguugacuacacugcaggcuuagggacagaugguucuugacaugacugguguucugaguugugacacagcaccugcugcuccuuugccugccucccauucuuuuaugugugugcgguguacucuugcaaguuuauguucagcaugugugugcagaagcccucagaggccagaagagggccuuucuuguuuuggaugguuuugccguucauucagucacuuaagagacaaggugucgugcagcccagccugccucaggcucccuguguagcugagcuugacccugaacuucuggucuuccugcuuccaacucccaaaugcuaggacuguuagcccaugccaccauccaguuuauguggugcuagggguugagcccugagcuguugcauacuggguaagcacccuaccaauugagcugcaucuccacacauuuauuuaauuuugaaaauuaaguuauaugugugugcauaguaggucauaggucagauuuuggaagugguuugucuguuccauguggguccuggugacuaaacauugcuuccuccagcuuggggacagucuucuuuacccacagccauuucccagguccuucucugacuuuuucuuuaguuuuuugugugagugguaugcuuuuauguaaguaugugcaccaugugaguucaugcccucagaggucggaagaggaggucacuuggccuggaacuagagauacacgugguugugagccaccacugcgugggugcugggaacugaacccaggccucugccagaagaagaauucuuaccucugaaccauuuucucuggcucuucuuugccuuuucugaggccuguuuccugcuuugcuagaaaagccucuuaccguguccuuucuuucagggauggauguuuacggcuaccuccuggcacgagaagggcggcuggaggauguggagaaccuuggcugccgccucuucaacauuucugaucagcaugcagagcccuggguggucuccggguaugggguucacucuccuuucuccccauuuuuaauagggguuuugaaaagagauucuuuaaagagaauaucaguuaauuuuugguuagcuuauguuuguuuuguuuugcuucuuuacugaucucuggcuuguagcuguaagcauaauuuguaauugugaucauguauacagacuuuuuuguuguuguuuuguuuuuuuuucuagacaggguuucucuguguagcccuggcuguccuggaacucacucuguagaccaggcuggccuugaacucagagauccaccugccucugccucccaagugcugggauuaaaggugugcgcaucacugcccggcuguauaaaaacucuuaauugauagccacagcuggagccuggguccuuugaagagagacugcuguggguuuucacaagaugaucaguggauuccugauaaggagacuuggugaacacaagucucuuuccagagguuggggguuagguaacuguaggucuuagagguggcaucaaaggaggccuuggcaaaguugcccaggguggcagugcagccucuggcugaaguguagcagucaucuauaccggccaacaucaguaacuucuugggcacaggagcagagacaaugccagugccucugggggcagggaugaggcgcaccagcacagagccacaguaccugacacacauauuuggaagucauagaacaauuagcaagagcaguguaggucuuaggaaguacuaggcuugccugcaagcaccuuggacagcuuuuuuguuuguuuuuuaaagauuuauuauacauaaguacacuguagcugucuucagacacuccagaagagggagucagaucucguuccaaugguuaugaugguuaugugguugcugggaauugaacucaggaccuucgaagagcagucggugcucuuaccuguugcgccaucucaccagcccuaguuuguuuuuaaagacaguuugucggcuucccaagugcuaggauucagaaauucucuauagucugguguuaagccuucuucagaggcuucucucagagaacuugugguuuuuuuuuccccagaugccacagcuucuauagcaagcgcuacucucgggcccuguacuuaggugccaaggccauccagcugaacagcaacagcguccaggcucuguuacucaagggggcggcgcuuaggaacauggggaggguccaggaagccaucauacacuuucgggaggccaucaggcuugcgccuugucgcuuggacuguuacgaagguaagccggggaccugccgaugcggugucggccugacagcugcgcccagauggcagugguguuggucagaguuugcuggugcugugcuguguuagaggcagggcagcuggggaaagcagcagcugugacacggaacucugaguuucuccagccugggcagcugagcugcuuuuuaaaacaguuuuuauuguuaauauuucuuuugaggcuggaugucacugcagcccagcagagcugugccagguuuagcgacauuuggugacugagucacugacacuaaaauagcucuuccaagauccugucccucuagaccucgucguaggaauuaacaauaagcucagcagucugccucguaacaggaagaugaggucaaaguugaagagaaaaauuugaagucaagaaaaagaaaaaucugcuuuuauagcuagagggccuugcugggucauucuucacagcuccuuagaacacuagagugaaggaaggcgcugcgggagugggcgcagccuggggcagagcucaggaggggcuggugagccauccugccuggcaucucugcucucuguguuucaggucucauagaguguuacuuagcuucuaacagcauccgagaagcaauggugauggccaacaauguuuacaaaacucugggugcaaacgcucagacgcuuacgcuguuagccaccgugugucuggaagauccagugacccaggagaaagccaaaacucuguuagauaaagcccuggcgcagaggccggacuacgucaaggccguggugaagaaagcagagcugcucagugaguacuacacuugcauguucuguuguccuucccccgcagcauccuccucucccugaggcuuacagaugaccgagcagcucugagccugcuaaagugcuuuacacagccagauguggcuuagaccugcuuggguugguuuaaaccagcuaacaccacuugguaguuguuguguucaucucacuuuauuuuugaacuaguuuagucugguccagaagccuucggucaguugacuaguucugagccaugggaauucucugaguuuuguucuucuugcuucuggcacauuccuaaguuuauaugaugcuaugaagaggguauucuggcucgggauucuacugcagggccacuggccuucuugcuagcauccggaguccagaggcagcaugggcuaucacaggaggugggggcguuuguucugacccacgguaaucucugugcuuucacugguuugggaauaaaauugaauucuuuuuuuuucuuuucuauuuuuguuacguuuaagaguauauauaugcugggcaaugguggugcacgcauucaaucccagccuuugggaggcagguagaucugugaauuugaggccaaccuugucuacagagugaguucccggucagccugucugcaaaagaaaaaauuuuuuugaaguuucagggaacagguuuagugguuuggguaacgaugccacuaagacugacgaggucaguccugagaccuacacgguaagacaggcagcucccacagauugcccucugaccaucaccacgugcuguguguggcaugcuugccccuccauauaaguuaauguaacacaugguuuuuaaagaugcaguacucaugccaauuucccagugaaauagagaccgcaugcacaggccccuuguaagcccuguagcgccuuugaggguaucucugagaaaguugucaugucacagugggugugacugcacuacugagcgugaagauugucuuucuccaggcagggaacagaaauaugaagauggaauugcucugcugagaaaugcgcuggccaaccagagugacuguguccugcaucggauccugggggacuuccuaguagcugugaacgaguaccaggaagcgauggaccaguacaguauagcacugagguaggugcucggccuccacgggagggaaagagaggaggcagggccuguguggcaggucugcaaacacgcgugcccacaguugaaggcaggaugagaauaguaacgagagaagguguuugugaauucaugacuccugacauauuuuccuaaagcacauuagcggaguuauccuucuuccccagcccacauccgagcagcacccaggcugacuguacagcucuccugugcuugcccacaccccauggcuucagaggguuacgucuaguggagauuuuacagucugcuuuuuaaaaucuauugcuaaguauguuccuguguuucugucuacuauaguaauuaaaaacuuaaauucugaaguuugaauacagcuuuuaccugucaucuuggucaaaauacuaaccaguuuccuugucuauaccuucuucauuggacauuaauuagggguaucaaaauucagaaugugccgggcagugguggugcacgccuuuaaucccagcacuugagaggcagaggcagaggcaggcagguuucugaguucgaggccagccuggucuacagagugaguuccaggacagccagggcuacacagagauuucugucucgaaaaaccaaaaaccaaaaagauugagaagguaauagugcuugccacauaacccuggagacccaaguggauccccagagccccugugaagguugcaggagagaacugacuccacgguuucccucugaccucgcaugcaugccaugacuuacacauuacacagacaaacguacgugugugcgugcacaugcgcuaauagcaauacaguuaaguuuuaauguuaauuuuuaaagaauuguuuauuuuuucauauaugaauauacuguagcuaucuucagacaccccagaagagggcgucagaucccauuacagaugguugugagccaccaugugguugcugggaauugaacucaggaccucugggagagcagucagcacucuuaacugcugagccaugucuccagcccaauaaauuuaauuuuuaagauaaauaaaugguuggacgaggauccagcguauucaguaggaagcuuuuggugcuggaccugguaugcaguagguaauaaguagagggauugguguggcuuaguuagaagugauucucugagacuugcgagugugucuuaggcaaggaguuguccucaucaggugucgcgugcguccguucucuuguccaggagauagcugaggcagugcuuuugagcacucaguacucagaaccuccaagcagucugcagggccgggcuacaggguggaagccucuguguaggcagaguuuuguggaagguuuggguaaagaagagaugucacagacuccacugugucugugcauaggacaggaugcagcauggccuggcacgagaaaccaggcagcaaguuuccugagggacgcuugcugacccgacugccugggcagagggagaggcugugauccugaaguugcuucaguggcgcggagcuccugcccggcgugggcgaggccugagcauuccuuuccaggaccuuguuuucccuuuuaaagauuucuuaggagccaaaucagugaggauucugggacgcugggcuuugugggguugcuacuaaugaggaugcuuugguccuggcucuguccucaggacuuagaaucuguccuguguaccuguguacaggacugauggcuguaguuacccacaguucaugguagaaugugaaacagugucacacccggaagaacagcuugccugaggcaggcugcauguauucaucauguaccugaggcuggccuugguguucugauccugguucccuccugcaugugcugggcuguguucugugccuggcugugagcaccaggccuccuguuagucccucuacucuuuccugacuggccacugccuccagcagagugcuagugaaguuagaaucuuuaauugccauuuuuuaaaugaauuguuuauuaaaauacauuuuauguagaugaguguuuugccugcauguaugucugugaaucaugugugugccuggugcccagagaggccagaggagggcaucagauacuugggaacuggagucacaggcagucaugagucaccauauggguacugggaacugaacccagcaacaaaugcucuuaaucacugagccaccucuccggccccuucauuuaaaaauuguaaaacguagaacaaugucccguuucgucucugauggacucccuggauccagccauggacgccacaguuugcagcaucucugaccuagucaucucacugcugaaccagcgcagugacagucccaagaaacagggcaggcucagccucuccucuguuuuguuguuccuuaguuuggaccccaaugaccagaagucucucgaggggaugcagaagauggagaaggaggagagucccacggaugccacucaggaggaagauguggacgacauggaggggaguggggaagaaggggaccuggagggcagcgacagugaggcagcccagugggcagaccaggagcagugguucggcaugcagugaaggcacaguggcagcgccugguguuccgagagugacagaugcugucggaagugugcucacagcagggcucccugccuguuuccaaguaguagucgggacuggugucuaccugucugcuuugcugaggacugagcgaguuccaagcugcagacucaccauuauggaugguucugacguacccaguggacgaugccuuuuucucuuuaugacggguacacagaacugagccauccucuuaagggcacaugcaccugggugguccugccagagggaaucugguuccugggagucaggguccucccugccacacucccuauagucaugaugguccggaugcggguaccgugcuucacggacugcagagcagcacuuggccccagugggcagaucugaggagcagaugauggccacacacaggacaggcucaccuaauaaacuguucagugugguggcacaugacacccuuugagacucuuccuuuuaucgccuugucagaggcagccaugugggccuagacaguuugauauaaauauacugucuucucccaugugcugggcggccgagccccgagccugucacaugaaccagccuggcucuucacugagaugccuucagcaucugccugcauuauuccucagcaccugggagcaggucgacucgcccuccguccugcaucugcaucucgcgugugaugccuuucaagaugcagaucaaggugcuaggaaugugagagguugauucauugugaauaaucagaacacugucagcgcaguaagaagugggacaggguggucugucugguggagacacguucuggaagccugcacuugagaggcagaggcaugacaguugagaugugcugggcugcauagcaagacuuguccuaagauacaugauaaauggacgaggucuccgcaaag

SEQ ID NO: 2663 - RNA, 3892 nt, Mus musculus
guggggacgcauguacuacaacaacggcgacaucuacgagggccaguggcagaacgacaagccugaaggggagggcauguugcggcugagugagugccccgcccccaugaaaccacgccccaacgcuuccuagccccgccccgucccggaaagaucuccucccagacucgaugccccaccagcuauaauacuugucccauagacaccagucuuauuggcccugaaaaagugagauucugacuuucaacgagauccaaauaagcugaagcccuggaucagcuggggugggcagagguguggucagucagucugucugucugucuuguagucccuauacucagcuaggagccugccuucggugagccuccccuaugcauaagcuggguuuagugagcucuugguaagcagaacaaauguuccgaggaacuucucauggccuggauucugggcaagagugcauguauucagauccuggugugagccggcaccagcucugggacgccagacaauuugcuucaguuuccuugugguuaacaaauagcuauuuuauuauauuauauuuuauuaugauuuauuuuuuuaauggaggaccugugaguuggcucagcggguaacggcgcuugcacacaggccugaccaccagaguuugagccugggucccacaagguaggaggagagaacugguucuccaguguuggccucucacccccauacacgcguguuauacaaggcaccgugauaugcaaaagccugcauuuaacacaaacagacuaaaaaacaaauuaaaaugagaggugagcaggaucccuaacaccugggaucagcagcacugcuuugacuuagaacccagccugggcuagccaaggggggaaaugcugucucagaaaauaaaacuuaaguaguuuuaaucacaguacuugggaagcagaggcagguggagcucugaauucuugguuuacaaaaggaguuucaggcaaaagccuggggguguggagcaguugccuagcacauuccaaguuuuuugcaaaguaacaagaaaagaacaaaaacuuacaccacaaaccggaaguagagagcagcaugcgccagguucuggcuccaaccucaaaaaaaaaaaaaaaaaaaaucaaaucucuuucucuuucuccuucuccuacccucuccucgccacggguuuucucuguguagcccuggaacucucuugguagauaaggaugggcucgaacucagagauccgcuuaccucugccuucuuaagugcuaggaucaaagcaguguaccaccguaaccggcaaaaaucaaaucucuggaagugguugaaguuaagugacguuggugaugcuuagggacacugcaccuccugccaugugcuuauuuaaugggucucagagagcuagcacacacuggucagcagcugggaccagcgagacccagccugacguccuaguugccucacugugccuagcacuccugcuuuccugucuagagaacgggaaccgguaugagggcaucugggagagaggcaugaagaacgggcauggccguuucuuccaccuggaccauggucagcuguuugaaggcuacuggguggacaacguggccaaguguggcaccaugaucgacuuuggccgugaugaggccccugaacccacccaguuccccauaccuaagguggguaguccuccuggggcccugaaaccagagaaacagaaaccggcauccaagcugggcgugguggcacacgcguuuaaaucccaacacucgggaggcagaggcaggcggauuucuguguuugaggccagccuggucuacagagugaguuccaggauagccagggcuacacagagaaacccugucuccaaaaaccaaacaaacaaacaaaaaggaaaaaaaagaaaagaaacgugcaacgaaagaacuagagaugaaguuuuguuuucuagcaaccaaccagccccccaacaccucccccccacuuucauccagguggagauucuagacccagauggugugcugaaggaagcguuggauaagcugaugaagcccgaggaagaggagggcugaggucagccgaagccucuccgugccccugaacaaugcugaccuucugguaucacuaacgggcgccgggcaugaccagagagggcaaaucucuugccuccuuauaguccagcuuuucuuucuugguuacuccucucugaaacacgaguucuuagaagacccagugcaauccaguccugccuaguuugcaucgguugcguucuuagccuccuugggugggcacuuagccgcagucagguuugaguuugccccuucuagaggaugucggucggaggcagcgaugggaccuugucccugagguggcuguuaaguuucauggcgaggauguucguggucguguuucuaauccuaacuccaacauccuccccaccugugcagagaucgaaucaagguucaggagaaacucuggcccuugucaccaaacugcucaaaccggugcagcuccugcaggaggagcacgcagcgacucugggcacgcccuuggcucccucggaggguaccggcuccuccagagacuagguuuauuuuuugccaguggagguggggguauugcuucucccuggcuggucuuggagacccacaugcuuaaagccuuugccccuauggcuuuauaugagagugcaugaaaauaacgugguggccauaauccaagggccaagagcuugagcagggguugccagggucugagggagaggaaagacagcuucaucagccacguugguugauuucuccccucguguguguguguggggggggggggcuugagggugcaaggcagaggggcaagguaguggcuucaguccuacuaccccugagcuaacccagagaggagagggagccagcacucugccacaguggccaccaagauuugcgauuuaaacggguccuuagccuaacccaagaauccagacgaagcuuuaaaaacucugagcauccagggcagacauguggcuugugccuuaaauacaggcacacaggaagcagaggcagguggaucucugaguuugaggccagccugguuuacacaaugaguaggggguguguagugaaaucuugucuuaaaaaaaaaaaaaagaaaaagaaaaagaaagaaagaaagaaagaaagaaagaaagaaagaagaaagaaagaaagaaagaaagaaagaaaggaaggaaggaaggaaggaaggaaaauaguugucagguggugguguacaccuuuaaucccagcaucucugaguuuugcuuuuuuuuguuuguuuguuuuguuuuuuuuuuuuuuuuuuuuuuuuuuuuuuacccuaccauguaaacaggcuacaaaggaaugacucaauuccaagucuuuccacaaaccucucagcaaacacuccaacuuagugaggcgcagcacuggcucacaucuagcauuccagcauucuggagauggagagaagagaguccaaagguuugaccccagucuggccucaggcccgaguacaaaggacagccuuaccaaaccaauaaagcucacacgaugaaguuuucuuugcuccuaaacucuaaaggguggugacuggcuucagggggugugguaccaucugugccugcugccaagacgcaggaucaacauaacuaaaggugcaaagugcugacucagugccagguccuguggacugcuuccguugccucuccugugacucuguaaucccgugugguagccuacuguccucucugcuguuuuagaggaaacugguucaaaaggcuccaagcuaauccugaaccuaaccuauauauucuuuuaaaucauuuuguguguguguguguguguguguguguguguguguguuggauguuuugucugcaugcaug

SEQ ID NO: 2664 - RNA, 614 nt, Mus musculus
gcccgccccccaggccuccgcaguacaagcugucauggcggccaggcuguuaagcuuguauggucgaugccugucagcagcgggggugaugagagggcuccaggcugcccucguucgcugggaguccuccagggcuguaaucgcccuauccgguguggagaaaaagcggcaacgagaaccgaccaugcaguggcaggaggacccagaacccgaggacgaaaacgucuacgcaaagaacccugacuuucaugguuaugauagugacccugugguggacaucuggaauaugcgagcugucuucuucuuugguuuuuccaucguccuggucuuugggaccaccuucguggcuuaugugccugauuauaggaugcaagagugggcccgccgggaagcugagagagacuugugaaauaccgagaagucaauggccuucccaucauggaauccaacuacuucuaucccagcaagauccaguuaccagaagaugacuaauggcuuaccgagcagggccuaagaagcauuacucauccgcugcuuguuauuuaccugguuccucagaacaccuuauuaaaggaauugaaaguaaaaaaaaaaaaaguucuaaauuagcuaga

SEQ ID NO: 2665 - RNA, 6810 nt, Mus musculus
cucagaggucgggccgggccagcugaggagauaggcgcgcgcgcgcgcacucacacccacccaggguggcuuuacucccucaucagcaagauguucagggggccuggggcacucuccauuguccaggaauuccuagagagcagaggaaagcaagaaauugcuucuguggguucuugccucaaaccccccucagggagcugucagguggucacugcagagacuaaagcucagauccaggggggcagaggagaacagacugcagccuuuaaggacaaaguacaaauuugggugggggaggcuaaggccaccacuccccuauucagaggccccauaaaucaauuauugagcuauccaaaugcagauggaacggauaagaggggggagauaaagacucuagcagaggggugaagccaggcuaucuuaucuaccugguuaggcagccugaccgcuccaagucucagcuacuuaacagcuccagggaacaagcagaggaugggcuuagugauuucuggaagccaggcggaaaaccagcgaacguugguacaaagggauauaccuaggguccuaaccugucacuaggacuagcccggacacagcaagacccuccuccaucacgcgacaauuuaauagcucugaagguuuuuguucaacuuucccuccugguucccauuggcacggaacaauccgagaaaacacugggggccguggagagcggggauggcggguccuccgacccaccucgguugcagagagucuaaaaaggucauauuccaaacuugggcucggggccagguggaggagccggaaggggcggggacacuggaaucucguguaguaaaucgaguacagccaccucccaguucaggcaagccuucugcuggcguggcccucucucugcaggccagagcggcuccgccccacgcuccgugggugaccaggaggcggggcaccccucggggccaggaacaacagcaggacaaacugccccacccuacagcccaggaggugauaaggggccaaagaaaggagagagagagagagagguggaaaagaccugaaguagagagcaagccacaaguuggucccggucacuuccaucuuccccuuucaagcaccacgucacagcuuagcgccuaauugcucccuaaagccuguagcccuccaggguacagcugacacagcgcgacuuaaaucaauuagugggaggcuggaggagauaaagaccccagccagauccaaggacucuaaccagagccuuuaggguugaucaguuguguuccaaggcuuaccagguaucuaaaguaugaacgagaccaaccuagcaaagcgcucuucuccccgccccccuucucaauaggggugaggaguucagccuucccagcagaaagccagcucaucgacggacuugaugccuggcccucugcaccagcgggagccacgggaccauuguggagccuugcuauaccagacagcucucucuggcagugauaaaggcagacagcuggcacgggagggagccuaaaauaacccagacagcugggcaagggggugucacgggcccagguucugggcugaaaaucaagacaccuggaacccuguccaggcucugcuccgugguggccucauaaccuugggugagacauuucuucucuuggggcuauugguggguggcccuuaaaucccgacccaaccacaggacagccuacggagccccgggaacagccuggacucaaacacuagaagaaaaacagggcuggcugccuucccaagcaaagccaguuuucuuucuccuuugccuggaggcuccagcacgugcuucaggaagugggcuggcggggaggagcccuggagacagcccagcccccaccggcgcaggcagcaaccacucccagcaacaauccuuaucacaauggaggccaacugguugugaggucagagcaggagucuggcccucuuaaucucacuuaauccucccaccaaccuuuuccagcagguauuguggucuuuuuaacccggggagggggaagagaggcaaugguccaaggucacuagcuagguccacaucuaaccuacagcugccagacuagaagcacccugauuaggcaccaaucugccuccagcaacaacucagggaagccuuccaggcuccccgacucacacgucagcacucacuguaggggugaggagaaaagagaagacuagaggcuggaagcugaggcccaaauaggggaagccagcaggagccgcggcaccugaggccaaauggcuuaucaaaguaacaaaacgagaaacacacuagggggccaggggucagggaucaagggccacaccaguuucagcagcaaagcuuccugccuaggaggagggcaagccaacugcuagccaccaagcugggugacaucccaggugccaccuacuagagagagucuagaaacuuggugcuaccuggaaccuuguaagaagagcaaguucuuagauguaacugccuaagagggaaacucgagaaaugggcacagucggguuuaauggguccaaccacugacuucugaugccggugcagcuggggagacccugcucagagacuaagcacagaccucauugacucuguaagaucacuacagacaggugaagggccagccuccguuugugucacguucuagaagccaggcuaccgacaccuggccuuguugagagcucggauccaggaaaaggagaagccaaggaaaucuuuucucucgggaagcuggcuaccacuucacaucuuuugcuucuuugucuauccagcaaggcagacaucagaagggggcucagcuggucccccuaaugggguucaggaacaaugucugaagcaccacugggaaaccuggcagcagucaccgucuucagaaguuuccagggcccucccagccaccauaaaccacaccacugggaaauacuugguaguccuugcucuaguaagcugcuaaauucggcaugagaaucgcccgcccuaaacgccccacagcagaagcugacaggcggggcuggauggacccagcaggccgcccauuucacacacacaaccgccacaucagcgugggggaggggcugcagaaccagcccagcagguuuggggaucccaagccgcccuucgaaggcugcaggucaaagcccggcaacaguucucugaacuuggggaaagggcucuuaccuaccuuagugggggaaggcucucagucaaauugggccugcuccagauguccagaggaagcaaggauugucuacaguggggauaacacagacauggcuccggucuccggccaagaccuguaaauucggacguucuguuagggcaauuccacaguuuguagguucagagagaauggauuggccaaaugcaauaccaacagggucuacuagauagaaagggagucacagaaaugcuguguccccccccccccuuucccagcugacaaggcggcccucacuguggaauggguggggguggggugaggguggcugagucacuaaaguucaacccaggagaccagcagcgggagacgacucaucugcauuuccaaagacccgcccuguccacauccccucccccaggaaggccaggaucuaaggcuuuacccucgggcacuaucgcggcggggggcugggggggaucccgaaggggaggccccaaucggcuuucccaagccccagcccacccccuuccaaaacacaccuccaacccacagagagcuggguuggaggcugggccccuggcguccaagugaagccacugcgaaggccucuaaccccaaguggggacaaaaggggagacccgccccuccggcucgacuaccaaaggacgucugggggaggcaggggugggucucccgaagccaaguggcagugaagggaggcuggagcagccucuuagcccuuggcuaacuacuggcuccuguuccgaggcagaacggcaggcagugcaagccagagcgaggccucgugcccgugugggccuugggaggccggggcugccacggagaucggggucccucacccgccuccaggggcucgcccuacccggccucggcuccccccgcggccgccacugcccgaaccgcgccuggggggaggggcucggggggaucgagugcggagaauuagggugcgcgacgccccccggggccuaaggccccccgagacccgucaccaggaucgcgggcgccgugccuggcaggcuguuagggcccggggcugccucucggcucccagcgacaaccagggaaaagcaggauggcggaaggaaggaggaaagccggccgccauuagccagagagcaguauugaauggcccggcggcuucagccuuggcuccaacccgacccagcccucggcucggcucaaaaaccugaaaauaaaacucguguuugagagggaggagcgagcgcggcccggaggacaagcagcgccaggcugcaggcgggagagagaugcugcgucaugaugccaacauggacgccggccuuuuguccuuuuucucuuuggaagagcaggcgagccccggagccccgaaaagcuggcuuccgggggacagaaacccccacaaucaaucaggaacgagacuuuaagaugggugggaagguuuccucgcuuuuuucagccccuccaucuccaaaacacuucgauuucuucucugccacuaaggugcaaaccugaggcgagccaaagggacuagcgcaggcggcuccauggaugccccaggguacuggggacaggcucucuucgccuuugggugcaaaagaggcagaggggucuggagagcccuaguccccucacccacccacugcaaucggcugccaagcucaagcucaagaaaucccagcucccaaucaucugcagcccauggccugcucaaucgagaguuccucgaagggggaaaaagacacuugaaaacaaauuuuuuuagucuaguuuuuuacuuacccacucagcccggcgccauggcgucuagaagaaaaagcuggccggcgcuuuuggagauauuauaaaaauaacaggucuuuuuuugggaggugggggauguuugguuguuuaguuggggggaaaccugggguucuggugucccuuuguuaccuucuuuguaaguuacacucgugguauuucugcuccuuccacgacugcaaacuuuccaggguugggcuggcaaaaaggcggcuucgcugagggcuguuuagugcucuggauuuaccaauggugugaucgucauuaagaaacaaaaggcgaaaacacaagucaaaucaaaacaaaaggcaaaaccagccaucccaaccgccacagaaaauaccaccgacucaacguagguguuuggcuugaaccggcuaagggcuuguuuuccaguuuuaaucuaguuuucagaggcggcuuucagucuuuuuuuauacaaaaggucuuccuuucucuuacccuccaccaccccacacccaguucgagaaaaacagcuguuuuucuucaaauagaucgauuuucaaagaguguacgagcuacugggaagaaaucugaauagcaacuauggcuguaaacauuuuuuuuuuuccaaaaagcucgaagcuaaaaaaucguagcuuuauagaagcaaaaacgucuaaaagcauuuuaacugacuuacaucagacaaagacaaagacauacaugcagaugaagcuuccgaaaauucaggacaucucaggcgacaguaacacgagaacggcagugcaguuaaggacagaauggauuggguacuuacaauguaaaagguuuuuagaaaauuuaacaguaacaacagcucacaguuuuuuuguuauuguugccguuucgcuacaacuauacauuuaaaacauuaccuuguuaaaaaauagaauuaauaagauggucaggcuuaaguguuuaauagaggaaacuauauuuaaaaauuuauuguucagucaagagaauacagauuaagacagcuccaagcucucccacccacccacccgagaaaaaaaaaaaaggaaaaaaauuaaauaugucauuuacuuagguuuuuuugaauucaaaacuguuaacugcugacauuaauagugugcuaugaccuaguuauacaagacaaagauggauuccaagucauaaggaaaaauccagaucuuuuuaaaaggucuucauucuuccaagugugaguccuuuggcaaauguuaaacacauucaggcguccugaacuggaugguggagucaaaggaaaagcauuccccauuugcaacaaaggaaaaacccacuuggccauuuaauuccauugcagaaaaauggcucccucaucuguuggccucuccuuggagucugaugaaggauguuuugagaucagcgucuaauaacucaagcccuauagaagccgcgcgcugauuggcugccgcacccugccgcccugcuccagccaauuaccuacccacggccaaauuacaaaccccgaaaagagccccaauaugaaauacaccaccacgaagccccggcgaggcggcugcuucgccucggcagcccgagaagagagaccgagggcgucugcaaccagauccacgcgaaaagccggggaagccuacgaguugaacucacaaaauggaagccgagcgcugauuggccgccgccacucccggaccuuuaauaaagaaaggggaaggaaaaugauaaaugcaaaaaaggggacucucugucgcugguggcuggaggaaggagggagggagaagcauguguucaagacaauuacugggcgcuccccuccaaaaauaaaaacagaaaggcaaaaaauaaaaacgaaaaaauaaagagaaag

SEQ ID NO: 2666 - RNA, 16015 nt, Mus musculus
ggccuuugacgaauggugggacaagaaggagcggauggccaagguauguagguggaugcucaggaagcccguuagggucacgagagggccggcaggaacuggccuaggcaucccuuucucugaagauguguuacuggaugggugguugcuucuacagccagccugagacaacuuuaagaagugccaacaagcaggguguugguggcacaugcccuuuaucacagcgcuugggaggcaggggcagguggaucucugaguuucaggcuagccuggucuacagagucaguucagacagggcuacacagagacacccugucuugaaaaacauagguagguagguagguagguagauagauaagcugacuaagcagacugaacccauggccacuggcugcauguggcucuuccccuuuaaauucuuccccuuuaacuaagaggagacaguagcaucagacacaguuccucauuggcccacucugagcuucaggagcucaacaacuuccugcccgguggcagcugccaauccagguggucccucagcugagaccucugggaccugauucaccucccuuuucucuccugauacauugggcacaaagucugaccuuguggggaccucugccugcccuuuucccuggagguuugccuauccagacccucacaaaugaucccuaacuaacugcccuuucccuacacaacggagaggagggacaacguccugaagccuuuuccuuuaagagguggagucucagucugugcuaugaaagcucaaggaugcuccugccucagccaugguagcuacaaggacaggcacuuaccugguuuuaguguuuuuuguuuuuuuuuguuuuuuuguuuuuuuuuaguuuuucgagaucggguuucucuguauagccuuggcuguccuggcacucacuuuguagaccaggcuggccucgaacucagaaauccgccugccucugccucccgagugcugggauuaaaggugugcgccaccacgcccggccguuuuaguguuuuuaaguccucucaaauaagcagagaguccuggcucacaccuuuaacuccagcacugggggcggggugggagugggggaggcaaaugcugcaggagcucugugaguucaaggccagccaggguuacauagugagaccccccccaaacccggucucacaaaagcaaaugaucaacuaacuaaaaggaaggccucaguggcugucccuugccccuaguccacucugcuccucaccccacccgcagaggagggcguccaccaguuuugcugucucucccugcacugcacuguagggagcucugugacuagaaacuuguucucugcaggguagguaagugcggccugucaggacucauauuacggggucauaaaaccagagaacuacccgacacacaguucuuuaucauccauuacuugaauuguguuggccccccugggauguguaacagucagagcuaucugaagcuaugucgucuguaacuuaaagcgccagagcuuugaggguggcuccuuuuguccaguucaccuccguccuuucaacccaauaugucagauccuugagccaccaccuuggggugaacacugaaguaauagcgaugcaggcauauuugcuuuuuguuguguuuuguuguuguuauuguuguuuuguuuuguuuuaguuuuucuuuuucuuuuuuuuuuuuuuccaagacaggguuucucuguguagcccuggcuguccuggaacucacucuguagaccaggcuggccucgagcucagaaaucagccugccucugccucccgaguacugggacuaaaggcgugugccaccacacccagcuuguuuuaguuuuucaagacaggguuucccugacuagccuuggcuaccuggagcucauucgauagaccaggcuggccuugcuagccuagaauucauagagauccgccugccucugccuuccaagcacugggguuaaaggugugcgccaccacgcccggcgguggugguuuuuaagacagggucucacuauguugccuuggcugucuguuacuugcugugaagaccaggcuagcuuccaacucagagauccaccugccucugccuccugaguccuggcuuuaaagaugugugauuaccucaccucgcucucacauacuguagacagucucauuuuaauuacagcuauaucugguuuuugcuuaaguaaaauacuuacugaaaccaggugaagcacaccuuucauuuugguacucagaauggagaggaagauggaaucucuguggguucaaggccagccuggucuacauagcaaguuccaggacaaccuaggcuacauagagaaacccugucuccaaaacacaaacaaacacacacaaaacccagagccucuaacccaggcugaccucagauucucuuuguagcagagaaugauucugaacugggaauuuuuguuuccaucgcuggagggguuaggaucccgaguaagccccgccacacacaguuuaacagucucugggaauggaaccaaaggcuucaugcccgcuaggcaaacacucuucuagcugagauguauccccaacugugaaagaaaaacuuaucuauuuuguauaugugaacacagugucacugucuucagacacaccagaugagggcaucagaucccauuacagaugguugugagccaccaugugguugcugggaauugaacucaggaccucuggaagagcaaucagugcucuuaaccacugagccaucucuccagcccucugaauaaauucuuuaagcuaugggcagugccugagccagaagugaaacccccccacccacccccaacuccgucaucccgcacaugggaaguacccccacaacccuugcugggaaugucaggaauuugaggccagccuaagcuacacaguuccaugcauaaaccaacauaagugggcuagaaagaugucucagcaguuaauaagcacugcaacugcauggcaggccaaagcugucugucaauccaguucugggaauccagcgcccucuucuggccuucauagguaccaggcauccauagcacacagacagacaugaagaccaagcagcuguacacauaaaauaaaaauaaacuuuggccgggcagugguggcucacgccuuuaaucccagcacucaggagguagaggcaggcggauuucugaguucgaggccagccuggucuacagagugaguuccagacagccagggcuacacagagaaacccugucucaaaaacaaacaaacaaacaaacuucuaaaggaacuuauauaacagauucaaaaggcuaggaacuuggguuuguuuguuuguuuuuuguuuuuuguuuuuuuuuaauuuugaacuagggucuucuaaaacuaagguuggcuucaauuuugcuauggagccaaacaaguuguccuuaaauacucccaucugccgagugugugccaccagucccagcucuguuguuguuagcgguguuuaguugguugguggugguauuuuauguaauagguguuuuugccucuauguauguaagugcagcgagugccugccuguguuccacagaggcaggcaucgaaugcccagaaacuggaguuacagacgguugcgagcugccauauagcugcugggacuagaacccagguccucuauaaaggcagccagugcucuuaaccccugagccgucucuccaccccucccccuccccauucuguuugguauugguuuugcuucuuugguuuuucaagacagcauuucucuguagcccuggcuguucugguacuggcuacguagaccaggcuggccuugaacucagauccaccugccucugccucccaaguuaugggauuaaaggcaugcaacucccauggcuggccuuuuuucuauuucuuuucuuuucuuuaucuuuuuuuuuuuuuuuucagcaauagcucaagagauaaaauugguuucaauuaauuucugaaagaagaacuccauuccuuuuguuccggguauauuggguccacuguguagacacugugacuguuuguaauacccugggaccacacagcacagggaaauuggaccuuggugccugugguagugauguagauauguucuugcagcgcacagcucucauuccugugccccccauguggaggccaugcuccaaaaacugcagcugugguaguguuguuggugaagcggugguggaagggcaguguggggcucuagaacccuagaaagagagggagguuguggcccaguguaugggaaaaaagugugccauuaacuaaggcugccugcagggggcagcagcaaugccucggacucuggucacuguccccuucucucccaucccaggccucacugacccccgugaaguccggugagcacaaggacgaggacaggccaaagcccaaagaccgaaucgccuccugucugcuggagucguggggcaagggugagggccuggguuacgagggccuaggccugggcauuggacugcggggcgccauucgcuugcccuccuucaaggucaagaggaaggagccaccggacacagccucuucuggugaccagaagcggcuacggccuucaaccucuguggaugaggaagaugaaggucagugcuuucugcugcuggcuggcuguugguuucccccuccuccccaucacugcguccccgcucauaacuccuucuguucccacagagucagagcgggagcgggaccgggacauagcugaugcucccugcgaacucaccaagcgggaccccaaaagcgugggugugcgacgccggccaggacggccccuggagcuggacagcggcggggaggaggaugagaaggaguccuugucagcguccuccucuuccucagcauccucauccucuggaucuucuaccaccucacccucauccuccgccucagacaaggaagaggaggaccgagaaagcaccgaggaggaggaggaggaagaggaggaggaagcagaggaagaggaggaggaaggccccaggagccgcauauccucacccucauccuccucaagcuccgacaaggucuggaucagagccucccgggugcuggguguucggacacgggccuccagcucaccugugucccucugucccugugccccaggaugacgaagaugacaacgaagccgacagcgauggccagauugauucagacaucgacgaucagggugcaccccugucggaggccagcgagaaagacaauggagauucugaggaggguaagcagggaagugguugucccggccccgccccccacccccagccugugcucucaagaugggacaucacacugauauugggggaccaauaucuuaaugcuuuugagagaugugcuucuuaaagcacguaccucccccuguguuaggauuccagacugggugagucuagaggcccagaaaauagaucaguggguacuugagccacuggugggggaggggugcugggggggagggcugcugaaaggaguagcuucugacuguugaugggagugcuuaagaacuaaguggaggggauggccgcuuugggagccuguggggugccaagauuguucacuuccaaauguacagucuuauguuaauuucaccuggagccuauuuauauugaggaguaguuuccuccuggucagcauuugaaggcuguguuuaaagggcuuccuguugaaggccuuuuggggaaauacuuagcauggggcaggagcagcccgggcugugaaguaacccgcccaacuugugucccucacccagaggagacagagagcaucaccaccucaaaggccccagcugagucguccucauccuccagugaaaguucuggaucuucugaguuugaauccaguuccgaguccgagucuucaucuucauccucagaggacgaggaggagaugaccguaccugggguggaggaagaagaggaggaggaggaagaggaggagaaagagacugcaauggcugcagccacgguaguggcuauggcagaagagagcaugccuccagcggguggccaggacuuugagcaggacagggcagaagugccucugggcccacgaggccccaugagggaguccuugggcacagaggaggaaguggacauugaggcugaggacgaagucccugagaugcaggcuccugagcuggaggagccuccauugcccaugggugcucggaagcuggaagggagcccagagcccccagaagagccaggccccaacacacaaggggacaugcugcucucuccagagcucccugcccgggagacggaggaggcucaacucccaucaccgccugaacaugguccagguaauucuucagccuccugggugggagucggguagggcauguggcaaaaagcuggguagugucuuuuuccaucagaaccagucaccagucuucuggaagggccucagcagacccccuucuuuggguugagaguaccugcaauggcagaaacggugucuccgccagacacaguguugccacugagcgccaccucuggggaaucaguaccuuuaguuaauuauaauucauuuuaacacuuuagaauauucaacauagucgaaugugguuagacuguaccuuuaugagaucgggggaaaagccaacuguagauuuuguguaauguaucgcuucugacugacagaccacagcucuuuaaacgguaacucaaugagaggauucuuguggcuccagcaccguuuuagucguuguuaauacaauaguagaucaaauggacaaagauaccuauucucaugaaagcacauauuacuaggucagagagacagguuacagcaaaugcacuggggaaaauuagaucccaagagaguggaggcaaacuccaggagaaguccguucagacugucugggacucagaugagacuuggauuuuguuccaccaugaagccugugggccucagggacaaaguaguguuuccuucucuggaguccagacccaagaccuuguggauacaugccaggcggguacuguaucaccaagcugugcucuagccccaagaacauagcuuggcagacauggggaaagcuagcauugcccuucuuggcacuuacggaaacccuuucugggucccugacccugggcugguuacugaagagccuugcauaguaguaucugugugguaaacacauagaaggucaguaaagagagaaggcucuccgagagacuugugaaugaaaugacaauauccugguuuugcuucccucuccacagagucagaccuggacauggagcccgagcccccuccuaugcucuccuugcccuugcagccgccauugccgcccccucgacugcuccggccacccagcccaccgccugagccugagaccccagagccccccaaaccucccgucccccuggagccucccccagaagaccacccuccacguaccccaggccucuguggcagucuggccaagucacagagcacagagacagugccagccaccccaggcggggagcccccacugucagggagcagcaguggccugucccugagcuccccgcaggugccuggcagcccguucuccuauccauccccgucccccggcuugagcagugggggacuuccacggacaccuggucgggacuucagcuucacaccuacuuucccugagcccaguggacccuugcuucugccugucuguccccucccaaccggucggcgagaugagcguaccggcccccuggccuccccagugcuccuggaaacuggccugccccucccacuuccccugccccugcccuuaccucuggcauugccugucccgguucugagggcccagccucggccaccuccccagcugccuccccuacugcccgcuacccuagcucccugcccaacccccaucaagaggaagccaggccggccccggagauccccaccguccaugcuguccuuggaugggccuuugguccggccaccgccaggaccugcccuugggagggaccuucuccuccugccaggccagccaccggcccccauuuuccccagcgcacaugacccucgggcugugaccuuggacuuccggaacacggggaucccggcccccccaccgccccucccaccccagccucccccaccuccacccccaccacccguugaauccaccaagcuacccuucaaggagcuggacaaccaguggcccucugaagcuauccccccaggaccucgccgagaugaggucacugaagaguacguggaccuggccaaggugcggggaccguggcggcggccacccaagaagcggcacgaagaccugguggccccaucggccucaccugaacccucaccaccccagccucucuuccggccccgcucagaguuugaggagaugaccaucuuguacgacaucuggaacgguggcaucgacgaggaggacauccgcuuccugugcgucaccuacgagcgccugcugcagcaggacaauggcauggacuggcugaaugacacacucugggucuaccaucccuauauccugccagaugugggaucggcauccuucaggagcaggaggccccucuaggcaucccaucuugugggaaguuacagucauggucccagggaggcaguaguagggucauagucaccuaucaagugguugccgugccaggccugccucacucccggagguagcugagcuggucucagguccaaacauaagcaaaaacauaaccagagacugagcugaucucccagcauggcucugccuggcugaacugaaucaauccucgguaauauacaggguaguuaguagucuccuuuaacacagggagaaucugauaacucagagaggcuaagugaucugcccaaagucacacagcauuugcugccucaggcgcucugucagaguacucuguccauagauuccucauuggcccuaucuuccagggaggaacaggaaguaguaagaaacauggcuagugucaggcaucuaagugcagaucaucagaacuggccggguggcauggaggugggugguggaccugggcauccuuacccuagagagggaucugaggcuggggaggccaggcagagggaccaggaggggggaaucucugagaacguccauguugcccuugacccacacccacccaccagccucuccucagccaagaaaaagaaacgggaggacgguauccgugagcacgugacaggcugcgcccgaagcgagggcuucuacaccaucgacaagaaggacaagcugagauaccucaacagcagccgugccagcacagacgagccccccauggacacccagguaccgugugagcagggccuguguaaaucuggacucagagucaggcagggcagggcucagacagcauccuucuggccuguaagaggggaaaggcagggcucagcuucuagggaagucugggcuacguagguagguagacacuaucgcagaauucuuaaaaaggcugccuuuuauucuauggguaguggagagucccaaauguuuuguuuuuguuuuuaaauauuuauuuaacguaugugaguacacugucacugucuucagacacaccagaagagggcaucagacccguaagccaccaugugguugcugggaauugaacucaggaccucuggaagagcaaucagugcucuaaaccgcugagccauuucccuagccccgucccaaauuguuuuaaccuuggacauaaauacauucccaaaaaguuggcuuccaccccaccccggaugcgcccagucucacuucagcacacacuuauggcguacugggcaucaaugaauaaaacagcuauuuucucaugggguggugcguggggugggggggugagggaacauucaagcaaacacagggucaggagcaaaugcuguggauaagagggagguuggugaguccaagggggguucagagaaagucaugcuggaucagagggaggagggaggaagccacauagaacaauaggaagagaccacagagaauagaaaggaucuugauaagaaggggggggugggaggcuugggggagggcucaguugugagaaaaauaaaagcacuucaaggugcugauaggaggugggugguggcagugcacuuuuuuuuuuaagauuuauuuauuuauuuuguuuauauaaguacaguguagcuguccugagacacaccagaagggggcaucagaucccauuacaaaugauugugagccaccaucugguugcuggaaauuuaauuuaggaagagcagucagugcucuuaaccacugagccaucucuccaacccagagacggcauaguucuuuaacacucaggaggcagaggcaggccuggucuacagaaagaguuccaggacagccagggcuacagagaaaccuuaaaccuugccuccaagaaaccaaaacaaacaaaggagacugauaggaagacagaugcucuaagccuccugaagccaggaggcgggggcagauccagagagggugugacagggccuugucugucccuuuuugacuugucaucccccguugugccagcaggguaugaguaucccagcccagccccaugccucuacucgggcaggcucagagcggcggucugagcagaggcgccucuuguccuccuucaccggcagcugugacagcgaccugcucaaguucaaccagcucaaggugaggcuagaccuccuccggggcagccaggucagugugggaccugaguccucacaaauccugucccucccucccguguccccuaguuucgaaagaagaagcucaaauucuguaagagccacauucacgacuggggccuguuugccauggagccaauugcugcugacgagauggucaucgaguacgugggccagaacauccgccagguaggugcugcccagggcgcuggugagggguggcaggggcacggagcaggcccagacuuaaggcucuuucuaccaccaggugauugcggacaugagggagaaacgguaugaggaugaaggcaucgguagcagcuacauguucagaguagaccaugacaccaucaucgacgccaccaagugcggcaacuuugcacgcuucauuaaccacagcugcaauguaagugcccagugagggaccgggguguccccaccucuguacugaggaccccaggaacucaggcacugcaaucguguucagucuccuuuccaggcuucauuugacccacaggugacagggagggagagaggagaugagaagccugaauaaggggcuuuucucuugagcucaguuguuaugucuguacaaugggcgcaguaggaauucuggagucauaugaaagacggaagguguccaagaggugggcugaggccaggugugauggugcgcaccuuuaaacccagcauuuaggugauggaggcaggugaauuucugcgagcuagccuggucaacauagugagcucugaacuagccaagauaacacaagaugguaauuggucucauugcucgguaaauugguuuugcaagucucuugcaagcacagagacuugaguucagcccccagaacccacauaaaagggguguggugggguacccgugcuggggaggugggaacagaauucuccgagcgaaucuagggagcugcaggcuagggagacaguguuguagcacugaugccaaccaggugagugauagugacagaaguagggacaugauggggaggagccagagccagcuagaagggagacuuggggagagggaggacuuggggaggauuuuggcuucaggcuccuagugaagugagcuugcugaucucuguaguaacuauuuaccuugcucuccacaagugauagaccaaugaaaaacagcaagacugugccaauaaaacuuuauuuacuaaagcaggcaaguagggccuaccauuuauagaccccuuaucgagggcucagaaaugacacuugaguagaaguaaagauucaggccucucuugcaguaugucugaugaggaagaauugugguccuucuuaaagacuuaguuguuuuuuaaacguguguggauguuuuacuaguauguauguauguauguauguacauacacugcauguguuccugguacccagaggagccugaagagggcaccugacugaggaguuaggggauaguagugagccaccccauggaggaugggaaccaaacuuagguccucugcaagaauugcaagucuucuuaacuucugagccaucucucucucucucuggccuccgcaucuuuuuuauuugguacuggucaugggaggagcuagccggagagccauucguggagcugauacccacgaguuggcuucuauaacuccauggcgaggauuggguuggggcucccgaccccgucuuuuuuuuuuuuuuuagcuuuuaaaaggaagauuuauuugacaagguucacuuagcgcaauacaccuaaaaagaaaucacaauacaaugaaagacuuaaaucaaggccucagaauuucauacaaacacuaagaccaaaaauccuaaaaaauaaugguauugucucuuaaaacuucuccauuaacuuaaaaauaaaaaaaagagcuuuaaacucacgugccuuacagguuaucaaaugaauuuagaauuaacaaacauagccgggcgugguggcgcacgccuuuaaucccagcacucgggaggcagaggcaggcggauuucugaguucgaggccagccuggucuacaaagugagcuccaggacagccagggcuacacagagaaacccugucucgaaaaaccaaaaaaaaaaaaaaaaaaaaaaaaaaaagaauuaacaaacaugccaaauguaucacuuuaauuguagacgcagcuccuauaguuuuacaaaaaagcauguuuuuucaacaugcaucaacaguguucaauguauguauaagagcaacauuuaacauaauucaacugcuuuaaccuaaauacacuuacugcuuacguacauccuacaguaacuagagaaaagcuaggaauuaaguuuaacaguuccaguucacucggcuuugcucuaucauccuagaugacugcuauguucaacauugaaccuucuuugagcgaugccaauguucacuuaagagcaggcauaaaaccacaaggcuggauggauugcaaaaucuguuaaacugagggguuuuaaaaaaaauuucuuuuugaccaagaucccgaccccgucuuaaccgcaucaccacccugucuugcagcccaacugcuacgccaaggugaucacgguggagucccagaagaagaucgucaucuacucuaagcagcacaucaacgucaacgaggagaucacguacgacuacaaguucccgaucgaagaugucaagauccccugccucuguggcuccgagaacugccgggggacccucaauuaguccccgcgugccaaaggccgaggaugucagccguagcccaggagaacccucgcucgcccugggccaggcuccacacacacccccacccacuucaggugcuguccuuauccccagcagccgcacuagggccuggcgcccccaacacuaucccaggacccacccgcagccccagccccgcagcgggaaagggcuucucugucucuccaccugcgucuuuccguuuuuauagaugcucuucgcacgcaggcuuuguauccuuauguaucuggcuuuccauucucccuccguccgucuguccguccguccgucugucuucccucccuggcucuggccucagucauuucccccaccccugagaaugcugcucugugguguugugucuccucuuuauuuucuuccuuguccgaagaaaagacauuuuuuuuuaaccguugaaaaugugaaggcagaaucagagguggagcccuguggggaauccggaggccucagugaaacugggugugggcccaggguccaggcugaccuuggacuaggugcugcaggaggagggggccucccgcggccucaaccucagaacacuacagacccgcaaggccccuaccugcccgucgaugcagcgagcagaccccacaguuucucccggccuguuccccagucccugacccccaccccccgugguugagggugccccuuucccuuugguagacccugggggagccaagcuggucccagacaggaacuuccuccuuggggacucccagcugcccuaccuacucccccccccacccccccaauccuuggguucaauguuuacuuucucauucggaugccagcaacgauggagccucccaggguguccccagugcggugggggcgcugggaaggguguuuccacucucggcagccuuggcccugcccagguguagagggugccagggcccugagggccucccccaagcccugccauuacggguuuguccgaccguacgcaugugacauuuuuuguuguugauaagcuucgccccauuacccuaacccccacacccaugucacccugcuggaggcccccacccaggaggccagggcguauuuauuuccauagcgagcagguuguuucuccuagagaaaggaagauggucuuggaaaugauauuaaaauucagaucuccaucuuggacagcuccugcccccaccccaccccauccucuucaggguuaauuuccaugaauuuuuuuuuuucucguguauaaaaucaaacugaagggaagaaaauuauuauuuuggcguuccgaaccaaucccuguagauagacugccauaacagacuacuuuuuucuugggaacuuuguuucuuguagaaacaagugggaagacuuuuuuuuuccuucucucauuucuuuguacuuaaaaaaaaaaaaaaaaaaaaaaaaagcaaaccaacaacaacaaaaagacacacacaguaacagcaagucccauccacccccccaaccccccagaaagcaaagcagacauguaaauauuucuggaccgugacuguugugacccagaguccucaccaagaugaagugcuccgggugggacugaccucacccguggaccagguggcaggagccucuugguaccucagcuugugucaagcuuucuuaucauguaaauucuguacaaagaauuguuuuuucccuuucucucucucucucucucuuucucucucucucucucucucucucucucucucucucucucucucugucguuggugguuuuguugugguuuuucucuuuuuuuuuuuccccuuuuuuaauuuuccacaggcccucuguguuugagacugugcccacaggcccucuguguuugagacugugcccacaggcccgucugaagguugagaggauuauuucgauuggcaauuaagacacaaggggcaccuggugggcacagcgcccaccuacucuuccauaugcaguugucugcauaauugugcaaaugagaaaaaaaagauuuauuuuucacaagaagaaauguguagcguguagagauggcuuaauuugaguuccucgggcaggccggcucgcugggggcuuucuucaucuucccuacugacccccaucacaaagggaugaagaugcccagaugccagggaagggcugcuuggucccuggcagggccucacugagccccgucacgggauccgcaugcauuaaccuugacuugaguuuagggugagguguugagcuaacccuuccccaagccccuggcuucuccacccccacccccagcaucccaggaaggguaugcaauacuccugaucugugggcccauuuuucuuugaaagcuuuuguuuucauugaguagaucucuugcuuuugaagggucagggguuucugauuuuuuuuuuuccucccucucccugccccugcaaagaagagaaccaauaaauuuuaggguugucugugcguauagacucugucaucuguauguaacuuguuuuugaagagaaauguuuccguugugggugugucuugcuguaaauauuuguucauacuuuugugaauucaauacuauguaccauuguauuauaguaacuuuuauaaagcaaaccauaaauauacugacuuuucuuacag

SEQ ID NO: 2667 - RNA, 16689 nt, Mus musculus
uagcagagacagccaggccucagucuaggcucgagucagcaggagggacggacaggaacaccaggagaaguucuuggccgugccucucucagggaagcgaagaucagcaaagacgagagaccugcaagcauugcccucuccuaaccuccacaggucuugccucagcauaugcaucuaaucagccagagugcacagaagcagcaagaaacugcaguacaucaccagauguuuuuuggugcguuucucucuauggaguccugacaaaugcagcucaacuaugcaguguaagguggaccaauaccugaguguuguuagcaaagaguccuucaguguccuuucacaugcuugcuuuagcagaauauccucucuccugggucugcuucagggaaacguuccuucacgaguuggccugagcccuucacaccuguguccacuuuaacgaaauguuccuucacguguuugccccagcaaaacgccacccgacagauuuuccaaagaaccguuguguuuccauuucaaucaguucccagcgccuuggcuaaacuugaguacagaaaauaacuuaggaagguuagcaguuaaguucauaaagcacucuaaugaagggcauagauagcaccguguaaccaccaccucuucccacagcucuagaacgcuccucuccuuccaaaauaagagccccucgcuuacagcaucucuuagguuggagaaauaauaagucugguuacgacucuucuacuggggaggaguugcccucuugugaugaagccaacgugcauuuuagaauguuugagaggaucuagaaagguagcuuuccauggccacagaagaccagcgaccacaggagcaggugcucagcagccucucugcaagaugcagaggaaagcaagacaucauuuucuacaaaugggauuaguaaagacaaaagugauugauggugcugagcgcuggcaaggguguggggaaccggcucgcccgcccaaccacuguuugggggggggguguaaauuggcauaaccuuuggggaaagcaauuugucacccucuguuaaauuuuauauccucugacuucuaggaaugaagccugcggaagugcccugcgcuuaugccaaggcauaaguaaaaggaucucuuguugggaaauauguuuugaaauggaagcaauccaaaaugucuguuaauagggcauugguuaagugaugucuugucaguacaccagaacacaauggcgcuuuuagcgaagggggaaaaccagcacgagaaagcugucugugcaguagcguggcagcauccccacgauacaggaagagaugaagcaaauugcugcacgaguaugaguaguuuaauucuuucuuucuuaugaacuccucuguauguuaccuuuuggugaaucgugcauaccaaacagucacccaugccuuccuugggacaggggacagcauuauagaauguggaucuuauauuuuacauauaucuaaagguuugaaccuuuuguuuaaacaaugaauguaaaaugccuuucugucagaaugaagagauaggaacuuuguaaaaucaguagacagguugacuaucacuggcugacagcuacaugcgaugugccaugaccucuuuggagcaguuuuuuguuuuaauuguauucacuaagcugugcccuguucaagaagcauccaucauacccaaaagggcuggagauuuggcucaguuaguagaaagcuugccucccucccauguacaaaguccuggguucaaucccuacuaccuaauuacccagacaugcgugcgucuauugccugcccuugggagguaagggcagggaggaccaaucuuucaaaggcuauccucagcuacauagugagugaguucaagccaaaaagcaagaaacaaaagacaaacucuggcucccaucaauagauguuccccagucaggccucucuguguccccggaagucacuggccugcuccuguccacagcacaucuauucugcacgugggaacacaacuucauucuccuggagauugauucauacagcacgugaccuuucuugccuggcuucucucgcuuaacauguucuucagacucauccacuuugugacaucaaccagugcccugucacggcugaguguugguccuaucccguccaucuguccaucugucuaucugcugguggugauagacauuugcauuguguccauuuuguaggggugugagcauugggguguaggaugugaugaagaugugcauacguauaauuuccugaacggcccucccauuggcauuuccgggucgugguagugacucuaagacuccauagucccugccccccacaacuuccccagcuggggaaaaaggugccagucuuuccaagcuuagaguucuguccuccugccucugcccacuugccgacauguggacggccucaggaaaggcuuuuggugauacacgggguaccuggcaggcgcuguagugucccaaagugcugagucuccaacaguccaacagcccagaagagaaagcccaccuugcucuaccucagugucucucucaguaccguuguuuaugcuccuuagacccaugcugccggccuucacccaucucuuccugacgcccaguucuccugccauccaaugcuguucuuucugccucugauccaucacucugaauacagcugcccacuccuuuaggaauacuucgcuccagacccuccgugccgccugcgaacuucaccucacaucagcuguucgucuguggucgcugccagucuguguccucaguagcagggcccacagugugcacaugucugcauccugacaccuuaccucaugccuggcauggggaggcgcucucaccagacagcuggcguggcaggauccagcacugacaucccgcaaagggaccucacuuuaaugcuucagucaagccacccgaauuagagcaagcuaagcuggcaugcaccugcaguuccagcuagguagggggcugaggcaggaggcgcucuugagccuaggaguuugaggacagcuuagguaaaauaccaagauccuuaaaaaaaaguagacauccuaaaugauggaaggagaggaccaccuccugcaaguugucaccugaccuccaccugugcacaccccuacacaugaauacaaagauguaauaagaaaucuugaagucaaagaggcccaaccagcgucaauacaacuugaugcuccuaugguucuggcgacaugcacguuacacagaccuguauuuagggaugucggcaacagaggguggcgucucauuccagucugugggccugacaucgaggaaucucacacaucccgcccaaggcauucgcagacuuuuuucuugucuguuguucauagacaauuccuuagggcgcaauggagagagaggaagucagcacacugcuaugcucuucacagucaguaguccccccccccccgcccccccuccaacccucuagagcauuugcuguugggaucccaggccccuuguuuacaacggcugcuggcagcgcuugaaugacaggcucuuagguagggauuagcugagugacaagacaggaaauucagaaucgcagauacauaaggagucuggcgcgacggugcaugccugucaucccagcacucagggggcugaggcaaggaggauugcgaguucuaggccagccuggaccucacagcaaaccuccaaacaacagcaaaaaguauggcagugucaaguccagccuuaaaacauacacugaagcuuaaggaauuuauacucucuuuucugcccuauacagaaagacgcuccuuggaccggcguaugggucgccuauugagcaugcgcaggugcuccccguaaaauccacgcuagagcugcagaagcgauacuugguguucauuaacaaggacaagguagcagcccucccucuucugccccugcaagauggcuaugcacugggucuaaagagcaggacaccccggggucggugagaucgcuggaccaguagggagcuuaccgccuauuccggcgaccugagucagaacccugggacccaguaagagaagagacugacuugggaaaguuguuuccaaaugugcaccccuguggcacuaaugucccuucccuaauaaaugcauuuaauaauagaacagacaauaagacccaugggcccuuaguuguucugcugcacagaauuaccuccauaggggucguugaccauucugaaaauagccacagauuagugagaaaggcucuggaaggcguuucuuuuuguuuuaauuuuguguguguguguguguguguuuguaagugcguaugugcuacaauacgcaugugaaggucaaaggacaacuuucaagagucgguucucuccuacccugugaguccccccuaccccccaggguggaacucagucaggcgugguggugguggcagcaaguaccuuuacccacugagccaucucacgggccccuaggagauauuucugagcugaguuuucaaagauucccagugacaauucauggcccuccaaaggaugcucuucuuucuuuuuauuggcugggaaaaaucuaauuugcauggaaguuauacaaaacaguugcauauauauacauauauacauguauagauaucucagauaucauauauauaucagauauguauaucauguauauuggauauguauaucauauauauguauauauauauauauauauacauauauauauauauauauauauauccauguuaaagccaucucugacagauggccccagaugugugaauguacaggaccagcgucuggagguaaagcuuauuaucugucuccacaugccuuuccagguuggacuccagaucuuaccaguugacggcaacccccacaaaacaugugcuaucguuugccacccaaacgggguggcugggauggcccuuuccuaugauggccgcuuugccuucacagccggaggccaagaucgcucaguggugcaguggaaaauuaacuuaggguacgugaagggacauacccuggccccauaaggaaauguagacuuguguguguguguguuugaauauguacauaugcaugucaguuccugaggcagccagaagagggcauuggauccccuggagcuggaguuaaugucauugugagccacccacagggaacacuuuuaacugccuuugcucugccccuuagacccugucuuuucauuugauuacaacagaccgguuucagaguaccugcuacaugcccuguguugugcuaggacuaaacaguaccuggcucucaggaugcuuccuggugacauaggcugccgugcaguuuccugggccacacucuaaauuuccagcuugggcgagaaugucccuggcucuaccuggcuccaccuggcuccaggaagugguucucaguaucugcacauagucacccugaccagagagaccaaggccacccccagcaugggcauuacaggaacagucaggaugacucuguugccuucggcuccucugcccgucccugcccugagaggagaccugcucugccuaauguaaggcuggaacauucuaaacuuguagauugucuuagucaggguuucuauuccuguacaaaacaucacgaccaagaagcaaguuggggaggaaaggguuuauugagcuuacacuuuccacauugcuguucaucacuaaagaaagucaggacuggaacucuagcaggucaggaagcaggagcugaugcagaggccauggagggauguuccuuacuggcuugcuuccccugcuugcucagccuguucucucauagaacucaagacuaccaacccagggauggcaccacccacaagggacccuccccccuugaucucuaauugagaaaauuccuuacagcuagauaucauggaggcauuuccucaccugaagcuccuuucucugugauaacuccagccugugucaaguucauacacacacacacacacacacacacacacacacaaaccccagccagaacauuaauauuagaauaaagaggcugggcagugguggugcacgccuuuaaucccggcacucgggaggcagaggcagacgaauuucuaaguucgaggccagccuggucuacagagugaguuccaggacagccagggcuacacagagaaacccugucucgaaaaacaaaacaaacaaacaaaaagaaucaagaauauuagggaccuuaaugucaaagagaugaggguuucaguauagccuggagucucugcucuagacucugggcaguuuucuuaauauuucugauccuuagauucugucugugaaguggggguaacagcuuuuauaggguccuguacggguccgacagguuuccacaugcaaacacagugaccaaucuagaguuaaaagcuguguaaaccagggcugccuuccuccccuuucuucccgaaaggcacccaagcugacccucucauccauucaaacgcagugacaggaaccacggaagaacaaacgagugggcagcgagcucacauuucucaugccgcugcccacuugagcuuuuggguggaggggagcugggcagacggaaacuccucggaggccccucccucaagaaagcagccugacuccccgucccaggaacguccgccccccaccccugccaucugccaagcaggcaucuuucucuuuauggcagauguuaacgcuuuccuucuuaccccgaacuugggugaaaauagcaggcaaaaaucuguuuuggugcugugguggcuucagauuguaaucgcaacucugccuuuugccucugccacccugagugacuugauagacggagcuggugugggggccucggaaacuggagguuagcucucuacccugaagcagcuccccaacaggcccccacaugagcuccuccaggugucacccacuugccaccuguaauccuuggggccuguggcacagggugagggaggugaagacccccccccccagccuccucuuguccucaauaacgugggaucugguagggauacccaguagcuccccugugcuuggccagaagccaggcuucugagaauuucaauuuaaaucuguuguggggacaaaggaucauuaugaacuaauuagcgcuuuauugcugcuucuggugacuuaauauguucagcguuucacuaauggaaagaaauguaagaacaccaaauaaguaaacacuacagcccugcaccagggcccaggcuguaucucagccugguagagcgcuggccuagcaugcgccaaagcucgggauucugcuccuaauaccacauagacuggagugcuggcuagcuuucuaucaucuucacaaaagucauccgagaggagagacggcagaagguugggcuguccuggggagcuaaguacauuuuauagccuucccuuaaggauucuugguggugacagauucccaugucacuucugguccugauauacccugcucuaggacagucugaacguggcucuguuaucccuugagucaggaccaggccaguuuuggccuggaggccacaggaaaggaagggcuagcugaucaccugauagccuccugucagagauaagaaggaaaaugaagaccuggcccggcaggagauggaccucgggcuccuguggaaaagaaaugcaucaggcccuccgcuagaaccacuaaccgggcagaggacauuuugugguucugcugagagggguagggacaugucagaaccuugucagcccuugguguggauagagaugcacuucugggcuccgcccuggccguuguacgcagccaucuugacuccguccucacugccauucuggagacagugcaauucuuauccccacguacaggucccuaaacuuccaaggaggucucuugauggcucaaguaaggaagugguuucugagaaaaaccaaaggccccauggcaaauccguguauuuaauucuuaugauggacccguaugacccuacccauucugcagaugcagaaacugagcagagguggguauuucucguggucacacagcuugcaagcaggaagagugaggccucacgugcaggccccugugauuccuggauacuucaguuccccaccaugggucuucacugaagugagaucuaguucacugaauuagcagaaauccagugaguagguuuguuguuguuguuguuuuuaaacuguaacuuuagaugauuugccuuuugugugaggaaaaguuggucagucucaugcaaaaguagguuuucuucccauucaaagggccuauuuuuggaaaaucugacccuguguuagagagcagaggguuauuuuugucugcuuggcauggguccccgugaucucccggguuuuucuggaagcaauuagcacuggcaaugcaccugccagcccuuuggcacuggucggccgugcucagccuaagaggguugaggucucaggcuggagccucccccagcccccaguagagcugugguccccaaagauuacagacaaauugccaggggccugcugugucauaggaacgagaauaucaccauaauuaaggugggugccccgaacggcugcacuccacacgugaaauugaauuuucugucauaggcuuugucgccgccgccgugggaccuuccugggccaguugcaaagacccugguuguacagaugcgguggguguccuuccuaggccaccaucugugcggcuccagcgacuucacgcuugaguacucucuaauggugauguuuuccauuguuccagggcccuggaggcugccguuucccuugggggugaagacuugaccccguucuauggucuggugucugguggcagggaaggaaaauucuacaggguaauuguuauccgagggaacauuuccugggggcgucuagucaaggcuguagagcaaaccuuggggucaacccucucugcuuuuccacaaagcuccgaccccacacugagcucagaaugaacuuuuuagaaaaaaaacaaaaaacaaaaaaccccaaaaacccaucccguucguggaugugugugacuucagagggacugugcacugucuucuguuucgucugacacaggaguuggaggacuauuuuuacuacucucagauccgcagucaagguaucgauacaauggagaccaggcaggugucggaacauauuugccugucggagcuuccuuuugucaugagagcgaucgguuuuuacccgucagaggagaaggugaguagaaaccggaucagagcuggggugggcuauuuauaacaagugccucugggaagagucucuggagccagccuggaaauaugccacuuuucucaaguaaauagaucagcaagaagacucugagaacucacacaaugagcuccugaguaacugacuggagguaaagauguguccuguucccgaagaccaauuccuugagcaugugugauguuagacgcaccagggccuccuaaaccuuugcugacuuggcgucgcuggccagugggaguucaugagcagauacugagaagguaccacgaucuccauguagcccugacuguauuucaacucgaacuguagaucaggcuggccuugaacucacagagaucccaccugccucugcuuccggagugcugggacuaaaggugugugcaucaugcccgaccugcagccccauuuuugcccaaguaauuuuuacacaauccaggguauauugguguauaaaauagguacacaaauccaaccuuugcugauaauagcuaugaagaaaccuauuuuaaaagaaucccagcacuugggaggcagaggcaggcggauuucuaaguucaaggccagccuggucuacagagugaguuccaagacagccagggcuacacagagaaacccugucucaaaaaaacaaaacaaaacaaaacaaauuuuguuuuccauacagugguacuguuuguuaaagacaaaaacaaauuugcacaccagugagauggguguguuuauuucuuucuauguaagagugaaaucuuagcuaaguguuugaugaugaaggaugcaguguacuuuaagcgguuuauuuuuuucagaggcggcugagguuugguucuguaauuguuaauacgaagaauaccgcuuccccuguaaucccagcucuugggguuuggaggcaggggcuucagaagcucaaaguuguccucagcuacauuguaaaugugaggcuggccugucaugucuccaaaaccaaaacaacaaaaguagaaguuauuagagagaaucacuuaauaucuugauaaauucucuucuauugucuauaugugauauagucuuaucaguauuauuuuaacaaagaauugguauuauaccgcacaaguacacauacagucagugugaaacuaugcuuacacauauggauuuaguaacgguguauuuaggcggauaaccuuaauggucuaaguuuccaguguuuugugagcuuggcgguaaaaauuucuuagugcugugccuuuuuugagcagugggccccacugacucgcucagcuguuggaugcugggcuugcccggagcauuuggcugucgagacacagcuucggugaacgugaacaucucuguuuuucaugguucugaguccaaguagaacuugaacugugucagagaacgugagcuuuaaggcccucuugccagccagaugugguagcacccacccaugacguauagccaugaaagcacuuacagcccacacaaggguuccaugagcugguguuguacuguccaguuauucuggaggcugaacccaggaauucaaggcuacuuuaucuugguuuuucuuguuguuguuuuuuguuuguuuguuuguuuguuuuuuuccaauguaguuuuguuuuguuuuggcuuuggucuuuugauacagggucuccucaugcaacucuggccugggacuuguguagaccagucuuucaaacucauccaccugccucugcaucccgacugcgggaucagagguggguaugccucugugucccccaccccccagcuguauuuuucaaagcaauauccuuagcuaucgcuuuccaaacugaacgucguaucggaaguacuuuaaacacuugucaggugggugagaugggauuucuaacccuccuacuccccccgggguugaggaccacagcuagcugggacaggggccuggccgucuagggucucaccugcccagggucuuuuagauauacagcugugcagaaagccccugcccccuacacuggcucugagcucaagggccacucaucacaaaggacaaggaccuugacacacacacacugcaagguuauuggucaggaguccucuuuggcuguaagucgcagguaccuaagucgggccgggucuugguucagagaauccaagucugaaguagaggcagugugcagcucagcugaacccagaggcucacaugcauccuucucucugggcucucuuuccuucgaguuuccuuggacugcaggccguccucacaccugccugugcugaggaggccaccgacccagauacagcaaugagcuuccuuuccaggaccagcuaccccugguaguggcuccaaccuuaucacggucuagaagcacacacggcccaggcuuccaggccuaaccacuaaccccuccuggaguccgagacaggcuugguccacccucacagagaggacuugggcagggcggaacgguucccaauugaaguucugcuuggacccuggaugcagcccagggguggagcacucuagcacguggguuccguucccuagcucuguaugagacaaugguggcacccaccucugggguuucggugcugacuuuguggguaacuagcccuggggcaugugagggucugaaaagcaguguggcuggcccuuucucaguccugccucuggcuaaacaaucacaggcuccagaauauaagguuccccaccuucuucugugcugcagacagaaccuagggcuugacauaucuaaguaagcacccuaccacuaagcuauagugacaguuuuggaguuucgguucuguggugguuugacuaugcuuggcccagggaguggcacuaucuagagguguggccuuguuggaggaaaugugucccugugagugagagcuuuaagacccuuguccuagcugaauggaagccagucuucuccuagcagccuuuagagcaagauguagaacucacagcuccaccugcaccaugccugccuggacacugccaugcuucugccuugaugauaauggacuggaccucugagccuguaagccagccccaauuaaacguuguccuugucagaguugccucggucauggugucuggacacagcagcaaaaccuuaagauagguuucuuugaaaaacucagaaauauuacgagaauauguuuuuuguuuuaaccccaagugugugauauggggcugcuucaggcugcccacagccgcugacuaugauuugccucgugcucuagcaguggcugguaagguugccagaugcagagaguuuuugcgaugguguggcgucuagaauucuggggccuuuucagaggauauauaaaugccaggguccaaacaggugggguggcuuguuguuggccguucaggauuguugguugguuguggguugauuguccguagugguuuguuaagcaguuguucacaaagaagaaacaacaugaagaagaaauuagguauccugacagcaaaggucaaacuugccccaaggaacuugaacccccaaucaccaggaaaguggucuaaccauaacggaccucgcccccuguucagucccugauguuauucugggaucucuuuccuuuccccucuauucuuuuucucucuauuaucuaguguuagggggcugaaaggguggaaagaagaguggaaaaggguggaagaaaaagaaacccacaaaguagccaaaguccagcuacacuaagcagucucuccaguccucagaaguugaagguuauccucgcuauauagcaaguuguaggcuagccugggcuacauaagacucugccucaaaaaacaaaacaaaacaaaacaaaacaaaacacccaaaugacaaaaaaaaaaaaaucuauuugggcuagaauagcaguucucaaccccuuggaaaaccucaaucuucaaaauuauuuauauuacaauuccuaacaguagcaaagucacaguuaugaaguagcaacaaaaauaauuuuaagguuggggaggucaccauaacauuaggaacuguauuaagggguagaagcauuaggaagauugagaaccacugggcuguaggcacacacacacacacacacacgcacacgcacacacacacacacacacacgcacacacacacgcacacacacacaguaccaugcaagcaaaugcauuuaccuucuggggacauuaucugaagcuccugugaucagauaugccccacaccagagugcggucuuugcuagcucgcacacuuguuuguguuggaagcacaagauguuucugaucuguuuuucucaugucagguuuauagugauuuggaaaaaaaucccccccccagggcuuuuacauuucuauacccuccaccccccaccccccacccccgucucugcugagguucaugaaacacuucccaugagaacauaacugugccgccaucccccucccugcugugccuucaccccuccccucugcuucccuaaggaguccuauggacaaguuggccuagccagcuugggcucacacacgaauauagccacugcaggguucaaagguaaugcaguaaucgaggucugauuucacaagaauacaagacucccgcaaagaauuccuagccccgcuuucaucuacagaaaggcgccggagccuagauuggcuuauugaagagggggucucccaaguguuccuguuguugguucugaaucccaggcugcaaucccccagccccacgcuuuggaguaguauagaugauagguauguaugccgaguccuauuuuagaugaacagugggcaguguguguaacaccauagaaaaagccagcauuaaggaaguguccaguuucuaucauggaugucgagaagguugccugugauguccuucugaccaggagauagcccaugcaccacgcucgcucccugcucccugcagcggucucucuguucugcuuacacagcacuauguaaucuacguucugucgugaguuaacauccgugcagccucucagcuccauaaauuuaaggcuaauccugguaggaacauaugcgcccccagcaagcgccccgauagcaggcgcucagcaaauguuaauugaacgagcgaguaaaugagcaaauggcgcccaguggccucauccagccgcaaggacgaggagaaaaguggaguccuggcaucacuguuugaucucagagucauuacaaaguccccuaaggcaccgggcagauucaggggcaguggcauuguauaggagugucuagacaggaauagcuugacuuuccagugugugugcgugugugguggggcaugguguauguguguguguauguaugaugggggcaugguguguguguguguauguguguguguguaugauggggcaugguguguguauguguguauguguguauguguauggugggggcaugggguguguguguguaugugugguuguguguguguguguguauggugggggcaugguguguguguguguguguguguguguguguguguguaugguggggcaugguguguguguguguguguguguguguguguguguguguguggcggggcaagguguauacuuguauguauguguauguguauguguguuuguggguguagggacacaguguauguguggaggucaaagggcagcuuaccuaccgaaguuuguuaucucccaucccaugggucccaggcauugaacccagguugucagucuugguggcaagccccuucagccgcuaagcauccugucagccccagcccuucucucugaagaauuuacuguggaggcuagaaagauggcgaggcgccugauuucacuuccagaagaccaagguucgaucccuggcacccacaggguagcuggcaaaccaucugguaacuaguuccaggggaucugcugcccucuucugcaggcaccaggcaugaauguggugcacggagauaaauacugggaaaaugcucguacacauuaaaaaacaaaaaacaaaaaaaaaaacuuuuaaaaauuaaaauaaaaaggaugucucuuccagagaaaaucuuacacauguaagaugauacccacaggaaaaggacaguuaugucaggacaguuugcugcaguaagaaccugggcuggagagauggcucagcaguuaagagcacuggcugcuuuucuagaggacccagguucaauucccagcugucuauaacuucagucccgggggaccuugacacccucuucugaccuccgagaacauuagacacacauguggcacauagucggccauguauccaaaauacccauucaucuaaaucaauucuuuaaaaaaaauugaaacaauucuaaugccggaggaugugauaaugaggcaggccuccagucaggagcuacugaaggugagauagauugacuagccugggcucaguggcucucgacaaagcucuggguucugggugccuaacaccacauaaaaucaggugcgugccuguacccccagugcucaggagguagagccaggaggagaaggaagggguuuggggucaaccucaguuacacagacuggggucagucugggauacaccuugagacucuugucuuuggggacagugaguucaaggguagcgggcucuaguuauuugggaaaugauuugaauggccagacccgguggugcaggcuugucaucucaacuacucaggaggauggugcaggagaauggccuaucugggcaacuuagugagacccugucucaaaaugaaccuacugguaucucaguacuagugcauuuaccuagcaugugugagggcccuggguucaaaucccccuugcucccuucccaccauauagucguaguuauuguuauuacuuguguguguguguuuaaccugaaggaacagguuccaagccuguagugacacccauuucugggagcugcaagucgggagaacgcgcucuuccuacuuccuagguacagccugaggucagcuagggccucugggacccacugaaaaccucaccguggucucauucagcaggcucgggccuucccgaucucaccccaggccugaugcucaucucuucccugcuuugcacacagacacugaaaccuacucccucaagaacuuuccggagacagccagaaaggguccuguauaaccucauuucacagcgauuuaccucaacugcaugugaccacccaccgagacgcuccuuagcuggucuccaucccacugggcucuccccuuccaccuccccacucuucccucccaccccccgccccugccugccuuggaggcccugggaacagccagguucuccuuggcucuucucagccucuuucucccgugcaugcagucagcucaucaagggucuauaaaugaaagccggcuugcuuaccaucuucccuguccccucagcaggcaguguggguccgaagagagcaggggcugguaaggaugucauugugcuauuuaguucccuuaaacuaacagcauauauagaacuaacaguguaucguu

SEQ ID NO: 2668 - RNA, 22809 nt, Mus musculus
cauucggaaagaggcaugagggcggccuuggcauucugggaguuguagucuccguccaggacccgccccuagacggcuuuggaggccuguguguggagaaaagccuccagggagagcggcucuggccuccaaccuucgcccccugcccuccaagcuuucccacagcccaagauggcggccgguguggauuuuggcgaccuagagcucuucgaggcguuugacccaccagaggagucgacgccgaagcccguucacacccgguucaaggacgacgaggaggaagaggacgacgacgacgacgagaacggggugggcgaugcggagcugcaggagcagcuccggcgcugcgaggccaccaucgagcagcuccgcgccgagaauauccuuccggcgcgaugggccgggugucacuuggcacucggggucuggguggcggcgggcgggggacacggcggaauuuccaagaagauuagcauucgaaguccuuccucccgcgaccuggcgggcgggcgggagucucgguccgguugcagaagcugcauccgcggcccgcgcgcgaucccuuccccgcgagcguccuccagugcacaccacccuggccccccaacucaaagcugcucucaacuguugugacacuggagacacuucucucccggucuuggaggucaccguguuuucuaacuuugcgugccaagcucgagaagagacgagucguaguguaguugugcguuugaaggugcggggcgucgcagccggggagugggaugauuuguggagggacgaaagcuacgagugcccacugugauggagaaucggggcgcgggggggacgaccuuaaagauuuagcaugcgaagagacuugcuaaauuguccagaucguuuugauuucuugagcuaacuugccucccggugcuccgggaaaaacgcgccaaaauucccuuugacuuuauuaacgugauuauaacguuuguggguuugcuaguauguuaauuucccguucuuagguaguuuugguucagguaacuuuccuuuuggaacuuagccugaacccugagcaugguuguuaugucaacuuuugaaguucaagucugauuuuuuuuucaugaaaccauuuuccgugacacacuuuauuaugaaaauuuauaaaauacuagagaguugaaaggauuguguauuucauauccguagggguucucucacauucuugcaaacauuuugcuauauuaacuuuaucauuuaucuuuaugcuuugacguggaaauuuuucuuaauugcuucaacuuguuccgggaacaccgcggucuaacugaaauuuuugguucaucucuuagacuguuucugaacuccaggaccaugucuuagaauauauguucaaagagaugaagaccuuauuuaauguucagguccaguuguccugcccucggcaaaacauguacccaguguuuuuccuucaaaguacugauuacggggccuuccuuuacauuuaugucauuuggauaacaaaagugaaaguuuuagugguugguuguuauguccugaggacugauauuccuuaaccaguaauaacaucaagaacuuaaaagaaaguugaacauucugacaagacccagguaugacaucuugaaauuacacacgagcugccucuuggcucuccuucucuagucacagcauccuuguagaaaaaggaauuuuuguaucauccacaacucagaauccaaugaagaauucaguaacgguucuuuauuguugacuuagggguauaaaggaauucugguaaguggguuaaaugucuaaacagacuuagugggucuuuuuccucaauccagaaauuuuugcuugacaauucagagaagcaaguuagacccagcuguucauauuuaacacauuucugguaagauaaaauaaguuuacaguuauguuagccgaugauuucuuuacagcuguuauuauuacuguuguuauuauugguggugguugguuggugggauuuuguuuuggacaggcaaggguggguuuacugagacaguguuucucaucuuguaacccaaacuagccuggaauccacuguauguuuacacuggccuuaaccuuauugguuuuuguuugucuaccuugaaagugcugggauaacaggagcaaccacacuagcauuaaauauuuuuauuaauauuuguaaaguacguauuaaauauuuuacaguuacagacagugcagguagagcauuuuuuguuuuguugauacagucuucuuguagccuaagcuggucucugguuacaguguggcucagggugacuuugaacucuugguccucccgccuccccuucccuaguacugggauuacaccuagggccaagucuggcaaggcacagcacuuuagaagaaaaggaaauaugcuuuugagaaaguaucgaaugcaggaggcauguauucagacaucugcuuauaacaguuacacuaaugcuggcaucuccauaugauaggaauuuaacaaguuacuagauuaauuuuuuauuuauuuuguuuuuugagucaggauuuuacuuuguagccuugaacucccaagucuuugcaugaaacucacuuucaguauaccaggcuggucucaaacccagcugcccuggguuuaaucugagugcugggauuaaaaccacgugcuaccacugcagccuagaguacuugcuaguuuauguagagcaguugcucguuuuuccuuucuucccaugucccuccccccccccucuuccuuccuuccuuuuuuuccagcagggucuguguaguccaggcugcucucaaacuccuggcaugccuucugccuuaacuucccaagugcuggcguuccagauaggagucuucuuguccaguugaaauauuuuuaggcuuuggaacugggaaguuuuauugucuguucguguacuggcuaggcugagaccagaauuucagguagggucucucgcaguccuggaacucacuguguagcucugaggaucuugaacuuuugaucccgugagucuugguauugcuggcgugugugcaaucugacccucaacucagccacuuugucagcuggccuuauauuggccuuauucauguaaccugcuuucuuauacucuucccuagucuccuaauuuauaaggaaacuagccauuaguuagggaaauuuuguuaaaaaccaaaagauuaaugggguguguauaugugugugcgcgcgcaugcgccugcacauauguguaaaauuuuuguuuaauguuggaggugauuucugggccagacgugguggugcagccuguuaaugaccaccugggaaacaggcaguaaggucucggggacgucagagccaggcuuugucuacacugcgaaugucagggcuacauagugaaacccugaaaagagacagaaacagagacagacagacagacaguuuguagggcuugaggagacagcugacugacugaagaguuugcugugaagccuggguuuaugaucccuagcacccguguaaaauggcgccaagauggacgucuguaaucccagugcugccgaggcagagggaaagccugcagauggagcaauggcagauucagugagaacccuguguuaggaagcaggccggugaagagcgauagaguaaggcgcauugacuuucccucuggccuccccaugugcaugugugcauacacaggcacugaacacagcagagauccuacuaaagacugcagaccgguuugcuuugcuaggguuggaagcugaggcccuuuccuggucugagcgaacgcugcaccacaggcugcaucucagcccucuugggcuuauucguagaauauuauacgaucuuuagugcuuaugaguugcuaacguuaguguggucguguaaccagugaucucaggacuggggaggcagagguagaagagucccaagcaugaggcaagcuaaggcaauuaagacuuugucucaguaaagaguaguugcagccacacucaagugcuuauaagagcuauguguguacuuuaaugccuucuaagauuauguuuaacuucuguuuuagugguauacuggugagcaauacuaagauagauggaccguuacuacaaauucuauuuaugaacaaugcuaucucaaaguaaguaguuuuucuguuucuuaaauaugaguucauguguuuuaugaaacugaauucuguaaauauacuauuuguaucaucugucucuuuuuaaauguauaugguugcuuugccuacaaguauuuaugugcauuguauguuugccugguguuccuggaggccagaagaaggcaucagauccccugaaacuagcauuagauauuuauuuguacaaagcuauuugugugcugggaauugaaccccaguccucugaucacagagccugucgcuagcuccuaguuauucuuuuuuuuuuauuacauuuuuaaaaaauuuuuauuagauauuuucuucauuuacauuucaaaugcuaucccaaaagucccuuauacccucccccgcccugcuccccuacccagccauuuacauuuuuuaauugugugauuuaugugaguagguguacgugugucguggugcagguagguggucaaaggacagcuugugagagucaguucuuucuuugcugcccuguguggguucaggggcuugaacucagguggucagacuuggccguaggcaccucagccugcuaagccaucucaagaacucacccuuuucguuauuauuuaagcuguuuuugaguucaaguaugagagagcaugguuugagcaagaguaugaaagcuaaggaccuggauuugagucuggacucccgacaucugggaacugguuaaacucaccguaucuguuaauucucucacuggaagacagugugugcaaaggauaaauaccucucagguccuuaaacggcaccgugagagcgcaggacauagcagcucauaggaagacugccaccaccguaauagcuccugcucucacgcaugcauuuuccauauuggcugucacuuggugaguuuuggucaauagcagaacaugauuccuguaagccuacggugugccugcgugcugggcucagugcacuucuacaguggccugcccuccugagucacuuguuccucuuaauguccugugcgcuggcuguggacaagaagauacaggaguagguccaggccugucacccgcuuucguccaggaggcuuuuggagcuaggaguugcugggugcugagcguaguagcagaaugaugcuaggcacccugguccuguggucccucagauuagaaagguauuaaugacuuuaauuagcauuuaguuaauuagcuuuuaauggucuaacuugagugccauucaucuguuacuuugcuugcagaaucuuagaacgcuacagaucugucugaggugcccuggcugucucguuccaacacagaaaaaccagggcuguguuugcaccuccugaagggagcacuccagaauaucugucugucugaucaguugacucuuuuuuuuuaaagauuuauuuauuauauguaaguacacuguagcugucuucagacacuccagaagaaggacucguuacggaugguugugagccaccaugugguugcugggauuugaacuccggaccuucggaagagcagucgggugcucuuaccugcugagccaucucaccagcccugaucaguugacucuugaccuggacagcuagauagaguagauguuguagauguuuuucauuuuucuuccuccuuuuuugucuuuuuuucuaauauauucuaugucccuauauuacagauauaggagaaaguaggaaggaagcuuuucauuauguaacuguuuggguggguuuugcugucuguuuuuuuguuuuucugaaacaagucuucucaugguagcccuggcuggccugaaauuuguagcugucugucuucccaccucugccugccagaugcagggauuacaggguguauacaucuaugccaggcuuuucguuugguuuuugagccacuuguaucuagcaccuauuaaaaauuaaauauaugacagccaaagcuacacagggaaacccugucuggcaaaaccaaaccuaccaaacaaaaguauaagaaauuaaaucuacuuacucucacuacuguuugacuaagguucuaugccagacagcaguagauuaucagaaucaagcuguuaaugcugcagugguagauaguguuucuaaagaguagcauucugaguuacaaagccacauuaggaagugugacaaacgugaaaaaugaaguugagacaacgugacuucuuacaucauacaguaaugcacaggaccugagucugcugauauuucucucugcccagguucuaaccaucuguccaucucuccuacaggcaauaccaccaagaaauagaggaguuuguaucaaacuuaguaaaacgauuugaggaacagcaaaaaaaugacguggaaaagacuuccuucagccuuuuaccccagguauuuuaagcuuuugaggcucagugcuaagugguuaugcuuuuugcugccagcugcuguuacacuagagauuucccagauugaaggaaagugaaggucgugcgcuggcuuccuucuccaaagucugaccaauacucccuggcugggauuggugcuggugugccgccuugccuggauuuaauguuauuuuugauuuaaugaacauuuuaaauuuuuuuaauggucugaggucuaggaggccgucaauauugacuaguaauguuagaguacacacaguuucagucuuccuggggcuauuuguuuucaagucugccuugcuauuugauugaaguauuggauaguuuauaaauaacccugccuuagcuuugaaacuuacaacaaaaugucucacuuauauucaguguguagguuccuaaaguuugaaagucaaaagguauucauucccuugugacuugccguaaugccuguuucuuggucuuagccguccaguguuauguuggaagaggaccauaaaguggaagaaucaugugccguuaaaaacaacaaggaagcuuuuaguguaaguuuggacuauuauucugagcucugcagauguaugguuccugugugucuucaguuggguggcguaacaauaggugugucaucacauuucuguaaagcagaaguguugcugucauccacuaaugucacuuccucucaaagugacugcugcgcucuguccugaggauacaguacacuugguuugcaagaguuuguguugguccugaccaaccucuucauguuuaucuugaaaccuuugacuaaacuuguaaaacuuacauacagaggaagcagagauaacguggcacauuagaaauucaaaaugucaguaagcuuaauuagcgaguaagagucaaagcuuaacaggaagaaccuauauaggccuuucagcuccuuugcagacuuuauuaguagcacagucucaaaggaugacugguuuuucugcuuauagaauaugcccugugauaauguaccccaguuuuacagacauggggcugcaaagaugauggagagccacgaaucucaugaaaaggccagagagggcuguuggaucccagcagauuugauuauaguuguuagacaucaugccucauagugucccuggcuaacuaggauuagugguggacuugaaugcaagguggugcuuuucaucucagagucagagagccuaggcugggagcuggccuugguggcuuagacuuguaaucuuagcauggggagacaaggcagaaaggaaaaaggcuaagcuggacuuacagccuaguggcauagugcuuaccuagcaugugugaguuguugguuauaucacugucgucgucaucauccuccucuuccuccucccccagagagagcuuagcaguugagcaugugccacugguguagaagaucugaguuugauucccugcgcuuaacacugggcaccuuccaaccacauauaacuccagcuucagggaauucagcgccuuuggcauacccaaagacuggcacucaugccacauacccacagauacacacacucgagcacacacacauaauuaaaaacaaagugauucuuuaaaaaaaucagaaauuugcaccaggcaguaguggugcauaucuuuaauaccaggacuuaggaggcaaaggcagguaggugcaacucuuacuugaagcacagccagggcucgcccuuccuucauuccuuccuuccuuccuuccuuccuuccucccucccucccucccucccucccucccucccucccucccuuccuuccuuccuuccuuccuuccuuucuuaaauauuuauuuauuuauuauauguaaguacacuguagcugucuucagacacuccagaagagagcaucagaucccauuacagaugguugugagccaccaugugguugcagggauuugaacucaggaccuucagaagagcagucggugcucuuaaccauugagccaucuugccagccugaagaaaccuuuucuagggaaaaaaaaaaucaaauuugcaucagagaagaaaaagaguucauauuauuuaaaauuagggaugcuaucaagaauauuuuaaaguuuucucuuucuuauucuuuguuuaugauuugguuuuucuguuuaaucuguaugcauacaugugaagguuggaggacuuugcuggaguuggugcucauccuccuaccccgugguccugauguugugcuuagcaucugagccaucucaacagugcagauuacuuauuucacgagacaaggacucacucuguaguccaugcuaucuucagacucauagcaguucugccuuggccuucgaaaugcugaauuuaucacauuuacuuuuaagaaguuuguuuuguuuuguuuugucuuuuugagacaggguuucucuguguagccuuggcuguacuaaaacucauuuuguagaccaggcuggccucgaacucuaagagaucauguuaguacucugguguuuucugaaugcugcuuuaugccaagaacggagagggggguuuugggcuccccccccccccagacaggguuucucuguguagccuuggcuguccuggaacucgcuuuguagaccaggcuggcuuugaacucagagauccgccugccucugccucccaagugcugggauuaaaggagugcgccaccacgucuggcgagcagagagguuuaagagacagcaaugagaagacagggucagggccagcuccacugcagugagcaguucagugagugaaggcugagcuccuaagaacaguaagguugggauauaggccacuguguguuugccugucacaugaggcccuggguucaguucugcaguggagacagaagagagagaaaguaggaguuugugucugugcacagugcacaugaggcacuagcugcaugggaggcugagacaggaagguugaaaguuuaaggccugccugagcuacagagugauucaugguagccuggauagcuuagagaaauucuaucucaaaguaaggaaagauguaaguucagcgguggagcacauacucacucgcccuaaauucaauacccagaacaauugggguggcaggaggagagugacauggaguccagugccugugguuguagagugaguuguuuggugacugccugugugggccaugaucuggaugaauugagggagaauguggggguguguucugagcagagagcucaauaaauaggaaaggaaagcagauaccaacagccaguauucagauugcuuucuguacaagaacugggcuaucaccuggaagcugcucagaucacacucacagaggcacuguucuuuacuaagaaggaaacacauugaaagcucagggacgcaccaguagcuaacagagcaauugaucuacauccugacgaaaacuucagauuauagucuaaacgccguuuaagggucauaaguaaaaaacgugacaugcggugucuuaacuaaaagcgccagguucuuucuggaaaguaguuauccccugggagggucuguagucaguuagaaagcuggucuauuaaccucagacaagagaaagcaggaacagaccagcaugguagugauggugacucauggcugagaccuggauauacuugcaguagggcuaaucugaugcauucaugaauuagauguagauguccuuuaaccccagaaagaauagucagaagagcucaggccuuggccaaggagagugggggaggggcgggcuuggagggggccgggaugcugguuuuguuuuuguuuuuaauuuauuuaucuauuguguuuuguuguuguuguuuuaaagacagagucuugcuguguaucccaagcuggccucgaacugugguccuccugucucagccucucaaguguugggauuucaggcaggugucaccauacccagcuuccugugccauuuuaaauaggugaguuugaggcaccuuacauaucuagaaggagguguuaguaggccuuugaauauccaaaacuggagcucagagacuagaacuuucauauguggggccaacagcauagaaguuauagcucauacccuaggugugagugagucagguacgaagggagaguguagagaaggcccagcuaugcuaaugucgugcuaauccguagagaagguggagagaagguuccaucuguaagcaggccucagaagagcauccuggaggcccuguaaagauggaauuguguaggacuugcugcuagguugagagaugaagaggacagaugcccuaaggauucagcugcagagucucacuuagcuucuuccucgggcagcuaguguagugauuggaaugaagcauugcuggcaauguccuagagagacuggcagggucauuuaagagcggcagagguguguucuagauaguagagacaaaaaauaaacauccaaauacaacauaugaaccuuaaucaaauccugaacuggggguaacacuaaaaaguguuuuggagguaaagaagcuugaaugcagaguugauacgagugauagauacuagggagucagagucgguucguaggaaaguguuuuugguuuguacugacgcauuuugagggucacucugucugcaacugacuuaaaugauuaagguguguguguguguguguguguguguguguguguguguguguguguguauguguguguguuugaagagagucaugcacagaaaaauuucagaccguuguuauucagucagauacggggugcaugaauauucauuguauuauguucucaaaccugucuguaugaaauggcuacaaaaacuugguaauagaccaaguaaauguuuaccaaggaacuugguaauagaccaaguaaauguuuacaaaggaacuagaaacacggucugccugcagacaugugagggccugugucaggcuugggugugagcaggacgagcuguggcacuaauugcacugggccccucagguggcauuuaccugcacaucagaggagguccagcuaauguuuagggcucuguuucucacagccacaucuggagucacacuuaauggguaaucaaaaacuuaaauuaucauagacuuacguuacuuaaugucuuuuuuuucugcuuaaauagcaauauuuuuugacuuguuuucugcagguuguaggaaguguccuguauuuuacuaauuuuugccuugauaaauuggggcaaccgcuacuaaaugaaaacccucagcuuacggaaggaugggaaauacccaaguauccuacauagugaaugaagaucuuuuauacaucuugccacuaaguucaccuuuaaaaaaaaaaaagcuuaccaaauuuugcagcuaugauaacuauuccuuaauaaaacucacuaaagguaccagcaagucuucagccacauuguuccucuagaagggcaagagaugcaagugaaggcaaaaagguucguguggggccuugucuuguuuuacucuuuguuuuccaagaccagaacuguaaucucuuuaucagcucuuaaacguuaauauucuuuguugcugguuugauauaaauuucacauugaacuagaauccugauaucuggacauuguguuaaauguuuggucauccgucucuuggaauucaggcccagugccugggaggguggaaugaagucauuauugcuaucggugugguuacggucuuagaaccauugccuucuucccauuaacugaaggaaaggacgcuccuucgcuuugguucuucuguuauuaaucacugaacaaagcugagagggaacgcccugagcuggagcaggguggcucuuggcuaaaagacgacaagugcugcuuacguaacugaguacaagacgucccugugcucagucauugcaggugcggggcgccucgccuucugcugucucuggugcuccacuggcaucuaggauguacugauuugcuugucuguugucauuuacaucgugaaaaucuuuggauuucuguucuguuuuguguucugaccuaauaggccaaagccucacuguuucaacugugguucugaagagcaucagaugaaggaaugcccaaugguaaaucuuccaugcgcagggugucacggggcuaaggcugugugcauguguggcccuggguaaugugcauagacuuccugugcuacauucauuugugcuuucaucuuuucaaauuuguguuuauauuuaagacauuggauuuuuuuaaagaaaauaacacucuguauuugaggugaaugaaguaugaguuaauuuuuagacauauuuuaaaauguuaaaauguagguucugauaacacuaaaauaauaaaaauuaaagugacuguuucuucuugcuugcuuuucaaaaaugucugcccacuuuguguguuuaguauacauuaaaacuaaagcaaucuacuuaugcuuuaaauuuuuaagagugagcuuucuuagggagucucugagauauuccuaaggugcuugauaacguucuuuucaaacgucaucaugcuuuagccucggaaugcugcucggaucagugagaagaggaaagaguacauggaugccuguggcgaggccagcggccagagcuuccagcagcgcuaucaugccgaagaaguagaagagagauuuggaagauucaagccaggaguuauuagguaucauugcugucuuaccuugggggucauuuuuaucuguuugcaacaucagacuguucugggaauugcaagaauagaagcaugucuaacacaucuguacagagugcauccuuucauucucacccaccuaucaaaggcuugccaugugcuugcuauguaucaaauauacuucaugcuauguaguaugggacacagauguuuuagccaugccugugaucccagagccugggagguugaggcagggcagacccuauaaauuuuaagugagccugggccacagagugagagcccugugugaggaaaguauggggcaggagagaaggcguggaaguuaagaggacaggcugcucuuucagaggacacaggacgacucaggaccauaucuguaacuccaguucucucucacagagcugacggcuucuucugcccucccugggcaccaggcaugcauguguuguacugacauccauguaggcacagacacucacacacaugaaaaugauaauaaaucuuuaggaaaagaaagaugccaaaaugcaaauagaaauuccucaucuuuccuccucuuuauuuuacauagugaggaacuucaagaugcacugggugugacagacaagagucuucccccuuucaucuaccggaugcgccagcugggcuacccaccgggcuggcucaaggaggcugaacuggagaauucuggacuugcacucuaugauggaaacgguauagucugucaggacagagacgucagccuccaggucccugucuucccccucccgucgucuuugugucgugccccccugcacccccagcuaauuaagaugauuagccaggccuuuaagccaguguucaggagggagaagcaggcugaucucaguuugaagccagcucggucucuaaugacagggauggcuggccuguuuaauguguuuugggguaacuaaaaucaugaugacuuuuuguguuuuaaaaggaaggaacuaaagcuucauugaacauauggaauuaucagguauuuuagcuggauagggugguacacauuugguaucccagcacucaguaggcugagguaggaggguugauaguuugaggccagccugccuaagcuauauagcaagacccuaucuuuagaaaaaagaauagaagaaauaguaucagguaggggauagggaagcagcucggugggugaaggugguuuuuaugcaacggggcagcgagaaggacagaagugucucaagaguuguccuuugaccuccacaugugucauggcacacccgcacacccauuucuuuagagccgggcaugguggugcaugccuuuaaacccagcacuuggaaggcagaggcagguggauuucugaguucgaggccagcucugucugcagagugaguuccaagacagccaaggcuacacagagaaacccugucucgaaacacucaaaaaaaaaaaaaaguuucuuuaguuaaaaagaaauaguagggggcuggagagauggcucagugauuaagagugcugacugcucuuccagagguccugaguucaaaucccagcaaccacaugguggcucacaaccaucuguaauggggucugaugcccaauucuggugugucugaaggcagcuacaauguacucacauacauaaaauaaauaagucuaccaaaaaaggaaguuggggguggggggaaauagaucagaccucaggccagaaaguaaaguaaucccagcacuuaggaggcagaggcagacaugugcgaguuugagguuagcagccuggucuacaaagugaguuccaggacagccagggcugcacagagaaacucugacucaaaaacaagacaaaagagaacggggaggagggagagaggaaggaaagaaaagaaauaucaaauuguuaucucagcuuggucugugaccaccgcagccagagcagaaacccugcggguaguacugagacguuucuaaccuucuuaguauugcgaacaucaaccuaucaauggcaagagagagguggcacuuccacagugauagggaaggcagagacaaagagaauugacuggguauaaccacuugccacaaauaacaugagaccaugccugccucaaaagcaaaggggccagagaaauggcucagugggaaaaggugcuucccgucaugccugauggccugaguuuugguucucgggaucugcaugguuauggagagaccuaacuuagcagguuauuuacugacuuccacacacauaccguggugcaaacauucacuggcagcugauugagacaaauguagacacagccagccuuuagcuugaguucuggaacucccgaguaagaguuugggggaggacugaaagaacugaggggguuacagacccauagacacagcacugucaacucacccggaccccucagagcccaguaaggagcauacaugggccagucugugagcccccaugcuacgcccccccaggcacauaaguagacgaggacugccuuaccuggccucagugggagauguuggugaaagagagguggggggcgggggaagaacucagggaguggggaacaggaaguggggcaacuuguggaauauaaauaaauaaaauaauuaaaaagaaauuagauggucuaaagguauggagggugugugauagaccacuguagcuguuccugcaagagcucucuguguggugaucugggcgcucuuguaaagcucuuuccaaagcugaguaugucuaaaguuuaaaauuuuucauaagaaaaaagaauuuaggccagguguggugccgcacgccuuuaaucccagcacucaggaggcagaggcuggcagauuucugaguuugaggccagccuggucuacagagugaguuccaggacagccagggcuaugcagagaaacccugucuagaaaaaccaaaaagaaaaagaaaaaaaggaaaaagaauuuaguuuuguuuuaguuacuuaguuugguuuuucaggagaguuucucuguguaguccuggcugcccaggaacuuacuccauaaaccagguuggccuccagcucaccugucucucugccaagugcuaggauuaaaggcauuugccaccaccaccagcuaaaucuuuauucuuuugagacaauauguauuccaggcuggccuucaacacuugccucagcccccuaaauguuggggucauggauuguguugcucagagccuauuuaaaaguuguaaugguucaggaaaaugauaauuaguuguuuccauacuaauuuagcuauaguauuucagcacuuccccuguauggguugaguuggggagggcaugucuagugucuagcuguguuaacauuuucucugacuucuaauagaugacgcugauggggaaacagaaacuggagaaauacagaauaaaaaugucaccuacgaucucucaaaauugguaaacuauccagguuuuaauauaucuacucccagagguauuccagauguaaguauacauuuuaaauuuuuucuucugaaaugugauaaucauauuaaauauuguuacauaaagcuuacuauuacauaaagaagugagugaauucauagcuagacaugagagcacacauguguagucauagcacuugggaaguggaggcaaacugaagugagcuuuuagggacauguuucagcuuuucauuuguuagacagaucucauguugcaggcuggcccugaucauccugccuuuccuucccagaugccaggguuacaggugugcgugcacacacugcugcguccaccucucgugugcguucuggaaaccagacucggggucaugggcuugugcugcaguucuuugugcaccaaaccaccucucuuguauggaacuuuuuccccccaacucuagaauaguaaaugcagaacuguauacaucagaguuguggguuuuaugcuacauccgaagcaaaagcaaaggagcagaagucaguuuguuaggcucugugauccuaaaacugcagcagcaaccucagcuggaaucgaaccucagcagaugacucuacagugccauauugugugguggggccugccuuuaauaaucucugaguuacagacagcugaagcuacagaauagacacagaaaacaaacgcacaccucuaagacuauuacauucuuugggguagucuuuuagguagucuuauaaguuuuauaguuauuuauuuagauacaauucucuccuuaucuagcuaggugcuguagggcucuuccaccugcuuuccuugguugcucucuuugugauaaguucucugugugugaggagcugucucacacucugaugugugccgccagcuuucacccauguuucagaauuaaacagggagcugcuuugaugguguuggcaaguuuggguuuuggugcuuuuuuuuuuuuuuuuuuuuuuugguguuuucaagacaggguuuuucuguauagccuuggcugcccuggaacucacuuuguagaccaggcuggccucgaacucagaaauccaccugccucugccucccgagugcugggauuaaaggcgugcgccaccacgcccugcuugguuuuggugcuuuugucugggaaauuuuuugauagugauguuccuucugacucuuccgacuucugggauccaagaguuugccgcugagucuaguuuuagaguuuccauuacuguuuucuagcuugcauacaaauaaagggucucauugugacauuucuguuuagaggggguggugguguuauugggguuuuguuuugaguuggagucuucuacuguagcauaaaaaacccuugaagucacuguguagcccauucugccugggauuugcagcagccuuuaugccucauccgccugaaugcuaggagucaaaucucaaaaagaugauguuuuccaaacccacucauccuuguuucuuccacaccaggaauggagaauguucgguuccauaccaaugcaggcgugucaacagaaggauguguuugccaguuaccuuaauucuaacauccagucgguaaauugauuuguguguguaugauguugggaauuggaccuaggacuuaagaugugcuaggcaagcaagcacuuagcauugaacgguacauuccuggccucagagcauagacuuuaaggguguagcuggcaaacauucguaguggugagauucuauagcucacugcugcucucuuugguuuauauuauaaacguuggugucugauuaaucaagaagcagauggcuguugucuggccuaggcugauuuaaggaugggcuagagguugucugucugcccugucuaacugguguucuuccugguugcucucuuagccgaguaugagaucuagcggcaagcggucuuccucgcaguccagcccuaacaguccaaagaagcagcgaaaggagggcagugcggcggccuccccugccgacauggagcuagacucagguauggcugcggcucaggcuccuugggaaggcaagcucagccuguauccuccgggucuguagagaggacggagcuccuccagacuuagcugucggggcauuuccacucuuggugauaaacccugaaucagaagcugcucuuggugggagaggcaggggaccagcuagccaagguccugaauuuggcaggcucaagcgcccgaggcaucacagcuuguccagcuccaaugguggggcagcaaccgggcacgcauacuucugggaacuccaguaggaagaacaauugagccucugggcaggugucucccaggggcugugugcuaugaucuuggccaucacacggcuucagaaggaccacagcaggccaaacaguuccacaugagguuuauuguagagaggggggcaagguggagauggaaagagaaaggagggagggagggagagauaucaggggggccagggggaccuuucuuuauauaugggugaugauguaaucacagguaaagguaggaggugagccaaguggauccugggaauaugguggcuguugccuuggcaauagguuugugggucccaccuaugugaugucacaauuuucagagguccugauaccaauacuauguacuccugaaaacuuaaaauugagcaaauucaagccaggcgguaguggcgcacgccuuuaaucccagcacuugagaggcagaggcagaggcagguggauuucugaguucgaggccagagugaguuccaggacaaccaggacuauauagagaaacccugucuggaaaaaacaaaaaauugagcaaauucuugcccucugacuuuuuguuuguuuguuuguuuuuauuuuguuuuguuuuguuuuuucaagacaggguuucucuguguagcucuggcuguccuagaacucacuuuguagaccaggcuggccuugaacucagaaauccgccugccucugccucccgagugcugggauuaaaccaccacugcccagcuucugacauacuuuuuuauccuuuuaucucuccgugucuuccauggaaccugugccaaccaggauccuggugguucggacaggagaauccaguuuccaccuuucagagugcagugucuaggaucagggcaaaagaggacuccauaguuaagagagcaggcguccucuuuucugcagccuuuuuaggacuccuccuaucaucaugacucgugcuuccuccaucugaagcuacauacaguacaggauagcucucccaaagguuugagacuguagcccaggcuggccaucugagugcuggcauuuacaggcauuggcugccauaucuaccccuugucugcaccaucucaaagaugggugcuuauggccauucuuccucuagguaccccaaguuccaauaauaacuuuguaugaagcgcugugacuucugaagugucuuuccucuuucagauguagagauuccaccugguucucagagcagcaaagcauuucaguuccaaccaccguugccucccggaacaccgccuccacucccacagggaacucccccgccucucuucaccccuccacucccuaagggaaccccaccacugacucccagugacucaccccaggcccgacccgcagccucagccauggaugaggaugcccugacgcuggaggagcuggaagagcagcagaggcagaucugggcggcucuccagcaggccgagggagggaauggcgacucagauguuccuggagacacaccuuuaacugggaacucaguggccuccuccccguguccaaacgaguuugaccucccuguccccgaaggaaaggcccuggaaaagccagugcuggcugagccccaggaaccagcugcuucuguagacacagcuggacccgagccauccugcagcccagcagcaggggcagcagugcucucucagagagaagaggaagcugcugcugaggggggcccgggagaugcucuucucgacaauggcgguguguugaacaugaacaugagcaaugggagcaaccagcagcccauucacccggacagccggccuccgauggccccaaaaacccauagcccaguaccugacaugagcaaguuugccacuggaauaacacccuuugaauuugagaacauggcugaauccacuggaauguaccucaggauaagaaaccuguugaagaauucaccccgaaaucagcagaaaaacaaaaagacuugugagugagcccuggcugcguggugaugugcagcucugauugucccaccagccugaggccaggugacccguuugucccucccaccuuucagaaucugguguaauugugaucucgagucaaggcuguuuuacagaaugaaagacugggugugaguuuguucuuuucuucucacugacagcaacccagaguuugcgugcgggagcugguucagggaugcuugguccggguuagacuauuuuuggaucgugagugucugucaagagugaaggguuuuuuuuuuuaaugucuuuuguaaauuguuuucccuuucuacauuuugcuauuauccuguauauauaagcuuaauauaucacuuuuuaaagaaaauucuaacaauuuuaaauucacauuucaauuucaacaaccaaaugagaacaaucagggaucggcagcuugcuccugcuugcucgggguauuuuuguaagauuuucaugcaugauuuuaauaacacuuuuacuuuuuguaauuuaauuauucaaauaugcuuccaauaaaggugugcucaccuuuguguacagagguuuaauaaauuaguuuucuuacacaugaaccaagacuuggguagauaugacucacaguucaaauuguucuuuuaaacuugaaugaaaauuaugagguugcaaagaaacugcauguuuggcugcuguaaguggauuccagccuuacauauacuaauauagaaacaaaauuguuuaauuacuuugggcaauuacuuugcacaugauaauauuguggcuuccagcuggaagguagacagacacauacugagugugacuguccuaugcaagcuggagccuggucugguucucuggcugggcacucuuaagucucugccaggucaaguucuggaacacuuggagaucuugaauaaccgcucagguaguguuaagcugcucccaggccagcagagggcgcaaaagggaauugguccagauuucagugacacuggaguaguccaauuugcccauuuauaaucaguacagggagggauggucagcugcuuugucaccugagucuucagugcauucuucaggguucgcauggugcugugacuuguggaagcagcagccuuccuagcaggccugccaugaggaaggggguuccuggaggccuggaggagauaagggguccugucaacauuaaacauguuuucuccucucucacuguucuuucuuccgagauagguuauugcuguguagccuaggcuggccuuacucacagucuuccugauacugccuacugcugagauuacaggcaagaugacaugguucuuuuuaaaaaaacaaacauuuauuuauggggguuggcggacauuccucagcguggauguuagaagacagugugugguguccacguguuguucucucaucaaugugugucuucaucaagcaccuuuacccagugagccagcucaccagccugaagaugacauggaauucucucgucuuccagaucccugaucacaggugugcacugccaguccugggggcuaaggauccaacccagagcacugucugucugucugugccaggcaagcacuaccaacuacauaugugugugccaggcaagcacuaccaacuacauaugugugugugccaggcaagcacuaccaacuacacugccuccccagccccagugaugugacuauggaagucuuagcugaucuacaucagaaguuauuauuuagcucugucuggugucuuagaccugaaauccuagcaguuggguggcaggcuggaggaucaggaccagccuugguuauauagcaagguuaguuagccugagcuacaaugugauacugcuucagggggaaaaaaguuuuccuuuaaauauuguauugcugguaucugcugaauauugaaauaauuauuuccagcacauacagacucuauuaagguauaaauuauaccauuuuuccuuuauuggguagguauugccucuucuuuuuugcuuuuuuuuuuuuaaacaaaugucuaagacauagauaauuguaaauaaauucagaucucuuaacucugua

SEQ ID NO: 2669 - RNA, 71880 nt, Mus musculus
caauucaaaucaguggcagggaagguaaaaugaguaggggcgguuguguccgucgggaagaagugugagacacuugagaauucucuuuuuaauuucgucagcugcugcaggugagacgucagccuugcggcucgaugggagcgggaggaguguuagguggaaccagcagggggcuucaguccgucucuggguuuuaucgaucucuagaugauggcgggagaaaaaaauuagagaggauucuagauggcaggccgucugaguuuucguggauauagcuucaucgauaguguuucaucugauucaugaccuuguauuggcucgucuguuuuuuuuccgcacucggugaugucaaaaucuguuuaucaccuguuugcucucuuucaccagaagaaaguguagucuuaaacggggcagugguggcgcacgccuuuaaucccagcccagcauuccggaggcagaggcaggcggauuucugaguucgaggccagccuggucuacagagugaguuccaggacagccagggcuacauagagaaacccugucucgaaggaaaaaaaaaaaaaaaaaaaaaaaaccaaaaccaaaaaaacccaaauacuugacacaguguucaaccauuuugucguuguuguucccucaagacuauaaaccucaggguugggaauguuaagucaguugguagagugcugaauaacuggucuagccuguggucugaguccagacucacagagcuuuguccugucuuugccucccaaguacuagguuaaaggccagucuggcucagaacucagagauccaccugccucugccuccugagugcugggauuuaaagucguguuauguucuuagcaggagcucuuuuccuuuauucauuacauuccuagcccaaauguuaucugcuuccagauagcauauuaucagacaauucaaauagagucccaggaaccaucaaaacccagaacaagcaggacgugauagcucuugacugaaaucccaggagucuagagcugagguaggacgauccugaguucaaguuaggaucaagaccuuuaguuacacagugagaggcugacucaaaagaaaaaguuauucaaaacaaaacaaacaaacaaacaacccuucaagccaggcagagaugucgcauaccuuuaaucccagcacucagguggcagaggcaaaaggauaucugaguuuguggucagccugguccauacagugaguucuaggcuacacacacacacacaaaacuccuucaaaacagccuuaguuuuagcuaacuccaacauuccccucccacucuguguguguggacaggaucuugcaauacaagcuuggaccagaccaagguuccccaaauuugaaauuauucuucugucuucgccuuuggcaugcugagauuauggguguuugccacgaugccugucuacauuaugcuccuacauguauacguauauuuucuuuacauuuauuguguguguacauucauaggucagaggauaacauucaugcaguucguucuucaacuuuguugcuucuuuuuuuaauuuuuaaauuuugugucuugaguuucuuuauauagccuuagcuuuguagaccaggcuggcuucaaacucacagagauuugucagccucugccuacugagugcugggauuuaaaggugugcaccaccacacccgccaaccauguggauucuuaauggaauucauauugccagucagguuuggcaucaaacuucacccuuauaacaaccaucuugccagcccuauauuacuauuuuaaagauuaaaauuggggcuggagagauagcucagcgguuaagagcacugucugcucuuccagcggacgaggguucaauucccagugcccaugggguggcucacaacugucugugacucuaguuccaggguaucugaugcccucacacagacaugcaugcaggcaaaacaucaaugcacauuaaaaaaaaauuagaaaauuguagccaccagcagccuggguuacuggguuccugaaaggaaagcucgggacggaugggaagguugugagagaaauaaauuagccaagaccaaguucucugaucaaggcucaauguuuaaagagccaaaagccaaaaacuguucuuucguacacuguaguguucuugaacuuguaggccuccugucucugucuccugcguguuggaaucacaggcuugcgauacugugcaguguuuauaaugucuuagagaugaacaugugugcuagacaaguacauuccucuucacuuuguuugcuguguuuugagacagaauuucuccacuaugcagcuuuggcuagccuacaccauauacagcagcuuggccuuaaacucaccgagacccaccugcgucccugccccacucgcugggauuaaagaccagcaccuccacgugcagcaucuccuuuuaaaaagguucucuucuaucgcaggcugguuuagaacucauuguguuguaaggccagccuuuaaccuucugaucauccugccuccaccuuuuuuuuguugguaaaacucaaaugaugucuaguguggggaggucauacuuccacugagcugcauccucagcuccucucacaggcugguuuucaaaggaagauuuuacuuuuauuugugucuguguguauuuaggugccuguaccuauggagucagaaggacaauuucagguccccuggaauuggaguuacggguacuugggugcugggaacugaaguucgguccuaucguagagcagcaagcacuuuuaaccacugagccaucugugucuccucccuuuuccucagauguuaaaguuauccagagucaccuucguauuuuagucugacucucuucacagaugauaugaguuauauuugcuaaugagaguguuuaaaaaaaaaucucuucuguguuucagguguaguuuuugaugaagguagaaaccaacucaugacaggguggagcccggauacagugcuuuaucugccaugcacaaaaccuugggucccaacccagcagcacagaacaaacagaacccuaauguaccccuuguuuguuuguuuguuuguuuguuuugagacaaaguuucucuuuguaauccugucuguuugggaauuuacuagauagaccaagcuggccucaaauucacagagauccacccaccucugccuccuacauacugggauuaaaagugugcgccauuaugccaaagucucauuugagguagucucagagaguccaggcuggucuccaacccaaaaaugacauuggacuucugauccuucuguggaccaucacagcugguucaugcagugcugggggcugaaccaaggcuucgugcaugcugggcaagcauuccaccuacagagcuacaagcccuuccccccaaaaaauccaaccuuauuuauuuguuuguuuguuuacuugccuauuuaauuagagaauaguguugcaauacuaaugagcuuugaaauagggucauggcuucugaaagauuaugguucuucucuuacaacuccuccucuucucaguucuuacucagcuuuuguuauucucuuuguucuuuuaauuuaauuuauuauaaauuuuuuuuguaguuuuuuuuuuguuuuuuuuuuuuguuuuuuuuuuuuuuuuuuugagacaggguuccucuguguaguccuggcuguccuggaacucaagagauccacuugucucugccuuugucucccgagucugggauuaaagguauauaccacuaccaaauacguguuuauccugagauaacccagucugacuuuggaaccuggauuuauucugaugaaugguuuauuucaaaugaaaacuuuggcuaauuuagauguugaggccaggcaguaguacaagcuccagggucuguugaccagacugacuuguguguaagaaagcucaauauucucuggugauaaucauaauaauuguccguuuguuucacugagccaaaacgugugacaaccccagauacagcauugaagacaaaguuagguuuuuuaauuuauuaguacuaaguucuggguuuuuuucuuugaguagacuuuauuucccaaagaacuaaguucuaugcacaaaaacaauuuggucuguuguuccaggaaagauagugguuccuuccuucuucugaaagacaaucucagaaacauguggaacaauauugagcugcuaacaagcgaugacacuggaaguggaugccugaguguuggcucaagaaaagaaaacgugacugcacuguaccaagccgacuugcuugggaagaucuccucugagaaggugaugguagauacugacuuggaauccagguucagucccagacuguaggagauuaguguccccauucacccgugucuucuuaggagcaguguuuccaaagaugaacccuuccugacgccuugaugucuagcauuggauguaaacugaauuggacaggguggguugugucuauaauccaguaucuagagggugaggcagguggaugacugggagcuaagaguccaaagccagucugaauaauguaaugagucuaggccaauuaaggccacauugaccagccacuaucucaaaacuaaaacaaaaacaccaccacagggggauaguauauaaguugauauaaagaauuaccuccuugaaacuuugucacaaaaaaaccuaaaaauaaacaaaggagaaaaaaaaaaaagaauuaccugcugucuguuugggacauaagacauucccaguagaguugaacauuagggcucucuccugugguggguugccuaauacugcugguauucaaauguuaguuugggucucccagaauuguuugcaggagagaacuggcacaaaggagggacccugucauccccuguccccucagauaguuuugauuggagaauaaaaaugccaccagcauuaacuggaaagaacagacagaacagacagaugggguccuuggcauuuccuaggcuugggacugagaggggggagaggagagggauccgcccggccaggagagguagaggagaguggaugccacuuggaggagccaggagaguggcccagaggagaggccguauggaggucaggaaguaacccagcuacugcacuguuuaaggcauaucaaaauauaaaggcugugugggggucuuucauucgggaacauacacccuggagguggguagcaagcacaccaccaggauuuaguaguaaaauauuacuucaacacacucccuggcccaggcugucccuuuacagagugacaugcucuugugguuggucguuagaguccuguguuuccaaguucuccgccuguuucccaaaaauugaaaauagugacuuaccuaaguuuacagaaguagcaaggagaguuuacucaaagcaaagugauaagaaagacuagaguguacugcaagaaagguuacucaagcgagacggugcugguauacgccuuuaaucccagcacuugggaggcagaggcaggcagauuucugaguuugaggccagccuggucuacagagugaguuccaggacagacagggcuauacagagaaacccugacaagaagaaaccaaaggaaaaaaaaaaaaaacccaaaaaaacaaaaaaagaaagaaagaaaggaaggaagguuacuuaaggccucucuuguuuggggcuuccuuuuaugagguucaagaggaagaauuugguugcuaagaggaguguagacaguucuccauuuugagagacagaauagguuguauaaucauuuuuauccuuuuccaugauucaucugauuuuaaucaugugcaucgcaggauauuucaucacguauuugguauauaaaauauacaccuuaguuccuuguccuggaaccugaaagcacacccguggcgugccaccacagcugaccuucugacaguacuauugagggucaugacacuuaucugaagucauuuuacuuuuggucauacuuuccgcucccacagaccucacugaguccgaagauccaagcauucagcuuaagccauggguuuauaaucguugcagaccagucagugauauugcuugacaguauaugcagaucacuccaguuguuucuuaucuucgguaagucugacagugaaauaccgagagacagucaggguugagacugauuucuuucuuuuuuuguuuuuguuguuucgagacagaguuucucuguguagcccuggcuguccuggagcucacucuguagaccaggcuggccucaaacucagaaaucugccugcaugcaccaccacgcccugcucugauacugauuucuaugggcccuguuuucuuuaaucuguuuuuuauaagaaaugguuugugguccugcaagccuuuaagcccagcacuugggaggcagaggcagguggaucucugaguuugagucuagccuggucuacagagugaguuccggagaaacucugucuugaaaaacugggaaauaaagaaauaaucucaagaaaaucacccauacuuguuggguagugaugguucaaaggcgcugagauaaaaccuugccuccgaauuuuuagggggaacaugcaugaauuuaacuuuugaugguuuuuguguuuuuuauucaaacaaccuuuccucccaguuacauauuugaauccuaauguuugagcucguuuguguucaaguuccuaaucuugcacguguuuccguguuugugcaugugaagaggguagguugccaaguuccuauuaguucuaggauagaucacagugaauaaucuuuuagaauacauguguaaaauaauuguaugaguuaacauggauuuaauaaugaauuugauuguggugugaaaucccagcacuuuggaaguugaggcuggagaaaugggaguuagaggcuauaugccaaguuucaaggucagccuagguuauguaguaauacuauaucuuuaaaaaaauucuuuaaagagcuggagagauagcucagcuguuaagcccacuggcuacucuugcagaggaccugaguuugguuuccaucacuuagggacucauaauuucaguuccagggaucugaugcccuccacagacacagacauuacauuuaggcaaaauacacauaaaauaaaaguaaggucgggcgugguggcgcaugccuuuaaucccagcacucgggaggcagaggcagguggauuucugaguucgaggccagccuggucuacaaagugaguuccaggacagccagggcuauacaaagaaacccugucucgaaaaaccaaauaaauaaauaaauaaaauaaaauaaaauaaaaguaaguacaucuuuuaaaaaaagagucacaguuuuuuucuccuggagacaggguuucucuguagcccuaccuguccaggaacucgcucuguagaccgggcuggccacaaacucacagagauccucugcccaccagggccggcucaagagucacaauuuaaaaucaaaaucgaaaugauuuuuuuuuuucccgagacaggguuucucuguguagcccuggcuguccuggaacucacucuguagaccaggcugacuucaaacucagaaauccgccugccccugccucugccucccgagugcugggauuaaaggccugugguaccaugccagaccuuuagucguucuuuuaguaccacuggugcugcaucgauggccaccacugcucagcuucgaaaugauuuuuaagugaugaugcugaaaugaagugaagauacuuugaaagcuuuccugccuugcuguuuuguuggugcuggugaucuuuuuguuuuaggcaagcucauuuuauuuaacccaggcugucuuuaaacucgugggcuuucuuaagccuuuaaucccagcaacgggcagguggaggcagguggaucucuuaguuugaggccagccugaucuacagagggaguuccaggacagcugggacuacacagagaaacccuuucacuccuccugucugcugcccauauguugguuaugggcauacaccaccauguccuggcauagguugguauauguuauugacuuuuuggugugaaaaugugcacuuuuucaaucaaaauuaaggauuauugaaagacacuuguaaguuggauuugaaauuuucagauacugacguggauguggucggccugugucaagaaggaaaguuucucuuugugggggagagaagcggcaacuuccaccuuaucuacgucacaucgaagcaaacgcuguucaccaagguaaagccgugcuucacuuuuagacagcaaguccagugagcauucacuuggccugcguuguaauguuaaaaaucaaucaaucaaucaaucaauaaauaaaucuguuagguugaauuuaaggaucagacugcaaaaacauauggagucauuucaaaagagacguggcgcucuagagacacugcgcaugcucgucugcaguuuuucauugucuagcugagugcuuagguaccucaguucucagucugugggucucagaccccuuggguugcuaucagcucuccugcauaucagacaguucauaaccgagucaggauugcagcuaugaaguagcagugaagugauuugaugucaccacagcccgugggacuguuugaaagugccacagcguuaggaagguugagaaccgccgauugaggcugugcucuguuguugugaugcuagugggugaguccgauguagacagcaaacuccccacuugcuguugucuaucacaguucaccuugcuaucugcgauucguuugcaauuaggcuuuuguggagaaagcuuuggacgagagucagcgaacguaccggaaucucauuauugagaaagaugguucaaaugaagguaaguugcuuugauuuuucuuuuucuuuuuuuuuuuucuuuuuuuuuugcacaguuuuugauggguacccaaucaagcauucacguuauguuuaauaaacaguguaaauuaauugcugugcuaccuaaaucaugguaaauuuucuguaaauacaauuaauguaaggaagacucuuuguuuguucccuuguuuucuucuugagacuggccugaaauucacucaauacaccaggcugcccuuaagagguccccagcuucugccucccacugggggagacuacuuuccugcucacuagcaggggucugaggaccacugugggacuugauucucucucugagccaugugggccucaguuugcggagcuuggcaaccugaaucuuuaccugccgacccgucuccccaguccuggugagagauuuuagagcgguucccaguauugcuuuggaucuccuacucaucugccuucucuagaaacugguuuugaucuuauuuuuccagguaccuauuauauguugcuucuaacgaacaauggauuuuuuuauauuacaaaccuccagcuuucacaaauugaacaggguaaaguauuguuugcuuauugauuugugacaggguuuauuaguuuucaaguaagucuucaaauauuuuuucaagaaauuuagugguauaauacuggguauaauuagacauauucagaguucacuuaauucuucugugcuaaaacugugguagaaugggaaaacaucucauucccuuacagccuucuagcagcuuauagccuaauuggaaggaaaagacaacagugaucaauggcuuuuuguaauacugaaggucagacucaggaucuagugcauaccagggaagugcucuaccacugaacgccauccaugaguucaaauccccagcaacuguguaaaaagcuggcagagcuaugcaucugccuguaacuaacuggagguggcuccucagugugugcuggccagccagcauggcugaaaguuucugguucagugagcaauccugucucaaggcaguaaagccgagaccaaaacaguagaggcagacaaccaaaauccuguucuguccuccacacaugcaaggaauggugcaugugacccuacacuaccaugcauuuaucuuacacaauaaacacacaaugcauaguagccaucaguaguaauccagggguauggacugucagucucacugagucagguaaaacugaggaguuuguuucgacaaaccuuacuaacaucuauugcaugcuaggggcauguuagguccccuguguaugauuauguuuuaagauacauucauuugaugguggauguagcucauguuuuuagucccacuucugacaggcaagaguaccucugugaguuccaggccagucuggucuacauaggucuaggacagccagagcuacauagagauccuaucugaaacaggaaaacauuuaagauacaguaauuuuuauaguuaacucaggaucuagacagguagaagagguguuccaagccugaaugggaaaugggaaaugcuuuauucgaguagcuugggugauggggguggcauagaggcccuugauaaggcucugugcauaagcugcgcccgaugccuugcguacaguagggacucacagggaauagucuugcuuagaaagaguaacuugcugacccugacuugugcucuuuggcuuaggaugcauucauuucacuuuaacuuaaaggcagacaagucuuauuuuuaguuuauguaaaccuguagauugauacuauguuuagauggcucuuuuuucuuuccuuuaaugaagccauugagaacacggacuuggauucagccaagaagguaagcaaagaaaaucauauugccuuuuuaaaacuucuacuuacuaugaauguagaggcuguuucugugauuaaucauuguacuggcugaugguauaggaucugcuacagucuaacacuuaaguaucguuucuguuuaaaaacauagaugauugauuuaaacagcuucuuaugguuuuucuugggcauauauauguauauauauguauucuaauuuuuuuuaauaaauuuugcaguuacaaggacaauucaaauguaguuuuauuucuacugaaaauuaccacaguugucucagucuuguggcaucucaaucuggaacauuugcaaguaaaacuucugugauaauugggguaauucuuuuuauuuauuuauuuauuuauuuauuuauuuauuuauuuauguuggaaacguuuuuuucuaguuaaaguacaaguuauucuauaaugugacaagaacagaaauaaaggcuagaggcucgaugauuaagaguccuugcugccauugaggaacaccagagguugguccccagcacccaaguugugcuggucacaaauacccguaacucagcuccagaagaucugcugcccucuuguagcccauggggaccugcacacacaugcacaugcacccucccauaaaucauuuaaaaugaaacaagccaggcaugguggcacacaacucuaaucccaucacccugucucaaaaaaaauggggguggggggacauuacaaaauuaugauuauaaaauuaacuaaguaaccuuuucuggguuagaucauugguguugauuuucacuagucugccccugaacuuuucuucucuuuuauucacuagucugucccccaaauuuucuucucuuuucuuuuguuuucugagucagggucucacuauauagcccuggcuguccuuaaauucagagaucugccugccuccgccucucuuaugcuggguuuaaaggugagccccucugggcuggccacuucguuuucccucaggcaggguuuuguuccuuuguucagcauuucuuucagcuuagaaaccauagaaaaagaaacugaaaaaggcuccauagugagagcagcaaccaugacauggcuguggcccuaaacucuaauggcaggcucaagucugagcacguagcucucucauagcacugugcagguauugccacuaugcauugugggugaucaugaaaggucuacugggagauccuccugccuccaccuucucugcauugggaugaauggcaugcaccaccaggcaugcaccaccuggcacagcuucucucucuuuguuucuuuuccuuuuuugauaaacaaaaggcugugcuuaucauuuugggagagguucuuuuucuuuagggugagauauuugaguauguacucagauauucaagugauaacaaggaauuacgaauaccucauuuuccuucccagucuggucuucauuuauuuguuuguaugugugcgugugugugugugugugugugugugugugcgugcgugcgugcgugcgugugugugugugugcgugugugugugugugugugugugugugugugugcgugugugugugugugugugugugugauauaagaguuuuggguggcugcagaagcccuaucagagugucagauuccuuggaguagagauagcggcaacugugaaacacuaguaguggauggucacaaacaaacucagguccucuggcagaacggcaagcucucuuaaccacugaaccaucucuuuagucccuccagucaguucuuaagcugaaagagaaacagaugcaagcuccuaugugccacuuacuugauaggggccaugccugcaaaccuagcuugcaaaaccguccagguaggaggcucacacgggaggaucguaagugaggccaaccugggcaacagcaggacacugccugugaaugaaauacaagugacuggagauaaagcuuaguaguagaguaguacucacugagcuuagcaaagcccugggggcucgugugccagcauccuuccaggggaacacauacauacacacgugugcuugaacucaggauguguucagcuuauguguaucugcuuugugcgguuccuggacgguuuggguuuaagauuuccaacugauggucuguuucacuuuuccagggaaccgguaguugugcauucucaaaaugggaacccgauucuaccaagaaagaaaugucucuuaagaacuuugugggcacagacauuauuaaagguaaugauaaaccacuguugcacucugaaaugucccagacugggcucaaauuugcuguguagcugaggcugaccuugaacuucugauccuccagcacaguagaaugguagcacugguuugcgaugcucuaagugauguaugugcugcguaggauuaaagggugugucuguguugugaguuugcaaacaaacucggguccucuggcagaacaacaagaucucuuaaccacaacugaguggaggucagaggagaguaggucucaguuauaacucggucugcuauauggguucuggggauugagcgcagcuugucagacauggcggcaacagcccuuuaccccugaaccaucuugcaggugcuuuggcucguuuuucuuuuaaguuauaucugcuuggucugugcauugcauguacacacuugguuacuuuacuguaugugcaugcagagaccagaggcucccugggcauuggcucucuccuuucagaguguugguccugaggguugggcucagcuucucagguguggcgagcacuuuuaugcacugauccaucuugcccaccugauuuuggguggcuguuguuguuugagauggcucuuacuauagucuaggcugauuacaguagcccagacuugccucaaaucugagcuuaucuccugugugauuuuccauaaugcugagaguacagguacaagcuacuuuucuaagcacaggccauuuuguuaucacccugaaacaagccaaauucauuuggugacuuucacccauguuugugacauguucagucauuaccuuuggagaggcuuuguauuucuuuuuuaaagauuuauuuauuuauuauauuaaguacacuguagcugucuucagacacaccagaagagggagucagaugucauuaugaaugguugugagccaccaugugguugcugggauuugaacucaggacuucggaagagcagucggagcucuuaaccucugugcuaucucuccagcccaaggcuuuguacuuuauuagucacuuugaaacaagaacaacaguaacgaaagucaaaauugaggcaagaguagaugaaaauggggucgucauuuaaauguaguucugcccuuucaugaagccaugacuuuacaguugaaacaggguccugcaugagaugaaauaaaacccuuagacaucucccuuucccuuucaggugcaaagucauuucagcugaucgacaaccugcuuuuugugcuggauacugauguacguuucugagacugcuuuagugguucauuuacuacuaccuuuuuuuuuuucuuuuguucuuugagccuuugugcuaugaagucagcucccagucucccacugagcuacgccuuccaccugauaauacauuuaggugguagacaaggacguuagcugggugcgugacuaucugugugcugugcuucgucucagcgugcaccaagaaacgaagccugacguuugccuucuaaaucauagaugucuaaaugggugucuuuccuguagaaugugcugagcuugugggaugcuuacacucucacuccuguguggaacuggcccucucuucccguagagcaguuuguucucacgacagaagcggauucucccucaucuguuaccugguauguugggggucuaguuaguagugauuuccauagccccaagugucugucuggguugguucagaucauuuacuacgucuuguguucgaaaccacaucugagucugucuggcagaggaaggaccgauucuuuauuugccaguuucuauuuggcacaaauagauacuauaaugugagcgucuauggaaugaugguagaaacagaaucugugauguguacaugugaaacagaguccacggucuucucugaauguguuuugaccuuucugugagaauaucacuuuauuuaaguucauacuuagaaacaugcauggugggcuggagagauggcucagugguuaagagcacugacugcucuucugaagguccugaguucaaauagcagcuacaugguggcucacaaccauccauaacgagaucugacucccucuucuggagugucugaagacagcuacaguguacuuacauugaauaagugaauaaaucuuuuuuuuuuuuuuuuuuugguuuuuuuuuuuauuuuguuuuguuuuguuuuuuuuuuuuuugguuuuuugagacaggguuucucugugcagcccuggcuguccuggaacucacucuguagaccaggcuggccucgaacucagaaaucagccugcuucugccucccaagugcuggaauuaaaggcgugugccaucacugcccggcuguaaauaaaucuuaaaaaaaacaaaaacaaaagaagcaugcauggcuuuuuaacuugaguuuuucuucucuuuuaggcaaggaauuacaaaucucaaauuagucacccugacagcaacagcgaaggagaagguaccgggggacuuuacacuacauuaguauguuuuaugaauuggaagucaggauuacuagccaguuaaugcucacagcaugcuaacuuguagcucacggagacuucgauaaacaagaauuaaugugcagagcccaguuuucaaagaauggaugaaaaucuuggcucuucauuucaaacagaacauuuuaggaaccaaagauaagcccagcagugguacucgggaggcagaggcagauggaucucugugaguuuuaggucauccugguccacagagcuacacagagaaacccugucucuaaaaaaaaaaaaaauuaaagaacuuauuugagcaagguguggugucucacgacuguaguucuagcauucaggaggcugaaaccgaaggucaugaaugaguucaaggcucuccuggguuguauagcaagucccugugucaaaaaggcaagggcuggagaugaaagaguagugugugcaaggcacuaaaauuagccuccagugcugaaagaaggaaagcaaaggguagggaaggggaaaggaaaagcaauagaaaggaagggcggggacagaagaaaaggcgucggcuaggugggguguugugaaggagcagcgcuccuggaguggagguggggcauucugcgcauguuuucauucugcggggcagguggacuagagcaucgucuucuugugguuuaagaacacaguuuuguggguagcauuuauacgauagcggcaggccuacuuguguagucagagagugcugugguuacucguguuuggcuuuguacaagaugggucaauagaugucuugacggggaagugcuaaccugugcugauggguuucuauuuuuauuucucauagaugagaagccucaucauuuacucucugccuucgauggaaacacuguacucuuuggaaguaucuaguguuucuucuuuaguucaaacaggaaucagcacgguauguuuauucauuuuuccaaguaagaaaagcgggaguggaacuuaguguaaugcuucgcuuuaucucugccuuauacuuauauguucauuacuaacacauacucaagagacccagccgagucuucauagaaauuaagauaaaacuucaucugcuguucaauuguaucuuuuuguuuuguuuuguuuuuuuccuuucacauuggcuuauuuauugucacaaugccacaaagaagucccaaaucuuuacaauuccuuacuugcuucucauuuuuuaaaaaagaaaagcccuaaauaucaaaucauguuuuguuuuuuguuuuuuuuuuuugagacaggguuucucuguguagcccugguuguccuggaacucacucuguagaccaggcuggccucgaacucagaaauuggccugccucugccucccaagugcugggauuaaaggcgugcaccaccacccggccucaaaucauguuuuaaaaauuuuuaacugaauuauuuaaguucugacaaugauagaaugugccagucagucaaacuuccaaacuacuaaagcucugaagaaagaaugaaccaugacuggagcucaccgcauugcacagcuguucaggcugagcagcugucacgaaugcgcagcugucacgaaugcgcagcugucacgaaugcgagugcacagccacugccacucacacacugagagcacguguucucuacaucugacacgcugagguaaaagccagguuuuaccaacuuuuuaauuaaugcagaaaaccuuccacaauagcaacuguguugaaaacuccaguaacauuagccaaccugugauauguugcaaucuucugauuaauagagaacagacauuuuuuuaacuauacaauuuauaagcaacuaauaaacuuugaaauguuaguaauauaauaaaguuauaaauaguuugccaucuccuuuccuuuauauauuuuuauauucaugcaucucauuuaucugucuaguagacuauuaaauucuggauuuaaauaugacuaagcauaaaauaaaacagagaugagugugaaugucuaagcccguaaaaguuauuaacuuggaaacaaauucaaccuaaggcauacauggagaaaguuggauuugacauuggguccuucauaguuugaccugucaaguacacaugaacauccauggcucaaauuaugaacgucuaugugccauaaagcuaacugcgucacaaauggaauguccacuacuugaagaaaugccccucugauguuaaacuuugcaagauguagagucugacgugguaggcauccguauuagcaagguuuuaagaucuagucaauauauacacauauguggaacuuuccguuuaaaucacaaugucuauuaacaaaagaaccuaggcuagcagugcuccaauccuagucaaaaggguaacauuccaucaguuuucuucuguuagucacuagacuaucuuccugcuaucugaagaucacaguagauuccacuuuaggcuguaagaggcauugccugaaugcacucaguguauguccaguggucaagcugcucucagcaucuaagagucagcuggcaucaacaucaagucacccacugcauuuccuuuccucaguguuugaagaguuuccuagugauucuaagaucaauggauggauaauuuuugccagaaguauuuguuuuuuucuaauaauuauaaaguacuugguggcuucuacauuuggguuuuaaucauguuuuuguucugauuguaggacacuauauaucuucuggaaggaauucacaaaaaugauccuaaguaggucaugcuuuguuuucucugauaauucauacauaucuaacuuagaauuuacucaugaauacugcaugacagagcuacucacaauguaauuuuuuuuuucagccuaugugaagacucugugucugacuuaguacuuagguaccucacagagguguuaccagaaaacagguaaauugucauuuuuuguuuguuuguuuguuugguuguuuuuuuuguuuuuuggaguguuugucuguuugguuguuuuuuucgagacaggguuucucuguguagcccuggcuguccuggaacucacucuguagaccaggcuggccuugaacucagaaauccgccugccucugccucccacaugcugggauuaaaggcaugagcccggcuaacuugucauauuuuuaagcauucuuugcccuuuaaugagaaaccuaaagucccuggugaguagggcaucuggugagauuucuucuccgcucuucagacugagccgguuacuucacaagcacagauuugccgaagccgagagcuuugccauucaguucggacuggauguugagguaagcauccaagcauccauuuguucuguuguucucgggcagacaucucuugguuugcuagaggcugagaagaugcagaagggugacaugugggcaccaagugaucuagugugcagcagggacguggcucccauauuuuuacuugaauuaauuagaggaagagcucuaggggcuggagagagggcucagcaauuuaaagaacuuguucuugcacagggccgggguucaaauccuaacacccacacgguggcuaacaauccuaugcaacuccaacucuggggaaugugaguaggcccaguuuggcgggggaggguucuaggauacaagucuuuaaugucagcucugggagagucauagucaagcaagucuuggugaguuucuccguccagccuggucuauauagugagacagagagagagaucacugaagagagaccacaucaaaacgaaaaauagugauggcaauauaucuaucuuguagcaauuugcaguacaggcauacaucguguggcuuaguagaucucucagucuccuucgcccuguucuugccugagucuccucccuuugauacacacccugcuuugcucuuuccgucccuccacucuauagcaucucugcgcugcuucugugaguucugugcaucugugagaucgugcucuucuuucugggccugccuugugucccucagcaugacauccuacagguuggcugacauuguuagugacacaguggcuucuuuucuaaggcucuagucuucaguguguauaggccggauuuuacugacuugcuuauccaucaaugggaagcuacuuagauuagauucauagcuuagcuuaaaucaaguucuuugaccaauuccugacaugguuauuaaggauucaauaaaaaugguuuucauaauuucuaauaaucuggcuuuacugucuagauggguuaccccuuuucccuuccauccuuuuuuucuuugccaagcucuuacuauccagccuaggacuggccuggaguucccucuauugaucagucugguaacgaauuugcagagauccccgccucugccuccugaguacugaaacugaaggccuggcccucuguggucagugagagcugccugucugagccuccuuccugagcgcagggaagagacuccuucccucgguccucuggacccccuagcuugcgggaacagugucgugcaaagacacugcgcaugcuucacggugcccgcuguggcaugcuugcguuacagcuuguuuauaaggucaaaucaaaugauauguuggagaagcuggcuuugauuuccucggacaagagugagcaguccaaauggcagcaacuuguagaugaagcuaaagaaaaccuaugcaaaauccaggugugucuucccaguugucacaugggaguuucaggggaugugcuauccaauauuauuauuggacccaacaauccaauaguguuaacuugccuuugucugguguauuuccaacaggacgaugacuucguggugaauuucugccucaaggcccaauggguaaccuaugaaaccacccaggaaaugcucaguuaugccaaaaccaggguaaguuauuuuacuuuaggaaaaauuugcuuuagucacucaugaugauucugucagcuuaaauguauuuucuuguccuuuaguuuuuuguuguguuucuucuuuaaaggaucuuguuuuuuuuuuuuuaaagauuuauuuuauuuauaugaguauacuguagcuguuuucagacacaccagaagagggcauuaaaucccauuacagaugguugugagccaccaugugauugcugggaauugaacucaggaccucugguggcucuuaaccacugagccaccucuccagcccuguuuuuuuuuuuuuuuagcaaccuuuucucuuccagcguugagaagguuuacaugagacacaguguggccaucucaaguucaugguucucagucuacucacugaauuaugugcauucaucaccucagucauuuaagacugacuuacuccgcagaccaggcuauccauaaacucaaauccacuugccucuguccccagagucugggacuaaaagugugcaccaccaccaccuggcuugggcaauuuucauaugcacuguuuuuaaacaauaccuauuuaauauuuuuauuuuauuuauuuuugagacagaaucucauuuucuagucuuuccuagccuggaacucuuuaugucaaccaggcugaccuugaacucacaaagaccugccugcuucugcaucccacaacugggacuuaaaggugugagucagcguacccagcaauuuuuauuauuuuuaguuauguguguguuucugugcaagcaaaugcagguucucucugagagaagaaaaggcugucagauccuccuggugcuaaauugaauugggguacucaggaagagcaauaaugaucuuaacugcugaacuccccccaaauuuuuuuuuauuguuuacuagcauugcauguaacaaguugcuuuuauauugggcuuaaauacaacugccuuucaaagagaaacgauuucugccagaucagaguccagcucuuaugaagagucugacaggaggugucuccuugugaucauuuuccuuccguccuuugugucuauacacgguguauuuugacucugucuguucccagcaugcccuugcccuaacguguccuuuuuuuauaucucgccguccaugcaugcuuagcucaugaagaaagaagacagagcucuaccugccucuucugaugccuucauggagguacugacgucacguccguagcuaacggaacuugaagacguugcugguuuucuuuucaaggcagauugauauuagugacugcgcccuaucucagcuuccuucucaccaacacgggauuccaagugcuguuguccuauuuuggaguuaaagcauccaaucccugcaaaacuuuugucuaguaccugcuagcuggcaaacacucaauaaaugguccccagugaugaguacaggcaugcuuacaggaaugugugcauuuaaguucccaaaauagggcaggcaaggcggcucaguggagcaaggggcuugugcuaagcuugaagacccaaggucagaccuugagauccucaugcuagggcagaaccagcuaacucuugagauggcccuguguucucuguguguuugugguggugcacacagccgccuccccucuacucaggacaaaacccagagaaaacccacaucucauaugcauuugccuauggcuagaaguguuuucacuauuuccugugggauguguuaaauaauuaacuuguauugaugggaauugagccaaaauaugaguuaaaaugagaauguauacgagguuucuggagaagacuggcccuuguuuuuagcauuuugaaguuuuuaaauuuuaguaucaucacucugugugugugugugugugugugugugugugugugugugugugaguuugcaugugugugugugugugugugugugugugugugugugugugagagagagagaguuugcauggaugcaaaugccauggugugcauguggaggucaggacaauguuuuggaaucaguucuuucuuacauuuaaauguguuccagggauugaaccccaggcuugaauggcaugugcuuuuacccggggagcuuccagcccacauccaguauuacaauuauuaaaacuauccaauuauuuuuuucuguaggugcuaaaagcucaugcaaaguuaacuacauuuuauggagcauuuggaccagaaaaauucaggugugugcauucuauuuuuaauuuuuagguugugaaugaaauauaauuuuuggauauuaugagaagauaguaguccuuugagugaauuugcaugcaaggaaaggcggagggagccuguguguucgaaugauaggaaguaguacuaucuuuccagcaagaauuggcucaagaaccuuugucauuucuuauuuugcucaugucauugccuguguuuucuaacuuccuauuccuguuaaacaugucuuauauuuguaaguaaauaauaaguaagaauuauauuaugacauaacuguuauguuuuuaauaagugagucugccuauuuggagucaguauuugggagcacaguugcugaggugaauauauguaucuguauguuuguucugguagauggcuuagagaaugucuguuucccguuuauucacuuagucaaaaaagucuuguguuuugcuaaucuaguuuguaagaguguuacaaaaauaaaacugcuuugcuuuggugugaaucuuaauuuuuaucuaaguuuuuuaauuuuauuuuguuuuguuuuaauauuuugcguaugaguacacuguagcuguucucagacauaccugaagaggucauuggaucccuuuauggaugguugugagccaccaugugguugcugagacuugaacucgggaccucuggaaaaacagucagugcucuuaacaacugugcuaucucucuagcccugacauaagaaaugugauguuugguuuuuuuuuccauuuuuuuccuuuuuuuuaaagauguauuuauuauguauacaacauccugucugcuuuuaugccugcagaccagaagauuauuauagauguuauuacauuauagauguuauuacagaugguugugagccaccaugugguugcugggaauugaacucaggaccucuaggagaacagccagugcucuuaacucugagccaucauuccuccagccccucauuuuuucuuuuucuuuuucuuuucguuuuuuaagacaggguuucauauagccuaggcuggcauacaacuugaucuguagcaugcauguauuucugagggugucagaugccccagaauugguuggagucacugacaguugugagcuguuguguggaugcugggaaugagacccaggucuuuuggaagaacaagcuguacucuuuaccacugagccaucuugcugugacugucugaucugcgucccuacacuucuguuacucaacagggguucucuaaguuucagaaaggagaguuacuucacaguguggaacuuuuagauuuguuuuguguuuuucuuaucuuuaaaaaaaccuugggagcucgcucugccuuaaagaacacuuguucuuguagaggaccagcauuuguuucccagcgcccaugcaguggcuuuuaauaacucauuauuuccguuugaggaaaccauacuccuuccucucaccugagggcaccccacacgagagggguacgcauacguauaugcaggcaaaacacucauaccauacgcaugaguuaaaauuaaaauuuaaaaaggggaaguaguuagguuccacaagaugcuuaagguguuugccaccaaaugugaccaccugcuuucagucccuuagacccccaugguggggagagaaucggugccugcagugguccucugaccucuacaugcaugccguagcauucuucccccacuaaauccauaaauguucaacgaaguggccuagauguauaaugaugccuauuuagaaguauucuuuacacuccuaacuccuuuccucugauuucucagugguagcucuuggauugaguuccugaauaacgaagaugaccucagggauguuuuuuugcagcuaagugaaggaaacuucgcuugugcucaguaucuuuggcuuagacaucggguaagauauugugcauuuuaauuucuuucuuccuuccuuucucucucuuucuuuuauucuuuuuuuuuuuaaagauuuauuuauacaaaugcugugucuucauguacacccaaaugcuagaagagggcaucagaucucaguauagauggacuugagccaccgugugguugcugggaauugaacucaggaccucuggaagaguggccaguacucaccaccacugaaccaucucuguagcucccugcauuuuacuucuugguugcuuucuaacuucugagauggguggcugagucuuggaaacuaacaggcugucaagugugacucgguggcagugugucuccagugccaggaugugaccugucccaggggagaugguccuaguuaauagcagguccaaggaaggcucuggcacacugucaggccuuaguucaucgucuucagaggcuuuccucaguagacauugguuuuugucuuugucuuuguuuauuuugagacaggguuucucuguguauguagcccuggcuguccuggaacuuacucugugguccaggcuggccuugaacucagagaucugcuugucucugccucucaagugcugggauuaaaagugugcaccaccaugguccaguaggcaucauuuuuuuuuuguuuguuuuuugguuuuucgagacaggguuucucuguauagcccuggcuguccuggaacucaaucuguagaccaggcuggccucgaacucagaaauaugccugccucugccuccugagugcugggauuaaaggcuugcgccaccacgcccagcaggcaucauuuuuauugagugauuuacuaauguccugcuuugcugaugugguggagaggaaguccccacuguuuagacuguggugaagaaacacccauuaaagguguuuaucugauuacuguuugcaguggcacauaaccggaggcugaggcaggaggauugcuuagucuaggaauuucaggccagauugggcaauguagaccaucucauccacagauagacagacaguuaauccaaacccccuucuguugccugauauugauauacaacauuuaaguucaaaaagcauuguuauggcacuaacagauacauuuauuaguaucugugcuauuaucucuaguugcauuuuccuuagaauacaguauuuucugguuucuguguguguuuguuauuuacuacuccagugaguaguagaaugucuacuacuaacuaaugaguugugacaccucccccacauuugaauuauuugcauaacauaaauugccuuucucauucauuauuaagugacauugcugggcagugauggcacaugccuuuaaucccagcacuugggaggcagaggcagguggaucucuaugaguuccagaucagccagggcuucacagagaaaaauuucucaaaaacaaaacaaaacaaaaaaccaucaauaacauauucuuuugaauuuuuuucuuugagaaaacaauuugcuucaguuagcaugcaaaguaauggguucugccaaggcgcuuuugugacucucugucauuauacuucguuuuuuauuuacccccacucacccccaauccuguagguuucugugauuuggggguuguuuaauuuugucagacaagucuuccgauucugucauucaggcugacuuugaaagcaaguuugacgugaaaaugcuggagaauuugcugaauucaauaucuacacaauuccccuuggaaaaccuuuguuccugguuuaaaaaugaagugauuccguuugugaggaggauugugcccgaaggacaagugaguugccuuccguauuucuacucuuacaaauuuaacuucauguaaugcgucauacuugguuacuggagaagcccuguacaaagaugauagagcuggacgcagugggagacacuucaaucucagcacucagaaggauuucugggaauuugaguccagucuaaacuccauagcagguuacaggccagcaugagcuacagagugugucccugcuucaaaagaaaaaaccagcaaaggugguguuagaguguuaccaugcuuaaggucguggguucagugucuagccauguaacugaucaauaacuccuaagagaacauuauagggcuagagagguggcucagugauuaaaaguacauucuacucuuucaaaagaccuggguucaguuuccagcaccauacaaccuacaguuccagucccaagagaucugaugugcacaccccccuuccccacacauauuuuugaaaaagccuuaaaauuugauuaugggauuuuuuugugugugugugugugagaauuuuauccuuaaaugguuuuucuguuucagaacauucuugcaaaauggcuagaacaagcaucaaggaaccuagaguuaacugauaaggugauguuccucuaacaaaggugacaaugacauuugcaccccuacaguagccucagacuugauuuuuaaugguuuucauauuuuuaaaggcaaacuggccagaaaauggacuucagcuggcagagguguucuucacugcagaaaaaacagaccgguuuggauucgcaucuucuuggcacuggauuuccuugguaugauguagagacaaauuuuaugaugaaauuguaacauccaggcagaguuugccugugugucuuucuguuucaguccacugaaagggaaaguccuuucuucuuuucugcuggaucuauuacaaccucaacuguugcaguguggucucuacacugaacuagccaaaaugaaaaccauagacagucuaagaauugaauugggauuuucagcaaaagugggaauucaggguccuaugggaaacagucugcaggagucacagcugcuucauucacuuaaaccaggaagccaugcucuguuaaaauggucauucugaagaaguggcagugggauguggguaagacuuagcaguagagcauuugucuagcaugugaggcugugugucauccuagcaucacaaaaggaaagaaacccugcuacaggggagcaugacccggugcaguucuggaggcaagcuauauuugccuccuugcuucuaaauuucuuccuuccuuccuuccuuccuuccuuccuuccuuccuuccuucuuccuuccucucucucucucuuucucuuucucucucucucucucucucucucucucucucucucucuuucucuuuccuguccuggaucuugcuuuguaggccaggccagccucgaacucaaagauccggcugcaucugccuucugagugccuggauuaaacaugugcauuaccgcugccuggcacaucuaucuuucuuaaaguuaauuucucucuugaguuuucucaaacaaucaagcaugaauuauacuaggaaaagugugcaacuuuacaguuuuaaaaaugauauugggaguacuagaguugaguuuguaaauuaauguaugagacguaaugaaauccauugugaaguauucagucuuuuaguaccagacaaggugaucuuuaagaauguguauuaugauggcuaccauguaguaugauugccacagugcuugcugagcuugcaugaagcccuguguguguccucagugacacaugaacucgguauguuggugcauacuuguacucugaggguguggccgguagaggcagaaggaucauccuuggcuauguauccaguucauggcuauccugggcuagcugagauccugccucaaaaaaaaaaaaauuauacacacacacacacacacacacacacacacacacaugcgcacauauauaugcacacauacacacacacacauguguggggccuucuguuaccaggucucaaauuuuuaguaaauuucagguucugguuuuuccugugaguaagcacugguaaucguggucauaacugauuucuuugagauaaguuugacuguguuucccuaucacacacuuuuguauccuuuagugauguuaauaaugcuuucguuguaaaaggauuaucaaaacacagaggaaguccgccaguuacggacacuggugagcaaguugcgggagcugaucauucugcauaggaaauacaacugcaagcuggcccucucggacuuugagaagguaccaguuccagccccugagcacuguuuuguuuuuugguauccaguaguggcaaacaacugcaucacuuaccccgucuccccgucccucaucuaggaaaaugccaccacugugguguuccgcauguucgacagggucucggccccagagcugaucccuucggucuuagagaagucugugagaguuuacauucgcgaacagaaucugcaagaggaggagcugcuguugcucuauauagagguaauguuuucuuuaacuuuuaaaguauugacuuccuauaugugacugugcgcacagacacgguacauguguggcggucuaacacaagcugggagacucaguucucuccuccugucacacgccucugggucuccaacucaggucgucaggcuuggaggcaagcgccucucccugcugagccaucccauccaucccugcuuuaguuugugaagucugaacggugccucugcauguucagugcucgacucuggaaggagcguaaggcuuuuaccacuggcaccuacgaagcauuuugaauugaucauaacauaagcugacuuuuauugucagaggaccucccagcuauucgauaggcucaggggguggggguggggugguuacucaggccugcaaguucaaaaccaacuaggcaacacaaugagaucccaucucacaagaugaagaaaagcagaagguguuuuccaagggccuccugugacguauuaggaggagcuuaaugcuuacugguuuuugacgaaggugauaaggaucaggccucaggccuccagagucuaagcuacauccccaaccuggcaguuuuuauaaacaauacaauagugcaauaaucucuuuugggaggugggaggggugggagauugguuuggcuuugcuacuuacaugacccuggcuguucuggaacuuccuauguagaccagacugaccucaaacucacagagaucagccgaccuccuaguguuguguuuaaaggcaugugcacuaccucuggcccaauaauaucuguagacccuucagaaauacuucuuuuuuacauuuucuaugccauaugaaaacauaggcuaaauuuuuggcugcaugcgugugcguguguguguguguguguguguguguguguguguguguguguuaugcauuaacuguaugugaguuugggcaagcacgucccacaauagcagccauguagaggcuggagaacaccuuucauggggucagcucuuuccuuccacuggaaagagcuggccugggaucaaacucaggucagcaggugacuuuacaugcucaauaccuugcuggcccauuugccagcaagaguuucuaaauuuguuuguguagccauccuggcugucuugaacucgcuguguagaccaggcuggcaucuaccucccgagcacuggcauuaaaggugugugccaccgcgccuaggcugugagcauuucuaauauguaugguucccuuccuuaggauuuacugaagagguguagcucaaagucaaugacucucuucgacacagcgugggaagcaaaggccauggccgugauaagaugcuugucugacacagauguaagcaaaccccagcugcuggcguuuucuguuuuggguagggaguucccuuuugaacguuggcucuugaagcgauuuucuggccauaaaaaugauauauauugguuagggaaauuuuucauagaauguaaaaaauauaaaaaggagauaaaaacaugcauaauucuauuuccuuugauaauggaaaauaagauuugaaaauguucuuguuuccauugucaaaagaauuucguggacaacgggaugccucucucucucuguucaggaucuuuacuuaaaaauugaaacucauauaguaaggcauugacauugagcuuuagugugguuucccacuuucuaaugaaugggcucacaguccaagcaucuaagagccuuuaagucaucuaugaagccuugucuuagaaaaacaauugaguauagguaaauaacuaaauauuuaaaauauaagggcagcacugguugucucaauggguuaaagaaaggaggugaaguuaggaggggccauguuagucuggaggcguuggaggagguauugggguacacaugaucaaaaaagauuauauaugcauaugaaauucucaaaaaguaaauugaaagauuaucuucaaaccacaaaagauuaucuuuacacuguggaaacugcuguuaaguaugaaaagagcugagcauguaggaaaacucuucagcugcugacugacaauauccuaggaauuuaauagcagaauuacucggcuucuuuuuguuguucagaaauaggguagguaucacauaucccaggcuagccccaaauucacucagcaggagauggugcucuugaacuuuuuuuuagauuuauuuuaugcuuuguguauuaauguuuuacuugcauguguguaugugcaccguguauaggccuggugucccucagagucagugucccagcuccuggaacuccaccugguuuggguucugggaauugaacuccagaccucugcaggagcagcaagugcucuuaacuaccgagccaucucucuaggcugaccuugaacuugugcuggagcuacaggcaugucccacggcagcugguuugaaauggcucuuuauguugaccauaggaggaagcgcaugcuucugcagacagaugaaacgcucucagucucccugucuugcugugugcagugcugcucgcuuccgugagagcacagcugagugcugggcacuguuccucuguggucucuuuguagcucaucuuugaugcugugcugaagauaauguacaaggcggugguucccuggagugcagccguggagcagcuggugaaacagcaccuggaaauggaccaccccaaguaagugugcagucugaugcugcaguugacccccaguuuuguuuuccuuugccugucucauagucuugcuaauaucaguacguuuuguuuagagucaaguuauugcaggaaagcuacaaacugauggagaugaagaaacuuuugcgaggguaugggauaagagaggugaaucuccugaacaaggaaauaaugguaagugcugguuggauuggguccucuuucuuguauuuuuaaggcagcauggaaaacugauggaagauuuucauauuuaaaguuaucagagcuagacuuauuaugugggagagagucacacgugugcugugggaagcagauggaggugggggcaaacacaggagucaguucucacuuucugccaugcagacuuuauggugcaaacucauggccucuaacuuggcucaaagcaccuuuauccauuggccccauaaucguagguccaguguagguuuuugauguuguuguuuguuuuuguuuuaauuuuugcugcauuuuaagaauauuuaaggcauuuugccuuuauaagcaagugauuucgggccucugugagucuucuuguuaagauauacucauuaucucuuccagagagugauccgauacauucuaaagcaggacaucccgucuucuuuagaagaugcucugaagguggcccagggguacaggcugucugaugacgaaaucuacagccugagaaucaucgaucugauugacagggagcagguguggagcuuuagguuguguggcgggggcugcuuugcugacuccaucuucaugaagcuaaacugucccagcuacugucaccaaacaaaaucaagaagcucuaucagcauggaagcguuacagugaccacucuauguugcucuaucagcaugaaacauuacaguaacuacuucuuaaguacuuuuaaaaggugccuugugauuggcuaaugguuaguacagcucaaccucggguuuuauacaugacaugggacucugagauucuaaaguaaaggaugugguucugcgguucucugccugauuuucuuagguguuacaaauugaaacuaaggccucaugcaugcuaauuauacuuuucagcacugcacugucaccuuuugucaccuuaaaugucuuuauugcuuuauauucagcagccaugggguugcucaagugcuaaggugaucgucauugcccugggcugguuguaaguuuaguuuuauguaccacugccauucaaaauaggauuuccagauguuuggguuuuuugagucggggucucauucuauggcccaaaccaucuuggagugcuguguagcccaggcuggccuuucagugcccugcugugaaguacuaagauugcuugugugggcucugccaccauaccuaaucuuccaguuaucagguuuaugcuuauauuuuauuuauuuauguacguaugugggcguuuugucuguguacacaucugcacacaagaaagggcuaucagaucccauggaacuacagcuauaggagguuguaagccaccauguggguacugagaaaugaacucagguccucugggagaauucgcauccagugcucuuaaccgcucagccaucuuacuagcccacagauuuuuaaagacaucaagcugucgucuuuuuucccccccauucugcacacuaggcagcauagaucagagauuuuuguuguuuuuuucuuucucauuuucaaguagaaaagaaagcuaauuucaaacuauuccuuguaaggaccagccacuuucuucccuucuuucucacacuguucacaggggggagauugccuccugcuacugaagucucugccugccgcugaagccgagaagacugcagaaaggguuaucaucugggcucgacuggcacugcaggaggagccugacggcucugaggaggugaggcaaagggucaggguggacacgcugggaccuugcauuccaggacagccuagcuccauaauaaacccuuguuucagaggaaaucuuugaagcuuaaagaugcccucaguagagccagccuauucuucuagcaauaagaaaucgugucgcaggacacucaacuuuaaugccaggcagaguagccagccuaugggucuauauaaugaguucuaaaaccagccuggacaacacaguaagacccugucuccugucugucugucucucugacucgaucucugucucucucugucucucucuuucugucuuucauauacauacacuaaaaaagagaaaacaaaaaaaaagaaaccuaauaccuaauuaccuaaauaguuggaguuuuaagucuugagacgugcuucccagcuuuaaaugaucuauuucauucucacguaaaguugugaaggcagcgcacuguagacugcagaacaggggaccuucagugacauuuugguuuauuagggaguagcagagccuccucucagaccccuugggcgcugccaccgcugcugugugcgugcuuugcugcugacuggacagugucucccauggucucgacgauggaucacccccccccccacgucacguccuuuagucaaugcucucccauggucucgacgauggaucaccccccccccacgucacguccuuuagucaaugcuucucuuuugcuuuuucuucugucuuuauugcuaaaagcauaauuaguccacuuaggugacguaagcuuuugaugggccuuguacucugcucucuuaagcuuuuaccugaggaaguucccaacuguuuagugugaccccaaagaaaaagagaggucuguggacuguaguguagucgaaaggcuguggguuagcaucucuuuccgguagcccuaaagcugggguugguggguuuccauacuuagccuuggugaugcucuuagagccuugcagcugccggacuggagcuacacauaacccucagccacuugcuuuauuacuuuccugacuccuugguugguucauuguuuguuuccuuuaucuucuuuuaccucgguuuucuguugguacugaggcugggacucaugccugagacaugcuaggcaaaugcgcucccucuuccccagcccaugugugguuuugucuguguccagcugaggugaucaguuaagaaguagauuucacuuugcauauuuuaggacaaggccuggagaauaucuguggcgaagacaucgguggauauucucaagauccugugugauauucgaaaagguaguuuuccuaguuucuguuccucaacuugguuuuugucccaaaauucacaaagguuccaaugagaaacaucuaauuuuuuuuuuuuuaauuagucaucuuagacuacagcaugugaaauugagaaauuuucugucuacacguuucaugaagcuggccauuguuggacuagauaccugauguagcugucgucuaugauaaggaaaaaaaaacccauguaaacuuggacuuaaaaaaguugaaaaaguaacucacuuaggaagcaggaauauaauuuguuucagaaggaccgccauucuuuuuauauuuuauuuuuuagaauugugugucuguucuuuggguacugcaugugucugucaggccagagaaguugaagacccuggagcuggaguuacaggcggccucggcuuccugaugugugugcugggaauugaacucugauucucuggaagagcagggcgugcucuuaacuacggauucaucuuuccagcccccgcucuuuuauuauaagccuuaaacuucccuuuucuacccccaagaagaagacucuugucacauuugaucuuucuuugcacgucaguuauguuauguuaggggcagugagacggcucaccagguaaaggcacuuagcaggcgagccuaucagccugaguucuaucccugaaaccuguguagauguagcaggagagaacuucccccacagcaugcauacacauacaacacacacacacaacaaauaaaauuucaaaacucuuacagcagcaacugaaacccaccacaaaagacuucuaagcaaaccaaaguuaauuggguaaucucuaagaauacugguuuauugaggccauagcccuaaagacugagaaggccaaggacacggugccagcaucuacucagggucugccaggggccuugcugcaucaugaugugacagaggacaucauggguucagaaguacuaagcuagagccaccaagcacucuggaaacaacccauugaccccugacuggauuaaccugcucgggaugaguuuucagucaccuuccuaugugaaauucagguccugccuccuguuacugugaugacguucuggggggaauucaaguuagaccaugugggaaucuguauaucugcuguaacuuucuaaaauguaauuccagacaaucugcagaagaaggaugaaucugaagaauuccugaagcgauuucaaaugguugcuaguuuacagguaaagagauuaagcacguggccuuaaugcuuucauccuucagggauggugacacacugguucuuuuuucucaacaacuuuauugugguguaauucauguaucacauacaguauugauaacuuuugauauauaguauuucuaguuucuuaacauuauaguaaaauacacauaacaaaaugaugcauucuagcugguucucugccugcauugcagugauaucaguuacauucacaaugcuauguacccaucuccucugcucuuuucacacucagauccgaaacucuguacucacaaggcagcagaacucucucaggguuaagcuuucuuuugcaaggcuccacucagcacagaauuaucuggacucaaaugucaggaguguuaaaauuaggaagagcuucauaaugaugcuuucuuauuuaccuaccuuuuaauguuagcauuuuauaacuuuugagccauaaaaguguuaaacuccuaguuuacuagggaguaguuucugaagcaggggcugaaauggaacgcugaguagacuuauggcugucuugcuuugcugcaggagaacuuugaggucuuccuuccauuugaagacuacagcaacaccgccuugguagcuggccuucgagaacaguauauuaaggcacaggaagcugcacaggcugagcacaaacacaggggaccccccgggcccaccccggcuagggggacacaccugagcaucaagucaaagcugcaccgacaggcacuggcccugcaggugucugaacaggagcuggaggcagagcugaccuugagagccuuaaaggacgggaaggugguggccgcccugagcaaaugcaggugacaccuggauuuccaccucauuugacaguggcauuugcucuguucauuucuuuaccaauaagcacagggccaggacaacuugcguuuucacaaugcaaguuugagagcccauuuuguagccucugucuaaaaauagugucauggaaggaaaauagacccacucaguuggugacgucacuauugaaagucagcuuaguuggugacauaacuauugaaugucagcucaguuggugauuucacuauugaaugucagcuccgggacaccuugacccuuaaggguauacuuuaaaaauagauuauauugccgggcgugguggcacacgccuuuaaucccagcacuugggagguuugaggccagccuggucuacagagugaguuccaggacagccagggcuacacagagaaacccugucucgaaaaaccaaaaaaaaaaaaaaggauuauauuuugucccaugaaaauauuuugaagacuuuucauguguugccauuagugguuagguauaaacacagggacaaacacgugugcuuguggcacgacuccuaacucccccucuucuuucccccacagagauuuacuuaagcauuacugcaaugccgacacugggagguuacuguuuguggugugucagaagcucugucagauguuggcugacgaugucccaaugguggccccaggaggacucagccuuccuucugagauccaugaccucgcaugccacgcugucaccaucugcaguccaggugacaggacagacaaaccucucauguucucugguccauuguaucgcuguguuccaccgcuaucucuugauaacugcguuccggaaaccacacgagagacagcucuccuuacgcuaggcauuauaauuaacaacugagugugguugccuccucaaaugcuugcaguuagguggcugagagccaggaggaucaucgacccugggcuagccuagacuacauagccagaccuugucagucaggaaguccauuaacaaugucauuccuuauauugauggcauuugcuucugugugauccugguguccaugacaugugaucaugugaucccacaugaaucuuuuucaaggcaugcuuaagcacagacaggaacuguguuuccaauagucaaagcuauguggugaaucuaagugguuguuaaagcagucugacgacacuuuccacuuucagauuauuugcuggauguuuuagaacuaaguaaauacacuuuaaccgcuguggagcuuugcagacaaugccagauggaugacuguggaaugcugaugaagguaagccaccucugaguucuauuuccauaaacagcacagcugcuggcccagugucuggcccugcagaucacuugcacaguucauagaaaugcggaauucaucacuugccuugguagccagcauuugcuucuuuguggguagcacugcuuuuccauuucaauccucuaggagaagccggguuugguggcgcacgccuuuaaucccagcacucgggagacagaggcaggcaggauuucugaguucaaggcuagccuggucuacaaagugaguuccaggacagccagggcuacacagagaaacccugucuugaaaaaccaaacaaacaaacaauccucuaggagcuaacaaaaggauagaggagaaagggggugauaucaucaugagacuacuuaacaaaccgagagaccaacagcaaacaacaacccaaugcaucucucugggcccuagcagucauucuacccucugaaaguuaccagaaguccaaauguuacacaguugaagaaacuaucugccagugucaaaaucacaccccuccuagagcaggaggcaaaucauagucagcugcuguccacagucugaaacagccucaucccacaccgcggcuuaaaacuaaaacauagucuuagaauaguucuguaguguuuugguuuuugguuuguuuguuuguuugaagaaaacaaaauuccaaaauuguuacuacauaguuuuucuugcucucuggaaaacuguccucuaaaaagcugugaagccaauucucuuuccaggcaaacuuguucauuuugauuugaacuguuuuugaaauauagggccuuaaccaaggccucuuuggauguugagcuucuguuaagaguuuaaucaaaguaauauuuuauaagucaccauccagaacagaauguuagaauaccguuuucccuuaguacucacagaauugguuccaggcugccucuccccucagagauaccaguaucucugggugcuagaauccuuuuguauccaaaacuaacauuuacacguaacccacguacauuucucacacuuccaacagcuccagcuuuuacugaauaaguuugauccaacauuggucaggucuguagccauagacugaggauucagaguuguguguaaacaucgaaaguguugggcucuugugcuggcucagugguuuagagcauuugccacucuucaggcacugaacuacaugaugcagcugcaagggucuguaacuccugcuccagggcauccaacacuucucucucccagguacauauacaggccuacguauaauuaauuaauaaaaacauuuuuuguuuuuucaagcuguugggcucucaaccugaccccugacucagcuuggguaaggugguaugugcuacagugcaccuaacacugucuuuuccauacguuugccguuaggccgcucuuggaacucacaaggaucccuaugaagagugguccuuuagugacuucuucagugaagauggaauuguucucgagucccagguggugcugccugucaucuaugaauugaucucaucagugaugcccccugcagguagaucacacuugguucauuauuuucuacauguuuuuacucuaugcacgcuggagcucuagaggcugagaaccagaacugcaucccauaagguccguuuauacacuuaaggacccaagugcaaaggaacaccugcggcauauuauuucauuuaggcaagggaaaacccagcucucaauuaagucaugguauuugaugucagggcagggguugccccuagggaugguggguaagaugcuuuucuguugcuguaguaagauagcaugacaaaaagcaacuuauggaagaaagggguugcuuuggcuuacaguuccagaggguaaagcgucuaccaugguaguagaacaaggaagccaagagcucacauguuccaaagcaacagugaagcaccgagaacaaacuggaaacggugcuuuaacauccaaagccugccuccauagcuagcccccuccagcaaggcuaccugcugacacuccccaaacagcgccaucacccgaggaccaaguauucacauauccaagccuguggggacauuccucauucaaaccaccaucccuggggcaugacuguagacggguguguggggcuguggguccuguaaaguucuggcucuuggucuugcugcugccauacccaauuuggcugcuuauagguuguacgcuuaucugggcauauggauguguaguugaaggcuuuuguuuggugggcuggcuuuaucugagggguuuguuuugagauaggacuugcuaugaacuugcaaucugucaccaaagugcugggaugucaggcacgagucaccaugcuuggcucugagguuugucgcucauuuugcuucuuacagccaguguuugcuuuagaucauuauuuggcaauagagcaguuuccaugacaucugaguuuggugcuuuguaugaguuccauuguuuagucuuaguuaauuuguuuuucucuuuuguagaaagcaaaagacauccuuuggauucuauaaguuugccauacugcuccacuagugaagguauuuacaauuagaaauguauauuauauuauaauuuuacaaaugcacaaaugccaggauaacuuaaagcauaaauucuuacauauugaaauuuugaaugugaguuugucauaauccuugauguaauuguuucaugucuuaauuguuauguuuucagaagccaauuauuugauuugucuaauuguauuaucguuaaugacuucauauauuuuagguuuauguauagagaaaauaucuucaacugcuaauaacuuauuaagcaucuaaauuuacacacacacacacacacacacacacacauggcuaaccuaucucauuaucuuguggucuaaauccagccucauguuaacucuucauuuacugacuuugggaaugaauuucauaacuguuaacuuuuuugaggaauuaggucauuccugaaagcaauuuucuaaaacaaugaucauuauuuaaaaacaacaacccaaaaaaaggggugggugggugggagaauugauggcuuagugguuaacagcauggcugcucuuguagagggccuacguucaguucccagcacccacaccaacacuuacagcucccuguaacuucaguucccucugacccgcaaaggucucugcacacccguaguccacacacacucaggcaugcauacauguacauuuaguaaauaaauaaauaauuauuggugaagauaauuauugcaaaucaucucacguuucaggagaaaaccguauucucccucuuguaagcuccaucucugcucugcuccggagccuccaggaauguagucagugggagcuagcccugagguucguggugggcuccuuugguaccugccugcagcacucuaugucaaacgucaugaguaucagcuugaguaaacagguaugacuuucauaaucaauuauuugaccuuuggguaauuccccaaugcucugccaaacagaucucuuuccuguuggcaaaggcaccaaugagugcuuguuaaaugccagauacacuuguugagcaucuacuaagaucccagggcaccugcacacauuucuaucaacagcccugagaauaucugcuuugcaaauauacauauucagaauggggcguguaagaauuaguuuugaguuagguugguaauucuuuaaucacaacacaguauguuuuguuuuguuuuguuuuguugugguugcuguuguaggaguuuuauuguguuauuguuuggggaguaucuugcagcccaggcuugccuugaacuuacagagauccaccugccucugucucccgagaugacacaucaaaggggaccuaaagacucuucuguucuuuucugaaaguuacuugggaagaacacauuggcgaacuccaggcauaucauuauggaauugaaagagaaguccaucacauuuaucagagaaaaugcuacgacacuccugcauaaagugagucucucuucuuggcuuguuguuuccagccagucaggcaaugcuggcuaguguccuaccugccauucagaagcgucaggaaccagugugaccaccaaacacugcugcucguguacuggguuuuagugcaugucaguguuauucuauuggacauggaugcaacuguaaugaaucucugucacuuucuaauggacuaaagcacaccaaugacccuugccuacaguuuacguuucuaucccaggauuucuucacaggaaugcucauuuauuaguuguuuaauuauuauuauuauuauuacuauuauuaauuccccuuugaaucagggucuuguguagcacaagcuagucucaaauuugaauuuaguguguagacaaagaugaccucaaaacuccugauucuucugccucuaagagcuggccucagagguguagccaagccuuuaguagcgucuaagagaccuuuaaaggggaacaauuauuauuucuuguguugggcacuagguuucucuuuguuggucagauuaauuaguaaaauccccccagacaggacugaaacucagucaguauagcucaagcuggacacaaacugccacaagucuucuaccuugcucuccagaugagcucauuaguaucccguaccccguccccacacuggcagagugcucuauagugguucucaaccugugggucaugacccccuuggggugggggugggggagauuguguaucagauaauuaugaaguagcaacaaaauaauguugugguuggggaaccacaucccaggaaacuguauuaaaggggugcagcaucaggaacuuuagagggagccugagaauggcagugccauaguggguaaggugauuucacacauauauguacaugaguacacacuuccaggguuggugauacuuucagaguuuuagaaagaaauuaauuacaauacaaggaacccuucacugauauauuacuuaauaucaagcccuccucuuuucuucuauuuucuauaauagaauuuuuuuuccucguuuuggaaacagaauuucucuccauagccuuggcuguccuggaacuucacuagguagaccagguuggucuugaaaucacagagacccaccugccucuaccucccagguacugggauuaaaggaaugugucaccauugcauagcauauaaggcucucuauccuuaaauauacaguguuuguuuccuuaguguaaagaucucugguucaauggccaugcagauuuccccauugcugaauuuaacagugguuaaacacuuguguuaaugcccacauucuaauuuaauuuugucuccuuuaucaauccugugcuuuugguacaagcucuagacuaacuuuuguacuuaaugaggcagcaaacuacagccugcaagacgagcuuuuagcuuuuaaguaaaguuucucuaacacagggcugugccccuugugugcugucuauggcugcugagguugcuuuccugccucuugagaaacaaugaguuguuguuacagaggugugccuacaaggauaaaauauugacucuguggacaucgucuaaaagccuuggagcuggagcaauagcucagugguuaagaguacuggcugcucuucuagaggaccuggguuugauucccaguuccuacaugguagcucccaguagccuguaacuucaauucuaggagauucagcgcccucuucaggccauugcaagugcugcacacauacaguacauaaacacucauguaggcaaaaaucccaauacauaaaaugauaguauaauucuuuagggucaaguccugguguugauuuaauaauuaccuuuuauccugcuuaaaucugugagucucuaaggugcagaauggucuugccaccauagcacugcaucucucucccuagaguccuccagagccugccguuuuguuuugauuuuagauagaagagauacuguugagucaucagaagaaagagcaaggucuuagguagacaaggaagcugggggugggauccaaugccauguaaaagggagggacagccaauuaggcauagaugacugaugaguggaaccaaagucacacagaccucccagagcaugaacaaagaugguugcaagugcagcaaggcucuaugggaccacuguuacaugagcagucuguugggacuacagcuuaauugcaaagcucacagcuguauuuggguucugaugcagggguugguggauuugggaaaaugugguagggggucagugacuacggaggcagaggaggacucaugggagauuucagauggaccuaaacuguagggagaaggaagagccccaggcccucucuacaaggcucacugaggcugccuuccuucuguuucuaguccuggcugaagguucccuaagcacauuuccuuagagugcuuucucuccaucacugccugaagagcuuggccuuucuccgggucuuguaccucagcuggcggggagugagccugagguccauuuucuguuugcucacggagccuuuguacugaugcuuucuucccguagguguuuaacugucgggugguggaucuggaccucgccuuggcuuacugcacucucuuaccucaaaaggauguauucgacaaccucuggaaguucauagauaaagcguggcagaauuacgacaaaauucugguacgcccugagggaggagaccugcuccuguugccaugcuaagguuugagggacaaagugagggacuuuguuuguaggguucaacuguugggcagaaacggugaucugucucaugaucucuaccuacuugugccugacuggugauaaccauugcuuaaagaauuaagauagcucuuauuucuuaagaaacuaaacagaacaacuguagcugggugcggcagcauaugcauuuaauuucagcacucaggaggcccagacuuagagaccagccuggucuacagaaugaguuucaguacagccaggacuacacagagaaacccuggcuugaaaaacccaacguggccaagcacgaugguacacaccuucucuuccagcacuguugagaagcggaagcaggcagaccuggaaaaagcuggagaacugggugagcagugcauagcacuggccgcucuuccaguuccagacuggugagagaacuauuucaaggaauaggugggcaguccucgaagaaugaaggacgggauuguccucuggcugccacacacaaaucucugugcagccuuugaacgucaccccucuuuaccgaaacccuagaccccauagcaaggcuuuuguguaggauagguacaggggcuacguagcucaucucaguuguucugauugguuguuuuguuuuauuuguuuuguuugggguuuuuguggguagccuagguuggccucagauauauccuuucauucccaaggaaaggugcacuuaauguaacaguauccugcaaaaagccagacgacuuggguuggaauccccagcacugcauaacaaaguguggguuccuaccuguaaugccaacacuugggaggcagaaauaagagaaucagaaguucaagggcauccucagcuacauauuaaacuugaggcuagccugggcuacuugagacccuuucucaaaaaaaaaaagucugugcuauguguguugcagggaggggucuugcuggagagaugacucagcaguuaagagcagcugcugcuuuaccugaggacucaaauucaguuccuggcacccaugccagguagcucauggcuuccuuagcucuagcuccagaagaucugccaccaccuuguagccucugcaggcaccugcacacacaugacauacacucacacagacauauaaauuaaaauaagacugaagagacgguucaguggucaagacugcguacugcucuugcagagggcugggauuuggucccuguacccacacuguaaccccuguaacccugcugcaggggucugaagcgagggaugcuuauggcauccuugaacaccugcacacaggugcgcauacacagagacagguuauguaaaauaauaaauaaaaccaauguaaagaaguagugaccaaacaaacagauauguaucagucugcugcuucucacauaaaggccuauauauaggguuuagggaguaugggcacucaggcuguacauaagcugugucauacuguaccgcuguaccaugugcucagcccaaggcuaugaguuuucuguuguguguagcucuggcugccuugacucuccagcgcaggcuacccuuguccucacagcagugcugccauuacgcagacacugccacgccuggcuuugagguuuguuuguuuuuuuguuuuguuuuguuuuguuuuuuuccccccuuucuggcuuucaucuaaaucguacugaaacuaauacuauuuacaaugcaguuugaucuuguucaaacuuuuuaggcauuaucuuuggugggcucucagcuggcaaaucucuaccaggauauugaaacaggacuuugguuccacgagcucaguaucgaugccaagugggguauucgucuugguaaacuuggugugaguauucauaguacuuugauauuuaaucugucuugaggauuaucuagucugcaaauguaagacaaagaucuuauguauaaagaaauaagcgucuuuucuguguuauuuccuuuucaacgauguuagaagaagccugacacuuuuaccugcuaagcuuauggguguaugucuaucuacauacacacacagcuaaauaaaucuaaaagggacacuuugaggagcuguagaaaguggguuuauaaaauaacaguaaagucaaaaggcguguuauaauguuguucguuuuguaacacuuuuucauucagaaguuguuuuuuauuucuuuuuacuuuuuuauuuuguguucuuuguuucuagauuucuuuucagccugcuuuuagacaaaauuuucucaccaagaaagaccuuaucaaagcucuugugaauaacauagacauggacaccagccucauucuggaguauugcagguaaucuugaaaugguaaugguggcauugcuguugguuuggccagcucauaaccuuugcuuugagaaggccauagacaagguucaugcagcccagagaccucuggcuuccuucucugugguuagucugagcagacaaagccagguuagauucucuggagauagauuuuugguuuacuuacacccugaugaguauccaagcucuuggacagaaauaucgaaauucugaucugagcucauauuguaucucacauauauauccccaggauucaggcaggagaauuacaaguucaagaucagccugagcuacauagugaaauacuguagcaaaaauuaaaaauguagguuucugggcuuuuucucccuggcauucuugacucugugggucuggacugagaggcacugaagucuugaguaucuuauacaggcgccauguggauucccucuuaccugugggaaccauugcuaaguaacuaacaggcaagccacauagagagccuggauacgcuggacaaagugaggagacaaggaaggaagacgggcaggugggggaugugugauauggucguggucaaugucaaauaauuaagugaccacuucuaaaguauuaaaggcacucuccuuuccgacuugacagauaaguggauucuuggugguggggggggguuuguuuauuuuugaguuagaaucucacgugucccacaguaacuucaaguuugcuauguagccgaggcuggucuugaacuucugaugauacuugcccucaccuccaggugcugggauaacagaugccuaucacugugcugguucagaucugagucggucugcuuuugguuuggugcuagggauuaauuuaaacccauguccucaaguacaugggcuacacugcacccugagccccggugccucuguuucugcaccugucuaucagagccuggucuggacauggaugcguuugagauccgccuuuaacuaacugaccgcuccuuucagcacauuucagcuggacucugacgcugcccuucggcuguucauugaaacucugcuccgcaacacuagcagccagagccagggagaugcugccccggaguccacaaagcaucagcauuccaaacuccuggcgaaagccacugagcuggucccuuuacugaagaacacaaaggaucuggugaucagucuuagugagauccucuauaagguaggugaauggaaacauggacaccuggucacccucucuccucauccuuaguuggauacauguucuaacaaacuacauaccuaaguccugaauuuuucaguuuuaagauagggucccacguagcccaggcuagacucaagcucaguauguaggucuuaaacuccugaacccucugguucuuccacucaaguguuagaauuauuggugugugccaccacacugcuaaauccugagcgugugugugugugugugugugugugugugugugugugugucuguuuguguagguacugguacccucagaggccauagacuugccagcagcuggacuuagcaccaguaacugguuuaaacugcauggcauggauacugggaaaccuggauucucuguaacagugcuaaccacugagcagucucuccagccuuuauuuuuuuauuuucacacagcaaucaccuuuuaagauagcucuucccuccuccugucuuaccuuuuauucuccccucaaaauaaagcagcauucuccauccgaguuguucgguuugucuccccucuaucuauagcuuuuugagaauggucucacguaguccaggcuguccuggaucuugcuguguauccaaggguaaccuuggacuccucuccaaguacugggauucgagguguuuggcuucucagguuugguuugguuuucauuuuacauauuuuuaguuugccucuguugugccugcaguaugcacaaggaggucagaggacaaacaggacuccguucuaccuagugggaucuagggauugaauucaggucgucagacuuggcagcaagugcugucgcugaaccgucucuaacccuccagcacccgaaugaugagacuuuuuaaucauuaugaaagcuuggcgggcucuccacgagcucaucuggguaacccuggucaucugucucugucccaccgcauggcuuguuggucaccucuccugcggucccugauuccguuccuucugcuugucuggcuagugcaccacccaccuaugacucugucccagaguucuaucccaccuccauccccaugucccgccuuuccacuccugcgcugcuauaggcccagugccgguccuauuuaguaccccacuuuugggggcaaauacugcaucuaaccagacuuucaugaauaagaugucuaagccauaugcuuuaauauuauaaagaguuauauugaaugaauauguuuuccauguguguguguuuuaaugaaauuuuuuacaaauugguauuuaaguuaauaguugauuggaugauugggagguagauagcagaaguaagguuaucaucagacuguaaggugaauuuuaguuuuauauuuugccuguaagucagccagaaauuauagacuugcuuaaauucccuuggucugauagauugccucccgacuugauaauuaugugcuuuuaguugaaauuaaaaaaaaaaauggaaaggaauggugaguaggcagaaacgagaagcugagagaacaugccacgccuuaucuucuuguaagccuagacagacgccauccagguaauucuugcguuacgaggaugacgaagcuaaaacagagucccccaagagccucggccauggaggcccacgcuguaguuaaggcacuuccaaggcaguuuuccuguuuucauucccaucaugaggagaacaagugaaacuucaauuucaaacucuugaaaaaaacaggaacuuugaccauguguuuauucuguguaucuagugcccgagagacaucugccuuccaaggauugccuuaugcagcuuuucaaaacauuucaaauauggaugcuuagcuuagcagagguagcuucagagcagagaacgcuccugugacaggcagccugggcacagcuuagguuugcucugugaaccaaugaugagcacugccaaagagagcauagcgggccuuccaggguuuaaccgcuucugcuugguuuguuuuuuuugcagcuggacccauaugauuaugaaaugauugauguuguccugaaaguuuuagaacaagcuaacgaaaagauaaccagugugaacaucaaucagguauggaaggacguaaaagguugaaaacucaucucuguggcuugguuuacuaugaugauauaauuuauaauauauguuauaauuauuauaaaauuaagaauauugugcauguucuuugaccucccuuuagauucuaaacuuaguuuuagaguuccuagaugcccuggaacucacguuguaggcaggcugcccucagacucucagagauucgcuugcccccgccucccaagugcugggauuaaaggcauacgccaccaugcccggcaauauauaauacuguaauuccuuaagaaucuuauacauggggcuggagagaugguucagagguuaagagaugguuaagagguuaagguugacuguucuuccagacguccugaauucccagcacccacauggcggcucacaaccaucugugaugggaucugaggcccucuucuggugugucugagacagcuaugguguauaagaaucucauacaugaauacaauguguucaaaaauaugaucuucuccuuccccaacucaucccucauaaacuccugguuuucuuuaauucauuuaucauuuuuauuuauuuaaggauuuuugcuuuuucuauuuuuuaacagcuuauuaugaaauuuguguaagcguguguguuugugugugagagaggcugggugugcagguaccuaacacaccauguggaaguuaaagacagcuuugugaagucaccucuuuccucuccaccuuuacauggguuugggggauuaaacccagguugucagaguuguacagcaagcaccuuuaccugcugagcugccugccucucucucucucucucucucucucucucccccucucucccuccccccuccuucccucccuuccuuccuuuguuguuauuuucuuuuucaagacaguuucucuguguagaccuggcuguccuggaauucacucuguagcucacucaaacucacagagauccaccugccuugaaugcuggaauuaaaggccauauuuaugcuuuuuuuuuuuuuugaaacagaaucuuauauagcccagucuauuuucacacucauuguauagccaaggaugaccuugaacuuuuuuuuuuuuaagaauuuauuucuuuauuuuauguauaggaaugcacuagcugucuucagacacaccggaagagggcaucagaucccauuacagaugguugugagccaccaugugguugcugggaauugaacucaggaccucuggaagaacaguccaugcucuuaaccacuaagccaucucuccagcccugaccuuaauuucuugaucuuucauuuuuaccucauaguccuggggucacaccauuugcuaccauaccuggcuaguuccuaguucugucuauuaugcaguagaggauuuuagggucagccuguaaaacaugauaaaauccuaccucaaacuaagaugaauaauuaaaaaugaaaucuucugacuuaaguguuuuugacgucuguccuaaacuauuuugaagaauuuguauggaacugcccaagucuuauccuaugagcaagauggcaccuugauuccucuuaaugugauaucugcaguguucauagaucaugcuuuaggagacagcaauagauuagggaaaacucgaaauggauuuuguuuugacuguguguguguaugugugugugugugugugugugugcguguguguguuuucaggcacacgcacgugccaccacguacauguggaggucagaguugguuuucuccuuccaccaugugguucccuguguuggaacuccgguuggcagcagacaugguggcaggugccacugacccuagcagagacugugaagauugggaaaugcaugcggugcagauguugcagacacagcggcccuuauaggucucuugcuccuuuccacacaggcgcugaaucuucugagacacuugaagucauacagaaggaucuccccgccaguggaccacgaauaccaguacgcgcuggagcacaugaucacucugccaccggcugcucacacuagacugcccuuucaccuaauacuguuuggcacagcacagaacuucuggaaaauucucuguacguucauuaacuugugaugaguuucgcuaaguggccgacgaauucuuuucucacuggcaugcccuucugcuucccccuccagccucagagcucagcgaagagucgcugccaacccugcucuuaaucgcgaagcugaugaagguaauggguagagcaucccgagagggcucuuuguaucucagucaagccucagccuggaccggggaucugacaccacuuccugccucacugucucucuccucuuuucugaaguucucccuagauacucucuaugugucuaccgccaaacacuuguuugaaaaaaaccugaagccaaagcuccugaagucggcacaagccagguccuccacccugaugagcaaggaaguggauaagcucaugcagacgcuggagucguaccuccuguccaucgucaaccccgagugggcugucgccauugccaucagccucacccaggaagucccagaaggucugccagcccucugcucucgggacucgggugcucgcugacagcuuucuuuggguucuauucccuuuuugcagauagaucuggggaaucucucuggggucuuguacaugcuaggcaaccguucugcccuguauguuguuucucacugcccaccggcuagaugccagccggagcucccaguauaucccaggguuugaagaguuugucaggagcugcccaagucuuacccugugagcaacaugguggcucgggcacacccacccgugacuucuuugcaaagauauccaaaagggcaacguggauggugucgugcucucuguccccguauccguagggacguccucgagagaagcaucuauuugugugcuggaagcugaggaagggucucuguggccuucaguuuucaugcuguagccuucugucccaguuaccucaacuugaauuuuuaccgaguguucguuauuguuuuaaaguucuugcugucuugcuaacaaguauugucucacaggauucauaucuccucaugaaccuccaucuuuccaggccccuucaagaugucuaguuugaaguucugccuguauuuagcugagagauggcuacaaaacaucccaccucaggugaguccgaaccagggaacuagagugccucuugcuguuuccgcaaagccaugguugcuuagcaucugucucaucacccccgcccuucagcccgguacccagcaaggagaagaaagcccacaguugcaugugauucguguuuaaggguauaaauaaaguggggcaggccugcagucacuaaagauggagucugucucccuagagaguuuuacagucaggcuuccuuuccguuucgaacgcuguuacaggaugagacgugugaaaaggccaaagccuugcagaagaagcucugccuccagguccggcucucaggaacggaagccgugcucauagcccacaagcugaacgaucaggaauauuuaagagugauagggaagccagcgcaccucaucgugagccucuacgaacaucccagcauaagcgaaaggcuuuguaccacaucuggcaaagauuaucccggugaggaagagacaguagugucugguccagaaaaggugcugucuugauucccaguugucuucagccaaaagcuugaguuucccuguuguacuuuuuuaucuucauugucuuagauauccauacagccgcuaaagaaauagccgaagucaaugaaguuaauuuggaaaaaaucugggacauguuguuggagaaauggcugugccccucaacggugcccagugaggugagugagcaagcaagcaagccagcacucacagcccggguuccugcugagauaggagcugaguguguucuacacaagacaacccugcaaagaaggacagacuaaccucccuuccucccucccagacagcagcucucugugucccucagacagcuugcauaguuauccuaguaucucggccuguccagugccgagagccaagugccgagagcauagccugcccugcacaccugacucaggcucuaagaucaccuguuaccuggcgacuguuaaucaaugagacuguuaguuaaugaggcaguuuguccuuccuuucuguuacucuguggcuauuguacccuccagccccugacuucagacgcauucucauauaagacuuuuuacuuggauucaugugguuaacuuuuuacuuugaguuaauuuaaaaugaaacagugcgggaauauuccuguacaccuccguuaguuauuaaucucccuccauauuuacuuuauucucucuaacuuuuuacucauuucucuccacuggggaauauacuacaugugccauauucuugacacuuuaauauuuaagugcauauuuccuaagagcggggauuugcuuaacuacuaccauuuuaauuuuaaaaaucagaaaaaucucagcaauugagagguagagaugggaaggucauugcaagugugaggguagccuugucuaccuacagaagacccuguccuaaaaguacagauuacagaguuaaacgugguacagugcucgagucuauagccucucuuaaauuuguuuguuugucuagacaggguuucucuguguauccuuggcuguucuagaacucacuauuuagacaggcuggccuugcagucacacagauccuccugccucugccugccgagugcugggauuaaagguguacaccaccaagcccaugaccauacccggugauacugggaguguuggcugguuguuuuuuucuaaacuguccuucuguuuuggucuaccuaauauuuuccuaggauagaaucugauuuuuagccagggauccucaugcaugcuuucaaccucggcacccagcaggcaaaggcaggcugacuucuaugagcuagaggccagcaugcucugcauagcaaaaccuugucucgaaauaaucauagaaaucgagucucaugcugcauaaaugauauuaggauaugauauuuggaagaauaggauaaucuguuuaaccuuuauggguaguauuaauuuccuugggguguguguguguguacagaggucaagggacaacucuaucgaguuaguucuaucuuuacagguuauauugauuuagauacauaucuugguauaguuguuccuucuucuaauagauacaguucuuccuucuguaguuacuaggggaaauacuuuugagaauacaguauaaagucucuacaaaaucauucuuuaucuuaucuacccaccccucuguguuaaccgcugaggauuuuuuaaacacguuuuagucaugguggcacauuaacaguuuggagggugugggcugauggcuuuuagaaaaugucauuuuugcuuugcucauauucuucugugauuuaacagagguuaugggcuuuagucaugcuguauaggugauguauaggugaugaguaggugauguauauaggugaugaguaggugaucuuuaggugauguauagaugaugagcaggugauguauaggugaugagcaggugauguauaggugaugaguaggugauguauaggugaugaguaggugauuuguguaggugauguguucuucugccacaugauguugauguuuuuagaaauagcgaauuucacauuuguggaaggagcuagcaaucucaauccagauuuuucaauaguuucucugaauuuucagguagaauuuaauaaguaaagccuacaauucuguucuuauguaggaagauaauauucuugaaauguauuuguaaaaaaaugguauaaccacuaugaaauuaaguacuuauauuuagugaguuuguucgauuuagggugcuaauaugcuacccaaacuuguuucaauucccagucaaacguaguuccgcugcagccgcccagguagcugagguuagcuguaguuggcagccagcuuuuauuugguuuuguuuuauuguccugacugauugauuugccugcugaauacuguagucauugaaugcuaagccuguacucuaccacuaaaucguauccccagcccuuggcauuuaacuuauuuuuuuaauuacauccaaauugccugagggaauuggcucucuccuaccauguagguucuggggaguggacuugggucuucagacuuggcagcaagugccuuuacuugggagucaacccagcagcccuguuggauuuuacuuaguagcuuuuauuuuauauuaauuuuccauuucaugccaaaaugugcugcugcuguuuugacaauagauuuuugaguaccccaggcuagacuccuguucaccauguagcugaggaugaccuagaacauauaguaccucccaaguggucuggggugugugcuaccacaccuggucugugcuacgcugcaguuugaacccagugguccauucuacugugcaaacacucccugccugagauccagcgcuagccccguucuaccaagagcagugacugcuucagugggaacagaauguaagcgugugucuaaaucgagcauuucuguguuccaagcucacagaagcucagaguagucagcucagagaaccuggcaacugagaacuaugccucccaucaagccuggcacagugcuuucugagucccgaugacaaauggcucauuuaaacucucugggguggcucagugacagaacacuuggcuggcaugcugagauccugggcaccugggaggcugaggcacggccggagccggccaaggcuacauaguaagacggacuaggaucaaaggugugcgccaccaggccaggcuccguuccuuuuaaaauuuacccaacaaauguaagcuccacaagcacccagauguuuguuuugucuucuuaggccaugcauguacucagagguacucagaacauauuucugugugagugagugagaaaggacccccuugucaagcagaagacaucaccgaguaauuuacugcaauguguuguccacauaaacauaguuugcuuuuuguuuuuaaaucauuuuauuauauuguauaugugaguauuuugcuugcaugcauguacauaugccacaugcaugccugaugccugccuaagguuaaaaaaaaaaaaagguauucggugcccuggaacuagaguuagagaagauugugagccaccaugugaguguuuggaaucagacucaaggcuucugcaagagcaacgagugcucuuagcuacugagccagaccuccagucccaugaacauaguuuuguauuuggguuuuuggucugauguauuacacuaagaugacaguuuguguggucacaaccuucaguuuuuaaccuguauccuucucuguucucgaagaaagcaucggaguucuuugagcuggaagaggaugaagugcugcauagguaugaauucuuucauuguacuggccuugacacccagcagggaccuuauggggacacugaugugauguggcuccgagaagaaucagggcagggaggggagccauagccaagacuguggguuugaaccccugcgaggguucucagacuuaugcagugccaggcaaggggagacucuucugucagccagaaccuuugccccgggcccugugugcucuggaauucuagaaaaugccuggcucagauauaagacacugaauccuuugucugagaccccggucuccggaguugagugcuugccauucgaugugcggagucugagugcucuuggcuuguucuauugagaagacuaucuaggcuugaaucagaagggaugugguaaccacccaucaccaguacuugauuccagcaugggaagagcgcauggugguaagcugccagcucuuaacuaauccucaccgagaccaccagcagcugagcagccuggggagccccgcagcuuccucuccccuggaaaucaaauagugaagacagacuugcaaagcccagaacaagaaaauaauuguuccuaguuuugaacagagcuggcuaccuucguagucuccgcccuccuucccuguggcccaccucacacugcuguuuagaaaagguggauguuugaggggggggggguuguuacuuuuauuugcuuuuuguaagggucuaacuguguccgugacaggcagaaccuacaucggagucaucuccuugguggucucuugggguucauaaaugcuuccaggcucaacauagguaguuauacugaucuaaaacuugggaaucucugccccagccuccccagugcugagaugacagccaagcaguaccaagccaggcuucccucccagcccuccagauaggguuucuuuuuguaggccuggcuguccuaggacagagacccuccugccccugccccugccuccugggcccugagauuaaaggcauuaaaggccacuacagcaggcuucuugcuuagacuucuaaggguaggugcaccauaccagcucauauacaguuccuggccuacuuaacggagccaguuauguggugagccuuccaagcaaugcagacagugacagaagacaucuccaaagcacugagacaucaggacuucugucuuuuccaucugaaggcccugucuccuccagcuugucuaauccuuccaggccuagggcuagaaucuaaaaggaaucacuuacaagguccuccugggucccgggagaacagguuuucccgugugugacacucacugugcuguaagcuguggucagugucaguuucaucaguaauacuggaaggcugaguggcuaugguacagaggagaacgcuggaaggcagcauuugaucugcacauuauccucuuuagcuguaaaggcagcucacaaccaucugugacuccaguuccaggggaucgcuuguucucuucuggccucugcaagcaccaggcacacauaugguauacagucacacaagcaggcaaagcaugcauacacauaaaucaaauaaacaaaauuucagaauaagagagacuaaaccuccuuugaaagggaaaacaaaagugccaauggcccguaucuuccuggcugacaucuaggauguugucauuuacugugggcagaaacauagcuccauuguauuaggaaucuaucucugaguuuaaaaaaaugucuuucuuuuuuuuuccccuccagagucguguaucuccuccaggcucguccuguugauuauuguucgagaaugcuguuuguauuugccacuucagcuacaaguguaagcucuagagacucaaccuauggccaucucugcuuggcauuuucuccgugugcauuucucacuucuggcuucauaaacacaauucagaugacacgcucaccaacacaguucugggugauguuaucccauacuccgggaucucucaguauaccacgcuccaguuagcacuccggccgcagcaucugcucggcaggucacaugaugcaccugagguagcucucaaaggugcacuuuguucaucgugauuaacuucccugagcagucagcacuccugauaccaagccacuauacaaaccgacccugggaagaagcucuaccaaccucgugacccugugugaccugcuucggcccuacucaccccccagccucucuacccgugugaaacugcagccucggggaggggacacacaaacucaugagucuucaggaauuuuccuauagcgacucuguugguaguuuugauguugagaagaguguuagaguguuucuuucuuucuuuuuuuuuuuuuuuuuuuuuuuuuuuuugagacacagucuggcuuagacuguagccucgauugaucucaaagucuuggaaacucuuggcgcuucucuugccucagucuccuuaguacuaauagcaaaugugaacuauuauacccagcuaacaauagcuugugaagcgaagcagcuagauuaauagaaggugaggaaccaugcguacaugguccucagaaggacgagaggaaaaucugagauacuggauguaagcucaccacgguuccugauuggagucuguccuuuagucguucuuuuuuuguuuguuuuguuuguuuuucgguuuuccgagacaggguuucucuguauagcccuggcuguccuggaacucacucuguagaccaggcuggccuugaaaacucagaaauccaccugccucugccucccaagugcugggauuaaaggugugcgccaccacugcccggcuaaauuuaauuuucuuaaucccucgacuccuguacacaucauguuaaugaaccaucucugaauacaugucgucguuaauugcugacgauacauucacuaauacucuucuugacaacauggacaguucacuuacaggcaguaagugaaagcaggaggaaagugaaagcagcuccugcagggccauugaagcaacaccagugcuacuuaaagacacuaaagggcgggcguggugcugcacgcccuuaaucccagcaugcgggaggcggaggcaggcggauuucugaguucaaggccagccuggucuacagagugaguuccaggacagccagggcuacacagagaaacccugucuugaaacccaugccccccaaaaaaagagagagagaaaauuaaacuuuauugcauuucaaggggaagcucucuuugguuuccagugcuggccacggcugggagcagcugggagucgcugccuugguucuguccacagucuuagccaucacugcauuagcaccaguaaugcaaagaacaagggggucucuggaguuccuuccagggucgaguuaguguugagcugcuugcucagcucugugcugguuaacagcagagauaauugagcucaaguaaaguggaaaaauaaccaagggaauggauguauuuacugccuaaguugaagucaguugccuggcugaggcugcaguguacagcuugacucuccaagccucuuguuuuacagacacugggcaugcgccagcuaacguuugcccacaaagcacgagcucugcagugucuccucuauuuggcugacaaggaaacaauugaaucucucuucaaaaagcccauuaaagaaaugaaguaaguagagcuugauguauuguuuuagaaggaaguaaacagacuucaucugcuuauaucugagccauaacuuuugagcccuugauugaauuaugugggugcuuaccgguugcuauguaaaugcaggcccauuaucuugauuguugauauuuuagcaaaggcaaagcaggccuauaagaacaucuuagcaacauuuggaaguugacuguuuccuuguucaaauugauuucuauuuaagcugcauccucugaagauaccugcagccuaaauggacaagaaacaacaagcuagcccccuguacccugcaguaguuuugguuuuagauuuaaaugugagccacaagaacgauccuuacaaagaccucuguuuuccagauccuaucugaaauguauaacuuuccuggcaucauuugagacauugaauauucccaucacauaugaauuauucugcaacagucccaaagaaggcaugauuaagggcuuguggaagaaccacagccacgaaccuaugguauguagucccuggccguggcgcuccugucuuuaccuaugcagugugugucacccagucacccagccccccagaugcccaaagaucuuuuacccccaguaggucuaaugcccuagaccuuucuguagguuugcaucccacuauauggaaugguaagacaauauggucaguccuuuccauucuuagaguacacagguuagucaugcuugcgagcaagaaggcacugucguacuuccuuccaaggcccacucuagagggagagguccccuucucucgugcuuaguugccuuugggagaccggucacugaugccguuggagcugggacagguaugaggccagcaggcauccuggguuuuuauuauuauuauuauuguuauuguuguuauuguuguuauuauuguuauuguugaauuaggagcugaaaacagugcauuagacauuuauagguuauuguccguauguuuuaugaagguacccugccuucuuaaaaggcugauuggacugacuuacugacgucucaaagcaaugugauguuauuguuuucuugucuggugguuuggcuuuuaggcaguacgauugguugcagagcuuugcuuagaauacaaaaucuaugaccugcagcuuuggaaugggcucuugcagaagcuucugggcuucaacaugguaaggcuugggucuucccgaugcacaacauccuaacauuacuaagcuaacaccggcuagcuauguauauugaugcaaacaucugcucuugggcuccugccagacuauuagagaaagucaaacucagaaugaucuugaggggcugggaacguagcucgaguggcugccugacuagcagcuuaaagcccagcaucacagaaacugaacgugggguccagagucaguaaucccagcagucaaggaguagaggcaagagaaucacagauuugaggggugcucauuugcauaucuaguucaaagccauccugggcgacaugagacccugacucaaaaagaaaaagaaguuaaagugcuguacaccugcaaucccagcucugcugugaucgcccaagaauuuaaggccagccugggcuguggcugaggccccgccucaaaaauggguuuuaaaacaggcuaauacuuuguguuggcacauugaaauuuaguacuuugggagucuuucauuuuggaauuucccuuuuacagauuccuuaccugaggaaaguguuauccugcauuucuagcauccauucguuauggcagguauguccuuucucuuuaagguacacgucaucgaguuuaaucucugagcuaggucgucuaagggugcccugugucaagccaucagcuucuuccuuagugacacggacgguguaggauggcguuccgguggccucagcugcugcuuugccugguuagggcucugcuuucugaguuccccaggcugcaugagucaccuggcacugcucuagcauuugucacagugccauugauucuacuuaaguguugguaggaccgcacccucauagaccuuacugaucuugaaaguuggggucuuucucuguuuuaucguguuuagucucaugaguugugcaccucauaaucaucguacagaacucgaucauuuagggagccagugagauggcucagugggagaggcgcuugccaccaagccucacaacuugaguucaaauccuggguccacuugguagaaggagagaaacaacacccccagguuguccugugacuaguguauauacacucccuugcacauguacacaccuuuucaaaaagaaguagguaauuuauucucaguuuacuaaaacagcaugagaauauuuuaaguaaaacaaaaaauucuccuucacuucuccuucgagacucgcuuuccuauuacacaaacauuggguguauguacucauaagugcauuuuauguucuuaaaacaguguuuaaagugcuauuuuucuucaguuauguguaugugugucugggugugugcacaaugagugccaugcccgagcagggcagaaaagggugugagauccccuaggacuagauaaaggccguuugagcugccugacguggggcgggcacugagcucuguccccugcuuaagcucaugaccauggaguuauagcucuagcuuuaaaggugcuguuuccaugugacaggcccagcugggugacugucugguccaggacacguaggucuagcauuguuuacuaagguagcauccuuuucaaggguuuaucauuauguggcuuuacuacauuuauggacuugaacagccaucacgauuagcuaguaugacacuguuguccucucuucagaaggaaaccucggagcuggaucugggucuugagguagcauacaugaggccaguccccagaacugccagaagaaggaaaaggucccccauaucuggcagccaucuuccccuccuccuugaccccagugacuccucauuuuucuuggcuuucucugucuuagacauuucacaucugauggcucacaugaugagcuccaugucuggcuccucuccuguaaccucaacgcuacguugugucuuuuuuguucuucauuucuucuaucaccuguaauaauaacagacccuugauuuccgugagggcuacccuaggaucccagcaccccucagcaugccucagcuuuuuuuguuuuguuuuguuuuguauguuuuuuguuuuucgagacagaguuucucuguguagcccuggcuguccuggaacucucucuguagaccaggcuggccuggaacucagaaaucugccugugucugccucccaagugcugggauuaaaggcaugcgccaucacugcccugugcgccgugauuuuugcucuagucccauauaugaaaaggugugcuguuugaaugcaacauaccuacuuccauuuuuauugcauuuuuacauaauuaguguguguguauguguguaugugcaugcacaugugccauauuuugugaguagcagucagaagggaacuuacaggagucaguucucagcuucuaccauacaggccccucaggccaaacuuagcucagcgcuuggccaccaguacugucacccagugagccagcuggccagcguauuuuaagucaacucuagauuacucguaacaccuaacgcugugcacuguauacauaguugucacacagcagcggguaggaaccaugcucaauccgggcuucccguucugugacugugaaaugagugucuaguguccuagacguggguucuucagugcccguguccccgcaggugcccuacuucagcaaagcguggcagcgcgugauccagaucccucugcucucggguaagugagccuccagccucucaacccgacaguagcaauuugggguuguuuagcauuaagacgggguuuuguacuauagcccaggcuagcuuuaaacagcgucagccucccaagggacaggauuacaggcugggcggccaugccuggcugaccauggcauuuugauguuggagugcucacauguuuaucaccuuuucucuucagcuuccuguccuuuaagacccagucaguuagcagacugcugugacagucucgucgccauccuugaguaaguagaugugugcucuccucaaguuccuuuccagugggcuucucugagcacaguggucgcguauccaugguuaccuccuaggcuccagucauguccuguccaccgccaucuuucacguucuccuguuuuguuucuacauaggguuuuauauagcccuggcuggccuagaacuugccgugugcugagacuuuugauccuccugccuccaccucuggagagcugggauuacaggugugcaccaccacacaucgcuucagaaacucuguuuuauuuuguuuuaauaaaaggucucacauagcacgagcaggccucagaaccuaugugcuuuaauucuuuuugugugugugugugugggggggggggguucgaggcuuuaauucuuuuaauuccuuaccuuuaauucugccuccagcucucgggugcugguauuacaggcuugugccgucauguccgcuucaaaguagugcuuugugcauucuaggccagcacuggaccgcccgagcuccauucccagccccagaaauaguucuaaagucucagauuauauaccauucuuuuuuuuuuuaauauuguauuuauuuuauguauguggguacacugucaccgucuucagacacaccagaagagggcauuggaucccauuucagaugguugugagccaccaugugguugcugggauuugaacucagcaucauuggaagaacagucagugcuccuaaccgcugagccaucucuccagcccuauauaccauucuugaguagcaugaguuaauggcaugcccucccaccuuugcccaucaaagcacacugugugugcugccuguccaugaaucaccugguggcucucacagcccuugggucccaaguaagucuucuaguuuacgaucacugauauuuuacugugccucauuuauagguuaagccuuauuacaaauguguaugcauaaggaaauagguuugggcagaauccgcaguuacgguguccaguggaauugaaucauccaaauaagaaagggggcaacuggccuuuucuuaaggaaguuaagcugacauuuacuuucacuaaaugcaccuauuauuuuugcaaugccuacuuuccacauguucuggaaaguucucucagaaguuuccucacacuuaugaguuuagagugccucuugcuaaguccuguagcauugucacguggacccuggcaucuacaaaguuuguuuauuuuugcuccaguaccacccgagacaggguuucucuguauaguucuggcugcccuagaacucacuuuacagaccaagcuguccucaaacucagauccuccugucuuugccuccgagugugggauuaaaggagugugccaccaugccccgcuugagcgucuaagaauguauccuaugcaucugcaggugucugggcaucgucggcaugcagacagcagucuguguccuagaagaagauucuuuuuuuucuauguggaaugcucucaaaggcucuuuccuuauuaguaagaaugugcugcgaaccagcacguaggcauuuaaaguaguuggcaguggccaggaaacaucuguggaaauggaaaaaggcuaauguggucuaauaaaccugccaggccauuaacuaauuccugcccccucucaaagauguccaguuucagaugaccuggacaugaugggagucgccaagcaguacguccaguuagaccuucccgcuuuugcucugaccugccugacgcucaugccccacucugaaaaaagacaccagcagaucaagguauggucugcauucguucguucuuccucucagguugccagggcacacugcacgucccucagaagacggcauuuucucucaccaaacccauacagcacugacacuuagugugggugaggcgggcuaacgggaagcaacaagaucaauugaaguacaucugagaaggauaucuuaaaaagaguucggccauuauucuguuaucugggagaaacugguuuucuuggcagagcacagugaacugagaaaaauuguuuuagcggcugucuucaagccagcuguggccacagcuuuaucaucuuuaaucccuguacucaagaugcagaggcuggcagaucacugaguucccgcccgcccgucuugguugccucccaagaccuuucuucuucucaccaaaagaaaagaggggaggggggaugugcucaggauguaaagugcagaguggccuuguaacccauuguagacuggauagguccagaagggugguaacacagaggcugucgaaggccucuagcuaaaaccggagaggaaggucuccuuggugggagguuggucaucagauugagcaagguaaggaggccucuaaggagggauuugugguuugguuugguuugguuuuaguuugguuuaguugguuugguuugguuuuuuuuucuuuauuuuauuuuauuuuauuuuauuuuauuugagacaggguuucucucuguagcccagacuguccugucacucuguagagcaggcuggggcuggagagauggcccagugguuaagaggguucaauucccagcacccacgugguaacgguagaccaggcuggccuagaacucagagagauccaccugccucagccuccugagcacuaggaguaaaggugugugccaccacugcccugcuugaggcagaacuuuuaaaauaauucuuaggacaaaggcuucugaaaugucuccaguuauucgccuccccaggugaaugggacagcaguggucugacuaaccaagcacgcacgcucucauuggccaccuggcuccccaucccguuugcugucaaggcugucugcgcuggucuuuaacuguuuugauuacucaaccgcaucucgcuacuuuucagcuucaggacguaaauacauguugccaccacagauaaagccugauaaacagcuucaucuuuugcauaaguuguauaaaagcacauuuuuuucuccuugucugggcaauuuuuuucaauagacguauauuagaaaugaaaccaucuuaguuuugaaauuuuuaggugaacugaugaacuuuuaguguguauggaaaugaccccgaagggaguugcacaagcccagugacccccacucuccuucaucucucccgccccacaaccacccuucuuucuugagaccaaggucuggugagccaggcuggccucaaauucacuguguagccaaggacagccuucccccuggugagugcugugacuacagguacccuucacugugcucaguuucuuaagucugaagccagaacauggggcucggugcgugcugggcggacacucuaccaagugcccagcucccaaauuuaaaaaucuuaaagaauuuaaaagccucccagacuuaacagcacagcauuacuauaacgcuuuuuaaaguacguuuuaauuuuuuuuuuagaauuuucugaauuccugugaugcucggaucauuuuacagcagauagaagaacauaugaacacuggccagcuagcaggguuuucacaucagguaaggacaauuccccuucauuuuugcucugucugaucauagaaggugauucuuaucccccaaauagucuuucacucuuaaucaaaagcgucaggcacuggcuggggaugugacuuagggguaaagcgcuccccuaacguacucaagaaccuggauccgguccccagcaucacgugaagauagaaacgacaggugcccuggcuggcuuguuuacuguugugcccacuggagaauugugcccauaaauaucggcaauuaaaucuucuuccccauuaaaaauagaaccugggugcacaaccgucgguuucuguuugugugcugcuaggcuacgcccuuucucccagaggcuuagucccagcgcucuaguuauucaguuucugacugccggaaaccuguuucggcaaagggcuuacaauuaaacauauuuuaauaugaugauaacugucaucccauagauuggaagucugguucugaaucauguuguaaauaagaaggaauuugggauuuuggcaaagacaaaguauuuucaguuguugaaaugccacgugauaaacaccggcaacgucacugaauugguaaacuauuuggcaaaugacuucagguaaguuaaugaucaguuuacuguagaacuucuuaaaacggaucuugauucugcagaaagauggccgcuauaaagcuguuuggccguagccgccuauugagccguagcguuccuacacauucccuggaguucaggcuccugcagcuuggaaccuuggaacacgaauccgucauccaguaauuaaaggaguugccuggauccucaaaauaggugucuuccuagucccgcucugaacccuaaauuacaacuugauuccuuagacgcgugcuuggagcacugcuugcuggaguuacauaacacguggcucuugcuaagcuuggcuagcucacucuccacacccacaagggaaggaacagugagcugccugggcuggagccacgacugcauaugggaaggaaaaaggaggagaguaccagccgacacgggaagggaacguguagucagaggcaguggccacggcucugucguccggguggucacucuggggugcccuguccccuucacacaccacgauucuagcuguuaguucauccucaaacccaugaguacguuguccucugugagggagugacaguuugagcuacaguugauucguacacuagaccauaucuacguggagaagaauucugcuuguguaccuggacaucggucuacauugucaacagucauccccacaggaagcucuggccagucuccucacgccugccuuguucuuugugguuccacaguguagaugaagcaucagcguugauaaaugaguauucaaagcauugugggaagccugugccagcagaugcagcucccugugagauccugcagguaagccagcugauaacugccucacgucccaccugagaccauuuagauacauuuguuuauuuuuuauauauauacauacauacauacacuguagauguuuacagacacaccagaagagggcaucggaucccuuuacagaugguugugagcuaccauuugguugcugggaauugaacucaggaccuccagaagagcagucagugcucuuaacggcugagccaucucuccagcccugguuuguuuucuuuuuacauguaagaccuggucuuacaugucgcucuggcugucaugagcucacuaugugguccaagcaggccuagaacucacugagauccucaugccuccgccuccugaguacugggauuaaaggcgagcaccaccacggccaacgucguuaucaacuacuaugugcacauaguuuucuguguucccuuugguucgcugacaccagcacccccauaagcaugagaagugaaucagcuguacugggauauuagagccgccaugaugucacuaaagcccacaggcuaagugaccugccugagucauuugcugccuaauggcccagcugugacuggaaccccagggccucuuggcaugcuacagugcaccuguauuuaguuaccgaccauaaagaaugagcuguguucauggcaguuggcuguguucugugacuguguuggucagacacuguagugacaaauccuaaggagcaaaggcuuguuuccaagacugcaggccagggccacuggcuccucagccugugacaaggcaaugugacugaugucaccaagcugcuggucaggggugggaaacuccugucuaggcacagccuuuagcaagccgagaguccucuaacccagcccagcucuagauggcaccaucuccuaaggugccagcaaagggacuuucggacacuguugaguagugccaccagguggagauugaugaugcccaugcugacaccaugacaacacacuauugacuuuacaaaauagucuugagacaacuuuguaaccaguaguaaaguuuguuucucucuaguuguaccugucacauucugggugcuuguguauguguguucuaacccugugacugagcccugugcucuguagcuuaucuaacaaucuccucuuuuacaacugaagcggggcugggaagagggcuuagcagggaggagcagcugcugccaggccugcguaugugaguuugauucccaagagccauggguggaaggggagagcugaccacaaggcuguccuccggcucccgugcgcucgcucucucucucucucucucucucucucacucucucucucucucacacacacacacacacacacacacacacuauaacuguaacgauggugacaauggagcugacgcucaugaguuaugcuucuguuuuucucccauuuagacauuucuugguggaucauaguaaaacaaacaaguuuucaaaacaagaggaagucuggagucugccgcuaauuaaucuuauuuauugcagcuuauaaauugugcaaucucuauuucauuauccuguaaggaauaaauaagacauucaauauugaccuaacuaacuugaaugucucauaugaugaaucaauaaacuaugugcacauagcuuugau

SEQ ID NO: 2670 - RNA, 1952 nt, Mus musculus
cugugucuccugucgaaauuuauugaaaugguagauguuaaaguacagaaacccaaguaaugaaccgcccccccccccccaaccauggacacaguugaauuccuuuuacuaagaaacgcagacagaggagggaagccacuguuuccccaaagccuuuuaaagcucagcugaauuuguuauuguuucucuccagcacugaguucagucccuccuggggcuaacccccucuuaccaccuuuggagacuuggagaacaaucaaaucuuuugcaucuccuccccucuuuagcauuucugcuaaagucuggcugaaagguauacuggucccaccgaacacaagugaccaacuggcuuaucagugacaucuggguagagauccccuccaguuucguggaucuccuuguccucacuggggcccacggacaggcuagguaggacccuaggacgaagagccauccgugacuuugagcagaacugaggugugucugggugcaucugggacucaaacucugcaggacucugucuucuucaguccuguaagcuuggaaggcugagaaguuuccacugucuggaaacucugcuuucuguuccucugagauuuucuauggcugcaccucgcaaccaaaacugcucacugcaccacgccguuucucuaaauucgauucuccgaaucuagaaguuccaagaaagcguaagccaaaucugaagauguuacccuguucaacgaacggccaaaucgccucuccagagagcacaggccugagcggcaaucucccuucuugucauaguaacuuaacgagauguggaagccagauaaggggggcugccuggcucacuggggucagccauuagcgccccuggaauacuucugguugugcuggggucccccgugagcuccacacuagugcuucgguuauuaucggguucacccaauguuuucuuucgaaggcagcgguugauacacguggagaagaaguuggggaaagaugggcuggagaaauaguagaccacaggguccagcaugcuguucauguagguaaagcuaagggugguaaagaaagccagguccaccgaggaguagaugucacaguugcguacguuauauuuguagagaagccagaagaugcggaugcgcacagccacacuggguaggaagcaaaugaugaauacaauagccaccaccaugaugaaguugauggcccucuugaucuuggcaugucuguccaucugucucugccucaggcuccagaugauccugccugagcagaacaagaugauggccaggggcaagaagaauuccaagaggaacauagcaucgugccaccugaaguuguaacagaugcugaagcugcuacacagauaugccucgccauuuuuggucaucauguuuguauagaggagguggacagucaggccgauggugagaccccacaagaagcaagaaaugauggccgccguccgguuggagaucuuguucaagaagugguguggauggaccacccggaaguagcgguccacagccaccacggugaggaagaugaugcugcccugucgguucauagccaacaugaagagcaucacacggcaggggaugccuccgaaccuccagucccaguuauggacauaguuguccgucaggaacggcaggcagaugaucaggagaaagucagccacggccaaguugaacaagaaaauccggcuggauuuccaggacuugagguggaaacagaaaauccacaaggcaaggccauugcccaggaguccgaacacaaauuccagccccaacaccgguggcaagaccuuggcgauguuuucaucucggaacacacagcaguucuugccguuuaucacuagaaaauggucugacuugcucaugaguggaucuggccaguccagcuucagagugccucaccuagcgaaggcucaaggcgagugugugucuguguggugaacg

SEQ ID NO: 2671 - RNA, 3533 nt, Mus musculus
gggguguuauaaagugcuuuauaauaucaacuuguuggacugucaccacaaccagggcgcuagggaguccagagccccacugcuggacaugcaaaacacagaugugaacccagaaagucugaauccccgcccccaauccuccgcucuccagcacugcugauaagaguagugaacuucacuuaagucccuggagccacuuuaccuaagguagaugucugcccagcccuaucucugagccacugacugaagcaacccucccuccucagucagagcucccuaggggucaugucuuuuccugacuucuucucuuccugggccugcuccacuccaaacccucaguacuucaucucaaauaaggcuugcuacagaucaccuguccaaagaaugacccaaaagucugcguguccuuuugacccaaggaguggcacggcugcagacuuuauuucugcccucccugcccacaauggcaaguuuucagcaucaacaccucugggggagaaccaggcucaagucaacacacagacauccacuguggugggcuccucccggguaaagccgucaccgaaacccucaucguccaccagcucuggcuucuggcagcacaugggacagaggcgauuucgaacagcagaugcccgcagccacacgacgagguuccagcgcucucccuuacacaggggccgagccccgugcagcuggccgccacggugcaggauaccagagcccaccacaugcuccacuuccagggucuccuucaaggcugcgggugccugcagaggcuaugguucaggcuggggcacucacaccugcccaggccccaccugguuugccucacucaccuggaagaggcccccaaaauacagggcacccccugugaaguccuugcccagagccacauugaggguaagcucagcauuaucguagugacagcccagauccagguccuggcccagugcguacuugaccacaaaggcacggugacugucgagguagcccccaccguagucuggguacaacaaggccaucaguggcagcaggaagcguucccgcagcggggucaccagggggucauccaggccuaguucauacaucaguaccuaggaaggaugcccgggggcuucacugcacauccccauaucuuugccaaagauguugcuaagggcaaaagcugucugcuuucaugguggucuuugggcucagaauggggcagguagccugcccgaagcaucucagaggagacucccaccugagcugcccccacucccuacauucacagggaaggccucacccaccccaugguuguucaugguguugggccuucccuugggcauguccgacugcucaaaaugcuccagcucuuccagcagggucuggcagaacuuggccgagaacacuggcacccgauagaugcgcuucuccucuggagaaggaggggcagguagugaacccggagcugcgacucaacgcccucaggaaccagccugucaucuuacggccucaagccuguuucuguuuccucugggcaauggggacagugacuuacugcccugauccuagcuagauggucagugaaugaauggaugaaugaaugagggaugaauuaaugaaugaaugaaaugcccuacuccaggccgauuggucccacuggucuucccaguuccuccuauuuuuagacuagaaaugggagguaaagcacucagccuugccuggcuuugcuggcgcacgccuuuaauccuaacacuggagaggcagaggcaggaggaucucugggaguucaaggccagcuuggccuacagauugaguuccaggacagccaaggcuacacagaaaaaccccgucuggaaccccuucccuacaaacaacaacaacaacaaaaaaaaucacccagccucccaaaucuaaguaucucaagcucccucgacccccacccagugccagcuggugauggugccuuaccugacacugucuccagacgcuggagaaggcccucaagaucugcgccuggggacguacuauauucagcugcagccauaaacucgggggccagagcagcauccugggagcagaacaugggucagcugcgcaaacuuagcccccaccagagcagccuccgccuccgccagcccccaagcucccaggccggcccgguguaccugcagugagcuguagaccucaggccuagccgggugguaggagcuggcaaugagagccuuccugacagccgauuccugucccagccugcggcggcgcccgaccuccugcucaagcugggcccgcaaaggcaguuagucacaaaccagagccugucaccuccaaggccauuguucaugugaagacacgaggcccaggaagaccaaagugaaguguaaccuaggcuggagggcaagucucccuauacuucuuaaaccugacacugcccacugcaggugucaaggcgaccugacagcugaaauaggggugauggccccgucugucccacucagcuguugagagagggaugcuguaggcaauuuagucuuucucgauccugggccaggaucucggagugggaguguguggaagcaggaacaggaaaagaaaggacuaagaagucuuucagggucgaggacuccagagaaagggcugacgggguacguuaccuccuccaagaguugcuggaaguccuuggaggugacacaaccacggcugcgcaggagcuacgagcggaaaggccaguuagcgggagggacuaacgugacccuaggcgagggaauaaacaucuccgagccucagugauaccccuccccccaccucuugucacggagaugagagugacagggucaccgaaagaucugcuaaaacuucuguccacuguccuccgcacgcgugcucucagcuacuagggagcugccauccugcagcgacaggccaggugugcacacuuggguugcacacucgggcaaagccauuccugauguccgggccccuccucuccugcacuugcugucgccucccacuccacccuaccccgacccucaccuggccguagucacggcgcagcugaugcucgucccggaagcgcaggugcagcccguagcgcgccacguacagguucugggagcagaagcaggcgcagcggcagaagcgccgcugggcggcagucgccauggcgaagcggccgcgccagccuccguagcgaguccuuccguaaacgucaccgccgagggcuccgcgccaggcagcaaggggccgcugacaauucuuaacuucggaggguaacgaagacugggcaggcccgcguagaaagacgucuucccgggaagagguggaggguguccccagcacgggguacggacgaguggcccccgagucacagcggggugagaugggacggucacaggacguagacagugcgggacucacugcccugucuccuacuagaaaucucuuugcggagccuccugacgcaacguguaagacaggacaguuauggauugagacaagaccgcggcgccagcuguacgggugagcucggguugggcauucaccgcucg

SEQ ID NO: 2672 - RNA, 2111 nt, Mus musculus
cucugugaccaagaucauuuaauagugacacucugcuguccaauuugcuguccaauccacugcacccaagaggaugcugggcuguaggaaaggcaccuggaccuauuagucuccaagucaccaacagcaguucacaaaccugggauggcugagcccucagggaaguaggccuguucgcaucuggaaggccagcccauccccucggguggcuugcugaggaaggaaacaggugggaagcgugagaaacuuacguguagauacaaugcgggcagagcacaggcagagugguaccaccaaccuuguugaucucucugugucguucuuugguuacgauuuccucuaaaaccucgccgucucccuugaugagccugggggguuggaggucaucagcuuagcacgagagagucugggacucucaugccauagcaacagaagcagacccacccaaggaaagggaucucggggcucaagcccagcuaucuugagaagggggugccugggcgcuccucccaaucaguuaccgcuuuugggacagaauggagacgggccagguaggcucucccuugucagccugcaccauuaacccagaccagccaacaacaaccauuugaaaagcaucaaggcccuccugguacuguaacuccucaagaggcacaggggguaacagcugggauaucacaucucaagugacuauuucccccacacuuuguuauaaaaauggugacagcuccccaccagagcacauccugggccaauauucugaauuggaccgagggcggggcuagcuggcucugccuucuguaccacaccuugugcguccugucucuggguccaccaccuuucgaauaacgcucugucgggcaucccacuccuccuuugucauggguuucauggccuggauacgagacuucugcucaucugucaggacuggaagggaauguggaggacgugucagacccagggagaggacccuuuccccacagcaugcuggcccgccaugguaccugggccaucauuguccuccccagcugaucugugccacugauccagugaggggccgggcagagccucggccuggugcaccgccacugccuucuccuugacucucuucuucaacuucuucuuccguuucuucuucuucuucuuccucuucuucuccuugugcuucgcucgcuucuuccggccaucacuggaggaugaggacgaggcggagcuagaagaacuggaagaggaggagguugaacuggaucgcgauguccucugggccuugugcuugcuucucucugugaugcagggagaagguaaggccuuugugcccugcucuagugguagggacccucccaaugggcucuccaagagaacaucuggaaccuucuuuuggguucuagaagucacuaugugccuggcaggauccugaccacgcucaaccucgaagacccaaagcauucaaggcauguauaaggcacacccuccacucaacagaaccucuucacacccucgcucccgagguggggggugcggcagaugccagccucccgcagugcggacgccacacaucucucuucccugucccccgugguccucacccucaaccccggaggcgcugccagccuuguggcccugggaucuggaggcugaacaguuccucgaggcauccuugcuacuccucuuacuucgcuuuucugacccucgccgaccacuacgggaccgacugcgacuucucgagcgcuuucgagagccaacgugagccaucagcgaggcgggcuagggaccggaaggaaagcgcuuagccugcgacucuucgugagcguguccucggaggcgaauccaaacgcagcgccaacgggacccgauccucggggcgcccagugcccauuccugccggagcgagccccggggcuuagcgaucccagcaccuccuccgacucccgccccgcccucaagccugcgcacuggacuugguggcccagggagggaacgcugcagcuuuccucagcugcaauaggaccgcgugggucgccggagacgcgucccgaggcugcuggguccccacauccaccauuagcccacagcaggccuuucgcgggaggaaacggcggcagguccggcuc

SEQ ID NO: 2673 - RNA, 2025 nt, Mus musculus
ugaugcugagugacaaagaagccaggcacaaaaggucacacaucaugugcuucuuuuuacagaacauguccagaguaggugacuauggaaacaaaaagcagauucauuugccagggggccggaggagaacagggguugccaauggguaugggguuccccuuuuaggggguagaguguucuggaaugagaaagaggauugauguaguacuaaauguugccaguuguagacuuccaaagugucucccccucugaaugccgccaugcuucaucacaugaccuucccuggaggaauggaaagagaagaggcaucuauucugcccacacagagagggcaccaauggaacgauuccacacagcccagccugguguccuaaagcaaucacuggggugauucacaagaucguggaugauucaaaggcagcuccaccagugagaagcccacugggcaccaauaccacugaagagucgacuacaccugcugcauggacaacucaacaaaagaugugccacugaaggcagucucacugugcagugaacagcagcaaccccacccaagaacacuaccuccugaauuagccuuccgauggggagggagcagugaggagcccugaaggcugugagcagcagcagcagcagcagcagcagcagcagcagcagcagcacaccaugggucugcccccucccagaggaugugaauagauacaaucucagaaagaccuggugucagaagaagagcagugaucacguuuaauaugagucugaagccgcacagcacacugaguuacaaggaggacacccucgcacugccacacuuccucuguguggaagguuccccuacugccucucccguuucuucccagccccucucuugggcuucacaugccucugccuugcguugcagcccacuccaccuucucuggguccaaaggcugggacccuggauuuucaagugcucugucgagguccagggggaaaaaaagaaacuggcaaucuacgaucugggagaacaggugggccuagucccuaaggcucugcuucaaguucugaaccagcccagauacucagaauaauauaccagcagcccguccuauccaacuggacauuuggaccgcaggagcuaaaccgugaggccagcaaggcaagugugacuuggaauggucagggaagccuugauagaguaucuacacccuaagcagguucugcugcuccaaacgcacugccugggcaugcagggaaacacccaacuccugccuaaggggccugucccagucugcuuucuaucgcugugauaaauagcacaaccaaaagcaacuuagggaguauggugguaugaauaagcaugacccccuaucccaugggcuugcucguaucugaaaguuuaaccaccaggaaacagcacugugugaaaggguuagaaggacuggaggaagugugucucugggagugggcuuugcacggccucugcuccagcccuuccccacaugcugccaugcucucugccaugauggcaguggacuaaagcucugaaacuguaaccuagcccccaacuagaagcuuucucuuacaacggcugccuuggucuacugcucuucacagcaacagaacccgggccaugucagggaggaaaggguuaucuccacuuacggcuuccauugugaaggaaaugcaggccagaaacucaagcaggaaccuggaggcaggcacugaagcaaaggccauggaagaaugcgacuuauaggcgugcuccuucuggcuuccucugcuagcuuuccuauauaccccagaaccaucugcccaggaauggcacugcucauggggagcuggccuuuucaaaccagucaaggaaaugccuccuccaagacuugaccaucagccagucugacagaggucauuccucaauuuagauucucucuucucaaaugacucuaguuugugucgcuuugauaaaaagcuaaacagacaaggcuugagucuacaguuccucgucaccuguuucagcagccacagacccuugagugccucugc

SEQ ID NO: 2674 - RNA, 77495 nt, Mus musculus
acucuccucuccuccucgcguucagugcuugaagagacagaaacacagccgaucuccuuaaauuucggguaaagugaggucagacaacucagcucaaggaccaggcuggaaaagaccccguguaaguugggggacggaagucggaaguagguccggaguuccagcuuccaugucucauuccagagccucugacuaguccgagccuggcugugcaggugcuuaccucgggccggaagcauucggcgagacucuaaacccacgguagaccgaggaugggaaaucuaagguuuccaggucugcgcaugcgucguacuccucccacggcuucucccagccuaccagagggcccauucucaucaacugcgcacgcuagaaacccaggcgucuuucccgcaguuuccagagaaccaaucagcagaggucuuggcccuagagccccgcccccucaggccuccggcgucgcccugcccucucuggagcgagcugcacgcacgcgcgucaggggaaacuaggggaggugcgcgcgcugcgcucgccggcucggcccucucuuccgagcagccaaucgcggcugaggcgccgggcgcgcgcacguuccuuggaauuuaacggucgcgugaggccaaaucuccggguacccgaucuaaggcggaggcgaggaggucagguaagcggucgcggcuuguggggagcugcguggccgcaagggcugaguccuagacgacuccaucaaaggggagccccccugagugcgugaacaggcuagggugaaggcugacggcgcccgcagagcuagccggagcccgccggccagugcagcgcugcggaugcgugcgccuuuucuagacucgugcccuugagugacaucagugaggcccaaucggauugcugccuuugcaaggggcgugaguguccugcccugcccccuccccuucguuccccuccccggguagcgguacugggacucccuuuggaaaucucagugguagugagugguucuccaucaucccuauguccucgcgccuccggccuuggaucauuguucgcugccagcgacucgauacuggcuucaaccccuggaaccaucucgugccguuuccuuucagccucuccgcagaaagaaagcauagugaacuugaaaauuguuaacgcaacuccaucacuuucugccucuaaccccaauggguuguagggugaggggcagaagcaucuuuguuuguuucuccuccuggcaauuauauuuauauaagaaugccugucccuauauuccuucucugucaaguuuuuaucggauucccuuuuucuuuucucucgaccuuccaccgugccuagagaggcguccucgagucucuaguggaguuuuaucugaaucucuugcauccggauuacuucagaggagguggggucggggagaagagaugggacuguagauccaccucucuggaggacuuguggucauuugaauccagguauuuucguugccaguuggaaggggcagccccuggcuuuuucaaugccccauuugucaguggugauaggcuugacacagggguggugaggugggggaaaggcagcagagccuauuuccuuagaucuaguuaccccuggccucugugccuguccugaagggacugcuucuuugccuuuaguggccugauuguguucuuuuaagcccuggaaagugagaguugaguggaauaggagcgugagagaguucuucugaugcagccacuacacuugccauuuugcaaacagcaugggacuucuguuuuuuguuuuucuccaucccccugcuguuucuuuuccuucauccuuuuuaaaucaacagauuccagagggaggaugcaugugauugggcuuagaguagcaaauuuaucuucgccuuuaguaagauuguaguuaacuugucagguaauggucuaucuuccaagaauacacagccucuguauugagaaguguacaucccacuauuuucuuuaucagauaaauagcacuucccccaacccucaagacaggguuucccuguguagcccuggcuguccuggaacucacucuguagaucaggcuggccuccaacucagaaauccgccugccucugccucugccuccugagugccgggauuaaaggugugagccaucacagcccugacaguggcuucugaagucaacaagcacuucugcaguguaggacuuaucaaagaagugaggcggaccuggaaguacucccguacuauuuauuacauaauagagugaauuuagaaccuugauuauuaaacacaaaauucugaaagauugccuccaggagauaauggacuccuacaaauuaccuuuaaaaaaaaguaugguuccuauauauaagccccauccuuuuugaagcauauucuuuagaggauuuagggaaaaaagcuaguugcagaacuuuuuaucacccugugaguuugucagcgucagaugcuucauacaaauggccucacagaguaguucuuuuuuuuuuuuuaaugguuuuuuuuauagauguauuuuauguauaugaguacacuguagaucucagacacaccagaagagggcaucagagcccauuacagaugguuguaagcuaccaugugguugcugggauuugaauuuaggaccucuggaaaagcagucagugcucuuaaccucugagccaucuuuccaucccucaugauuguuuuuuaaacuuagccugguguauugguagcaacaucuaauugcuacaucccuucuuuggaccaguaauauuccaucacauggaaaucccauauugcuuugucccuucaucugcagaggggcacuggggcuucuucacuuuggucauuauauauaauauugcuauucuuuuacauuugugugugcguguuccuuuuuuuguuguuuguuuguuuguuuguuuguuuuugguuuuucaagacaggguuucucuguauagcccuggcuguccuggaacucacucuguagaccaggcuggccucgaacucagaaaucugccugccucugccuccugagugcugggauuaaaggcaugcgucaccacugccuggcuuguguguauguguauguguguguguguguuucuuaugugccacauggggaacaggggagucaguucucaccuuccacuguguauucuggggcuugggucagucaggcuuaccuggcaagugcuccuagcuaaugagcccuaccuaguauugcuguucuuauuggagguggauuugagaggguuccaaagucaugagaagacaguggauaaauuugguggccgguuuacagcaguucucccccauucauuuucagacucuuuggaacuauagccaauuucacaguuuugaaugucagccauugaggaugccgguagaagaugaagcagcugaagaggacuccgaagcagucuccucccgaaggagaagcaacaguauuccuaaaugacagagcuuaaccauuuuuguacgcuauggaggauuuugacuugguggaaaauuuacaaaaaacgucaccuucuguagaaucugauauuaaaagcgcuccccaaucccuuggguugagcuugcaugcuaauagguaagaguugguuugauacuauuuucaugugucaacaaaucaaagucacuuguuugcagagccuaccucuuaaucuaaucagugacauaguugcugguuugccuuaaagaacagaacagccaaccucuguguggguccaguggucaguugaaaacaguaucccucugucucucugcugugcuuuucacaagugaacacuguggcaaagaacuuacuagcuauguagcaaguuccaggccagccagggcuacauuguacgacuguggucucacaaaaacaaaagccccaaauuaauuuugcucauuguacuauguauuaugcuuuccuuauuuggcaacuuaaaaggauaucuuuaaaauuugguaaucuagccaggcaaugguggcacaugccuuuaaucccagcacuugggaggcagaagcagguagauuucugaauucaaggccagccuggucuacagagugaguuccaggacagccagggcuacacagagaaacccugucuggaaaaaccaaaaaaaaaaaaaaaauugguaaucuaaauacauacauauacuuacauuuuuuuuuuuugagguuagagucucuugcagcccaggcuagccugacucauaauauaaccuugaacuuuuaauucucuaccuccugauaauuucauaauuauuucuucuuuuuuuuuuuuuuuuuuuuuuuaaagauuuuauuuauuauauauguaaguacacuguaguuguccucagacacuccagaagagggagucagaucucauuacggaugguugugagccaccaugugguugcuaggaauugaacucaggaccuucagaagagcagucagugcucuuaaccucugagccaucucuccagccccucuuuuuuuuuuuuuaaagauuuauuauuauacauaaguacacuguagcugacuucaagcauaccagaagagggcgucagaucucauuaugggugguugugagccaccaugugguugcugagauuugaacucaggaccuuuggaagagcaagcagucagugcucuuacucgcugagccaucucaccggccuuuuuuuuuuuuuuuuuuuuuuuaaaagagacagccucauugugugguucagguuagccucaaacucaaggcaguccuucuuccuaauacuggaaucacaaaugugagcuaucauacccagcuuauugcuacauuuuaauuaauacuauaauguuuuauacugcagaagcaucacgcuagucucgaagguagcaauggaaaaugugggaguggggcuggggagacggcucaguggguaagagcacuggcugcucuuccaaagaacuggguucgauucccagcaugcacauggcagcucacgauugucuguaacuccaguuccaggggaccugacacccuuacacauacaaaaagacagaacacuaguguauauaaaauaaaaaauaauuaaaaaaaaaagaaaauguguuaguaacuaaacaaacaaacaaacagacaacaacaaaacagacuaugaacugacaaaauagccaaccaacugcuuucuguauuuaguuauuuauugauugauucaggucuuucugucccugccugccuuccaugaagcucacuauguagaccaggcuggccuggaaccuguggcagugcucuugaugcuaccucccaaucugggcauuaugccuuggcuuuguacagccacguacacauacaucugacuguucuuucuuuuucuuucuuucuuccuuucuuucugucugucugucugucugucuuuucuuuuucuuuuucuuucuuuuuuuuuuuuuuuuggagacagggauucuuuauagcuuuaccuguccuugaacuggaacacacuggucuuuaacucacagaaauccaccugccucugccucuuaagcaugcugggauuaaagguaugugccaccauacuuggcagagggucaaauagcuuuagguauaaagauuuugaagaaauuguuuaucaugaguaaacuguuuuaaaauuguggggagccugaaguagcucuaagauuguauagaaccacuuggcauaagggaaucugagaggaaaauguagagugugagaaaugacgcaggaggaauguuugcugcggugcuuugcccugaaagcugagugcuggucuacaauuuuuuaaaaaauuuauuauuuuauguauaugaguauacuguagcuguacagaugguugugagccuucaugugguuguugggaauugaauuuuaagaucucugcucacuucggucaacccuacucccucugguuggcccuacuugcucagucccugagaaaauggccccagauuuuauuuauuauacauaaguacacuguagcugacuuuagacgcaccagaagauggugucagaucucauuacuggugguugugagccaccaugugguugcugggauuugaacucaggaccuuaggaagaucagucagugcucuuacccgcugagccaucgcgccaguccgcuggcucacauuuuacuuccugucccauuugauggcuccucugaaauguacuucuggaagaaauucccuuuagaacguagugcuugaauugucuggaagaaccuaaauguguucuucucauaaaauucaugucauugaauuuguauccuuuuuccuuaugacugacaguuacagagcugcucuguaaaguucuucuggacauagauuuuaaagaguuucuugcucuugaauuauuuuuaauuuuuuucuaguccuaacuucuauuauuuuaguaucuucauuuugugguguguguguguguguguguguguguaaguguaacaaugcucagggucugggaauguagcucuguugagugcuugucugacuugcaggaagcccuggguucuguucuuagcacagcaaagaucaggcaucacggcucaugacaguaacuucugcacuugggaggaaaaggcagaaaaacagaaguccagggucaucuucuccuauauacugagugaggccagcuagccuauaugcagcugagaaaacaaagcaaaguauaaauauggagagaaauggcuuaguaguuaagagcacaggcugcccuuccagaggaccuggguucaauucccagcacccacauggcggcucacaagugucuguaaguccaguuccaggagaucuaacacccucacacagguauacaugcaggcaaaacaccaacacacauacaauaaaaaauaaaccauuaaaaaaguuuuguuacaaaauagaaaucaauauaaaugaaaaugccccuucagcuauuagacaaauuuuaauguuccuaauugugcuuugugguguguauaaacaaaucuacaaucaacccacauuuggaaaagaacucaucuggaaagaauuaguguucuauuacacaccacacaggcuccauaaacccugaauauuggcugcuaauuggcucagcagaacuuucauucaaagguaguccagcgauaagcuuaucacaccaaaucagggucugguuacuaagacuugacuguucugggcaguggagagagaauccuuaguacacaaugaagggcuguuuaaagugggccagacgcuccucuggaauaauucagagaagcuaggacguuucccuguggauuccacugggcuuuggggcauucccucagugcuggagaagggcuuccuguggcgcucguaaagaagugagcuuguccagucauccugugcugcccggccucuguggucagauuuuuaaaggaggugccauucuaguggacgauuagguagcagugguuguguucugcucugcucagucuugaacugcugacuuacucaacgcuucaguccaaugaggaaaaccaucugaauuguuuauguuucaacagaaguaguccccaccuuaguacaaaugggguguccucuuucucagggaagaccgggccaccugucauucaagggacaguggaaguccucacugcuuuaagacaagaccuacagaacaguggccggacugacucagaacuuuggaagaguugcgagguaucucauuuugcuuuauuuugggggucuugaaaagauuucuguuuccaugggacucuacugaacuguuagaaaucuaugucuagaaaaccaugauacuuaaccuuauggcuaaagucaaaugacuaagcauguuaaccaggcaccgauacugaaggaacaagaaaaagaaaacauggaaggugguggccucaauagacagccuggaauagucccugugaacggcagccuuuguucccagcccccuuggauuguuacaauuguuuugaguuagucuucugaguaacuccuacaguuguccuuagucuacuuggcuucaaauauuuugaacacucugauuauaaauacauucugcagcaugcuguguugagcugucugcuuuucauggcagcgauuucuuugguuaaauggugauggaaauuuaguuuauaugaacaucacacaguugaaguuugguguggaagcugguggugaugugcccuccuuaguccugcaaagaucaagaaggaggggagcaagaggaaaaacaaacagaaacgaacuuaauagauugacaucuaagaggauauucacaagauuuggagaauauuagucuuuguauggccuuuucucuuuuuuuuuuuuuuuuuuuuuuuuuugacacagggucucauuauguagcucuggcuggccuggagcucagcucccugugcauauaccgggcuggccucgaacccauagagaucucucagagauucucuugacugugucucccaagugcugggacugaaaaugugagcuaccaggccaggccucuauuuuuuuuuccugcuuuuaaagacuuaaguuaaagguugaaaugcuuuauagaaaugcaaacaugauuaucaaacucuaagcaguagaugguuugguuucuauuaauuguacuuuauagaaccaaaacuuguguuuuuaaacuauaaaauggaaauaaugaucuccugguuugagaauucaguagcagccauaccccaaauguaaucucuauaaggauuaugcauuuaaaauggacuguugcuauauacuaaaagaaugagcucuucagauuguuuuuguaggggaaggggugguggugguuugaagcaggucucacccugggacccugaauggucucagaaugcugggacuccuucuggagcccagccugaccuucuucaguucauggcacuuagccucccaagugcugagauuucagauuugagcuucuguaauuggcagcuuuuugguuuucucacacacguuuuguuuauccacccaacaaccacugagcuaauggggaagaccucuaagaugcccuugugcuaugaugcuguuaagacacaagauggccugguuuggggagguagcucaguggcguggggcaugcuuagcauacaggaggcccgggguucuaauucagcaucuggaaaagcaaguuccauucauuagcuugugaaacacagaaauaagaacaagagcgacuagcacggcauggcuuguuucuggcgcuuguguuugacuagaaauuauuacuuuaagacuuugaaucaacaccugaagucagagacagaugguauuugugagucucauguauugauuuaagaaaacgaucuuugcagacgaucuccuguagccuguugauucugggcucauaaccugacccugagcucucauuugcagccucagccuccuucaggcagaguggggaaagucugaggaggguggaggccuggcuagaguuuugugagccuguuucugcacaugucucuucagugauguaacauuuuugcuguguuuacuaaacacccaccugaucaguaagaguuuagcuacucagugaagaacugcauagaguagugcuauaggaacagaaggucaggcguuuagcaagccugagucuggugguuucccucuggagucucugguucucaccucccuuuuggaauaguaagguugguuuauucuugccacucaaaagacacuaaucuacuucgcuagaaacaaaaccuuccuuauucugagcaggcagaccgacaguuuccauuguuggcuuuagcuagaucuuuuuagcauuuuaccacuuggauuacauauacaauaauaacaguuauaggaugaaaauacuaaguguuuacaacuuauugucucuuugcuggguaguguacuagagacugcuuguaacauggaaacuuauuagaccuggagacuucuuucuguugcuuuuaaaguaaaagcaguuccuacugaagugaaauucaacagauaaaauaaccuaucuguacuaaacuuagcauaggugguagugcacacuuuuagucccuuuaauugagaggcagaggcaggcagauuucuaugaguucaagacuggccuggaucacauagcaaguuccaggaaagccagggcuacccagugagaccuuguuucaaaaaaaaaaaaaaaaacccaaaaaccaaaaaaguauggguaguaggaugcuaguuuauuauucaccguggccuaaugucagucugcagcaaugcacgcuugcugaugugcuuggugcacauacacacaccccugccuaaaugugauuuaaaggaaauggaaguugcuuagcugcuuacagaaaugaguauuacaauacguaagugucacauccguguaccuuguaagucugugaaguucucuggcauuucuacagucuguauacuauacucacuguaaggacucugguauugaugcccaugacugagauacagauugacgucauuuucugagcuaguaacuggguccguuucugaaacagacugaaguuuguuuggagcaauaugcgccaagcugcacaagugacauuuuuuucugauauaaaaaggacacagggcaagaaagagagagaugcuugagauggugggagaagaugguuugcaauugugaggacgguagucaugugaggagcugggguggagcaguccagguagagggcagggcgcuuccaaagcugggaaguggaaggcaguucugcuugcccagagauaagaagaggcugguggguggcaagccagccguacacucgggcguggcuccucaucaauacugcacgucuauugucuauaugcucagcagguaccagauguaggaggggauucuuccugugugcccuucuagggaagugcuuccugcucuuaguagucaggagggauggagaucuacaugugggcucggaaaggaagcagaggcccaguccacugggcuccagagaaucagucuuccguucuuugcacuuggagcucugagggauuuggaacacuuuagugaacguggaaguguuugccuauguuucuauuuugggaugugagauccuucugcguccauuuccguacugaaggcagccaugagcuucucugagacgagaggauguggaacugaagggaauuggaggcacgagaagcucacuuugaucccuggcgcccacaggacuccugggcuagucagcuuugcaugauuggcaaaucucaggucccaguaagagauccugucucaaaaaucagauaggcugcugacugcugguggugguggccuuuaacuccagcacucagaaggcagaggcaggcagaucucuaggaguuugaggccagccuggucuacagagugaguuccagaauagccagggcuacacagagaaacccugucuugaaaaagcaaacaaaaaacccaaaacaaaacaagguggguagcuccugaggaaugacacuugagguucaccucugucugguuuccauacauauacauacaucaugagugcauacacacacauguguacauauauauauaugcauacauaaagugcagcuaucaggucuuugucuccauguauaguccaggccaguuucaacauccuccugucucaaccugcugaguccuggaacuauagguauguacuguuguaccugguacaaucuaguccauuauuagucagaaauagaagggcugaugagauggcucagcagguaaggaugcuugccuccaggccugaugaccugaguucacccccugggcacugcauugaaaggaaagaaccaccuuccacaagaugaccucugacucccacauauuuaccuuggcauauucccuugugcuuggcacauuugagugcgugcaugugugcauaauaaauuauaaaaaguauauaagaacagagcuggagaggugguucguuggcuaagagcacaggcuacuuuccagaggaccaguggcccauucauagcaccuacguggcagcucauuagcugaaacuccaguucuaggggaucuucuggccuccacaguaccaggcaacaacagaagacaacuuaaagucccguuugaaaaauaaggcagauuuacccagauggcagguuacaucuacaaagauucuuuaaucccuacuuuuaauaguauuacacuaaauauauaaauuggccuauaaauuuuguauuuuaaaaaaaguguuuuuugcuaggcuugguaccuguaaucccagaauugggggagggggcuaaguaaggaaggaggauuacuuugaguuugagcccagccuggguuguguagugggcuucaggccagccugggcuacagagcgcuucucacucgagggguuuucuugcgacgucuuagguugaauuacggucagugaagauucuuuacaauuucucaggccaggugguugcagcucuucagugugguugagcagcacugccaggagcagauugucgcccagcaggagcaguuccauaggcagauccgggugagucgcccugaccgaccgacugugggaugccuuuaucugugagauuugccgucaaaacaguguauuaauuuugcuuaugaagauaucacacuuagaguaguaguguauuuugaggcauggccuuuucuuaacauugaaaauacaauguguaauuuacuuuucuuuacccucuuuguucucagcgaauacaggaggagauccggaaguuagugaaacugcagcucagccaugcuucccggccuucgugcagcagcagcucugugagugagcaggugucugcagaaacccaaaugggcuucuuuucugagaacagugagagaaaugagucuguugucaguuccccagcguccaaggaacccgagacacagccagcaucauccacauccuacccagacugccauguggacagcagcucagugagcaguggcuacggcaccuucugcauccuggacaugaacacccacaaggcuaaggagcccaccgagcccuuggagccgggggcagcuucccaggggcagcacccagccucuguggugcaggcacauggcccugcagggggugcagcagccauaaacuucuucacacagaccccugaagagcuuugugccucucuaaaggaagacggcuccacuuuuccuggggaauuugaccgaaauuuucuuggugaaaacaagaucucugaaguguacagugggaaagcaaauagguaaguggauuucucugcucaguuuuacucauuuauugguggcauugaaaguguaauaaauaauguucuuuuuauuuggucuacaguggagugagauguauuuggauacaaaucagguuuaccauuaaaaucugacucuuacauguuacaugcggagaacuaaaauaaacaagcgcuguguacuaaugacuccugacucuucccaugugcagugcuuuaagacuguucagugcagggcuagaaagagggcucagcauuaaagagcucuagcuguauucuauguauucuauguauucuauguauucuauuuauuuauuuauuuauucauucauucauucauucauuuauuuaaauuuauuuacaucucaaguguuauucccucuuggaaacccccuauuuuauccccccuccccuugcuucuaugaggguguuccuccacccacccaccuacuccugccuccccgcccuugauaccccuacacuggggcaucuguggagccuucauaggacuccaggugcauuuuuuuuuaaaagauuuauuuauuauauguaaguacacuguagcugucuucagacacuccaggagagggcgucagaucuuguuacagaugguugucagccaccauaugguugcugggauuugaacuccggaccugcggaagagcaguugggugcucuuacccacugagccaucaaaccagcccuccaggugcauuuuuaaaagacguucccggcaucuacauggcagcuaacaaguauaaucaccguuccaguugacccaacacuuucucuuggucucuuugugcacuguauacaugugauacauauauaugucauauaucauccaggcaaaauacccguacacauaaagauacaaaucaaccuuuaaaaaugacucuuaacagcuggauaugauggugcacgcuuuuaaucccagcacuggagaagcagaggcaggcgggucucuaggaguuccacaguguaaguacaggacagccagagcuacacagaaaaacccugucucaaaaaaagaaaaaaaaaaaaaaaacaaaccucuuaucucaggcugcggauggugguguuugcauuuaaucccaggauuuggaaggcagaggcaggcgggucucuaugagcuggaggucagccuggucuagauugugaguuccaggacagccaggaccaucucaaaaacaaaaacaaaaaaccaaauacccccaagucaaaaaacaacaaauuuugugaaauuuuguuguuuacccuauguuuucaguuuggcacaucugaaauguguuauagaagcugggcgugguagugcaugccuuuaaccccaauagaggcagguggaucucugugaauucaaggccagccugguuuauauagcaggguacaggacaaccauggcuaucuaacagagagacccugucacaaaacaaaacaacaacugaaaacagagaaaaggaaaguucggagacucagggccagugggaugucccuggauaacggagcuugcuugccaugcaggcugccgugaccagaguucuguccugaaggagagaacugacucuacagaguuguccucugaccucuguguguacacugugacacacagacaucaugugugcacacagaauaaagaagagauacauagaugagugaauaaauaaaaaguuaaggaaaagaaauuugcagcuggagagaggguuugagagagcucgcugccauuacagaggaccugaguucaguucccagaacccacacaguggcugccaauggccucggauuccaaguguaagguacugcuguucucuucuagccucuauaggcacuagacauacaugugguacacagacauauguguaggcaaaauguucauauauaaaagucuuucacuuuuuucuuuuuuuuaaagauuuauuuauuuauuuuauguaugugaguacacugucgcugucuucagacacaccagagagggcaucagaucccauuacagaugguugugagccaccauguaagcgcugggaauugaacccagguccuuuggaagagcaggcagugcucuuaacugcugagcugucucuccagcuccaauaaaaauauaucuuuauuuuuuuuuuaagauuuaaaaaaaaauuuauuauuguacauaaguauacuguagcugucuucaaaugcaccagaagagggugucagaucucauuaugggugguugugagccaccaugugguugcugaaaaauaaaucuuuuuuuuuuuuaaagauauuuaggaaaaccaauaaaacaucauuuuuguuucguugcuuugagucagggucucuauauagccuuggcugucccacaacgugcugcauagaccagucuggccucaagccugcagagaucugcugagugcuggugcuacacgaagugcaucaccacaucacccccuuuuacuagcacuaagacaaagcccugcccucugaaacacuagguaguauaugcugaccucucgagauaaaggguggccuuugaaggaaauaauuuuauuuuuuucucuuuuuaagugguaagucuguaacauccugggcacagaggcugaagcagaaccagucaaagcaggcacauacagaggaugacugcucaggaccuaagccagggagcgagcugaacuggaagccuccagcugacacaguaggugacagggggcucuucuggcaugccucggcuccuguugguuacacugacauugcuguguuuuugcucguuuguuuauuuacauuuucuuaaaaaggacuuccuugauuuugagcguaugagcauuugcuugcgugcauguauguguaccguaugcaugcagugcugcuggaggccagaagagggcaucggacccugugaaguuacccugguuguaagcugccauaugggugcugggaaccaggccccaguccuccucaagaauagguggugcuauuagcugcugagcaacuguucuuucuugagcuucucuuuugucucaggauugacugucauuugcuguaaauccagccucuuuaguaggcuggacaugagagcugaugcaggacagaauuguacaaaaaugaagagagauggguaagauggggggggcuucucuuccagagggccugaguucaauucucagcacccagugacaaguacggcagucuguacugcaguugcagggaucugaugcccuagucuggccucugaggggaccgcacccacacgcauaggcauacaugaaggaaaacacacguaugcauacauuuaagagauuuguagaguguuuauucucuguguuaaauguuuacauuaagugaucaaagaaagagugaucacuaaaaaucaaagcacuuugacugauagcauagcucggggguugaguauuugucugacaugugcaccugagccccugggucucuuccccagcgucacagcacaacaacauauaccuucagguaguauauacuauuauguugcaacaaguaguacugugugugccaacauuaucuuaaaauugucuuaaaauuaugaaaauuuggauaauuaugauuuuauaauuugaugucuaaguuuguagauaauagauuuaaguuuuuuccuuggggcuaaguuugcuauaucgcccuggcuaccuccaccucuugucucuuagcccccugacuagcagggauugcgguagaaugucaccaugcugugcagggguaaauguuuacauucuguguggagcucuugcuaacacggcaacucuguucauuaaagggccauggacagaaaguuccaguauguguguguuccugccauggccuccacugucauagggcagcacacuucuuagggucauacuuggagggucuaaaaucaggucuuuguauaagcugggcauguccauuauccuaggaaaagaaucugaauuagaagguuguaaaaguuuccaagcuuuuaacuuuguuuguguuuaucuauuucccugcuuuucauucugaugugggugugcauguuaagcccgcauguggagguccguggacaguguaugagagucaggcucaggagauuaaacucagacugucaggcagccagugugugccuguaucccccaccagcgagcacauguacccccuccacacccagccuucucccuguucuuucccccagccuuuuaaauuuuugaggguuuuuuuuugggugggggcagggucccucucuauaucccuggcuggcuggaacuuuuacuagguauaccagguaggcuuugaaaucacagugauccaccugccucugcuuuugagugcugggcuuaaagggauucaccaccaugcccagcuucccucagacuuuaaagaaacugcuucuuucgcucuuaggaguguccuuccacccccucuacccccuuuuugagauagacucucacccuguaguccaggugaccuugaacucacgcuaauccuccugccucagugucucagauagggagauuacagaagugagcuuccuccuuaugggaccccaguugguguugaagaggaaggagcugaagacuucugaagcccgagaagccugugguggguacuguguguuaagucccgggaugagcuuucugcaguugcagucuggaaaggcucaucacgcucugggggugggucucuuauucucaacucuuuugccaucaauagugggcugucauuuuugggacaauagucugaaacuaauuguggauuggggcagaaaauugcuauuuucuuuguaguuguuuggcaugaagggaacauguucuccuuccuauauaauaguuucuucuguuuuauaaaacuuaauacuuaaaugcugucuuaccccucaccccccacuccagagacagggucucccuacguagaucaagcugccucugccuucugaguucuaggguuccauggguauguaagcccuguaccaugccuaccccccguuuucuguguagguacaugcugagugucugucuacugccacaccuuuaccccgagacuuuucugcuucugguuggugguuuuacuccugguggagucagcggguucuuggcgacaacugugguugugacucaggcuguaguugauguugccucgugguucccaaacuucgcugcuaguuggagucaucugugcuuuaaaaguguucucagagccgggcggugguggcgcacgccuuccagcucuugggagguagaggcagguggauuucugaguucgaggccagccuggucuacaaagugaguuccaggacagccagggcuacacagagaaacccugucucaaaaaaccaaaaaaaaaaaaaaaguguucucagaccggcugcuuccgcuaggcauucugacugcuaguugggguggggcugccugcagagaggcauuauauuuguggacauuggggugugagggccucuaagaggucccuggguggauuggugggguggcgcgucuggagcagcagccuuugccuggcugcucucaucagggcagcugugaaucaggccagcagcugccacccuccacugcuguuuaugcccagcagggcagccgaaagaggggcugacacccccacccccaccaaggcaaggcuaauucuuccucgugaaugauacauuuagcaucaaaccauuuggggaaaucaaauuucuaaugugucacugaacuuuuaagggauuuugaggugguauuggcaggugauagaggaauggcgcgaccauuguguuuccucguuguggaauucuggguucacagaagcaggaaagucuuucccgagcuuuucucucuguuccuagugucuucaguuucauuccacagaagggacugcuuaucagaauuguccccugaugggcuuuuccuuuugcacagcgcugguuuauucuuggaaauagcugcuuugaagucgaucaugacuuuguguauuggguggcacaagcgguuuccagggccaaguuguucuuuauuucuuuggcccuuuguuuccauuccaugggcugaaggacuccggucuuuagacagcgcucaucaguagguccuugagcugggcccagggcaacagcuuugccuaagaggaccuagguuuagaaggcuuuguugaagcgggcuuugacuuucaaguggucuuuucuucgguggauagccuuucacagccagcauuguguaaggcaguauucuagugcacaguguguauacucccgucccgaggcucgaaucucagcagcagggugagagcuaacuauuucacuuggaaguauuugacuuaguuccucauagucccuuccccaguuggaagagucaggaguucuaagagacagaugaugacuuaggaauuugugccuucauagaaggagguggcgcgguucccuugcggcagacuugcgaguagcuuguuccuucugauaaagcgcuaauaaaguccuucuggagcagggaagucaaggagagccggugguggucgcgcaugccuuuaaucccagcacucaggcaggcacaggcacaugggucucugugaguuugaagccagccuggucuauagagcaaguucuaggacagccagggcugacacagagaaacccugucuuggaaaacaaccccccccccaaaaaaaaaaaaaagaaaaagaaaaagaaaaugucccugucauacaucucuguuugagacaguuuccuuuuucucuguaguggugagcaugaaauuuggcagaggucuuuuggcagcaaacguuccaguguucuauccccauccccggaaaauagaguaaggaguaaugacucacagguuuuguuucuuuaaaaagacuuuguuguuuuuuuuuuuuuucuauucgugcacaugugugugcgugccuguaccugaaggccccuacagaggucagaagauggcguuggaucccugaagcuggaggaguuacaggugguugugagcccucuggugugagucagugagggcugcucgcugaaccaggauccugugcaaaagaaguaccuaugcucuuaaccccucacccacugcgccucuucaacaccugaguuuguuuuucagucagcauggauaauaagcgcuuuuagccuuugcugggauuuguauaugagaagcaagaagcugagagccugcugguauacauuugagauccuagcuuuuagugaauagagagcagggugauccgcaauacaaagccagcuuggacugcagaguucacucuggaccagccugggcuauguaucaagacuguaucaaaaagugaagggcugggggcuggggcgaugauguuaugguuaaaagcaucuuccagaggauccggguuccauucucaacacccauaugauggcucacgaccauuuguaucucaaauccaggugaucugacaccaucuucugguguccuggguaccaaguauauaagugguacacaggcauacauguaggcagaacacccauacacauaaugaugaugauuaaaagaaaaaaucaagcugggcggugguggcccacgccuuuaauccuagcacuugggaggcagaggcaggcggauuucugaguucaaggccagccuggucuacagagugaguucuaggacagccagggcuacacagagaaacccugucucgaaaaacaaaacaaaacaacaacaacaacaacaaaucaaaaccccaaaccaagggcuagggaauguagcuuaggguagaaagcuuuucuagccuagcccaucuggguuugaucuccagcaccaacacacacacagagcaaucuguuauccagggagcaggaaggugaugggguuuaggucauccugggcuacauagcaaggcccugucucaaaggaacaaaagaaggagggcuagguggaacaugcuaccuagugugcccaagaccgugggauuaaugcugucuacagagagcccaaaagucauucauuauuugcaguuaauguuacugauuugugguuuugagucaugugauuuauucaaguugugaugacauaaacagauuacuaauucauuuuuuuuaacugacuaacuaauugcagauuuaucaaauuccugcuggaaauugauagcaaacuguaaauacauuuugguucuuaacucauauauaacacccgcccucagcuuucucucuccuucuaaguacccucuagcuccacagugaccaaaacaaacaagaaagccuuagagagaugaugcagggaugccgguccccugcauugcacuuuugcagccauggagccucuccucacacccggguugcagccucuaccuggauuaacgcccggcucagcaaugaguacccgaugcguguagccguccaccaaucguccucuuucguuucuuucaguuugaccuugcugccgaugcugcacguccuugugccuuuuacaucaauaagccagccgaaagcccaaguucuugguugucugauucaggaacagguauggaacuucaauuauuuuaggagacaggucucacuauuguaguucuggcuggcuuggaacuuauucuggagaccaguuuggccucaaacucagagauuuuccugugucugccuucccugugccagcacauggccugaacuuaaauuuaaaagaaaaaaaauuaacuuuccuuuuaauuuauguauaugaguguuuugcucacacauguaacugugcaccauaucugccugguaaccuaggaggccagaagaggguacuggauccucuggaacuggacuuacuguugugagccaccaugugggugcugggaauugaaccuggguccucuggaagaacagcaagugcucuuaaccacugagccaucucuaugagcgccuagaucuuuacagaguuuauuuuacccccagcucaacuugcauuucccacugugugauuagaaguaugugcagugucuggcuucucuagaagcaauauuugccugucgccuguuugcuguggauuuguuccaaguucuaugaggacagguugaagcagugcauccguaacacuuccagagagcugccgaaaccuucgcagccucucuccauuacccuacaaggguucagcgaguucucugcaagccauggucagcuguucugucauucugcugacuguuuugugcugacugcccagucuuagcgcuguuucccauauggcacaugcacuuagcuguuugaauuagcugcuuuaacggaaacgguggguucagccaccuucccauccccacugcucccgcucccauggugcucgcucacugucuuccaccuucugaccugccucccugcugccauuccaccuucaccuuuuagucugugggcagccugguagccagagugcuccuucuggacuuggggcuccucuacuccaagcucugccacgguucccauuuccuuaaacuagcagccaggaucuuuacggagucccacagggccccgcaggauagagcugauugccuccuccucgugcugagagccuguucacuucugcaggcacucauuugaagacuucgccuuagcgaccuucucuccaaugggagacucuccuagcuguuacccucucagcaaaacaggccuugccugucugcaaauaguugcucccccugcagccucccugaaauaacaaagucagugacugggacagagaugcagcucuaggagggaccaggugaugcuagauaguuaccuuaacaaccaaaucugcagcccaguggacaugguggcacacaccuuugaucccagcacucgagaggcagaagcagguagaucucuuaguuggagacuagccuggucuacagagcaaguuccaggauagcuggggguacauagagaaacccugcuuugaaaagaaccccacacaaacaagcaagcaaacaagcaaaugaauggcuucauguaguccagguuaagcuaguugcuauuuaacugacagugacuugagcuccugcuccucuguggcuuccucuccaugugcugggauuauagcggugugccaggaugccugccuuguguaauucuagugcaggaacucaaggcccuggcccuacgugugugugugugugugugcguguguaugugugugugugugagcucgaguguguacaaauacauguagaucaugcauguuugcacaugcuuguugaagcuagaggucagccuaggguggugguuauuaggaucugccugcauuuuuuuucuuuucucuugagugagccucacuauguaguccuagccggccuagaacucacuauguagaccaagcucucuucagacuuacggugacccucaugccucugcauucuaagugcuaggauuauagguguuugucacuauacccauaucgaguagagaauuugaacucucuaugucgauucuauggaaaucuguauuuauaaguaagauccucuucaaaauacauauuuaguuauuacuaauucuuuuugguugcuuauaguuuugacacaagguuucaccacauuuauuuauuuauuuauuuauuuauuuauuuacuugggaggaaugauaacaaaggcguaacauaguguguguggaggucagaagaaaacuugugggagucaguucucuccuuccaucaugugaguucaggaauaggacucagaucgucaggcuugguggcagacucuuuuguacuggcuaguuuugugucaacuugacacagcuggaguuaccacagagaaaggagcuucaguugaggaaaugccuccaugagauccaacuguaaggcauuuucucaauuagugaucaagggggaaaggccccuugugggugggaccaucccugggcugguagucuuggguucuauaagagagcaggcugagcaagccaugugaggcaagccaguaaagaacaucccuccauggccucugcaucagcuccugcuuucugaccugcuugaguuccaguccugacuuccuuuggugaugaacagcaggguggaaguguaagccaaauaaacccuuuccuccccaacuugcuucuuggucaucauguuugugcaggaauagaaacccugacuaagacacucuuuaaucuacugagucccucacugacccgugacugaacugucugucuaggacccuuccucacuccucucuguucccugugugugcaugucagggcugacuuacuggaaacuggaggagaaggacauguaucacucuuugccugaaacuuuggagaagacguuugcaccauccccagcagagaggccccugagccagguaauaaugcaagaaccccaugcaugcauggguaucugugugucaugauuauagauaacuucaccaccauagacugcauuguuucagcuucugaaaugcugguggaagcuuagguuugagagucaggcugccuuucuuuuuuuuuuuuuaauuuucuuauuagguauuuuccucauuuacauuuccaaugcuaucccaaaaguuccccccccccccccccccgacuccgcuaugcccccacucccacuucuuggcccuggcguucaccugcacuguggcauauaaaguuugcacaacaaugggccucucuucaggcucccuuucaaauuauaccucagcucaucuccuauaugaucagaauaagguuacuucaaaauagaagucagcuagguguggagguaccaucauuuccucaaucuuggcacuaaguguguugaggcagguggaucacugugaguuggagacuagcuugggcuacauaagaagacccuaucucaagaaaacaaaacagacacaaaaauacaggcugaggagaacucagucagagcagcgcuugucuugcagucauauuacccaggcuuacucuccagagucuguauagagggcaucagcgggggccaugcuucucuucucagcucugaggagcugcagcaggcaggcagucagucagucuagacuacucggcaaguuccaggccggucuguuuuagagaacgucucaaauacaaagggguauggagcaagagguuguccuguggccuucaugugaacaugcacuugcaugugaacacacacacagagcgcacacagacacuuauacaaaaccaaccaaugaaguaaaaauacugaacuaauguuuuuuuuuuuuuuuuuuuugguuuuucgacaggguuucucuguauaguccuggcuguccuggagcuuacuuuguagaccaggcuggccucgaacucagaaauccaccugccucugccucccgagugcugggauuaaaggcgugugccaccacgccuggcuugguuuuuuuuuuuccucaaucuuuuuggagcuuuaaugauccuuucacagagauugccuaacacgcagauauuuaaauuaugagucauaacaguagaaacauuacaguuaugaaguagcaaugaaguaauuuugugguuggggaccguuauagcaugaaaaaauucugugguuaagaggacauaauugagcuaauguuuuagaaguuaaaugcuucugugucuacugguuguuucucucucucucucucucucucucucucuuucucuuucucuucuuucucuguguuagguuauuggcaguuuccuuccuuguuuucccucucuccuagaucugauggugacuucuguccuuuuaaaauucccauuagaugcacuuguaacauaauuugaagcauuuaauuuacaauauuuucuuuaagaaauauauuuuggcugagaaacccugucuugaaaaaccaaaaaaaaaaaaaaaaaaaaaagaaauauauuuuguuucuuuugcuuuuuuuaagacaaggucccauguguccccaccugaccuucagcucacuguguagcugagagugaccaugaacucuuggucccauugcccuugcuuaccugccagaguuugggaucacaaguguguacuguccuccccggccucacuuguaggcucuuaucaaguacugaggagaacagucugggacaggaaaggguuaaauaggcagcagcauuuggggugcagcucauuuuagagccuuugcauacugauccccacagccacaaaacagagcccucagaacacaauaaggaaacacagccaaaaagaaaauaaagacccucauacagucaugaaagugggaauuaaagcaaaccaaauccaaaagcaacccaugucccaugugugaugauaggugguagagacaggugggucccugggaacuugaugaccagauauaguccugcccguuuggcagaacuguagaacgagagacccugucucaaaugaaaaaagaugcauaaggaaugauaccggagauugccucugcuaucugcauacacacacaagcaugaaugcacacacaaauacugacuucuggucaguuagguguguuagugugugccuaugguacuagcuaguugcuuggcaggccacacaguaggaagaucauauaggucgaauagugugagaccaacuuaggcaacaaaccuguaaguagcauguaguuucuacuacccugcuuuaaucuccggguggacugggcuaccagccaccgccuugguucccucggauccauagaugaaagacacacauacacaucugcucuuuuuuuuuuuuuuuuuuuuuuugguuuuucgagacagacaggguuucucuguauggcccuggcuguccuggaacucacucuguagaccaggcuggccucgaacucagaaauccaccugccucugccucccaaguacugggauuaaaggcaugcaccaccacgcccggcucacaucugcucauuuuuacccugccuuagggcucagugccugggcucuucuaagccucccguggccagcgugcccugcccuuuacuccuugcucagcaccccaaaucugcccucagcuuaguuguguuucuuauuucccaccugcuacuccaggcccaagaucucacauggcugguggcucucucucccuccaaagcauggcaaauucccuuuucuccuccugcaucuccuagccugccugcaggaaccuggaagucccaucuuuuccacccagccauuggccacuagcaugucuauugauugaucacauccagauuuggaucaaagcaucagaaccaccccacacccauucccuuaacaagagaccccuggugccuuugugggcuuuaguggggcauaagguuaaaacauucgggggcugggaagguggcucagugaguaaaggcacuugccaccaagccugacgaccugaguucaguuucugggucccauuauaugguagaaggagagagccaacuccucaaguuguccuggcacaugugaguggacacacauguacacauagguauguaaauauuauacaaauuguaaagauuuccuaaaugugugugugucugugugugugugugugagagagagagagagacagacagacacagagagacagagacagacagagacugcaccuauauuugugccaugugggugaguccuggagccuauguaggccaggaaaaggugucuggaaguggaguuaugggugucgucagcugcucugugagugcuggaaacuaacccaggcccucugcaaaagugacaaaugcguuugccuacugaacuaucuugccagccuguuuugcuuauuguugugacagggucucauauagccuacuauguccugccacucaguguguagcugaguaugaccuuugaacccugaucuuccugucccugcuuuuccuguucugggguuauaguuagugcucagcuaaaauuugguauuuuaaaaaauagggucguuugggcuggagagauagcucagagugcuggcuguucuuccugaggacacaaguacaguucccagcaccuguaugucagguuacaacugugucuaacuccauuuccaggugaccugauguuccagguggccucuauacgggcaccaagaauguaggcaaaacacccauacacauaguuaaaaaaaaaaaaaaaagcaacccccccccccccacacacacacacacauaauagggcucuacaagagcagccagugcgcuuaaccccuaagcuaucuccagccuucaaggauaggcuccuagugaccugcuuccuucugcuaggccccaccuccucagggauccaguguuuccugaugacaucaucagcugggaaccagcucuuguuaucugagucuuugagggacagugcagacccaggucacgagggugguauuugugaacugccgacuggguuccaguauccccuuagucuuuacuauuaggagaagcaaauuucuauucuggaggaaacauaacaagaaaggucuucaaagcugacaguguuaaucugacagguuaguuguucagucugguuaaaaucuuucacagucuuuuuuaaggugcugaucuugauaguggauuuuuuucauuguugauuaaaugauuuuguuuccuuuugguuuucucaagacagaguuucucuguuuagcccugccuguucugaaaauuacucuguagauugggcugguuucgaacucaagagaucugccagcuuuggccuccugagugcugggauuaaaggcaugaaccacaaccacccuagcuagcuagcuuccuuccuuccuuccuuccuuccuuccuuccuuccuuccuuccuuccuuccuuccuuccuuccuuccuuucuuccuuaacagauuuauuauuagccaggcagugguggugcaugccuuuaagcccagcacuugggaggcagaggcagacguucaaggccagccuggucuacagagugaguuccaggacagccagggcuacacagagaaacccugucucgaaaacccaaaaaaaaaaaaaaaaaaaaaaaaaggaagaaagaaagaaaggaaggaagaaaaaagaaaaaaugauuuuauuauggauacaguguucugccugcagguaugcuugcaagccagaagagggcaccagaucucaguauagguggcgaucagccaucaugcggucuuuggaaauugaacucagaaccuuuggaagagcagucauugugcuaaccaaugagcugucaccacagcccccaccuuagcuuuuguuucaaguuuaacaaaaacuguuuuguuuguuuuuaaguuuuauaugucuuuaaguuuaaugcuagucaugggacgaagcgacugucacuguccuauucuagagaacaacaagaaaacaagcagcgucuugagagaggaccucaccucugcuuccauccucauucauuuacugagagguccuaggaugcuuuucuguccuuuagccuuagcugaccuagagagcugaaccccacuuuccugacagccugagcaccgaggccacaacuugaugcuuguuaaucuuccuucuagguccugacucuugauccaggagccauacgcaugaagccaaaggagcaugucgcagggauccaagcccauggcuuucugcaugcucuugacgacagaauauccuuuuccccagacuccguucuggaaccaagccugucucgucacucugacacugacucgucuucacaagcaagucauaauccuucccaggugucuggguucuccaaguauccuucaaccacgagagcaucaccuguggacacuuggaaaaaccaugcauuccaaagggaaaguaggaccagcuccaccaucccuucacgcuacaccaucacuagcaacgauaucucagucaaaacuguagacgaagagaacacugucacaguggccucagucagucagucccagcuuccagguacagccaacagugucccagaaugcauuucauuggcuucccuggaagauccugugauguugucuaaguauguauaucagcaacuggcuuauaauguuacuagacuugugaugucugagugaaugaugaaagugauuucuauuggaccacagcaauauaaaaaucuuaaugaaagaaauagaacuaaugucuuuuuuuuuuacuauugacaguuuuguugaagugaaagauaagauauugacaaaggcuggguaugguggcacaugccuauaaugccaguacuuggggggcagaggcagguggaucccugugaguuccuggccagccuggucuauauacugaguucuaggccagccagggcuacgcagauagacccuauuucaaaaucaaagacaaagguguugacaaaggcaucuaguaaaugggagcuaacagagugcuucugugucuagaacacauggcacaugugcuguguuuccugggguggauggaggaacaggcuguacucgggcuaggagaaugacuguggugugugugucugaugcucuuuucaucacugugaccagaugcccggcuguaacaucuuaaugaggaaggguuucccguggcucacaguuggaggggauacaguuguccaucauggugaaaaggccugguggcuggguggugggccugagacagcugcucccucccaggguuccugcaaucaggaaguacagagagacaaaguuggcgcucagcgcgcuuuauccucuuuguccuuuuuauuuagucugggaccccaucccauggauuggugcuccuccccugcccccacauucagggcaggucaguuaaaccucucugaagacacaccugacagacacaccucugugucuccuaggugauuucucucaaguugacucugaagcccauggcuugacucacgagggcuaaaggaugcacgguccugagagcaucuuuccuucuuacugacaggaucaggcagaaccucaaggagaagcaugcccgacacguggccgaccuucgugcuuauuaugagucggagauaaguagucugaaacagaaacuggaggccaaagacauuucugccguugaagaguggaagaagaaaaaugaaauucuugcggacaggugagacucccagagggcuaauguuucuccauccuggguagauuucuuccauagagccugucauuguguggaagacgcuugaaauguauauacuuugcauuugaaaauuuaacacagagacauguagaccaggacauaucuaaggaugcgagugauucuuuuuaaagaugugaacuuaaucucauuaauucuccguuauaaccaacacaaagccaugccuuuuauggggguaaaucucugaaccaaguggagcuagcagaugcagaguaauaucacuugugggguaguuaauacuguggaguccuuggaaaagcaagaauccuggaaagugggccggugagauggcuaaacaggggacaugcuucccacgaagcuggugaccugagcuugaucccugggacucaacaugguagagggagaggacuggcuuuacguuguccucugaccucuguguacacuccaugcacacguacacgcgcacacacacacaugcacacagacaugcacacaaaagaaguuugggacuuuggggccggagaguguacguguagcucauugguagacuauugggcuuagugucgugaggcauugugcuugaaaccuggcuuuauagcagaagaagaggaauggaaagaaagagaaagagaauggacuaacaggggauaauguuauggggagcucaccagaggugagcacucagacacaguguguagucaguugaaagucuuuauucaggaugacugggacagcacucuagcauucauggaccuacuucucuguggccuugaguguccagaacaaugggcuucuaagggcagagaccuccuucaggcagcuccuccaggccgcugcagaguaagcaguuugaagcagcagcuuuaacagacgcaaagauaaguauuagcuggaggaggauucgcacaagcaagcaguuuuaauaaaggcuaagauaaguuagcuagcacauccugaccuuugauuccuagaagagaguuggauaguuuuccaugggacuuucuaucaaggagggcgaauucuaauuaaaccuggaaacagccucagcuaaaauaaaagauggaggaaccucuacacugucuuuccccauuuuuuuguuuuuuguuuuucgagauaggguuucucuguauagcccuggcuguccuggagcucacuuuguagaccaggcuggccucgaacucagaaauccgcuugccucugccucccgagugcugggauuaaaggcgugcgccaccacgcccggcugucuuucuccauuuuaaucugguacccucuucuggauuuugcauaccuauacucaccccacuccucccucccucccucucccccuccauccucccuuccuucccccccaucacacacacacacacacacacacacacacacacacacacaccacauagauauuguaaaagaaagauugugaagcugaauuuaaaguguuuaacauagaccuggcaugcaaucacuguuaacccauuccucauacaguuuaaucauuaaacaccaagucagaugauagcugaguuuuguggaccuuguugacugucuuugauaauuuuuuuuuagauuuauuuauuuauuuuauauaugugaggacacuguagcuguauagaugguuguaagcuuucaugugguuguugggaauugaauuuuuaggaccucugcuugcucuggucagccccgcucacucagucccugcucacuccggcccaaauauuuauuuauuauuauaaauaaguacacuguugcugucuucagacacaccagaagagggugucagaucuuauuacaggugguugugagcuacuaugugguugcugggauuugaacucaggaccuucagaagagcagucagugcucuuaucugcugagccaucucaucagccuggucuuugauaauuugcagaagaauccuucuuuauaagaaucauaaauuagggcuggagagauggcucagugguuaagaguaacaacugcucuucugaagguccugaguucaaauuccagcaaccacgugguggcucacaaccacccauaaugaaaucuuacgcccucuucuggugcaucugaagacagcuacaguguacuuagauauaauaauaaauaaaucuuuuauuauuauuauuauuuuuuuauuacguauuuuccucaauuacauuuccaaugcuaucccaaaagucccccauacccucccccccacuccccuacccacccauuuccacuuuuuggcccuggcguuccccuguacuggaguauauaaaguuugcguguccaaugggccucucuuuccagugaugaccgacuaggccaucuuuugauacauaugcagcuagagacaagagcuccggggaacugguuaguucauaauguugcaccuacaggguugcagaucucuuuagcuccuugguuacuuucucuagcuccuccauugggggcccugugauccauccaauagcugacugugagcauccacuuauguguuugcuaggccccagcauaaauaaaucuuaaaaaaaaaaagaaucauaauuuaggggcaacaguuaagagcauauauuucucuuccagaaggaucuaaguucgauccuagcacuccugugaggcagcacacagcugccuauaccucuagcuccugaggaucuccugccucuggcuccuagugauaucuauacacacacauauguggcacacauacguauauacaugauuaaagauaaaaucaaucuuaucuuuagauggcucaauaguuaagagcauugccugcuuuuccagacaacccuggucgaacuucccgcacucucauacauagcagcugauagcugucuguaauucaggcucaggagauccagugcacucccaggcacugcaguaccucugugguaugcagacauccacacaggaagauaccugugcacaugagauaaaucucaaaggauuagcuaaaaaauaaaagcauaaaaaugcagucuugaaaaaggguucacacuucagggcuggggagaugguucaauuggccaagugcuugcguuauaagugugaggcugugcaguguaaagaagagcugagcaugguggugcacuaguaauucuugugccauagggguggggacaaaaggacacugggggaucacaggccagccacccuagaguaguuaguuggugagccccaggccaaagagagacccuuucucagaggagguggguggccauccugcagaugacagcugagaucccuccaguuucuucacacauguagacguucaacaaaaagagcagcgcauuagcauugaguuagaaauagcucagaaaggacgcugugcccugucuucaaauagcccagcucuuuacauuccuuccagaaacuguaacacacacguauauguccaggcagaguuuuccaagcuaacaccaagccauuuuguacaguguucucuguuuuaaaaauauaaaauuuaaauaucaaauuauguagaaugaauucacuguuuuaagugugcaguuagguggcugaaaucuguucacauuguuuggcucuccagcuccagaaucgcuuuugacuugcaaagcaaacucuggguagcagugccugaugccagaccuggcauccugaguuugaucucuggaaacuacaugguagaaggaaagaagaagagacuccugccaguugucugcacacacacagagacacacacagacacagacacagacacacacacacaccagcauguauuuaccccauuccccauugaauaaauaaguaaaugaaaaaaaagggggaaccccccugaaauucuguccuggagauauagcucauuugguacagugcuugccuagcaugugugagguacuaaguucaguacccagcagccucccaacccgacccagugcaaauauauaaauguuggaaaaagaaaagugaaaaacagaggcuggcaagauggcucagcagguaagagagcugacugaguucaaaucccagcaaccacaugguggcucacaaccacccauaaugagaucugacgccuucuucuggugcgucugaagucagcuacagugacuuauguauaauaauaaauaaaucuuugggccagagcaagcagggacugagcgaguggaguugaccagagacagcgggggccgaccggagcgagcagagauccuaaaaauucaauucccaagaacuacauaaaggcucacaaccaucuguacagcuacaguguacucaaauacaugaaauaaauaaauauuaaaaaaaaaagaaaagaaaagugaaaaacaaaaaucaauaaugaacuuaagcccuaugcuuguuaggcggucaucuccucccuacguccuuuucacugacccgggucaccucauuucuccguguguccauuaacuugcacagucugcaagugaaguguuuaucuuuccuuuuuggggggaugggguccuuggaauggaagccuggcuccugcagagguucgguauguguuuuuuugcuggcauacagugacagacuuaguucgcucagcacauccucaagacugggccauggcauccgaaaguccucucugcucuaggccuugucaucuucaucaucacaaaugccacauuuggguuucugcuaaaggacacagugccguccaccuuuccugucacugcuguggcuaguucaguauaucugcacagccuaauguucucauuuuuguccucuggugcugauuuuuuguuuuguuuuguuuuuugagacaggguuucucuguguagcccuaguuguccuggaacucacucuguagaccaggcuggccucuaacucagaaauccgccugccucugccucccaaguguugggauuaaaggcgugugccaccacugcccggcuuggugcugauaauugacuucaaggucucgugcuguguucuaaaaccuuccucuggcuauuuccgagggaucuuucugaucauugcguuacccuuuugccuugcuauacuagacuaucugggaugcgcuuguacgaaaguggugucuuggguguuggcuaacauugaggagccuuaaacauugcuuuauacuacauguggacaagcuucuuggcuuuguuuaaugcucuuuguuuucuaacugauccuaaauuucuguuuccuagguguggccagcuggauagugcauugaaugaagcuacuagucgagugcgcacacuugagaagaacaacaacuugcuagaaauagaagugguaugugcuuguuugaggggccgggucuaguguaugauguuuaaaauguguggaucaugacagcuucagucuuacugacugacuguguaaccaggagugcagauacuggguuuguuguuuguuuguuuuguuuuuuaagacaggguuucucuguguagcccuggcuguccuggaacucacucuguagaccaggcuggccuugaacucagagauccaccugccucugccucccaagugcugggacuaaagguguacagcaccacgccuggcuguuuuauucuuuuuauaguaccuuauaagcaaaauuuugguaaaaagugccuguuuuguucuauacauugucucugcuuuaauggcugguccccuucuggguagaauucagguccuugcuaagcuaggccagugucuagaaaccgagucaccccagccuuuguugcuuuguuuuaguuggcucuaucuaagugguaaacuccagcaccaaguuaggaguuaguaucucucuagaaucuuaguaucuuaauaucuuacuuucuguuguuuuguuuagagaugggucuugcugugcuguagcuuagaguggucuuggacucgugggcuuacgcagucuuugcaguucagucuuucuaaccaaguggaugggggcacgagguauuggacccagccuuaaucuuacauuugacaucauccuguggucuagcaccuauaugguauuccagacauaaucauugaaugaaugcuaacaugugaaaugcauuuuuaauuuuguauuuucauagaguaugguuaaaaagcccccguccugggcuggagagauggcucagugguuaagagcacugacugcucuucagagguccugaguucaauucccagcaaccacacaguggcucacaaccaucuguaaugggauccgagauucucuuccccauccccagcauguuaguuuugagcaguguauucuaggacaguuucauaauuccucugauguuugugguuauuuauuucuucauuggggucaucuacaaacagucccgucuaugcggguccuagaaucauuauaucccuguguaguuguuuucuguguccaccuuugguuaaucucguggcauuguuucauuagagugguccuuucuagacucugucccaggacacaaugaaaugugucacucccaucuguauguuugguucuaaugcacaucauuuuuagcuaauaccaagguaucgucacuuagagugguuuuucucugucauuucuauguagagugacuugagagaacgcuucaaugcagccagcagugccuccaaaguuuugcaggaacgaauugaagaaaugaggacaagcaauaaggagaaagauaacaccaucacucggcuaaagugucgccugcaggaucuggaggaagccuucgagaaugcuuacaagcucucagaugauaaggaagcgaggcugagacaagaaaacaagauguuucaggauguaagucgccaacccuggacucaggcagaagcagcuuaagggagaaggauccuuguuaugaaggggaagccauggcuacaggcagggagaggaugguggcagaagcaggggucugcguggucacauaacagucacauuuagccucaaggcccagcccuuguggcucacuuccacugggaagucuccacaaccuuccuaagcagugccaauagcuuggggaccaagugcucaaaugaagccuguagggaccguugcccauucaagccauagcuggccaaaaguaaugcauuagcuaguguacucuaguguacucagugaugacuuuccugggcacauuuuggucuaagccuuagaugccaaaguaacugacugcugugucuccacauacccucuugauggaaacuucauccugcagcagaaagucggcuguaggaggcuggcucagcucccucccucuucuguuucuagugagucaacguuggagcugucauagcugugucuggcaggauaaaaugauauaagccagauuuagagcaggguucuuugugagagagggucuugccguguagcccaggcuggccuugaacucaugguucaccugcuucagucucuugagguuacagguguuaacuucugugccuggcuguuucuguuguucuugugcugccaccugcucuuaccccaucccauugcacagacagagcuuaggaccuuaauguaaguguaaaugugugugugugugugugugugugugugucuguguauguguguuuacugucuguggugugucauuaucguccauuugcucuucccuguccugggugcuguggauagaguccaggacauugcaagcuauauugccaauauagcugcaucuauggcccuuuagagccaguuugauuuuuuuuguuuguuuguuuuucgagacaggguuucucuguguagcccuggcuguccuggagcucacucuguagaccaggcuggcuucgcacucagaaauccaccugccucugccucccaagugcugggauuaaaggcaugugccaccaccgcccgucuuuuuuuguuuuuugaggcaggguuucucuguauggccccaacuguucccugccuccagagugcugggauuaaaggcaugcacugccuagcuuaguuugacuuuuuuuuuuuaagucuuacuauguaugcauagugcaggugcacauguguggaaguuagaagacgacuuuccgagccugguucuucuaugguggcuucugaggauugagcgcaggccugcccaucagaagcuugggccucuugagcuguuugcacagcccaggugugaauuguuuuuaagauuuauuuauuuuuauuuugaguguaggaguguuuugcaugugugcauuuguacugugugcuugcuugguauguacaaaggccagaagagagugucagauuuuauguggauuuaauuucacuuaaaauuggauuccuagccaggcagugguggcacgugccuuuaagcccagcacuugggaggcagaggcaggcggauuucugaguucgaggccagccuggucuacaaagugaguuccaggacagucagggcuauacagagaaacccugucucgaaaaaaaaaaauuggauucauaaaacauugauacuggauuggguucaagguugucuguuuuuguuuucacuucauuuauuuguauguuuguuuguauaugugugugugucuacacauauauguagaggucagaggacaacucugaccuggguccugggacucaaacucaccuuguugucuaggcaaguguccucaccugccgucuugcuggcuuucuuacaauuuuaguaucugaauucuuuuuuuuuuuuuaaagauuuauuuauuauuuuguguaaguacacuguagcugucuucagacauaccagaagagggcaucagaucucauuacagaugguugugagccaucaugugguugcugggauuugaacucaggaccuuuggaagaacagucagugcucuuaaccacugagccaucucuccagccccguaucugaauucuuaaguugugguauuuaggugaucugaaaucauuuugucuugcugucuucccaguagccagggccauguugucgcauggcugccugggucugaaaggagcuggacggguggugagauccuccacugccugugaugaccccacaggcugcacuugugcugaucuguuugaucauggccucuguuguguugugggcaguggucuuugucacugguuugguuccucucucuggaaauguuggggucuugccccaccugaaaugaugcagugugguucuaugauccuuguuuugugggggcguucacgaggcuguucacucugggaguuuccuguuuuacuaguuauuuuuuuguuuuuugauuuuguuuuuuguuuuuuucuguucucuucagaauucuuacuagacauauguuggauuucacauugauucuuuaacuuuuaaaccuuuuucuuauuuuaauuuuguuugugguuuuuuuuuuguuuuuuguuuuuuguuuuuuuuugcuuguuuuuaaaagacagagucucuauuauuauacagucccugguuguccuggaacucacuguauagaccagaauggccucaaaccuacagacaucugccugcuucugugucccaagugcugggauaaaaggcauauacacacucauuccaguguguuaauagauuguauuuuuuaaaaugugugcugaaguguuuugucugaguguguguaugugcaucacgugcaugcaauaccuucagaggccaggagagggugguuuaucugcugggacuggaguugugagccacugugugggugcugagauuugaaccuggguccucugaaagaacaaccagugcucuuacccagcuauuucucuaagccuggguguuuuuuuaaaaaaaacccucucaaggcagugacuccccugaaauacuccguucuauucuaaugacuucccaccccacccacguccaucauuuuuuaaaacauacuuuuauuuucggcccugccuucuguuccucucauuuccuucuuguguuuuaauguuagggccuuuucuacauggaacggugcauuaucuguuaagauugacuuuuucaaagcuaacuagaaaguagcuuugcugggaacagacauugaguccucuggaagggcagugagugcucuuaaucacugcaccgucucucagaaaucccuguaacuccaguuccuggagauacagugcccuccucuagcuucuucagauaucuaugccucucccucucccugucucucucucucucacauacacacaaauuaaaaagagaaaaaggagguagcuuuguaacccugggcaggguggcucacuggugggcagcauccuuggaauggaugugugaaugaggacaaggguuaccgagcugucuuagcuccuguagcucuguucucucgggcauaucagucuuugcagagacugucaggccuagcauccaggguccagugucaggcagaagggggcaggaaggcucuuaggcaggagcuguaaccuaagcccucuuuuccacgguguguuuucuauguguuuucacuuauaccugguagccuugaguggcagcugguuugggcaguuaucuaguggcacaggauguggcagggccuagaauucccuugcccuuuuagauggguuucuguuauuuuuaagaaccauuugcauacuuucugcuguagccauguuuuguccucaucuuuggggcucucuguguguaagguccgacugcccucaacucugccauccuccuucagccuccugaaugcuggcauuccagggcuguaccaccauauguauuuuuaaauaaugcuagguggguguuuuggcuuuguguguuuauucuauaaauaaauguaggacagucuaauaaaaauuuaaaagacagaacaaacacauuuuacuauuauguugagggcuuguauugcuauuguuuuguucugcuuuuaaaauuguuucagggcuggagagaugguucagugguuaagagcacugacugcucuuccagagguccccaguucaauucccagcaaccacaugauggcucaccaccaucuguaaugggaucugaugcccucuucuggugugucugaagacagcuacaguguacucauauaaaauaaaagaaauaaaucuuaggaaaaaaaagaaggaaguuuuauuaaaaauaaauaaauaaaaugaaauuguuugagacgcaaaaggcuuucaagcauucuaucaggaaucauccuguccccuuuccagagccauugcuucucugucagcuucccuuacugaccuuggcaguuggaagagugcugcucuuuggcuuccucucuagcucugugugcaauucucuguuuucuuugcagcucuuaggagaguacgaaucccucggcaaagaacacgggcgaguaaagguaagggucaguccaggcuuugcgucgggcuuuccauagguacuggcuugggaagcaaaaugccuggcccuucuucccauucuccauccauagcuguuugaaaguccauguguuugcccuuccucuguugaugucuuuauguucaaauaucugcccuacuugacugacacguuugcuugcaagaucuguuaauguaccaaguacuauugcauggcuguugcuuuugauauggcuugagaagaaacugggcagaaguugauugcauacacucagaugaccaucuacuccuuguaaaauuagaauucucaaagcaguaguguuuauggaguaguaaaaaucuauacauuguaucugaauucuuaacugaggcucuguuuggaguuacauaucuggucucagugaguccucacaguaaagcugcacucuggccagucaacuggaugcaguaggggacaguggauuuguaagguuugggaacccucuguagcuacagcuaagacugaguuugucaggccugcaaaucacuaaagguuuuugucaugcuguucugcuaagcuuuccgucaccucuggaccuaacgcagaucccucuuacugugagcuugcuucuaauuaggcaggcaguacgcugcaucuguuagucccugggagaggacaguguuauugcuucccccuggaguugcccagauugguuccccggcucggcucgugccauccuugcugaguuccauugcaguuaacagcuggcuguuuagccuuacguuugcuuuauauuacacauuuugaaguaaaagguuccaucugagagcuuaucuccaguuauguaaauucuuucuccccuuaggauacauuaaacacaacugagaacaaauugcuugaugcacacacucagauuucugacuugaaaagguaaguguccuacaaauaaaaacugcuaauuguccuuuguguuuguauugacaguaaggaagagaaacucucucaaggacuuucaaagccauuugagaucuaguaguauccuaauccuugggcauguaaaugcauuacauuuuagcuuaggacauuuuuaaaugauuagaauauauuggugauugagucucagguaugugcauuucuccagacauuuugcuuuguuuuuuuucagcacaaugagaagucugauugaagucugaucauaaaugauccauauugcagaugacuaaaaacaucaaaauuagggcuagagagguggcuuggugauuaagagcacacaccacucuuccagaauccccaaguucaguucccagcaccaugggaggugcacuguaacccccugaguauguacaagugcauacucuuaaaacuaaauccuuuaauauuuauuuauuuauauauauauaugaauacaucauagcugucuucugguaagaagagggcaucaaaucccauuacagaugguugugagccaccaugugguugcugggacuugaacucaggaccguugaaagagcagucagugcucuuaaccacugagccaucucuccagcccccaaaacuaaauccuuuaaaaaaaggaaacuuuaaauuggccucugagcauaccuuuuauaguuguguuugggucaaauccaaccccaggguuagagucacuuuaaucugaaggauuuacacagaaaagagcagcaaggugucucgacuugccaccugccugauccagucgcuccuuaccacguuggagggcauaccugucauguuagagcuguuccuucccaggccugccuguauucccucagcuuuccuacuggcccccauacaguuuuaaagaauggaaagagggacagugagccuuaugacucccccagaucccacaagguggcaggagagaaccaacaccucagagucaguuagccuuugacuuccacauauccacaccucaacacacacacacacacacacacacacacacacacacacacacacacugauugaaauaaaugaauuaaauuaauaaauuuuacaaaaagaacuaacuaacuggaaacacuugaaguuggcugggguaguuaucuucuagucagaaaacugaagggagcuuuuauuccgaauguaguacaaaugagauggguugcugccucaucucugaauugaaaguuguugagaagauuuugucuuuuuauaauaaaagauauuuuaauuuauuuaauauuuaauaaauuauuucaauuaaaauauuaaugacuauuauauauuuaaugaauuuuuuuuuauuuauuaaaggagccuuugccucuucuaaaaaucaagaugcuauuuuuugaaauuuaauuucugacuucaugcuucacagaauccugacuguccuuuuuuucuguaguuauagucugugaaacgcugcucugcagagccccguguauuuccuguccugauuauuucugguuuuuuguuuguuuguuugugguuuuuuguuuguuuguuucuugcuuguuuguuuauuuucuuugaacuuuuccaaguguaauggugcccuuuaacugugaagaagguuucugagcagcaggcuaucacagccuuccagaagagggacgauuagguaacaucugguauucgagcuguguguguaguccgcuuugcuguguuuaauacucuaacugcuugugaccuaggacaaucucaaagcuugaggcucaggugaagcaggcagagcacgagaguaugcugagucuucgcaauggcgcuaaaguucccgagaggccgucccgguccaaguaagugacuccacauaguguggccuucuauuccucaggggagcuggagaugaauuaucuauagucuuagaugcauguuaaagucacagucgacggaugucagccacaucccuacaaagaaguguuuuugaggauaagaaaaacagagucagguggcaugagagccuccggcaagccauguguuccugaugcuggcccuaccccucuccacgugaccauaagcauagcuccugcuuuuucacuccgucuuucucauguaagcagcguucaaaaagaugucuuucuuuuuggguagguauauagacuuaaguucagaagcaggugugggacuccuggagcuggaguuacugguggcuuggagccacuggucaugagugcuaggaacugagcgugggucuauugcaaaaacagugagcucugagccaucucuccagcccuaugcaguuuuuaauaagaguuauacaugggauuauucuuuucaaguguuuauucuccauguuugccaucauucuccuguuuggcuuuccauuccagaaucuuuuuguuggcuuuguccuuguauugaggucaauguucauguggacaguugugccaguagcucccccuccccccaucccauucaguguggaugacagccaggcaugguggcacacgccuuuaauaucagcauuuagaggcagaagcaguuggaucucuaugaguuugaggcuauccuggucuacauaguaaguuucaggccagccagggcuacagaaagauacccugucucuaaaacaaaacaguaacaaacaccaagguaaacaccaaggaaacaccaguguauuccuuucuauaaacuggauuacuuugcuggucugcugagcuuuguaauguccucccacaacccuaacuccaucaucuuucugaugggugugguuugacauuguccuguucucugcaucuuugaaaagaaggggaaacagucucuugaaguggcacacgccuuuaaucccagcacuggggaggcagaggcaggcggaucucgaggccagccuggucuacagagagaguucuaggacagccagggcuacacagugagacccugccucaaaagaaaaaaaggagaaggaggaagaaagaagaagaggaggaggaagaagaagagaaagaggagaagaaagagaaggaaaacaagaagaaaggaagcaaagccuugagugugagaagcagccuugaacucuuuuuaugguucuugcuucaguuagaaguugcaaaaggauggagcuucguuuuaccagcugccucuccagugacauucgcaaggggggcacaaguaauuaccuauaagaacaagauacuggacuggagcacauuuuaaaguuuuaccacuaaaagucagucucauacacacacacauaaauuuucuauuuauuuauaucccaaaugcugucccaccuccggcccccucaucacagacaccuccccaacuccccuucuccucugagaggguaggcauccccugguuccucccccacccuggugcaucaagucucugccaggauagguguauucucccucucacugaggccagacaaggcagcccuguuggggaauggauaccauggucagacugcagcuuuagggagagccucugcuucaguuguuggggagcccacacggagacugagcugcuugucugcuacauaggaguggggggccucauuccagcccgugugugcuuugguuggugguucugucucuaagaguuuccauaggcccaguuuauuugacuauguuggucuuccuguggggguuuccauucccuucagggucuucagucuuucccauaacucuuccauaagugucuccaaucuccauccaauauuugcccuugggaagcuguaucuguuucagucagcugcuggguagagccucuuagaggacagcuaugcuaggcuccugucugcaaguauuacagaauaucauuaguagagucagggauuggugcuugcccaugggauggguuucaaacugggccaguuacugguuaaccauuccuucagucucugcuccaucuuuguccuugcauuucucuuagacaggacagaguuggggucaaaagguuuguggguggguugguguccuuaucccuccaguagggguccuaccuggcuacaggagguggccucuucagguuuucagguuccagguccccacuguuaggcuucuuggcuaaagccacccauauuguuuccugggagccuccucuccccacccccaccaucccaggucucuaaauuccuaaagauucuucccaucccccaacuccagcagcugcagauguccauucauuccccuggcccccugggucucucuccugucucucuaccaccugacaccccccccccccccccgccccaucccauucccuucucccuccccucucccuccccuuucccaccacuucccuuccuuccuccuccuccucugauuuguucccccuucuaaguaugauuaaagcauccuugcuuggacuuuccuucuuguuuagcaucuuuggaucugugggguauaucauggguauuguguacuuuauggcuaacauccacuugacagugaguacauacuaugcaugcccuuuugggucuggguuaccucacucaggaugcuauuuucuuuucuuuuuuuuuuuaagauuuauuuauuauaucuaaguacacuguagcugucuucagacacaccagaagagggcgucagaucuuauuaaggaugguugugagccaccaugugguugcugggauuugaacucaugaccuuuggaagaguagucggugcucuuacccgcugagccaucucuccagccccaggaugcuauuuucuaguuccauccauuugacugcaaaauucaugauggucauguuuuaauagcugaauacuauuccauuguguaaaugacgcacauuuucuauguccauucuuugguugaguuguuuccaguuucuggcuauuaugaaucaaguuguuaugaacacaauggagcauauguccuugugggaugguggaacaucuuuuggguauaugcucagaaacaguauagcugggucuucagguagaacuauuuccaauuuucugaggaacugccagauuuauuuucagauugguuguacaaguuugcagucccagcaccauuuguugaagaugcuuucuuuuuccauuguaugguuuuggcuucauugucaaaaaauucuaccagagaacuccuacagcugauaaaccagaaauggaggaguguuccccuuucuccacaucuucgccagugugugcuguugcuugaguuuuugaucuuagccauucugauugguguaagguggaauugcagggucguuuugauuugcauucccugcugagucaggaaguugagcauuucuuuaggugcuucucagccauuugagguuccucuguugaaauucuguuuaguucuguaccccauuuuuuaaauuguauuauuugguuuguuggagucuaacuucaugaaucuuuauacauuuuggauaauagcccucugucagguauaggguugguaaagaucuuugccuaaucuguagguugcuguuuuguccuauugacaguguccuuugccuuagagaagcuuuucaguuccaugaggucccauuuaucaauuugucaucuuagagccugagccauugguguucuguucaggaaauuaucuccuguggcauugaaggcuauuccccacuuucucuuccaugagauuucguguaucuauuuuuauauugagguucuugauccacuuggacuugaguuuugugcagggggauagauauggaucuauuuguauucuucuacaugcagacauccagguagaccagcaccacuuguuguugaaaaugcuuucuuuuuccauuuuggcuucuuugucaaaaauuuuuaccagagaacuccuauagcugauaaacaacuucagcaaaguggcugcauagaaaaaucaguagccuuccucuauacaaaugacaaacgggcagaaaaaggaacuaaggaaacaacaagcuacaaauaauauaaaauaucuuggugugacucuaaccaagcaagugaggggucucuaugacaagaacuccaaaguccuugaagaucucagaagauggaaagaucucccaugcucaugaauaggaaggauuaacauagugaaaguagccaucuuaccaaaagcaaacuacagguucaguacaagccccaucaaaauuccaacacaauucuuuacagaccuugagagagcaauucucaacuucauuuggaaaaacagaaaccccaugauagccagaaccauccagaaccacgaagaacuggaacucagcacccugcccucaggcuucuucagagcaacggugguaagaacugcauggcauugguacagacagguggaucaauggaaucgaaucgaagacucagaaaugagcugacaguuuaucuuuuguuaacggaaagaccuuuggggauggaucuauauuaagcugugguuuucugcuuuaguucucuagaauuaucuuaucguaaucuuuuguuuuugagacagucuuuauuugucccaguacucacucuguagcucagguuagccucagacuuacagugauccucuccccucugccccccaauacuaagauugcaggaacguacugcccuggcacaguguuagcuggauggcacauuuacagaagaaggcucuaacuauuagaauucaguuuuuaguuaugauuucgguauaagguauauuacuaaguaguucauuauuucauaaugaugucugucagaaaugaaguugugcuuucugacccucccuaagcuguaauuaucaaaacacuuuccaugucuuuguugaguaauagaauauaauggauucuuguauuuaaaagaaaaguuagggacuagagagauggcgugguaauuaagggcauucccuccuccagagaaccagugcucaacauuugugcuggcagcacagcaagcaaucgcucauaacuccaguguugggggacaugacgcccucuucugaacacugggaacuacacucguguacacaggcucccauucacagacacacagaccuaucauugaaaagaagaaugauuuuuaaaaucguuuuuaaaaaguaaaguaauauagggccgugcugugucucagcagcugaggacaguggccacagagugugagcacccgagccgugugagcacccgagccugagcccacauugggaaggacagaaccaguuccuaagaguuguuuucugaccucccacaugucagccaugacagacaugcaagccuacucucacaagaaaaagaaaucaagagaucguaaaaaggaaaauuuagccagauauaguagcgcauacacuugcacuuccggcucuugggaggugggugcuggaugaucaguucaaggucauccuuggcuacacagccgguuugauaucaagcccggccuauggaagaccuugucucaaacaaaaaaggauaaaucagaccagccaaaaggaaccaaaggcaaaaaugaaguuuugagaacaagcaaaagaaggggcauaaaguuugguguucaagagcccuuuuguggguuggcaugcaaggugccaggguggugagagcgcugcucauucauauuguuauaagcaggaggcagagugagcauaugaccugcaaaggccugaccccagugaccuuuucccaccagcuaggcugcauaccccuaaggccccauaauuuucccagcaguaucagcaucucaggaucugaugucaaacacaggagccuguaggggacauucauuuacaccaugauacguggcuuggauagucauagcaagaagucagguagcccuaggugacauuguggauuaaucauagauagcuuucuaaguuauuguuaggugauuggauuuuaaccuguaguccauugagaauucucuugaagauuuugauuuuaggguuuuuuuuuuuuagucaggguuuguuuguguagcccuggcugaccuagaacuucauauguaguccaggcuggccccaaccugaucuuccugcuccuuuaucccagauaugcugggauuaaagguguaugccauuauaccugguuuuaaagauugugugugugugugugugugugugugugugugugugugugugugguguucauuugccaugguauccauggaagcugguggaucauuuuauuuccuagaguuuucuacuuccuucuuuauauagauucuagggaugaaacggagucaugagucuuuuggguaagugcuuuaucuaccgagucaucucccuggcccugaagguucuguguaaucaaaagugccgccuggcuuuuguauauguacagcccugucaggagggagagcuuaguuagccauuguuguucugggagagcaggguuuggguaucugguaucuguaagagugaugguugagggccagggaggcagcucaguguacagagguguuugcuaccaggucuuaugaccucauggcugaagaagagaagcagcuuccaaaaguugugcucugacuucuacacacacaucacagcaugucugcacacacaauagaaagaaauguaauaugguauauauauguauauauaauuacaagaagaaagagcuuggaagguucuggagguggaauccacagaacaugguuguguauuggcugaugagacaagagagggacagcucaggcuggagagauggcucagcgguuaagagaacugacugcucuuccagaggucccgaguucaauucccagcagccaugugguggcucacagccaucuauaaugggaucugaugcccucuucuggugugucugaagacagcuacaguguacucauauacagaaaaugaauaaaucuuuuuuaaaaaagagagagggacagcucagaacacauaaagagaucagaccuucacgaagcucucugcuugugauuuacacggauuugaagcagaaaucaagcaggcaauuguaaauguaggcucggagcucagaacuccuagccuggagucccagcguuggagccaguuauuuccgaaugguccuuacaggguugaugggagcugaaugucaguaggaguuggugcaaggcagagcucuuaggagcccugcuuucuuguugguuagaggaguuuggcagaggagccagcgaaccagccacugcaagugaggggggaacugaagcagccauagucacugaaugcuguugagacggccugugggagcuacaagcuggagacugcuuugacucaggaguguggagagugugagacguguuuguagggugcugcagacggccuacaugucuagcaccuggaaaugcauaugugugguguccuuauucagugcggccaugguugauggggaaggcuuggcugguuacagccuuugggucaaagucuuccuacguaggauggaggaguuuuuaguguuuuuggcagggcugaggcuuuauaagcucaagggccuaaguuaucccaaaacuuaggaaaaugcuaaguguggggcuagagagguagcucagcaguuuagagcacugcuuggucuuccagaggaccuggguucaaguccaacacccccaugauggaugggucacagcccucugugacuccaguucuaggggaucugacaccauuucuggccuccagggacacuaggcgugcaugugauacauagacauacaugcaggcaaaacauccacacauauaaaauaaaacaauaaaaaauaguaauaaaaauaucccaggacucaggaggcagaggcaaucagaucucugaggccagucugguauacaaagcgaguccaggacagccaggucuauuacacagagaaagccugucucaaaaaaugaacuaacuaacuaacuaaauaaauaaauaaauaaaaaaaauuuaaaacgccagguauggcugggcagugguggcacaugccuuuaaucucagcauuugggaggcagaggcaagaggaucucuaugaguuugagaccagccugguauacagauagaauuccaggacagcuaacuuccccccucccccccccccaaaaaaaaaaaaaaaaaaaaagaaagccagguuugauaguuuuaauccuagcacuggagauuuggagauaggaagggucccugauagucacuggcugucauuccagccagagaaagacucugucucaaaggagguggacagccucuucugaggcugacaucugagcuuguccuccggcauccaugugaaugaaugcacacacaugcguaagauauuuaaucccagcacucaggaagcagaaacacguagaucucugaauuggagcucaaccuuaucuauacagugaguuauaggccagccagggcuaaagggcuguauugugaugucuugcaggggagggggagcaaagcagguuaacucauuugcacauugccuuccugcuuuugcauagcaacaacaaagcuaaguaguuuuuauucuuuugccuuuuuguagauuaaaauguguauuaaaaugucucaucuggacugucaauuuggaguaauuuuuuuguuuuuuguuuuuugagacaggguuucucuguguagcccuggcuguccuggaacucacuuuguagaccaggcuguccucaaacucagaaaucugccugccucugccacccgagugcugguaucucuuacacgcguucucgcgaccggccaggaaagacgcaauaaaccggaaucuucugcggcaaagcuuuauugcuuacaucuucaggagccagagagcaagagcucuauugcuuacaucuuuaggagccagagcgcaagagagcaagagagcaagagugcaagagugcaagagugcaagagagcaagagcaagagcuuuguugcuuacaucuucaggagccagagagcaagagcaagagagagaauggcgaaaccccgucccuuuuaaggagaaauuauccuccaccuaggacgugucacucccugauuggcugcagcccaucggccgaguugucgucauggggaaggcagagcacauggaguggagaacuacccuuggcacaugcgcagauuauuuguuuaccacuuauaacacaggaugucagcgccaucuugcaauggcgaaugugagggcggcuccccacagaucccccuuuucuuuuaauaagagcaauaggccacccauauuaaugagaguggagauagaggucaaauccccagugugcagguaaaggagccauacacauaaccuccuuccaggcucaucacccagagggguccuggucuggucccgugucguuuuuccuggggagaaggacacuuggacacucaaccuucuugaaagaugacaugucucccuagaauaggcucauaugugccgcagagcccuucuacugcagugcuuagccgugcaacucucucgggcugcugaagcacacucacucuaucccgugcaaugagacuagccucguggggugcaagagcugaguggccagcgaccuauugcuuaagcauagauauaucaggggaagcaccauguucuagagcugcaagugucugggcaauaaccaccuugucucuccuaguuugggccuuaagcuuacagaccaaccaaagaagcaacacuaauccacagcaaaguguaucuccaaauaaucccacccauacccauucuuuaaagaaggaaaaugcugaggagauccaauuggguaauccuuuggucagggacagguccaagugcguggaguugaccugaauaauggcaauucucaauucccgaagggucuguucaaauucagccguccaauucuguaacauauacugagaaagacuuuuugacaaauuagcugccuuaguaaauuucucauacugaauggaaguaacgcacaaucccggaaacuuuuguucacaucccagcugagcuauuugccauaauacaucuaguuguuccuggacaagaucuaugcguugauuaauuucugcccauggagcauuuuugggauuggaggauggcggccgcuaagccugcauuagugaggggucccccaagcucucgacaaacccugagccagucuuguaaaccuuuguucuuucuuggggcuauggcugcucggcacuccuguguggcuugcucauaaaugagcuguuuuaccagaggugcggcuugcucugaaucuccaaaaauacgcucugcugccucugucauucuggccagaaaaacugagaaugacuccugaggucucuggacgaucuuuguuaguuguccaguggccucaccugcucgggagagcgccuucuaggcccuaauagccguggaggaaauuugggcauaagcuccccagugguaguuuguuugaucagcaguauaagcucccugacccguuaacaagucaaaagucuaaucucucugcucuggagucaaagcagcagcguuugcucgggccugcgcuugugcagccucuugccauagagcucuccauuucauauauuugcccauacuagggagagcggcuuuugcaaucauuugccagucggcaggaguuagugccaugccggcaagccugucuaccugcaccaagguaaaauuagcauugguuccauauuuacggaccaacucggcaagcucuuuaaucugcacauacucuaccggagcguggacacgcccacccucggcuccuucaaagaccggaaaugccuguugcauuuuccuuuguuccucucuaggaaugaacgagucugcgcauugccucucuguccauugccucucugcgcauggcugaugccuuacacagggcgggggggcuccgcauagggcggaagugcacuaugaccuugaagccgacugccuggaggcugaacagcaugcuggccuucgccagccgcuuuuggcuuuuuccuuaacugauuagcuagcauuuuaucuggcugguacuuuuuucucucauaacgagcugcuuccuucuccaagucuguuucuucagaggagaauucuucaucugauucagagcuacuaagagcuggcuccuugagcucaucuagugaugaguauagacuccuucucuuagagaccuccgcuaauugaucuuuuuucuuuucuuuuuucuuuuccuuccuucuaaucucuccccagguauucuuaccugaccuaaacuuuuccucggguucaagacccuuggaaaggccuguauacuuauuuugugcaccauauuuccucuuugcuccuacucucucuccccgcuuuacuucugauagauugcccugaauuucauccaaaauuuucagcccugccuuaaccgcuugauaacaugugaaaaggaacgaaaaggcuccuaacacuagagaaaguucaaggccaaacauaccuuguaaagcuauuucccacuuuacuucugauagacugucuugaauuucguuagaaaguucaagaccagacuuacuuuguaaagcuauuucccacuuuacuucugauagacugucuugaauuucguuagaaaguuuaagaccagacuuaccuuguaaagcuauacuuacggguacccuguuccccagcugaagaguucugaauccaggcuggauccuucucaacagucuguuuuacgggaacacuuuauuaccaccguuccccagcugaagaguucugaauuuacgcaguugaauccuucucaacagucuguuuuacgggaacacuucauuaccaugacccgcaguucugguuccagaaugagggaucuuucuugcgccggugaugguaaauuucgucccggguuuucuugucccgggauuucucgucccaggucuucucgucccggguuucggcaccaacucucgcgaccagccaggaaagacgcaacaaaccggaaucuucugcggcaaaguuuuauugcuuacaucuucaggagccagagagcaagagcaagagcucuauugcuuacaucuuuaggagccagaacgcaagagagcaagagagcaagagugcaagagugcaagagagcaagagcaagagcuuuauugcuuacaucuucaggagccagagagcaagagcaagagagagaauggcgaaaccccgucccuuuuaaggagaaauuauccuccgccuaggacgugucacucccugauuggcugcagcccaucggccgaguugucgucacgggaaaggcagagcacauggaguggagaacuacccuuggcacaugcacaaauuauuuguuuaccacuuagaacacaagaugucagcgccaucucgcaacggcgaaugugagggcggcuccccacagguaucaaaggcgugcgccaccaugcccggcuuggaguaauuuuaauagugaaauauagaacaauaaaaaauuaggugagaaagaaauagaauuuuucuuuucuuuucaaagugcuggugacuggggcuggcaagauggcugaguggauaaaggcccuugccaccaagccugaaaugaguuugaucccuggauccaccugguggaaggaggaaaaucagcucucgcaagcugggcucugaguuucacaaaugcuccgagauauguguagaccccucauaacaaacacaugcagacauauauagacaaagucaauuucuacaaaagaaaaucuaggaacauugaucugggaaauaguuacuagggccuugaugucaguuauccauuggcguuauaagauaagcccguguucuuguaaguccauaccaagucaggcuccugcacuuugcagguaaaccguacccguuucuuguauuauccaugaaguaaucugaaaccauuacaacaaaaucauuaaagugcuggggaugggacccagggccuggaaaaugcuagauacaguguuaccaaugagcuccaccuuucugaauuaacaccagcuucagcaugucccauaguuccgaucugacaaaugcagucaaggccuuaaaacugugagggggaaugcugagugcccguugaggaccuuuucugcugugagcagggaacugugggacugaagagacucagcagggcuuuaguuguuuguaguggaaaucuaagggguguagaacaaagugaaggccuuaugcccgguaucacaugcgugaaaccuuuaaaagaaauguguacauuuuuaaacugugugugcaugaauguguacucgccacugcuuauguguggaagccagaggacaacuuucaggagucaguucucuuuccaucaugugauuuccagggucaaacucaggucucagguggguggcaaacccucuuaccuacugagccauucaaaggcucauucgcuuguguguguguguguguguguguguguguguaauuuguuuuaaugacagcaaaaauaaaggacaaguguuuagaauacaaacgaucuaccauaacuuaauaagaaggagacaauuucuuccacagaaaaaggaaaaagagaugugaagcugcacagaaaaagaaauccaaauagccaauagcaaugaaaagaggcucauuuuccuaagaaauuggaaaaaugccaguuaaaauaauagcauguaccauuuuugccaucagacaggccagacuuaauucauuccaaaguuuggcaaagaugaagaaaggaacucacgcauaccaauggccgccugcagauugauggcgcuugucuagaggacuguuugacagcagccagaagccugaaggugauggauaugucccagauuucaugguugugcuuuuagacauuugcuuuagguuaagucucccacguguuaauaguagcguuguugaaacggcauccaccaccgggagacaaaaucagcagagugcauucagaggagagacgugauugacagcccugcacgccagcaugaauaaaccaugaacacacuggaggagaagcguuaaaggguguggauagcaugcccuuguuuaacaaaugcagcuauacauauguauacaacguuaugucucacaauuaaaaacaaauauggcucagaucuaagcaucuguuaagacugagagucgguaggugggcgcuuguaguauucacuguaauuuccuaagaguguuugaaauguuucuuaauuuaaaaauugagggaaaagggcucuguucuguugcucaguggcagagagccuguguggcagugaacaaggccuggggacaguuucaggcucaccagaagaucgguucugaaaggacaagagugaccugggguugaagugaaaccuaaucuagcggugagcuuaacccagcagguuaaguaugacaugagcagagaggaagacagcaugcucucuuaggguuugcugcuucuuugaagucggaccugagguuaucuccccacugaaggccgcugggaagagcuguuacagagucagagcuugcugaucaaggggaggaauguccaggaugaaguugaucaguaggcccaggcaggugacaguucagcaaagcucagccacggaggauggacaggaaguaaggcccccguuguccgucaagcuggagguuuuacuuccagucagauagugagagcuggacucaggguugugaauaguugaggugguggcugugcuuucccaaguggacagaggaacuggagaagcuaggauugauuggggagcugagggacccugggcucauuagcugcuggcugggaugauacuugacagccgcagguacaaagacaggggaggaauugggguguucaguuuccuuagagcugugaccucugaugaugacagaguccagucguauccuuggaaguagaugacuuuguagacagagucacugggucuagaggucaaggauagcucuggaaguugccucgugcgguggugacagcaggccuggagaugagauagguuugugcugguuuauuaccucuauuagacuggcucugauugacauuggugugguuggacccagccuacugugggcagugccuuuccugugcagguagaucugggguaugguguagagggcuuaguuguacuggagaccggagagcaagccaguaagcagcacucccuccaugaucucugcuuucuuuccugccuccaggauacuguucaacuuccuacccuggcuaaguagaccaagcuggccuggcacuagagauccauguccucugcauccugaaugcuagaguuuaaggcaugggcuaccauacccugcacugguucacagucuaguagagggcaggguuugacaagguguaaaccucaacaaacugaguguuuagcauuauuacuauuuacauuuuauuuacuauuugaguaagugauacgaaccucggggaagcaagguuuuaaaaaguaguuugagucaggcaguggcgcaugccuuuaaucccagcacuugggaggcagaggcaggcggaucugugaguucaaggccagccuggucuacagagugaguuccaggacagccagggcuacacagagaaauuuugucuuggaaaaaaaaaaaguaguuuguguuuuauuuauuguccucaucacaugcauacaugugugugcacgcgugucugugugugugugugugugugugugugugugugugugugugugugugugugugaaggacaaaagaagacaacuugcaagggucuguucucccuuuccaccauaugagugccagggauugaacuccacauacagacaggaagugacaguauagcccugugccacugguaucauaggcgcucugagaagucggauagcagcuugaugcagguaguguuugcagggaauggggaagcagccuugcuuuaucugcuuccucugagcguguagagagacggggacuaagugugcuagaacgcagcuaggggcugugcagagccuugagcaccugacucuuccuuaucuuaggggaauguuuaaaaguucaguugaaucuuaaaaccuuaaaauagccggguggugauuguggcagcacacaccuuuaauuccagaacuugggagucagaguuugagaccagccuggucuaaauaacaaauuccaugacaaccagggcuaccacagagaaaacgucuugaaauccccuccuccucaaaaaagcaaaacaagacaacaacacaaccccuuaaaauagaauuaaguuuuaaaguauagguugucuauacaugguuucuaagucacgguacaaauguaaaucaaacuuggagaugguuguuuugauauaaauauuugcucuaaauugaagugcaaggggcuagguagaugguuuugugguuaagagcacuggcuguucuuccagaagaccaggguucaagucccagcauccccacaugggggcucauaguuauggguaacuccaauccuagggaauuuaaugucuucuggcuguguuggguaccacacacacauaugguacacaaacaaaauauucacccacuuuuaauauauauguuuucuuuaaacugaagggcaaaccucguugauacuguggaauguuucuuaucccuacagcuccguagccaccucggaugucagcaggaggaaguggcugauuccaggagcggaguacuccaucuuuacugggcagccucuggaccccagggacaggaagcuagauaagcagcuggaggaagcccuuguuccugggugagauaauggcagaggucagcugaggaaggcuuuuguagagaugcagauggcuuggguagaggaaauagucaaaaguuggcuaugaaagggaagcggggcaggagugggagagacaagaaacaguuccugucuugggaugucugccuucucuuugaaguuggacccaagguucuuccuggguugugaaaaucaggauggagggcgggugaaaaguggacagggugugaaucagcugucuugcagagauggggguugcuaauuauggaaaggggagguguccacucaggauagugcugaugaguagacacaguugggugagaguguagacaggaugccuugauuaaacacuugaucugcucuucaccgccaugagcugggauuccagcaggcgccaccacauccacuaguugaucuuuuacugucuuaucuuuuagaaccuaguuuguguggcuuugguuuggcuugguuuuuuucgagacaggguuucucuguguagcccuggcuguccuggaacucacuuuguagaccaggcuggccucgaacucagaaauccaccugccucugccucccaagugcugggauuaaaggcgugcgccaccaccaccuggcuuuguuuuguuuuuugcuugcgagguaagcucucuuagcaguggauccauguucucaguccugagaggccuuuagaauguuucaccuucauaggcuuuguagcgcucucugccugugcucaggggcacagugcaggcuuguuguuaggacaacaggaaaauccucucgcucucgggauagccugagcaagcucagcaguguacucuggguaccauagagguggaaauguuugucuaugcuagcuuguuuaaaggaccaugaagcacuggcuugcuaugugcagguucaguuuuaacuacuugcauuauaacagcagccguaugagauaaauggucaacucuccuguuggucccgacaguucuaguaaacuuagcgugguuugcuguaacuagugagcguagacuuagauacguuuauggauuucugcaguucgggugccagcagagcaccaagaggucuuggagagggcuuuccuccuggcugaguuucacauggccuguucguggugugcaccagacuacgugcucucuguuuucuccccccucucucuuucacuuuaaauguauuauuuucauuuuaaauuuguauguguguguuuauguacagggaccuccugagacuagagauuucuuuuuuuucuuuuuucuucuuuuuuuuuuucgagacaagucuugcuuguguguccaagguuggccuggaacucuugaccauccuucugcuuuagccuccugaauacugggguuacaggcaugugugcaccacccagucuauuuccuccuuuucuuauaaggaccuucaaucccaucaugaggcuccccucucaauguccuguccaaucuuccagcuaagcuaggcugccucugggcaguaugggcuagggggcuugcaaauguucagcccacagcaguuacaauugcagcuacuguuuuagauaccauucuccuccagaaaaggacucuucacuuggaaguucaccagcgagccuccugguuaaaaagaagagggacacuccggacacaccaccgaucaucaaggcuuuaaaggaacuugaugaagaaagaguauuuaaaaguugggggacacagacagagaaagaggauucuucaaguaguaaguauuucuuuaauuguuuguuuuguuuuaagauuuacuuugccaggcagugguggcacacgccuuuuaucccagcacgcgggaggcagaggcaggcgguuuucugaguucgaggccagccuggucuacagcgugaguuccaggacagccagggcuacacagagaaacccugucucgaaaaaccaaaaaaauaaaaaaauuugcuuaucuuauuuuauguaugugaguacacuguagcuguacagaugguugugagccuucaugugguugcugggaauugaauucaggacuucugcucgcucuaguuggucccgcucgcucuggcccagagauuuuauuuauuuauuauaucuaaguucacuguagcugucuucagacacaccagaagaggacgucagaucccaucacagaugguuguaagccaccaugugguugcuggaauuugaacucaggaccuuuggaagagcagccaaugcucuuaacuccugagccaucucuccagcccauauuucuuuaauuuuaagagugauuuuauuuuaugucugugaguguuuuaucugcauauaugaauaugcacccacaugcaaaccuggugcccacggaaguaucggguuuccuggaaccgggguugugaaugcuugugaagcgcuguaugggugcugagaccugaacccaaguucaguacucacugcaaguacacuuaggugaggagccgucuuucuaaaagcuaccccaggaguacuuuauucccuuuuuaauauugaaagaaagaaaaagguaucugcucuuuucuuuaauuuauauuauauucuuuaauauuagauuuuccaccaagcauggcacugcaugcuuuuaagcccagcacuuuugaggcagaggcaggagucucaggccagccuaguuuacauaguauguaccauguccaucagagcucaaaaaauaaaauauauuucucaagauaaugaaaugaaguccuaauugaugauacugcucuagccccauuucauagacaguugacacuuaauaacaauuuauaauuguccuagcauagaacguaucuuuuauuuaaagcaagcugcauaucuggucauuuaagaggccuacccugagauagcucaguggauaacagcacuuauuuuugcugaggaccugaauucaguucccagcacugacacaguggccuacaaccaucuguaaauucuaguuccaggauaucugaugccucuugccucuguaggcaccugcagucaugugcacauagccauaugcugacaugcacaccuacauguaauaauaauaauaauaauaauaaugauaaugauaaugucuucgagagcugggcggcacaggcauauaaugcaguugugugggcuaucuaggaagauugaaaccacgcccugcgugcacuccugaguaagugucuccaucuguaugccuuacuugcacauguugggaaauggugacggucauuuuauauuaauaauacgaggaauuaaauggucagugggguacaugccuacuuuuccagcacuuggaggcugaggcaacagaaucuagaguguccaaaaauauagaaaagcagauuuuuccuuucuuuuuugugauuacugaggaagaggaauaucuuucaaggugugcucccccugccuuccccccucucuuuuucucucccccuccaucccuuucuuuccaccguccaucuuuuucucucuguccuccacccuucuuucuauuugagaccagagcucauggagccuggacuagccuggagcucacuguguugcugaggguaaccuugauuucugcucucuugccucugccucccaagcucugggcucaccucaccaugccuggcuccuuuguucucuuugcuuccugcucacuucucaaaccuacgaggcacacgcccucccucugcuuuguggugcagcaucccgcagcagcagcagcagcaacuccuaguaaacacauuaggaaucugcuuccuaaaaauauacuccuggggagcacucaccuugaaugccagaaacucucagggagcacucaccuucaaugccaguggcaacaggaagccaggaugcguucauuauaaacuccuucuuaagcaguuuaucaucggaaugcagggcacuugcaaaucauuauugcagccuggguagcaguacuuugagcagagcgugcacucuguggagggccuugugccaugaugguugugaaaagcagauggggaagccaggucuggcuuauuuguguguguguguauguuugucugaugcagaauuagugaauucucggcaaacugagccuucagucaauacaggccguuccccagagaaaugugcccagcagagaccgaagagacagacuucggcuucacaaaggucgucgucucucccaccguccagucggaaagccaacacuccaaguaagagaugugugugccuuggacuaaggagagugacuuccuguguaugccgagcaugggcggggucccugaaggcgcauagauacuacaaacaucaccuaagaaaccucauuauaugccaggccuguaguagaggucugucaucccagcuaccugggaggcuaaggauuaagguucaaggccugccugagcuaccaagugaguucaaggcuagcaagcccugucuuaaaaauacaauguuagaaggguuugggauauagcucagugguggagcccuggccuagcguggauggggguccuuaguaucguaagaaaaagaaguugguucagaaaagccaaaagcuuuugagaguuuggaucacgucaauggcugugaaauacuuauugagacaguuacggaggucagagaagauuccuuuugcaucucugcccugugcuuggugucuguagcuuuuccuucccaggguucccacucacccuagagcuuaagcauugccuuucggguccucagugucuacauucccacccgcucagggaagucuaucuuuccuguguuccagggacagucucuccugcacuggcguuucugccuuauuuacacucgacuucuaaaaucuugaaaaaccaguuuugagccagagugcugagacuauagucugguaugcuaacacaucagcaggguuugccucuagacauuagaauuauggguuguuuaauuuucacuuuguguccucugcaauacugucaaguuuugcuguggaauuucauuaucuguagaauuaggaauaaguucugccagcauaacacagaggaaaaauugcaugucuucuuugcuuucuucuuuagcaaaaagagagauuaugcuaacgccagugaccguggcuuauaguccuaagcggucuccuaaagaaaaucuguccccuggauuuagucaucuccuuagcaaaaaugaaagcaguccaguucggugaguucugugaagccgugggauugaaaauauauuuuaaaaacauuuuauugaucgugugugugugugugugugugugugugugugagcgagugugugugccauggugaauuugugcacaucagaggacagccuguggcgcuggaucucugcuuccaccauguggguuuggaggcagguuccuuuaccuacugagucaucuuccugaccccagcgaugguuuuaagccaucaauauggcuccagcuguccggucauggggcccuguggcuuuagguccuuuauaugaauaucauauggaaaaaucagguauuggaauguguggaaauaguuuuuaacuauggaaacuugcuguugauggacauuaagugucgccucagcaccucagcagaguuuagauguagaagaggcucucugugcuccugaggaggagcgugauuuagggacauuuuggugccagcuagugggugugaggguggcaggcgccugucucuagaugcaguguuuccacuccugaaguaggccagccgugcgugacgaacuggaaaggacuugaccacuggauuccagacgcagucgccuaagcacagugacccccaugcccaccuucugagcaagcugggugcugccugccugcccugccuguuccagaagcuugccauggaggacagaggaugcacagccaccagcgcuuuaagcuucugaugugggaauagaacuuugugucaggaaagccagguuccgugccagcuuugucagucaauaugacuagcguucucuuaaggaaccaugugacugugagcucguagggugccagcucagcucucuagagagauagggaaacucacuucacauuuuucucacgagucgcuugcuucauucacuagauuugauauccuuuuggaugauuuagauaccguuccuguguccacguuacaacaaaccacugcaaagaagcagcuccaguuucugcuagaugacucagaagguaucuuuuccuaaaaauuacuggucauagcuagaggcauuuguuucccaaaguucuggugucucuguaaggcucugaagauggucucugccugagcauucacucugugccugcuguacgggugcugauugucaccaccagacaguucuauacagcuccccucuuuacacugucccugaaauaaaucuauaagcuauaugaagucacuuuguauaacaauguuaaguguuucaggguuuagagcaugucucccaaacgugauaaaucauuguucuuaaacuuuucugaaacugaauuauauuuacauaaaguuuauuugaagucauuaagagaacuuuuaaaaaugauuaagccaggggugugccuuccagaguuccugugcgauaaagcacagaguguguauucuucagugugugugugugggggggggggguucacaucuuuuaucccagcucucguggcugcagcaggagaguuacuaugacuucagggccauuuugggcuacucaaugaguuccaggguagccuggaugugugugagacucugucucaagaagcugggaggggaagaaggaaaagcugccucucuucuuaugacuaagguuuaggccauauagcaguuccuuucaggaagugagguugagcuggguauuuaaugaauauucagucuguuacaaaaauuaauaagaaacauaagaaauuuuuuucuuuccugacagaaaaaaaguauucagaaaaaaacagugaugacccuguuaauccuagcucuuguccugaacacucaccaaauggacugaagaaaguguccacgagacaagccugggagaagaguaagucagucagccuggagcagugucagccgggaucagcagcaccacaggacaacgguuuugaguauacagcgaagauuaggacccuagcugaaacggagcgauuuuuugaugaacuuacaaaagaaaaagaccagguaaaacaaacaaauauauuuuaaaauacuuuaaaaaauuguuuuucugaaccuaaugcuuaugucuagggaagggacuuacuaggcugggcuugcugguacguguuugugucucagcucaagagaggcuggggcagaaagaucacauguugauagccagccuagggcuguauugugagacccugucuccaaaagaaacagcaaaccaaacacacaagcauaaaccacuaacagaaaaaaaaguaaaacgcaagaauccucuggucacuguucuauugcugugaagagacaccaugaccaaggcagcucuuaggaaagaaaacauugaauuggggcuggcuuauggguucagauguguaguccauuaucauccuggcauggagcauggugacauacaugcagacauggugcuggaauagcagcuaagaguucuacaucaggaucugcaggcagcaaggggagcugcucuggccucggcaugggcuuuuuuuuuuuuuaagauuuauuuauuuuauggauaugagugcucuaucugcauguauaccugcugugugccagaagagggcaucagauuccauuacagauaguugugagccaccaucuauaaugggcuuuugaaaccucaaagcccacccuaguaauacuuccuccuucagggccacaccucaaucccugaugacuaagcauucagcuaugugagccuaugggggccguucuuauucagacuaccacaaaggagaucauugugucagaucuaucauggggaauuugccuuguguauauaguagcaugggguaucagauggcacuagaagucacacuguugaggcaacuugucaaaauggacaagaaaauacuaagcugaaaucuuuccuucccuuucugucucagaaagcucacugccaguaacuagaauucuuuuguuuuuauuugaacaauuucucuuguuaacagauugaggcagcacuaagccgaaugccuucuccuggaggaagaaucacuuuacaaacaagacucaaucaggugagacagcuuagugugagcugcguuaaggguggcuaugaggcagugcuccgagaggagucuuagagcauggcucacugugcugguuacuuuucuagugcugggauacaccaugaccagugcagcuugcagaagggaucguuuauuuuggcuugcagauccagaggguuagagucuugugaaggcuaagugaaagauagguggcugaaacagcagcugagagcucacaucuugacaccaaacaggaaguagagaguacaguggggagagcaggaagcuuucacaguuuugcaucccuaccuccaacaaggucacgccccaacaaggccaugccuccuaauccuuuccaaacaguuccaccaacuggagaccaaguauucagauguaugagccuaugggagccaucucauucauaccaccauaguuacuaaugcagcagucaaagcugcuacccuuugcagucaguauuugauaguuauaguuauuccauagcuacauuuacugucaggaauaaaauuaauuuuugccuuuagauguaaaaaaugauguuuguucaugguagcaaaugucauacauuuuauuauuugguaaggcucugguaacauaacccagggccuuggacaugcuagggaguuccccucagcccaccagaagccugugacagauuuuacauugcugaguaggugcugccuuccucucugauggcuuaucuuccuccacugccaucugucagugacuucugacccucuccaucuagcaaacccugacaacaguugugcuucacaaauggagugagcgcugugauuggaaagacagcuagggagaugugacuccauccucaggagcagagggucaguuuaggaugugaugaguuugccuguguguucauuugugcacuguaacagugccuggugucuguacaucaguucaauuccuagcacccauauggcauugcuccuaauccccgagccaucucucuagcuaauggaauugcuguugagggcuuguuuacaaguucugacaggggaaacucagcuacucauauagccuugagagaagacugguccuacucuggggaagguuguccucuuugacuaaauguacagcuuuggaaggacugcacauagagcaguggggggaggaaggggacacaaguugacccagucagauuauccccauauccaugaaauuuaauuuuuaaaauugauuuuauuaauuguuacauguauuugcguguguaugauguugggggcauucauguuccaugacacauauguagaugccaaguuuguggaguugguucucucuucccaccuuuucuuggaucccaaggaucaaacccaggcuuguugauggcaagucaucuuacuugccgagcccuuccgccauuauuucauugaagaauucacaaugggaaacucaugguacuucacaaggaaagcggagggaaauguggugauaacucauuaggaaauccuuaguguguuuucauaaugaacaucaguguucuguucucacaggacgucugaaagggcguuagauucucuucaugugugucaugucacuaagaaaguaagugacagcgagaaaggauugaggauguguguaagggaggguagagcugggccagggagggguguccggccucacuggagcagugcugggguuguaacucauguagcacacaaggccuuucuccagcaacacugauagaaacacucagccugcucucaagaaucacacacugaagcagagauggcugcuccacucagcauaggccauccuuacacucugcaggcugaggcaggaggauccuaauuuggaugccagccuaggcuguaagagccugucucaaaaaauaaggcgaguuggagauauagcaaguugguauuugucuaccguguaaacccaucccaagcaacacacacacaacuggauauggugguacacacaugugguacagcguuugagagguggaggcaggauucaaaauucaagaucagcaaccauauauugaguucaaggucagcauggacuacuucaggcuugucuuuauuguuguuguuauuauuaaauuauauuuuuaaaauuaauuuugguuuuucuagacuggguuucuuuguguggcccaggcuguccuagaacucacucuguagaccaggcuggccuugaacucacagagaucuuuguucuucugccccuggaguguuaggacuaaaggugugugccaccaugccuggcuuuacuaguuuuaaaaacuauuucauguguauggguguuuuuccugcauauaugucugugcgcuacaugugugcuuggugcucaaggaggccagaagacggcacauagcccuggaacuggaguuacagccuguugugagccaacacaugggugcugggaaucaaaccuugguccucugcaagagcaggaaguccucuugacugcugagccauaucuccauccccuacagagacuucuguuagugaaaagagagaaauauaagauaacccacuaguacaauuguuuaaguucuuucuuucccucccuaauuacaucaguagguugaguuuuuaguuucuuugagcuaugguccuacgcuggcuuugaauuccucagcuuccugccuccaccucacuagcucugggguuaugagcauguccaguuuaucagguguuuuauuuccuuuuugaaagcaacucauagcauguagacaaugcaaguacaaaucaccagacuuucuggaaugcagaaaucugccuuucuuugaaccaaaaugcucucuuccuugucugccagugauugcaaaggcaguauuuauagauacugcaaagagauauguuuaagaaauguacugcagccuuauuuauaguguccaaaauuagaagcaaccuaaacuucuacggaaagauuccuggugaaauguguuacuugcaaaggaauauuguacauuaauuuaggaggauguugucagaagacacauuauaacaugccaagaaaguucaaagggaacaaucuuugaaaccuuccauacuagguuuucccccucaaaaaaggaugugcauauacaaggggacagggaagaagagggugguccuucccuuuggucaccugucuuaguguggacauguaaucauuuuauuaaaauuguuaaacauaacaggcuuuauuuuaggauaccacuugaguccauauggaauauauuaucuaggaugguaaauauauauucuagguaucauuagcugcauuucuucaucauuaauuauuaaaucuuuuuucuugaagucuccaguaacauuuuaaaguugucagguuauguggaauguaugucuguggcuacagcagcauccaguaugcacaccucucugaaaaacgguggagagcaccuuuaggcucugcacauacagucucacguugucacuccucucauggcugcucugccgugaagaauucccauauggccaagagugcccugcagauggaggcuccuuaaauugcccugcuuauuuggaagggcugagaagccaauccacuguucaguuugagaagaguuguuggccgggcaguggggggcgcgugauuuuuaucccaccauucuggaggcagagacagguagaucucugauuuugaggccugccugguuuccagagcuaguucuaggacagccaaggccacacagagaaacccugucucaaaaaaaaaagaugauuguggagaaaguaaaaucugccauuuuuucaccaaccuaacgucuguaggugcgguuguugacuguagacccagagaguuugaggaggauucucaugaccuuucccauugcuuuuaccuaggaggccuuggaagaucguuuggaaaagaucaaccgugaacugggcucaguucgaaugacccucaagaaguuucauguuuugcgcagcucugcaaaucuuugagacugguagccauuaaacuugagacauuuuuguuugcacuaauguaacaauuaugcacugggaaaaggccagcucuuuucuacuguuuauaagccuucagacgguaguuuuacagucaugcuauucuuacaccugcuauuuuauacuuaaaauggccacauauuuucaagauauuuuuguuaugcucaggaaccucuuguauauuuuacuauuuaaaaagcauuauuuuuaaauagcauaugucuccaauuucuaucaacaagaaggaaauguaccuggggaggcagcuuguuuguaaagaaauaguguuacccuuuuacaaugaacuuugcacacuggguuuauaaacuuguucuacacuguaaacauaauucauuuuuaaaauaaaugcuuagcagcuuccauaaggauagacugacaugcuagauauuuagaauauuauaguauaguucgcauugagguucuguaguaguuuuuaagaaaugauaacacaauuccuaugugaaacacaugccuugaauaguagaauaauugggccagcaagaagguucagcagguaaaagugcuugccgcuaagccugaagaccuguuuaagguccaggacccacgcguuagaaagagagaaacgacucccucaaguugucuucugagcucuacauacacacuggcacguucacaucccuucccaccccaguaagucaaugguuaaaaaaaaaaaguaguucuugagugcuggagacuuuaaaaacuacgcaaauauaacuuauuucucuacaguaauuuuguuugugaggaaagaaaaugauuagagcuggaaguggcagguggauagcuggguuuucugcccgugcgucauucaugcuuuacauugugacccaucuugggcuguucccaggguggcuccaguuuccauuaagcauaaagcuuuagcucccaaagucaucgucggaacaguuucacccucuuaaccuuaccugacccacccacccccacccuugccaaagagaaaagcacuuccacgguaagagccauuggucugcgcucagagcacucuacccugccugguaauggacagaggauguguguuccccagggcccugcggcagacuuuaacccgucaccugggugccauucccuaauucucuguaagagcgcugugugggcaggagaagcuguucccagcuaggagcagcaaguauccugucuguguugcgacuauuggugaugucugggcugcucacccacucacuuucuggugaccagugcgaacccagcacccacauauuugugcucugagucugcagacagagucgucugagcucucacaguugauuuacagggccagggcucaggcuuuugauuuugguuugccccugaguucuuucuccacgaugagaaacuacuuagagugacccaaggcauucaggcagcuccauuacagcguaugugucucagcagguucagguugucuccgagcauuuucucgccaaagcuucaccuaugcccuguucaacuugggacucucaggcaggaagggacccuugggauaaucccuaaccccugagcuccucuucaguaacuagggaaggcuggcuuaaucaggauuuccuaucauuagaagcaagugccuuuauucuugauuuuucuuucagccuuuuaaaaauuauguuacaguaaaaaaaaaaagguucuuuuuaagcaagaucuuguauaguugugaugaguacuuacaaaggaauagucuauuuuuuaauauguccuuccaugugauaugcagaauugacaagcugagaguguuguccacguggugguagcgugcuugccucgugugugagggcacgugcgcuggcaccaacaaacgugacugcccgaacaagcugacagugcucccgugugucucaucguucccuccucccauuguauagucaacugcauccugaagaagaagaaauugccacuagcuuuaucuugccaaggaguuaucuucuugggugccuauaauuggcuaauuccaaaaaagguguuaaacgccaucagaacaucugcgcuccuuagaaagcguaagcuuugguuuuugaaguguguaauagauguaaacuaucaauuacuuauuugaaaaagaaauuucauucuuuucuuccucacagcuauaaagaaagacaccaagggaaguucuugcagcugccucugcccugaguaaugcguaucuuaugaacacucagcuaaaaagcagcucagccuaaaagugggcaggguagcagucuuaaagagcaucuguuacccaagagaggcaaacuguuucuaugcugggauguacugcagcuaguauuaaaaaaaaaacaaaaaacaaaccaaucucagugagccugcagcuucugagaagugccuuuuaacauguacauagaaaauaaacucuccagcuguggagcugugccccucucuucucacaaagccacucugcgggagcuuugagggauggcuccaggagucgcauuagcuagagcuaaagcacugcugauagagaccagagaagggagauuuggagccagacaaucccgggccacacccuggcucaggccugcuuuccucaguguagagaccaaaggauaggagaauccuuucagugcagaucggccagugugaagugagugugcaccgaacagcacgauucagauuagccaguuccugcgauguugaaauagugauuuuuaaaaaugauuuauuuauuuuuaugugcauugguggugugagcugacaugugagugcugggaauugaaccuaggcccucuggaagagcagucagugcucucaaccacuaaacuaucuuucuggccucaugauuuuuuuuuuuuuaaggcauacuagggucuugcacacgcuaggcaacucugccacugagcuauguucccaacccagugauuucuuuuuaagguugaugauuuuguacagucacuacauuggguugucauuuguguuagguggucuauguuaucuuugcucuuugauaaaaucaaggguuuucuuggauuuuaaaugaaauccuugguauguuauuuauuuauuagcugacugaaaauuauaaaaaguuaacccaucaaauguaaauucagaaagcauuuugauuuaaauggaugaaugggauuuauugaguauaaauauugacuucuuuccacuaugguuuaauguuggcuugacuacaguaccguuuccuucaaaaguuccaugauuagaccucuaaaagcugucgaccaccugcaagaggggccugccaucgagugccagacauaaauauggacuuaaaacaagacuaguguuacccuuuuaaccuagggaagccaggugcuuugccaaauucugcuugucuuuugaacccugcacccaaauauguaguaaauccaaauucucaucaucugaaauuucucauauccuaagaaaaguguucacuaauuuuaaaugugcaacucugugcugcgagucucuaagaaccuuaaaaaaguaacugacaggcggggacccucggaaguuacauucaucagugggucacgcacacuuuuguauguugccagucugauuaaagcccugguggugcacagauuuugccagaaaugauuuccuguucugccaagagcaauauggacuuuucaucccguguuagguuagugcagggcucuuaggaccuugcuagcuuuuuucuuccaucugguuugcccguuguuucacaagagcccucagcuacgcgaagagucaagccauaaccacgcaucugcugaucauugccugccuugccuucacugugacuacagaguucaaagauaauccugucuuacuuccauuguacacuugaacugugacagugacccacaaugugacaaucaguuacugcuuccuacagugcugcugcuggucagacaagugcuuguuguguguuuuguuuuguuuuuuaaaucuggucagauccuggauggaguacugaaguugugagcuccgugagagcagggaccauauucuagcaccuuccaucgugcuuuuugcacucaauaaauauuuguggacaugaac

SEQ ID NO: 2675 - RNA, 650 nt, Mus musculus
ugggauaaucccuggauguccuagaacucacucaguaguugagacuuugucucaaaacucagguaucuaccuaucugucuccugagugcugggauuaaaggcauacaccacuauuuuuccaaccuggcaaaauaauguaaaucuuuuugaaaaauucuguuucuuucaaaaaaaaaaaaaagucauaagcaaaaugcauauaauucuagaagcaaaugguaagaaaagaucugagaaucuaaaguuugaggaaauuccugagcaaggcugcagugguuagaguuaagcacagcaauggaaaccaugcuuaagaauccuaccaggagcacauacaaaaucaggggagucuaaagaaggguccuagguauucaaaaugucuucagugucagauaugaaugaagagucuauaaacuacacacuguaaauuguauuaauaugcauggcacaaaacaaaaacucaaaagacaccaguaaucugaacacaugggguuuuauuguuuuguuuuuaaucaagacacaggcuuacuauauagcucuagcuggccuugaacucacagaaacucaaugccucucucugccuaugaguggugaugguguagcacucaccuucuaauccauuauuuuuuuguuguuguuuuuuuguuuuuuug

SEQ ID NO: 2676 - RNA, 650 nt, Mus musculus
caaaaaaacaaaaaaacaacaacaaaaaaauaauggauuagaaggugagugcuacaccaucaccacucauaggcagagagaggcauugaguuucugugaguucaaggccagcuagagcuauauaguaagccugugucuugauuaaaaacaaaacaauaaaaccccauguguucagauuacuggugucuuuugaguuuuuguuuugugccaugcauauuaauacaauuuacaguguguaguuuauagacucuucauucauaucugacacugaagacauuuugaauaccuaggacccuucuuuagacuccccugauuuuguaugugcuccugguaggauucuuaagcaugguuuccauugcugugcuuaacucuaaccacugcagccuugcucaggaauuuccucaaacuuuagauucucagaucuuuucuuaccauuugcuucuagaauuauaugcauuuugcuuaugacuuuuuuuuuuuuuugaaagaaacagaauuuuucaaaaagauuuacauuauuuugccagguuggaaaaauagugguguaugccuuuaaucccagcacucaggagacagauagguagauaccugaguuuugagacaaagucucaacuacugagugaguucuaggacauccagggauuauccca

SEQ ID NO: 2677 - RNA, 8249 nt, Mus musculus
ugcugccgauaaaggguuccaguggaggucggcguguggaaucugcaguuucugguaaacgggcgguggaaacgguuuuucucgcggugcggaaagaaccccaaauuugucgaggugaguggaaggaagcccgaagggagccgggccaaggugagaaggcggagcgagucgcccaacuggcuuggcggggugccacgucggcgcguggccgacgccauguugaagccuggcagaaaccgggcagugggagugggagugagacugaggguuggggagccaggcggccggggugaggggcggggugagggaugggaugagggacagccuuagggacagcccuguccaggcguaguuggaaccuggguaccgaggagccggcuucacaccgacagcuccuccugggcguccucggcgccacugcgcaugccugggacgguugggcaguggcgguuucguccuauguuggcuuucggaaggcgcgcuugccaguuucucaaauuccugaaaccucuacaccuccggugaggaguuuccuuucucucucucucucucucucucuuucuuuaaagcgcauauaucacguguccggacugauuuccaacccacuagguaaucaaguacaggauuacagacauaugucaucaagcaugccaguccgggcuaccuuaggcccaaucucaaacacacaaacaaagaaacaaaagcaaacgggcuauuaagacaacuuugggguaugccgggcgggcagugcuagcguaugccuuuaaucccagcccuugggaggcagaagcagauggaucucuaaauucaaggcucuccuguucuacagagccaguuccagggcuacagggagaaauccggucuccaaaagaaaacaaacgagcggggggugggggagaaaaaggaaaggaaaaaggugguggugggggcggugggugaggcgggagagauggcucagcgguuaagaacacugacuguucuuccaaaggucuugaguucaaaucccagcaaccacaugguggcucucaacuacccuuaacaggauuugacacccucuucuggugugucugaagagugcuacaauguaguuuuacauuuuugggguauuuacaucuuugggggauugaccagggacugaaggagggggccgauuggaauaagcagagguccuaaaaauugcuacaguguacucauauacauaaaauaaaauuaauacaucuuuuuaaaaacucacccaaucccaagagcaugugacugguugguuggcacauacauugaggcaguagaaguaggaugaucauugacuacaggaacagcagcucaaaaagcagaauuaauagcucugacaaaggcccuacagcugggccaagaaaaaagacuaucuccuuggacaggugguaugcuuuugcguccgaguuuguugauggggccauccucaaggaaagagggcgucucaccucagaaggaaaaacuggcaaaaauaaguaggcaauccuaagccucuuacaagcaguguggcugccugagaacauaucagucauauacugcccuggacaccaaaaucgacacagaacuaucccuagaggaaacaccugggauugggccggaaggcagcacuccaggucaccacuauccuaauggcccagaugcucuuauggugacacccauguugccugaggucccaacuuacacuaacaaggaguuacagaggaucuaaaccugcacaagcagccuacaaggaaaagggauuguccaggaccggggcggggggggggcacaaucccuuuuccuuguaggaaaauccccccaccucggcaggauuauccuccccucagcuguuaauccaucagaggcaccagaacccccaccuagggaaaggucaguuugagagccuacucugaagggcucaccuucaugucuuugacuuaaggccaaaaccagaggaaguccuggcuugggggcccaccugccagauagucaaacccagcauggagggaccuccagauugggauccagggagagaggaucuugacccagaagaaacuuggaaauuaacuuuauagaagccaagccugugguugugcaggucuggguacuuguagugucaguagauggacagagaggccuaucccaccaaaugcugugauggccaagaagcuguuaaaagacaucaucuuuagguauugcccccccccccauacuccccgggucauacaauuggccuauuuuuaucucuuaaguaucccaaaagucagggcuguggggacaaauuggaaaccccaguguguuuaucguucccaaaguucaagauaaguagagagaaagagugguaccuuaaaggagacaauaauuaaugucucaauuaaaccugccgacccacacaaagauccugacaguuacgcaccuggcgcuagcacuggacugugucgagcuguagccuaccuacgaaacccaguuaagaguucaaaacucaugccucauacccacccugcugcaugcuaaacaauggugguucccagagaucuccagagaguccugacugccugauacucacacuugcucugcuuagagaccagacuucagaggacacaaacccucaccaagcucuuaccaccaaaugaauccucaggcccucagagaaccccacgauauuuagggagagaggaacagacuuugacacugacgggucuggugaauugauuuuuaacuuagaccguugugacuuggccugauucauaaggaagggucuggguccaagagugacuugcaggaaggacugccaagaaguacaguucauaaccauccgacucuaugcaugcccagagacaaacggugguacagaaagcugcuuugccauaaguagggcugugagaucagugccccauggguacauaauaauugggauuuuaucuagauggcaggauaaugaaccugaccccugggggauuggugggcuuaacgggaggaucccauguccuugucaauaauggaaaagggacaaagcagaggaugggaggcuggagagguuugggacuuaauggucuaucauggacacaauaggagacuccucuucuagguacaaaaacaaauaguccugucugagcacgcacgcauacacacacaccauagcuauaggaccaacaacaccagcaaugccacuaccugccuguccugaaaaacuacagcaucagccuguguuucagaucccuguuccccuaugaacucagucuuuccuccgggcuucccacuucucucugggccuuugacacaucgcccuguuuagacugcucagcuuuaccuugaacugcaccacucaccucaucugagaagauuguuggcucuuccuggaaccaagguccccauaccauacugacugggcuaccauagaaaauuuguugacaccacuagaaaggccaccaguguuccuggggaagguccccaguccucaccuuuacagcagugacuagaaagggacuaugugugauaggaaaagggguuaggcuaauuaucuucccucacuuuuuuuuaaaaagauuuauuuauuauauguaaguacacuguagcugucuucagacacuccagaagagggagucagaccucguuauggaugguugugagccaccaugugguugcugggauuugaacuccagaccuuuggaagagcagucgggugcucuuacccacugagccaugucaccagcccccucuucccucacuuuaaacacuguugcaaucauagaccauagacccuuaccauggaagccagcaacuccucccucguguuccccaauggaacuugcauguaccucgagcauagacccuuaacauucauccacagguacuucaacaaaauuccagcuuguguguuucgguuacccuguucccucuauuaacuuuccuuuuuucuuuucuuuuuuugguuuuucgagaggguuucucuguauagcccuggcuguccuggaacucacuguagaccaggcuggccuugaacucagaaauccgccugccucugccucccaagugcugggauuaaaggugugugccaccacgcccagcuucuauuaacuuucuaugauugguauuccugguugucagcuucacuacuuauagaaugaacuagaauccagaaauggaaggcucaccugugauccagaucuugaggcuggaagacacaaguuucugagcuagaucuuggcauggagaucuugaggcauaguggcuaugaaaagcuuaggcccaggcaaggugguacaggccuuuaaucccaggagacugaggcaaggagaucucugaguucaaagucagccugggacaaagcaaguccccgguccaggcuugguggcauacacuuuuaaacugggccccaccuucugcuggaggccuauauaaggacacuggacgaggaagauuccgucuuuccccugcuugcacuuacuuaccagcacgucuguuggaaccuacuucuagcuuauagaagacuagcugaaacaacuagccucuuggacugaacaacuacuagauucuuggacuucccauucacagcugcccauuguuggguuaguuggacugaagacuguaagucauuacaauaauuucuguuaauauagagagagcccuuccauaaacugugacucuagagaacccugacuauuacauuuucuaccuauauggagauggcucugggucaucaaaggaaaagaugagauuuugucgccccaguaguccuaccugcaaugcugguggagucuggccuagcugcaggaauuguuacuggugcuacagcccuagccaaagcagcuccaacucucucucucuuuuuuuuuuuuuuuuuuuuuuuuuuuuugguuuuucgagacaggguuucucuguauagcccuggcuguccuggaacuugcuuuguagaccaggcuggccucaaacucagaaaucuaccugccucugccucccaagugcugggauuaaaggcaugugccaccaugccuggucaacucuuuagguccuaaacaaccuugauguagaucuagcucaauuaggaaaaucuauccaucacuuagaacaguuguuagagucauuagcugaaguaguaauagaaaacagaaggggggcuggugagauggcucagcggguaagggcacugauugcucuuuugaagguucugaguucaaaucccagcaaccacaugguggcucacaaccacccgugaugagaucugacgcccucuucugguggaucugaagacagcuacagugaacuuauguauaauaauaaauaaaucuuaaaaaaaaaagaaaaagaaaacagaaggggauuagacuuacucuuccuagaacaaggagggcucugccaagcccuaggacacaaugcuguuucuacaccagcaacuuggguauuaucagagacagccuggccacggucugccagagauacaggagaggguugaacucagaccguagaaucaaaacugguaugaaugauacuuuucuggucuuaucaggcugacuacucuaaaaugggcauugguaggaccugucuugcuauugcuaacuguccucaccuguggaccucaugugguaaaugcacuagucaaaucugugugagaaugcaucuccauagcuuauguucuuacugucucaaugugagcaucucagccccgcccgucccccaggagaagggccuaugauucagcccauggucuaauuucaagggggagaaugaaaggacaagauaaacuccauuuuaggaccaggccugauuucaaaggcgucaucccuuccaggaacugaacauaaacacuccaagugaucaaucucaggaacuaggcuauaagucaccagcuccuggacaaggccauaaaaucucccauccagagaacagauaaccacaagcauagggaaaucaucuucccucaggaugggccaucugugcugagcagcccucuaugguuugcguaucauccugugguuaaauguucauggcacaggaaugcaguccaccuaccaccuggacacaagccaaucaaaaaccagcccauguaacaaugaaguuuuagauuaccuacuccuagcuaaaauugccuuaguucccuauaaaaaggacggugugccuuuauauggggguugcauuuuuuuaaguggcugaccccuauaugcagaauucuugcuuucucgaaauaaaaacaugcuugccaauuguauuugugaguaguggucucugugaggcacuuucggacuuaacagucugcauguuuguauaugcacuaugcacacgccugguguucgcagaggccaaaggagggcuugagauucccugggcuggaugauggacaguugugagcauccuguggauguugggaaccauaccuagauccucugcaggaacagccacuccucuuaacucgugagccaucuuuccagccccuagcucuuugguuguuaagacagcuagccuagacuggucucaaacuuguggcaauucuccagucucagccuccugagugcugggugcacauguguacaguagcauggccaggaauaaauaccauuuuagggacauggaaaggugcuauuaggaaaggaguugcccgcaguguuucucacacuccugaguguaaacugcagacuccagcauuggcucagcaggguuagugggcagucaaagcuuucuggagucugaauuaauuaucaugugucaauaugaauaugcuacagcggggcucagacauucucauguccagcauaaaugggguacccuauugggcgcugugaagaaagucccuagucuugagcacacugccuucaauaugagcagugacguuccuugguggcacaugccuguaaugucagcacucagggcaggaggauuuggaguucagggccaggcccuauguggugaacugcacccuccacaacagggggugaaugacacugcuuuccagagcuguggucaggguggagaagcgugggugccucauaacuuccuaucauguucuagagcaugagcgacuggaugcccauugccaaggaauaugacccgcuuaaagcuggcagcaucgaugguacagaugaagacccacaugaccgagcuguguggagggccaugcuggcccgcuauguccccaacaaaggagucaccggagacccccuccuuacccuguuuguggcacgacugaacuugcagaccaaagaggaaaaguuaaaggaagucuucucccgguauggugacauucggcggcugaggcugguucgggaccuggugacaggcuucuccaagggcuacgccuucauugaguacaaggaggagagggcccugaugaaggccuacagagaugcugauggccuggucauugaccagcacgagauauucguggacuaugagcuagagaggacucuccguggcuggaucccucggcggcuggguggcggauugggugggaaaaaggaaucugggcagcugagguucggugggcgagaucggccuuuccgaaaacccauuaacuugccaguugucaagaaugagccacauagagaagggaaaagggaaaggagggagcgaucucgaucuagggacagacacugggaccccaggcccagggaacgggaucaugacaggggccgagagaagcacuggcaagagagggccaggguguggccugagaaugauugggaaagagagagggaguucagggaggagagggucaaaagccgggacaagagggacagaaguaaguagaggcagcagcaggcagccuccgucaggcuggggcagugccuuuagcaguacuggggauugaacuagagagugcggcaugucaggcaagcgcuccaaccacagccacauaggaugagagggagaaacaaguguguaagaagaaauguccagcuccuguggaaauagaagaguuuucacaugcugucaacccagcacuugggaguuggaggcagaaggauggaaagagagaggggauaauaaagaaucugucuucccuuucucacaccuuuugaggugggguuuguauguguggcagaggggauagugguuuaaaccccuuaaguagccuggugugauggcacaccccugucauccuagcacuggggagacaggagaauugcaaguuugaagccaguuugggguacaaaauaagacccugucucaauagccuaugagaauuaauuauacugacauugacuccugggauauauugucuuuuccauuuucauguuuguagccccaggguuugcuaaauuagaaag

SEQ ID NO: 2678 - RNA, 1368 nt, Mus musculus
caacugggugcgauggagacgcgggucccggccugggaggcgguggcgcccggugcccggagggaccgcggcccggagacuccucccggagaggagaaucaaacuuuggugacgccgagugacuccgguuggccggcuccuccccgugggaacgcugcgaggcgacguggguuuggagaggagggggagcgagucucuguccccgggggucucggugcgcagccccgcgaagccgaagcuccgcccccggcuccggucccgccuccccggcuccgguccccaagaccccggcccugcuccaccuccuccagccgcgcuccgccuccaaggcagcggcugucaccgcgcacggccauuggcugcuucaacagagucugccugcgagggcugggggucaggaggugggcucccccugcgauccagauagugcaggaggacccucgcaccuaggagcucccugcuggcuagugcuuagcccgacuccagcgggcgccucgaguacaaaaccccaccgcgcauagggguccucaguccccaaagucggccugugccccacccggauuccagcucauccugaggacccuuugagcccugcaggucuacccucucauuuguuccacugucuaccacuacuccgugcuacccuacccugugcuccagcagagacuaaggugacuucagccgacaaagcaaaagcauccuuggucuccaaagccgcugccugaccggccucuacccuucgagcugagacaaaaacuucauaucgcagugcaagauggaaauuuggaucucagucccaagacuugauucugagcucuguucguccuuuggccucgccaaacccaguuguccaucagaccucaggccaagccaggagagauuauccugaaucugcccucgcccgcuucucuucuguucccaggcuggacguggagccccuugagcuuccuccauugaaaaguacccuccacauacauaacucuaaguuccuagaagcccuuuguccuucagaacaggaaguuuuguuuuuguuucuuuuugaauugcuggccugcaauucgcuauguagaccagucuggcuuugaacucauagagauccuucugccucuuccaccuugaaugcuaggauuaaaggcaugugccacauuuuagcccauuuacaaauuuuggaggcccagagguugcaguagcccccacccuaaccucuguuuagugucugaggccagaagaaacaauguauacauuuuauauaaguuuugauacaguauauaauuagaacaauacuacuuuacuuuaaaaaaaaacuuacucuuguacagggccuaauuuauacauuaaaccuuuucacagauaaauauauaaaggaaa

SEQ ID NO: 2679 - RNA, 8920 nt, Mus musculus
ucaugguacacaucuuuaaucccagcacucaggagacagaggcagguggaucucucugaguuugaggcuagccuggucuacagaguaaguuccaggacagucagggcuauaagagaaacucugacugaaaaaacaaacaaaaauuaagaguugccuuagucuuggugucucuacacaggaaugaaacccuaacuaagacaacuauguaguccaggaugauuucagacugauccuccugccuuagccucccguguucuggggccacaggcuggggucagauugggguugagaguauuucagaacaggcucuggcggugguuuauuaaaaccaggaagaacuaccccgagaagugcugcuaggccuuuucuuguuaauggguucugccuaauugugcuugcacuguuucugaucugucaacuuagagaggcaauaccguaucuaaauuguucauauaauuuauugauuuguuuccacauuuaacuuuaaaaagcuguuuggguucuaaccauguuuaaaguaaacucccauuuucuauagacaacauucugugcgcaguggcacaugaauggcuccugcauugguauuucuccugucuggcuugggcugcugaggggagggagccccgaagccagacguagucagccaguguuugcugucuugugaggcaccauaagguuuguacucagccgucugagugugguaugagaagggggucucugcucgugugccgucuuuccucaggacugcagauguaaucucaguuguccuuccugagaccgaguuuccgaaaaccauaagggcaccucagcuugcuuccagaacuggaaacaggcuucagaugugacagagcagaaguccacggauucuucaggacgucugauguuggauucaguuucagccccuggcuggcuggcguggagaggcugcucauccugcacagcgcgugcuuccugcauguuggcaggagcgacucggcucauagguacagcuugaugagcucaucgcuuacagcagauggcgucaacacacccagguccguaaacagcagggugaugagggauggggagguguaguccacccauggguguuccucuuugagauccugcccagucugcacagacuucagagugucugccuuguacugaggaggaaagaacgugguuagcuggauuggccuuguauccaggcucugcacugcugaggcccuggcuugaguuguaagugagcucuugccgggacuaccccugggucaggacacuggcuguguagcaggcuggcagggacagcauguccaggauaccuucccaucucacaggagagaggaggccacaauggaagugccuggccaaggucacaugguuuguaaaagcagagaugggaugaagaaacugggguucugccaggcucucagcagggugcuauguaagugagauugugcccagcuccagcucccaucucuacaccggaaaagcugcaggaaacagcaaugggaagggagcaacuuucuggguauagucaaagaccccugucaaauacauaaaacuuaccuuaaacuuaucugggacguccuccugguugaguggaaagaggcguacgaacuugaagcuuucugcaaccacauagaagggcuuauucugggcuuuggcacacacggccaucugguugguuccaaucugagaagucaggaaagauggacagggugagcuugcauagcucagugaaacagaaggaaacacaguaaguuuaaucuuggcguggcgaucugaacuguugcuuuuuaaaaggcaaggucuuaauguauuuuaugcuggccuugcacucgaguaugucuuugaacuucugauccucaugccuccacaccaccuagugcugggauuucuugaguuccaccaggccuagucuauucagugcuggggcuugaacuaaggguuucagugugcuagacaggcauucuaccagcuaagcuguauuccuagccuucaaagaggaccuuuuaagaaagaaagauaaauguucccaaagcacaugaaaagaugccagcaucaccaguuagaaaaaguaagugcagucuaagauaagccagcacuuuccauauuugggggccucagacacuggaccagugucuacaguugcacccugcaccacagccaacgguaggaaaauccaaguguccacuacaggugaacaugggcaaguggucguguuauaauggaacgguacucugcuugaaagcacacagcaaugacacaugcugcaguggggccagugaaguuugucaagcucaaaaucauaagugucauguaaaucuacuuaucugugguucccucgccuggaaaaaucaggacagagcagaacaaaggugaccagggacaugggaaaaggccaucugggacaaauagaaagcuuuguaaauacuggcaauugcauggcuugagugugccgaaugccagugaaccugagacuuaugacgguccaugcacagcuuaauaugauuaugacaucugucauaauuuccaagguaagugacagagaaaauguaauaaacccuggggauggaaguccucaaucaaauggaaacaaaaccagagacacucaauuccaagcugaauccaguuugccugggugugauggucaugccuaugaucucagcacuugggaggcacagacaggaguuugagacaauuugaggcuauccugagcuacauaauaccuggucucaaguuacauauccaaacaaaaguaccuauuguguauacauguaaaugcuacugacuaaauucaucaagaucagccuccaaagaagaaagcugacaaggucuugcucaggcuguaggggcuucugggaacaguaugacaguaccuaccuuguuaauaaugccuccguucucuaccacuccuucagcaccaacuaugacaagaucugcuuucuccaugauauagcugaggagacagaaaagaaauccuugguuggccugguauucagagucgccugccucugcuccagugcugggauacuaggugugugacaguuuacuguuuaagacaguacuacugaagaugcuauccaagaaccucuaaccaccucaauagugagcuuucuuuucaaaggacuacuauuugugggucauacacaccgaugacccaacuuggaagaugcucccagugagccacugcacagccagguaugcggacaaagcccagcaaucaccuaacugcugaccauagccuuuuacucugaaaacaugagcagccaggcugaggcucauugccagcagcccuggcacucugaggaaggacugugaguucugggccagucugggcuauaagagucugucucagaagcaagaccccugcagccugucuucuaugcugcuuacuguaagaggagagaugcuacccagucagauuuuauggccaggauucaaacucugcuuggagccagcaaugcagggacacaggaagagucacuuacccgacagcagcauccagcaccacagugacagggacguugaggugggagagggcuuuggccauuuucuuacugaaggugacaugaaaacaugacagugaggucccagugaugcaugaugaccuugauuuagacaaagauguccuguaaccuuaguggcuuaaggggcagaugcugacucuggaccaagcaaacaggaaccaaaguucuuuaguucuuguuuuuagacauaguuguuuuuauuuuaugugaauagugauuugcauguaugucugugcacuccaugaaugcuugcugccugaggccagaagagggaauaggauccccuagaaauuacaggagguuguggaguugggggcuagaaauggcucaguaguuaagagcacaggccacucuuccagagaacccagguuuaauuucaagcccgcacauggcacuacaauggucuguaacuccgguuccagggaacccaacacccucacacagauggaaauaucuauauguaucuauccauccacccaggcaaaacaccaaugcacauaaaauaaaucagucuuucaggacugucaagacaacaaggagaagcccugccucaaacccgcucagccggaggaggagcuccagagugccugacgagccugggcagucaggguucacgucccacaaccagaggaaaacagaacaaaguuugcuuuucaggagauggggcuguuaaucaccaauucuuucauuuaguguccugcuguuccccugacauaacuaccuuaaaaaacccucaaaacuggaaacaaaaccaaaccaccacauccggcacugugccccuggagcccacagggucuuuccucucaggggugggaauagucaugaacggguccaaggcaauguugacucccuggccaguggcgagauacuugcccagauaaaucaggcugcgacuccgugauauacacacugaaccguuucuuggcugccacggcuucuuccaggacucuuaagacaacucuggaguaggcgugagucaaaauucucuauggaacaagaaaccuccaucagaggggcaagcugccugccagccacugcccacccugucugcacugccaugacuccuccugucaggugaagcgccaguauucuacaaccaaccaugaucagaagggugacauaacaguacacugaacuucaagcccacugagcuugaacuuuugaacauuucugcccccaaaaguagggcacagaucuccccagcagaacccaaaggcacauaaaccacuacaucuggaggcccauggguuggcuucccuagccuuaagauaaagagcuugcauacuugagccuacaggugccaagaagcguagguaguaagagugguccgaugaggccacuggcaguggaaggccaagggaacuaggcccuaggugccucuucuugucacaugucccacuaaugcagccacccgucuuucuagaaguaaaagaucuagucacuagacacaaggugagcuaacaaguuuuucaaacugacaagcacagugcaguaaguacagccaucuguggugcaggugaugacuuaugcacucacauggccuaggcucuaagaaugcaguggacguggcugucauaacugcucacuagaaccaugggugcucaggccucaacuuagacccgaggcgucugcauuuagcaagcccacgggugaccugcccgcagcucugagauccugcagcucugcuuugaacccaguugaaagguuaagggcaggcugcugugggugguaggugagaaagcuacacucuagccacacucugugacccaggagaggagggucguggccaggccuccaacggcccaggucugugacaccaccauuuacacaaccucucauauauuuaauagcauacuucaaagucaagaagcgcaguaaaaggcagggugagcucugagagucaggaugugagcaaacacagguguggucugggaggcugagauggcgggaggccaauggguggcugaaggcacacugccuccaagagccaguuucuucagaggagccaucuuagacagcacgugcugaagcugguuugugagcaucugggggcccagaccgugaacacaagaguagcaaccgcaggcaggugauagagaaaacaggguuuaucaccuggaggaguggacaagcuggagacuggcugagccugcuguuccucauuuaacuagggacaggucguagcuguaaauaggacaguuccacccagugccaacgcuggcuugaaggugcuuggcagugaccacaguaacagcuagucugcgcagacucacuucagcuuagagcaccguaaacucaaucauaaaagucagagcaagugaaaugggucaguggguaaaggugcuugucaccgagcucgaugaccugagugugaugcccugauccuacaguggaacgaaccaauuccucagaccucuacacacucacugugccaccuaggcguacucacacaaacacauacaaaagacacgugauucaaaaacccuuagaaaaauagcuuacuaagagcuaugggccgggcgugguggcacaugccuuuaaucccagcacucaggaggcagaagcagguggguuucugaguucgaggccagccuggucuacagagugaguuacaggacagccagggcuauacagagaaacccugucuuggaaaaccaaaaccaaaaaaaaaaaaaaaaaaaaaaccaagaaaaccaaaaaaacaagaguuuaugggcguagcucagugguagagcaugucuagcagguuagagguccuugcuuuacccuccagccccacauaaaaguaaaaagccuauuauaccaagacccacgcaugcuggucucauguucuccccauucccaacgaugagccucuauaaugucuguauugacagugugcacacuacagagcgucucagucaccccucacccagccugggagcugccguccuuauuaacacacaagaaaaauucaagacagagaagugacuguccaccgucccagcaguaggugacagagucagcauuccaggcccagcagcgugaccccaaagcucuugauucuagcagcacgaaagaggcaacuacucaccgccccgucuuugaugaauguaugacacagauuggcaaucuuauuucucgacagggauauucuucucaggaacagcucuccucucucaaucaugaucuucuuacauuuggaguaguccugggaagggaagagccaagugaagggaggagggagggagccgccagcaaagcgcacagugucugcacacagagaaggguccuggggagggcggggcuuacagaguauuccagggaggugaggcugaugaagcgaaggaagagcuccccgccagaugacacggccacugaggaguccacaccacagaggguuuuuauggcauaggugagauuugcucucaggcccuggaguguuucuccugcaauggugaagugaggaagugauguucauuuagcgucacugcccuugccggucugcgcuucacccacucuuuuuuuuuuuuuuuuuugguuuaucgaggcaggguuucucuguguaguccuggcuguccuggaacucacuuugucaaccaggcuggccucgaacucagaaauccaccugccucugccucccgagugcugggacuaaaggcaugcgccaccacgccgggcgcauccacucuuucaaagaacacuggcugcuucucugugccagccacugcacgagagagggcccugcucucacggagcaauaaaucagcacagaaagagacugacaccuuacaaacuggaacaaugacgggaaaaggcaggaugacacauaaggugaagcgccuuugcgaggcuggccucuugcauuacagaaaccaagacuugaugaaggacucagacaugugaagaccagugaggacagcuccuguguagaugucagggaugccaaggccuaagaaagggacacacuugguuuaaaacaaaccaaaaaaccaagaaggccaaauggcaaaguaggcaaacugcuuuguggugccggccuggugaccugaauaaagaaagaagaaacucccaauagcuguccucaugugcacccacacucaugcacacacuaauaaaccagaaaguaaaugucaaagaggccagcagggaucugcagcaagcgacaacauggcaggucauuacuuagcagggcagaugagaucugugagacagaucugcaggcuccaagguaucugaauguauguaugccgggaaaauaugcgaggcuguguuagagaaauucuccucuuggccaucccaugagaacgaaaaaggcccauauuuuguaaguauaagaggccauguuaugcccaggaucuuaagacuuaucauacucaguaggucucaaugaauauugauaccagaauuuauuccggaacauuacagcacugcacagaauugaggauaagcuaggagcuugguacgcaucuauaaagcuaaauuauugcucuaauauaagccuuuaauuuaaggcuguauuguugccucuugcaucaggccauauuuuguagguggauggaaauccuuucggugauaacccaagggcuucccuacaggcccgcaagucuaccauggacacagagguuggccuugagacuguacacauaucuacauaucugccuguucacacuccuaauagucaucugaagaccuuccugaggcccagacuguucggggcugacccuucuuaccuuuaucucucuucaagaauuccaacaaagucuggauggcagccacagcugaggccauuuuaggaucuccuuucaucugagacuuaaaguauucaauuaacucuaaggagagaggggggaaaaaaaaggaucaucacgugaacuuaacaggaagaggccagagaguuugguaacaacugcugaccuuaagaauaagaggcaaauacauuuuaaaaagcagccuuuaaaguuaaaggggccaaauguugguagggguagagacgauacauccuuacuguuggcagggacauaacuucuuccauauuuuaaaaaagcuauuggugcacaaggcauaaaauucaggggcuaagaccagaggcuaguaguauucuaaagacuccgcucauccacuucaucuaugucgccugcagucuuuugagcaguguucgccaaucgagucugcucaugugcacagacauaaauguuuacaguucacuuuuaaacuaaacgcauucgcccggagcucaggcugccagugcggaggccgcggaccguguguccccgccgcucuguugacacacucaccaccguccuccauggcuuccucgagcgacuucccgcaaggcgccagcagcaaagcacggccugacagcgcgucgcccuucucgcgcgucaguuccgucgucuccggcgugcguggcgucacucgucggcgcc

SEQ ID NO: 2680 - RNA, 3427 nt, Mus musculus
gugcaguccauaguguuuaauacguguucauuuuucuuucuguaggguagaauuucagaacaaauucuacguuggugcaggcaccaaguuuguucccuucuccuucagucugcucuccuccaaguucaguaaugaugacagcauagcaugauugcacgcugcagcaagcccgcucugaucaacggaggacuaucauguuacagaauucacucacucacuccggucagaacuuaccaggggaaaguuccacccucguugauugccuuacgauucagccaaaugguucuguaagauacaccucuuccucauggugaagauuuuguaaaacucaccacuccggacacagaaauuucguugguuuuuauuaugagcaaauauaaguuaaugccaacgcuacuuuaaaguuauuuuuuaaaguguaagauuggaggagagaagccagcugaacagcuagcuaaaaauggucuuagauacuugauuccuuuucaacuuaaaaaaaaagaaacaugaaguuauuccaucgcaagaagaugucagauaauauuuuccaacagcucaaguuaggcauaguguuuucagacauuacugcugggucaucagcagguccccgcucccacugccugcuccagaauguaugugaguucucccaaaaugcucgcaggauugccgggaggggcagcgugacagccugaucuucuuuuaauaaucggagacaaugugacaaaguggcacagcgauggcucuccugcuugcauauuuuuuaaagacgcuuguccuucauccuuguguuagaccagucacggcaguugugcguucugaaggaugacuguccugagccuuaaaacccaggggagacaggaaaagccguguguauuuuuauagcaaagaacagaugaagauauuuuaccacagagacugcuucuacuggacaauaguauaguuuuuuacuuuggcacuaauucugaauaaaggucugauggccaguuugauuucccaagcuguucagguuagcugaaaacugauucuuacuaaccuguuaauuuauuacauucauguaagaucaccuguccucagcuuugagugaaguuggcucaaucccauugaacacuuagauccaugucacagucuuagaaauuauccucacuuucacauuuuacguuaagcgaguuuagcuaaguauuucagaaagcaaucugaggcugggguguggccugauuguuuccaucccccgaaccacuucacccaggugugguggcaucugacugguauuccaaggacuuagaagguggaggcaggaggaucaggaaguucaggguuuccuuuggcuaugugguaaguuugaggccagccugggcuauguaauaacccuaaagagagaaaggaaucuaacaugucucuggccucuuaaaauucugaguuccacgcuauugcagagaccuuuuggugccucagcccuccagaaccaugugguagagugugggucccuuuccuuaaaagccaagccucuggcagccagaauuucacagcuucuuggguccuguaagagcugcaugcugagaggcauggacugcuugugccucagcuggagaguaacaucagaucgcuccagccccugugggguccacacugacggcagcgaggcuccagcuaggaugccgagccugccggcagcuggguaagcuggugccgcccaguguagaccugcucuuaccuguaucaugugucacccccaugucacucuuguuacugugcccccagggucuuuggucaccacagagauagcugcuuccagggacaggaaccaaacaguuucugccauauguacugucccuguuggcaguugugauggggccucuuuuauaacuggcaucucuuaccuggguacagaacacagagcaagaguaacuucucaguugaagccugucacaguuaaauagaauguccuugcauaaauggaagucacuguuucaugagcccucuggaaauauaauugguagcguccucucaggggaugcagcucuuugguggugucacauguuccucuuccuagaacaacaucaauggagccacgucacauagacuuaugcuggugggaaggcccgaugugauguggccaguagaggcaugcaaagggcuuugagcuccugcacgcucccuccuccauaggaccugggacagacuccuuuucccccagauccuccccuggccucaguucuggaaugggucucuaugcuucaagauauuuaaugccaccgacgcaggccuuggccuugccauccucuugccuuagucucucagcuggcacuacagguaugcaaugcuggccauggguguaaugacauucaggcccacugcuccgucugcaggaguguaguaaggcacagaccguccacugguaacuuacagggcuggcacaucaagcugugauuuagaguuugaacaaguuuuggaaaauaaaaacaaaaccagcuccaaggucacauuuuucuacggagggaggaagucuggguaugcauacaugccacacuauccagaugggccuuaggaacucuugugguguugugaagaggcaguuugcccaccagcagaccacugcucuaauacaucaagaaauccucagaccgugcaacuccacaggaugauucgucaaggcuguguucuggagcugggaccuggggcggaaacuacgggagccagccagagccgcacuguacugauagacgcauggaaggacuagucugccugacaguauugaacucccuuuugcuagugacaaaauaaauguauauuuuugagaugccagugucuaguuuucuugugauccuguucccuaagccccuacgccagaaagagcuaguccuuucuuagggccugucgaguguccucacagugccugauggcugaagccagucuugccugccugaccugguuugcuucuguugcuaugguaaaacaccauccaaaaccaacuugggagggaagaguuuauuuuauccuagguuacacuccaucauuaaggggagaagcacacagcaggaacugaagcggagacuuggagaaacaguguugauuuguuugcccuggcuugcucggcugccaacuaaggcccaccugugaggggugucaucacccucagugggccgggcccuccuacauuaaucaggaaucaagaaaaggguccauaggccaaucugaugguaguguaaugucucaguugagauuccuucuucccugcuaaguguagguuggugucaaguuuacuuacagaagcuaacccguuucaaaagcuaaccuguuuccugcuucuaguccugccuggcucugccacaaagcccuugucucaguuaccaauucucuuguaccuuagcuuuccugacagcagacuagggcccucagccccgcgcuggcgccguugcccagguccccg

SEQ ID NO: 2681 - RNA, 1381 nt, Mus musculus
cucuuuuuuuuuuuuuuuuuuuuuuuuuuuuuugagacaugguccuguagcccaggcuuggucucagauuuacuauguagcccaggaugaccuccucugcuucuccaacccugggauaacuacauucacagcuuccagccaggcuuuucuaucuuuauuuucuaaccuucucugcucuuguuuuucucuuccauuuggauuuugagcaagaccuuccuacccacugcaauauuuuuuuuccccucacgaaugucaccaaacuaaggaagccagaaaaacagcacggaguccuagggaggaaggccaggaggcgggguaaacggcagccagggaaccuuccagaagaaaacaguauccacucuggcugaauuccuccagggucaagcugcggguuuaccucccaaagagggugucccucuggcaagacguggcaucuuuaaguccucgggguuggaaugggacagcuacagggucucuguggcauggcaugagggaccagaguggaauagaauucucuggcccccaggaaaugaccccuaagccuggaaccucaacaugcugaccgaaggucccagagccaaggaagaagcuuuugucggggagagggguuguuuuugaagcaggggccugcaaaaccuuuaguuguacaaggcugcucagcugccuguguugggugugaacucuaacucucugucagacccuucagaucugcccauuguggcucugcgcaaaacccacagucagggcucucugauccacauggucuucaggggcccagacccagcugccauacuccuggagcugauguggauugagaaguaucugccgggaggcucccacauggccuguucgguggccacaucuauuucuguggagcagagaccucacugucaguccucaugaccugcucacuugucacuguccucgcuaagccaucacuguuggggacaggcugcuagccugagcugcaggagggacccagacauuguccaccaggcaccgucucuccccagugucauccgccucucccaggcccuccaagucaguccacauccuguuccucuuugcugucgagcagacagagucaagagaugucccuucaguucaucaagugggugccauucccuagugcaccccaggguugugugugcauaaagacaguuaucuaacuggagcaaaauaucaacagcugccgcuugugguggugcacgccucuaaucccagcccucaggaggcagaggcaggcagauuucuaaguuugaggccaagccuggucuacaaagugaguuccaggagagccagggcuauacagagaaacccugucucaaaaaacaaaaacaaaacaaaacaaaaaaucaaaucuuuuagccgggugguggug

SEQ ID NO: 2682 - RNA, 1381 nt, Mus musculus
caccaccacccggcuaaaagauuugauuuuuuguuuuguuuuguuuuuguuuuuugagacaggguuucucuguauagcccuggcucuccuggaacucacuuuguagaccaggcuuggccucaaacuuagaaaucugccugccucugccuccugagggcugggauuagaggcgugcaccaccacaagcggcagcuguugauauuuugcuccaguuagauaacugucuuuaugcacacacaacccuggggugcacuagggaauggcacccacuugaugaacugaagggacaucucuugacucugucugcucgacagcaaagaggaacaggauguggacugacuuggagggccugggagaggcggaugacacuggggagagacggugccugguggacaaugucugggucccuccugcagcucaggcuagcagccuguccccaacagugauggcuuagcgaggacagugacaagugagcaggucaugaggacugacagugaggucucugcuccacagaaauagauguggccaccgaacaggccaugugggagccucccggcagauacuucucaauccacaucagcuccaggaguauggcagcugggucugggccccugaagaccauguggaucagagagcccugacuguggguuuugcgcagagccacaaugggcagaucugaagggucugacagagaguuagaguucacacccaacacaggcagcugagcagccuuguacaacuaaagguuuugcaggccccugcuucaaaaacaaccccucuccccgacaaaagcuucuuccuuggcucugggaccuucggucagcauguugagguuccaggcuuaggggucauuuccugggggccagagaauucuauuccacucuggucccucaugccaugccacagagacccuguagcugucccauuccaaccccgaggacuuaaagaugccacgucuugccagagggacacccucuuugggagguaaacccgcagcuugacccuggaggaauucagccagaguggauacuguuuucuucuggaagguucccuggcugccguuuaccccgccuccuggccuuccucccuaggacuccgugcuguuuuucuggcuuccuuaguuuggugacauucgugaggggaaaaaaaauauugcaguggguaggaaggucuugcucaaaauccaaauggaagagaaaaacaagagcagagaagguuagaaaauaaagauagaaaagccuggcuggaagcugugaauguaguuaucccaggguuggagaagcagaggaggucauccugggcuacauaguaaaucugagaccaagccugggcuacaggaccaugucucaaaaaaaaaaaaaaaaaaaaaaaaaaaaaagag

SEQ ID NO: 2683 - RNA, 64017 nt, Mus musculus
uguuguugaaucagugaaaagguuuauugcuucagucaugacuuccuuucaaaagaugauaaaauuucucuuccaguagaaaaaaggggucgguugcaggaugcugggccuccgaauacccucuggugagguacacuagaugccggggggcggggggguguagacggcccauaccucuagcuuugaccccaugccugaaaaauaaggacccugaggggccugccaccucugccacguacagugguuaauucagugacauagcagagacgauagaaaaagcgccagauacagcuccagagugugugugcaaacuggucaggaccuggagcugcuugccuggccuuggcacaagaggccgacauaugcccagccccuaggagugacagauccguccucugugggaacuaaggcuuucagacugauggagaaagacagaaagacuuccugagggaagucaggagccugggcagggccagcuccuacaggaggggcugacagcagcuagaguucccacagccuggcucacaggccauuuagaagagcacaccuguggcccaucaggcucacuuggcagcaggucugucccuggucccugaguuguuuuugcacaugcgugggcauccaugugccgugcgugcggacaggugugacaucugggggcucaggccauggcacuggugggcuguccgcugagagaguccucaagaagcgggguguagggacuggguggcuggucugaccaagcuaucagguuuggggggcuuauagugucuucaggacccuguggagaaaaaaggaagcugagucacaagccugucaccuagcccugcccugccuaccuccccuagucccaccgcacaucccaccagcacagaaaccacuuccugacacauccagcccugucugccaugaacccagagaugccacucuauagacacggggacuccucagucauguaggucucuugguuccaaccucucccuuuagagaugggaaaacugaggccagggagacuggccuguuacagugaagggggcagaguccggaguggguagauaacaccgccgcacaaagaaacuaggaauggcuuaaaugucugcccacauguuuaaaaugcugucaccugacgggccaggaacagcuauuaaaacuggcucuuguucauagagguaagagagacacacucucaccagacugcuguaaugguggccucgggccuuagggacaguaggauguugggcaaagggugcagaacaggaaaggauggcuugguaaguugggagacucugacuugaaaagacuucccaacuuaggaaaaugaauggaaggccggguuuaagaacacugggcaccccugcccugcaacccccauaccgaucccccuaguggcagggaaggaaacugcagggaggcgucuucucuuuggaucaaagccaacgagcaccccccaucccacuccuccacccccgacacagcaccccagcauuccagauagucucacucagaaguaaaacaggaagugcuggggugaagcucagagguggacuacacuaagcaaaaggcccuggcuucaccacacacagacagacagacaaauggacagacaaaaaaacagaaguaaaaggccggacagugguggcgcacgccuuuaaucccagcacuugggaggcagaggcaggcagauuucugaguucgaggccagccuggucuauagagugaguuccaggacagccagggcuacacagagaaacccugucucaaaaacccaaaaccaaaacccaaaaaacgaaaacaacaaaacacaaaaccaaaaccaaaacagaaguaaaauggggaaggggacacaaggcacaguaguggugcaugcuuggaaucuccgcacucgggagacagaggcaggaggauguccacaaguucgaagccagcgugaguggcccagaacgcccuuguugccagagaauaaagcaagaguuaacucuguagcuuggucucucccaugaaaacacacacaaagccacaaggcucugggcagccagggcgggugggcagauuuccccuccucuguccuggcuccucccuguacugugucugacagaggagaauucagaaugagagacagaccaaaaagaagcagaggaucaggucauuuucuuaaaggcuacuguguucacagcagcuggccggacagccaacccugccugccaacccccaacccccuugccuuacagaaaugcccauccacccagagggacguuauucauauaauaauacccuuuggucuagcggcacgucuguuuccauucuauagcaaucagcagcagccucuagggaccacccccacacccaggugcauggcagaguguggggccccaccgaauuucacuuagccaggcacuggggggucgggggggggagggugaggucccuaugcaaggacccaugugcuguagcugauccucagaggacacugcccucccuagcacauggccaggacuagggggcacccaggggaaucuugaagccaaacgaggauuagaccaagcugggaaaguaaagagguaagcccaaucuuguucauucuauuagggucuggacagggcuauggcuguguaccuaugggcuccaucugggcuaaagggacugcggagccucugcucggagccuacauuuguccccucgcacucuggcaauacccaaacaucaccaugacuggcagacacuaaccaucuccccaccucuuccuggcaggacccuuucucagcuccagggacauauggggacccacugagcugcagagcuucuuccuccuccagggagguggcacucaccaggacaaucacacagucaccagaguucugccuuauuugcuucucaagcaaaugacauugcagcaaauagucagcuggccuccaggagcugagcuguggccuccccuccccgcccccccaagccccgccuccaccccccacccccagcucccuccaagaaagugcucacacccaaguuggcucacaagcuaaaauagcagcuucuauugagacacucacucaccucugcuaaccccaaauugcagggaccacagcucuuccagucccuucccaggcagggacacacccuguagggcucagccucucuccugagccuugaucccuacaggaccuggagaucuuggagaaguacgguccuggauccuugcgagauggcuacuaaguaaaccaggacgccagcuauaccugacucgguggcucaccaccuggaccacccaucgcagcaaagcacagggcggacacacgacuccaucuaaauucagacuguauugagcagucugucgcacacccuguguacuugaccaugaaauucuauccucaggcccugacugaguauguagcuggugcuuaacugauguuuaaacgucuucauuuucagucucucuauucugaacuggagucaguguguccuuuuacaugcccuugaaguccaaaaaaaaaaaaaguuuucaaaccuuuugggcuaggagagucucuuggcuuuccgggaugcccagggaccuguauuuagcaaccugcaggggauaggacacugagaagcaacuggccuaacugucaucuucuuuuuuuuuuuuuaaagauuuauuuauuuauuuauuauauguaaguacucuguagcugucuucagacacuccagaagagagcgucagaucucguuacggaugguugugagccaccaugugguugcugggauuugaacuccggaccuuuggaagagcagucgggugcucuuacccacugagccaucucaccagcccuaacugucaucuucuaacaggacuuuguaaaugagagucaaugacugaaaggguccaagaaaccgaggcaagauucccaucucgcaggagggugagaggcaggaggguaacugcucuccaugugaauaacauccaggaagaugcuauagguagagacgguaggucuacuggcuaugaguagguggggugaagaggggggguuaccugguacgcaccuauagcuuggcuucuugcagcaccgugcccuuggcagcuggugacaucagggacucagaguaggccugaauggccuccuuauccugggagcccuuuuuacuaccacuccaaaacaaaaagcauuucuccuggaagacaaccaagcuaguuuauauggcaugccgugucacuggggugacgcuggguccccccagaagcaaagggacagaagagaacaagauugcagagucuuguuccacccugcacugugggcgaagcgccccggaaguccggcaagcagaaagucaccgacaggaagagaguggcggagguggccacagcgggacuggccugcugaguguuugaauuucucuggucuggucugguggggcuggauuugaaccuagggccuggagccuacuggguacaaucucucucuuaaccucuucuccaaguccaugguauuugucaaucugagggaaacauuaacauacucuugauuuaugaauggcguaugacugaguauguucuuuaccagcaagcaguuaacccccccgcccccagaugcucaaggacaggaacacacaggugaggccuagcuuugucaggacaaggcuucuuuggccucucucugaugaaacccgcaggacaaacaaccuugcccccagaccccagcgagacgccugccuucuauuuuggggucucuccuccaaugguugacugaaaaagccuggcucaguucucacugggcagcagcagggaggaacaccagcccggaagcccagaccgugauguccuccagauccucauagcuacagucaacauggagagccagaggcaaccagacaccccuuggugaugacaagagacuuggggccuguguuuggaaagggaagccgggugcuggggacuccacagggauccguucuucccaaagcaagcaagcaagcaagcaagcaagcaagcaagcaagcaagcaagccuuaaagaagaaaggcagccagcuggcugacugcaggagagcaggugggaagacccccccaacacacacaccaagcacgcacagaaagcccagccuguggccccaggacaucucaggugggacccugugaguggcucuuguacgaguguucaaagguggccaguggcuccccuguuugcagacagcagcccucuugaaucacagcugaucacaguccuguccucaaauucccugcuucacaacuacagcuaucagcaagcaccccaggggacuugaccaaugucguaaccccaagaucucaugcacgagccgguacuccugaggccagaagggaacgaagguucuagucaugaccccuuugcuuccugcuuucaggggcugcaugcccugauguuacauuccucagucauccuuucuuuauggaagugaccccuaccccugucugaaccacacuauucuugucuuuuucuuuuuaaaguuuuuuuuuaaagauuuauuuauuuauuuauuuauuuauuuauuuauuuauuguaaguacacuguaacuguccucagacacuccagaagagggagucagaucucguuacggauaguugugagccaccaugugguugcugggauuugaacuccugaccuuuggaagagcagucgggugcucuuacccacugagccaucucaccagcccuauucuugucuuuuaagauuuauuuauuuauguuauguauacaaguacacuguugcucugcaggcaucggaucccauuacagaugguugugagccaccaugugguugcugagacuugaacucaggaccucuggaagagcagccagugcucuuaacugcugagccaucucuccagucgcccacacuauucuuuuuuugaaguuuaauugauuuucggagacaagaugucacguauccuaggcuggccuugaucaaacccuacauguaaccagggaugauuuugaaccggauccuucuccccuggccuccuuccuuccugagugcugggauuauaggcaccuguauuaguuuauguguaugaguguucuccaugcaaguauaugcacugugugugugccuugagaucaccuggaacuaggguuacagaacuaggguuacagaacaaggguuacaguugguugcagaacaccagguaggugcugggaaucgaaccugggucccugcaagcaguaagugcucauaaucacugagcuaucucuccagaccuucuuuucuuuucuucuucuuuuuuaaauauuuucauuauuuuugauuauuuuuuuuuccugucagcgcugaggccugaauacaaggccucacacuggcuaaacaagugcucuauggcugauguaaaacuucagccucauaugcugauauauuugggucaagcaaaauuuauaacuaauuucuuucacuuuuuucucuggacuuagaaaaucuaaguucaugguuccacacguggcuccucccacuuccaucucacacccaacuccagcccagagcauuuuccuugggaaaaacuaucuucucuguuugguuuaaccuggcuuuccuuugcuucucuaaccagcccagcccugaccccccaccucuaccuucggcaggcacuuuccagagcgggcaccaaguggcacccacuuguuggccaaaugacuggguaccuagccucagccuagccccgaccugggaggguccugggccuuccaggacuuguagagaaaaguuacugcagggugcgagagaggagguagaacaagagcuagcugcaggaaacagaggucggcugaaacccgagccgaguccgaggcguggccgccccuccuacuuaccuggcugcgcaguuggcagaugaugggcaccagcaacaggaggccuccaagccccagcagcacauacugcgcguagugaagaaccuggggcaucagcaccagcugcguguagaacgugcucaggggcuugccacccauugcuccgcucugcagaagaaaggucgggcugcacgcugcgucuccaaggcacccaucccacugugccgugccccgccccaaaucagaacagagagccucgggcgcuuuggcuagaaguccaaagagaacuacauuucccagacgcccuugcuguuggcacgcccaugaaaugaggcacuggcuaaugggagguggaucuggccccaagccuccucgccuaacagucaucucuuucgcugguuagaaucuagucuuaggaccugaagggcgacgagaucaggaugccugcaggguggccuggugcggaauuccaucuccacuccccccucucaggggccauuaacaaaaccuggaaauggcucugugguuaagagcgcuggcugcucuucaagagagcccacguuucagacuugacggcucacaaccaucuguaauuccaguucuaggagaccugaugcucucugggcuucugcggguaccgggcacucacaugauaaccauacauacauacauaugggcaggcuaaacauacaaauagcuaaauuuagguaccggaaguuaacauaacauuagcaucaaagcgaacuaaaagccucagcuaacauacagagaccccagacucccuucuaccuucauagacucaccuguucgaaccacagcaacggcagaacuacuggcucgaucuucccuguuugccuggaaacaugggacacaaagugagugaccaggggugaugugacccucgcaauggagcuauguuuggggcuuggggugucagugggagagcuacugguuaccaugugaaaggccuucgcucagucgaaaccacuucacaagaaaaugagacagaaagauaaaggggagccuguaacgcuacguacaguugacuauccuuagccaaguuugaggcuagccugggcuacaggaaacccugaugcaaaaaauuaauuaaggggcguggcaaggcucagcugagugggugacagugcuugcugcuaagccugaagaccugaguuccauccccgggacccagaagguggaacaggcucccuaaaguugucccaaccuucacauguucauuguggcaugcaccuauacacacacacacacacacacacacacacacacacacacacacacacuaaacacaacuaaaaauggggcuagagagauaacucaacgguuaaaagguccugaguucaauuccuagccaccacaugguggcucacaaccaucuaucauggcaucugaugcccuccucuggcucacagguguacauucagacagaccacucauucauaaaauacauaaauacaacuuuaaaaauaaauaauaauaucuguguaugugguggcacaaugccuuuaaucccagcucuugggaaggcagagauagguggaucucugugaguuugaggucaaccuggucuacaaagugaguuccaggacagccaagguuauuaacacagagaaacccugucucaaaaagccaaauaguaguaguaguaguaguaguaguaguaguaauaauaauaauaauaauaauaauaccaauaauaauaaaauaauaaugagucuccucccaccaaagccuggguggcugccccuguuacuaucuacaggggaaccugaucgcaccacacacacccagguccagcaaguacuuuaacaccccaaaagcuagaggagaaacuaucacugugcuggggaugguucaguggggaaagcauuugcugcucaagcaaaugaacccgaggugagaccccugaacccaggcuaaaagcuguguguggcuuugaaccugugaccccagggcugagacagguagaagcuagcuggggcuucggugagaauuccugccgcgagggaagaaagggaagagggauaaaagaggacacauggcauccucuuuuggccucuguaugaaccaccuuccccuccaaaaaccaaaacaaaaucccaaaacucacaacaccaacaagaaacaaagauuaaaagaaaaaaacaaaacaaaacaacccaucacagccacgggagccgggcgugaggcgugagcgggcggcaucucgugcugagaagcugcaguuguggcaauaacgcugcacuagacuuugguuccuuaccgugacagauacugccaggagcggacaguacugaaugcaccggggacagagaacaaagauuugcuugcgucucugacaccucuccauaaaucuauaaagauuucuaaagaguauuugaggcaguggagcaaaucaauguuuggcugcugaccucaggaacucaagcccguggccagcccacuuuggccuccgguuucaagagcccagaugagucagaucaaguggcgcauguucaaggccaugaugggcuacagagagauuaagggcagccuggguaaucuagugagaccuaaaaagugaagagggcugggauguaauucagugaaagaguguuuucuggcaugcaggagucccaggguguguguguguacagaagccuagcugaguccagcaauucccggacuuaguuuucaccaugaagcccagaguccaccucuuccucagugguucccaggcaugugaucugcgaugcugaggagugaccagcauguggguccuuucguucaaagaauuauuuauuuuauuugcauaaguacacuuuaguguuuucagacacuccagaagagggcaucagaucccauuagagaugguugugagccaccaugugguugcugggaauugaacucaggaccucuggaagagccgucagugcucuuaacugcuaagacaucucuccagccccaaggcuggacuccuaccaccauguuucugccgggcaagcagggaaugggggcaggaggacucucagucucacucuguacguuacacaaagcuaaacauaaaguaaacccagggaauugugguugagaacacuggcaggacccagguucaagucucagcauccauucaguggcucacaacuccgucuaacuccaggucccuaugcccucuuccggccucggcggcucuugcacuuacauggugcacagacauacaagcaggcaaauccauccuacugugggggagacaagauuaccaaugcgacuaauggcagaagagcccuugggcguggaggauggagguagugucaggaugcagccugggucugagucuccauccagagcaaugaugcaaucccaggaaaagaggugguuggaucccaacgcuugggccucgcccuguccugugccuugcaucaccaaugcaugaaaccuccuggccccugaagcuuucagaagcucccgucccaacuccacucacccgaugcccuugacagauuugauguagaggcucagcugcaucuucacagaacaguucauggggaucccagugaccuagagcauaaauacagugaggagauguaagauccuguggggagccucccagccugcuccagccugcuccagccugcuccagccugcuccagcccugggguuucuuauccaacuuaaaccagauaauaccugcuggggcauccacccuucuagaaauuucccacacacccacugggcucucccucaggaaauaccugcucccaaagggaucagcuaucgcaagauccccucucuagacacuuguugccagagggaugacaccccccgccccccacaucugcauguucguuuggggacagauuucaugugguccagguuggacuccaauuugcuauguagccaaggaugaccuugaacuccaaaucuuccugucucuaccuucugaggacuggcuuaugccuaacuuuacauggugcugggauggaagccagggcucugugcagggcaggggagcacccuaccuacuaagcuauccucccagcccucacgaagcugccuaagacagugccucccaaguguggggcaugcgcaguaaggaugucuuuuuucuccuguuuacauuuccuaauagcccagggaaccaaaggaagggccugguccagggugaguagguuuaaucgagccaguuucccacuauguagcauccuggcgcucccuaacagagguagccacagagagcugccugcuugcagcucucuuuuuaaaaugugaugcuuuuaaaaaaaaaucucgcuggagagauggcucagcgguuaagagcacugacggcucuuccagaggugcugaguucaauucccagccaccacaugguggcuuacaaccaucuggaauuggauccaauguccucuucuggugugucugaagagagugacaguguacucacauacauaaaauuaaaaacaacaacaaccaaaaaaucacuaggagaauucacagguauuauuuaaaucaggaagaaaguucuagaauggaaaagguuggugaaaagagaccaccguuugaugccuuuagcccugcccagaucaugagacucuugaaagauugaugggaggccggaggccaccucucagauuguaaucacccacaguagaaggccaggacacguuuugcccaggacgcccagaucccuccugcccccagggcaaaggccuccagaaaccugguaugacuuuuggacagaggcauggaugugauaaccacgcauaccaugggugggcccggcaacccucccuagaagucguccaggguaggugcccaguguuggucuuggaaccuaaguucuggggggugaggugagggugccccauucucuaagcuaguguguuggccucacugugccauuugcauagacaguuaauaauaccaaacaccuucguccucugggaugaagcauggaucugccccagggagagaggcucacaggacagguccccagucgacaacuaggccccccuauucugaggggcuuuccugauauaaaacaccucuaugucaaguuccuugcuggggagcuaggcacaaccugggaaagacuucagacgacugugccccaugugcccacccuuccucugcgauaacccucagcuaugagccaggugugaagaaacacuggaagccgaggcaggaggauuugcaaguucaaggccagcugcaggcacagcucggcaucagagccuggggccuuguguguucaaaacccaggcuuccauccccacccaguaaaacaaaaaagaguucuucacggaaugccuucagggcgucacguagggcaggaacccuggacuggacacaucuuacagugaccagaggcagagagaaguuaacagaggacaaauuccucccccugauuucucugugagacacuggcccacgaugaugucuuuagugucuugacacugucaaggguaucugucucuggugaaggagacgucccggcugauaggucuuaauuaauuuacuaucuuauaucuuuuuauaggccccaauaaaaaagguaaugauaucacugaacucuggaauugggguaaaguaagacuuugaugacuugaaguucuaggagcagccgcuguggaaggaacugaacuccccugccucaguuggaacccgcucuguccuggggaauuggggggagcggggcgggugcccagcggccaguggcaaucucugggaaugggccccagccacuagcaggacacggagcuuaccggauggaugucuaggaacaaggaaugcuccuuuggguuaggguucagaccaagaacagcuucugacaacacagggucggcguuguaaaagugggggugggagagaaacagaggcgcaccuggaggaggggaagagaggcguuagaagacgggagcgucacguuggccugccucggugccagggaugcagggaugcuaacacuggggaccaagcugagcacacacaggaccugggaaggguggauggagccagaguggccgauuacaguguuggggguggguggguggguggguggaggaagggagagagcagcugcuacccggcaagggaaaggcauuccgggugggaguguagcaagaggugagagcuuggacgugauuuucaaccccccacccccaccccuccaggucuggaggugcagcagggaaucaugggagaugaaaguggaaaggaaaauuaacaccauaugaauuuaggaguggaagcggagucugaaugucaagccaggcacacagacugcuuuuggagacauuguagcucagggguacacgugagugggucucugacaucacaggaauggaagggacagcaccaaugagauauucccacccagggcccugaggugggacuuuaccaccaaccagccaaaguggcucaacccagagaucucaggacaagggccuggggaguuccgaguucugagucucccuggggaggccacaagaggcucccagggcaacagauccacagggggggcauuguguuuuagcugggucugguggugcacaccuugaaucccagcaccuaggaggaagaggcaaggagaucucugaguuugaggccagccuggccuacauagugaguuccaggacagcuaagacuacaaaaagaaacucugucucaaaaacacaacaaacagggcuggagagauggcucagugguuaagagcacugacugcucuuccauagguccugaguucaauucccagcaaucacaugguggcucacaaccaucuguaauggggauccgaugccuucuucuggcaugucugaagacagcuaugguguacucauaaauaaaauaaauaauaaaccuuuuaaaaaaaagaaaacauuucuuuaaaauccaaagccagacaggcuagcauaccucuuuaauugggagccagaggcagguggaucucugaguuccauccgagucuggucuccaggacauccacugcuugaagcccccaaccccuaccucuugcucccaaccccugaaccggcugcuaugggcaucuucaagugcaggugucagacacaagagugcugcaccugugacagccuuggcagagaaauggccuagccaggaggugcacgugggcagggaugcagcagagaacccggaucacugagaguccaggugaacccuagcaccuucgaggcuccagagacacaccugguccugucagaaagacaggcgaaggauccucaggguggccuucaagcccucauggaaacacaacaccaaggauacaacagaacagaaaagagaccugaucaaucccugaggccuaacgucaccucuguggacccuucuaaagucacgcugagauaugcugccuucuacuuggaaaacccuacccauccuuccaaccauacugugaaaggagacaccagcaaagaucagagagaaccccauuucuuucagagggaugccauggauccccgggagaugaagcccccaccuaaccagaccuggaagcacagauuccaacaggaugucaaggcugccagcacagaccugcugcagguggcaugcccguggcuuucuaacaauagguguggcucaucuuuucuuuugauuuccaaacacccucagagagacgcacccgggcaauaaguauaauuaauuuauagcuuuauggcccguguauccagacuuaacugcucaggauuacccgcguggugauuaaggaccacuucagggaagauccaaggugcucccaagacaaggacaggaaacacggggaguccugaguccaagaaagucucgugacccagaaagggaaaccuauguguauucuuuaucuuaagauaaaaugccacagaaauucgaacucaggugcacuccuccuacagcaggugcgagaauguucuagaagcauccuuguaguggugaaaugccaaaagaaagcuccgugagccaggaaggaguaaggcaagcagaguuagccccaccauggaacaccacccaacaaucuaggcuaucacccgcuaucuugcagauuuaccauauaaucaugagagccaucaugggaggcaucagggaucgagggagaaagaacaguugugacuccaucuauguaaacaguaaugccaggcagagagccgagagaccaaaagucaggccagugggcaggaggagcaggaaggggagauguugggugugguaagaguugccucuuugugggguuguuggucacauggccguguucccuaucacucgaaucccuguuccucuuccccuuucuuguucucacccgauuuacaaggggcaagcuuuaggggcugggaaaacaguuuagucaguuaagagccuccugugcaagugugaggacccgaauucggguucccagcagcgccacaucuguaacugggaggcagagacagguggaucccuggaccucccaagauccaggauuagugauugaaaaaucugcaucaauaaacaaacaaacaaacaaacaaagagugaugaaggaagacacucacuuccggucuccauccaucgaugcaccuguuuauaccucccuccacgcgugugcgacacgcacacgcauacuuaaacccacugucuccggaaaacaaaacaaaacaaaacaaaagaacaagcuacagacacaacuacacuuagauucucuuucacagcugaaauucuguuccugacagcagaguucugugugaugugggccuguugcugccccugcggugugugggacccagccuggccaauuaacacagccuaaugacuaggucagagcuggaccaguucaaccaagcccugggauuuuugcugguacaaggaggggaaggcggaggugcaguugugagugaaacuuccuguccgcaggcaagcccuggaucccacgucuguguaggggccuuagaaguuugacucccaauauccuacugggacauggccacaggguuugcaguccaaggaggagacaagcaggggaggguucaguaaauaacaucgacagccaugagcaggcaacaggaaggcauaagagagaguguaccagagagcggcuggagagccagaggggacggaagaucagggagagugucugggaggaucugaucaggaucagaggaagcauuucauuugaguuugauugacaucuggugcaauacgagcuggcgagagagcaagggcacccgagugacacgggaagaaggugggugggaaggagaaagacugugugggaggugcuuagagcagccugggccugacugccaggugaggggugaggcacggagcagacuugagcaauagcagcaggguagggcccaggauuagaacacagagcagaugugccagggggccacagccaguaccaagauucacacccaacuuggcuaaagaggagaguuugacacaauaggagcguggccaguuugagugaagggcaggacucuagcuuuugcucccagcaggugaauggccacagggaauguuuccagccucguccuagugggcaaagaaguuagagccaccaggauaacagaccagguuaucccaguggccucuacccagucagucucugggguccugaaagcuaugggcuggauagaggaggaggagguggucauagaacggaguguuuuggggggaucuggugucuggguacaugccuucuaucccgauaccucugaaggcagaggcaggaaggaugcgcaaguuugaagcuaacuugggccacaacgcgcuacccagucucaagcuggaugcuagguugagaaaggaagggaccacaagccaaggaauguggugccuccggaagcaggaaaggaugagggcaggcuccucuccuuggccaagaagcagugcccacugauggaaucuuaaccucggggcaggacccuucggacuucggagcgacacggcuuguggauaacgcgugccggugggacauuuaucaggguggcuguuaucuuuuuuccaguuaccuuuagcucccuaucuguagcacugagaucaucaugggugcagagaccagagauuaaugggacagcaagcuggcagcagauaaaaucccgguaccacccucucaccucagccuagagguggagaacacuuagaggacacucaccaaaccugcaggugcugacauucugaaugccagacucucggcaugggcagaagccuucguuggguggguagacggacccguuggcaaacagaguaucgggggccgugaagcgauacgugggaaugccuucaaacacccuugauucguuguaggucagcuucauggaccugcagaggggaggcagggugagaacugugccuugagcacagaggcuggggcaccccugcagaagaaaccacagggaccagcaaugacacuagucaccuguugcugaggaaacuucagcggucccucaauguucugccugcucccuuggcuccccacucacuaauccauccucccaaugaggcaaauuaaaaaccagaacucagcacaguuuagcacaguuuggccagcaugcccuaggccggagguucucaaccugugggucguaaccgcccacaaaagcccacuggaaaacgcagacauuuccauuaugauucauaacaguacgguagcagccgggcagugguggcacacgccuuuaaucccagcacuugggaggcagaggcaggcggauuucugaguuccaggcuagccugggucuacagacugaguuccaggacagcaagggcuacacagagaaacccugucucgaaaaaccacacaaaaaaaaagaaagaaagaaagaaaggaagaaagaaagaaagaaagaaagcaagcuaaaacaugcacagcacaugucugcaguagcugugucagucacuugagauaaucugaaguuuacagaguucccuuacacuuacaacgaugugccauguucucuugauaggggcuugagagcugaugaggacuguggaaaccaaggcuuugggcaaugguuuucugugcaugcggagggaugagcaaccaccauggcccugcagucacccugcagugcgaugccauccacagaugccauccacagcuucccucuccacuuccugucucacuguaccugccagggccuuagucaugucccuuccugccccugaaccuccggaucccaccucucccucagcccagacuucggcuuucccagucucccuuguccacccugacuccucuucauccauucacucccacugucuggccucaaacacucuucugaugggaaacaaggcccgggugacccacacuguccauggucaacaccauaacacacacacaugucugcucaauccucaaaacaaagagaguccagggcagaacucggucuguggcucauggcuucaauccuaggacugugcaggcugaggcaggaggauacuuuuuugccaggcuacacagugagacccccccccccaacucaaaacaacaaagcaaaacaagaggaaaccaauugggaugaaccaaaaaaaagaggauaagacauuggcgcucucucucucucucucucucucucucucucucucucucucucucucucucucucucucucucccccucccucccucccucugccccuuccuuauguaguucuauagucucucuauguaaagaacuggaaauagcuauguagaccaggcuggccuuagacucccaaggauucccuugccucugccuugagugcuaggauuaaaugcaagcacugccacaccugaccgacacccagauuucuaagacccaacacuaagcaaaagcucuucucagaaaaucuuuucacacagucuggugguaaguuuuuaaaugucaauuugacauaguuagaaucuccugugaagagacucucacugugugaaauugucuggauuccccuaauugaugugggaagagccagcccacugugggcggcacuauucccuagguuuggcucauggacuguauaagaauggagacagccaucugagcuauaggcaugagugcauucagugugacucuguuccuguaaguggauugauuagcugccuggaguuccugcuuugaucuccccccaccaccagccacaaagauggccccuaaucugaaauuauaagcacaguuuguuuuguuauuuuaugcagcagcaccagcuuagaggcucuuauuagggcgauguuaaauucucugauuucgauccuugugauuguguaagaagaggccuuuguuucuggagauaaccccaugaaggacugaaggaaagagacaccuggccugcacccugcucucauauaauucugccaggcugaaauccuauuuagugucugcggcaugacucaguaucaggccacuuacuuagagugugugaggcccuggguuccauuaucagcacacacacacacacacacacacacacacacacacacacacacaaauaaaugggcuggagagguggcucaguaguuuagagcaacacuuaaguucgagucccagcagccgggcgugguggcgcagcacaccuuuaaucccagcacuugggaggcagaggcaggcggauuucugaguucgaggccggccuggucuacaaagugaguuccaggacagccaggacuauacagagaaacccugucucaaaaaacaaaacaaaacaaaacaaaacguuugagucccagcauccucguagggcagcucacagccaccucuuacaggagcuccaggugaucugacgcccucugcuggccuccucaggcaccugcacucaugugcacacacacagauacacaaaauuaaaaaaccaguaauaaauaaaauguaaaaacaaaacaaaaccaaacccgaaguucugcuuuugaaaguccaccagagcacacagacuuugcucaccccgucguggcuguguucacaccuggcaugaagcauggcugccugugugagcuagagaggaagagggcucaaagaucagcccagugaguccccaggccagagucaucucugguguggccagaauggaugcacaggcuagggcaccaccuggaaaugggucucugaagacccaccaugucuuccuaggccacaguuaggacccuggggaugguggagcccaagcuacaagacuuuaacacuuuccuaccaguacccuucaccacugccaccaugacugaguccccagacaccucgcaagucaccucugucagguaucuugucacagugacaagaaaaaccauugaggcauaguacacagaaggccagacacuuugagcacacuuccagggagcuaccugaguggacccugaaccaucucagaagcagaguuuccugguaggaggcagggagucccuacacagggcuuaccugcaugccuccgggcugaagaauuccagcgaggauucgggugucaugaagggugcccacaucugcccggaagucccauugaucauguuacacugcucugaaugccaauaaucgaucugcaggacaggaugagauauagccuugagggacagccaagaucuacacccaaugugugcccuaguacagacaucaucauauccaagcccgugagcaggcugugugcacagagguucuagcccagcuuccuguuccccacaguggggacagaacauacaguauuguggggacucaguuaagucaccuguacaauaucgaguuccaggcuagccaggacuacacugagacccugcuuccaaaacaaaacaaaacaaaacagcaacagcaacagcaaaacuaaacgcacuucccacucugccguaagagcuuucaaucagcccuucucauaguagaaaggagacgauuaggggcuggagagauggcucagugguuaagagcacuggcuguuuuuccagaggacccagguucaaugccuagcacccagauggcagcucacaacugucuauaauuccaguuccaggggauccaaggcccucacacagacauacaugcagacaaaaugccaaugcauauaaaacagcagcugguuaaugugaacagcacccacuaagaauagcuguuggcugggugugguaacacacaucuaugaauuaaacacuuacaaggcaacagagacaggaggauugaauuuuugaagcuagccugggauacacagagaccuuauuucagaauaaaaaaauuuaaggguguggcucagugguagagcaccugccuagaaucccccagugaggggcugggggcguggcucagugguagagccccugccuagaauucccccagugaagggcagaagucuagcucagcagugguguccuugucaaagauucacauggccugcguuccaucuuuaguaccugggccucuggacaacacaacagaacaaaaacacauuauccauaaagaugccccuaaggagaaaagccagcagcaaaauagcacaugacaggauuucuguguauucgaagaaggaaggaaaacacauuucucuggguacacagaggcguggugguggguaaauggccaggaagcuggguucuauaagcaguguugggggauuuccgggugggccuaggcaaggugcuggaccucauugucuuaucuuuaugggaaugucuuccugucagccuuagaaaugacaacucaggaacagaaaagaguucccgacagaaauaccgcagggacaguugugggauccgugaaguccucgggugacccggacacccucugccaaggcuuguucugguguaguccccacaccaaucgauggggacugucugcccuccugcucaccuugcugaguccguuccauuuguccaccagauggauccugcugaaauucuggacgcccgugaagacagugaagaccccagaauucgaguuguucaucuacagacaggcagggaacagcaccuuuagcccugggcauagaucacaacauaggcacaagcccaccuauucuucagcuauagguauguccccucacuguugcugcauaaaugauggggacagaacccagugccuuacacaugugggcaaguacucauccacugagucacacccccagcuuccccccacccuuuaaaaaauuuuaugugaguacacuguagcucucuucagacacaucagaagagggcaucagaucucauuacagaugguugugagcuaccaugugguugcugggaauugaacucaggaccucugguagagcagucagugcucuuaacugcugagccaucucuccagcuccacccuccauccagcauucuuuuuuauugcacauuuucagacaggguuguccaggcugguuuugaauuugccauacuccugccucauacucccauguacacagaugacaagucuacucaaucagggccaacagcuaauaaaguaaaaaggcauuuuagcggggguuuaguggcacacacccuuacucccaacacucaggagagagagguaggcagacaucuguuugaggccagccuggucuacaaagugaauuccaggacagccaggacugcauagagagacccugacucaauaaaaauaauaaaacaaagauaaaaagaaagaaagaauuuaauacaaauuucugacaggaacgaucuagaagcucaguagaagggccccaccucaauugucaggaagagagggauggcagucucuaugggguacugggaagggcagguacagacagguacagggcuuuacccagggccucuaacucuguaaaagcuuuaagacuggguauucagccugccgcccucguuauguguucaccccaugggguccccaucuggucacugggagacacagugccuuaccccgucuccucuccacaagauuggacauauuuuuauuuuaugugucugagucuuuuugccugcauguaggucugugcauugccugcacugcagugccugagugagccagaagagggugucagauccccuggaacuggagcuacagauggggugugagccgucaugugggugcugggaaucgaaccuggguccucuugaagaacagccagugcucuaaccacuggguaguaaaucucacgugaacucaguaauaacagguccuggaggguguggguaacguuacugcaagcacaccccgucaguagauccccacagagaaagcugagcugaaccagagaguuggggucaggggucagagaccaaaccuuagcucagguuaccaaaggucaacugugagaaauagugggugccucuaagucacacugauggggacauuugagaggugugcuucgaagauccaguccuccuccuccuccccgcaagcugugccucaaaucuucuaaguuaaaccccagccauauccccccacucgaacuggaucaagccgcaccugaauguaauccuggcaucuccuguuauaugagcugauaauuucccaauuuuuguuuaagcugguuugaguuaggguccuugagagauaaccugacucucugaagggacagaagacacuuaccccaacaaacaggccaaauuugcccuuuaugggaagcaugucugggagguacguguugagaaaaugcacgaagggaucgucauagccccacaggaucucaccaacugugcgguucauaaaagcacgcuggcccauggugaccagcgccaaggucaucaucagcuucaggcucacaggcuugcucuccaucaauaucgagccccccuggaaagccaaggacaugggauuaggguaaaggacaugguaggacaccaucccccacuuucaaccaggcuucaggcaaagagcucaggcccucaggauggaccuuucucugguccuuguugccaggguaaccuguacucucgagaacacccgaugauggguucagauugagugaacucuacaaggacucagaggcauacacgaagcucaggccugaccuccggaagccuuccugagccacugugucuguagagccacaccugaggccuaaauggaaccagugaaccaccagagacacuccgcagagccggggcacagagaaggaggcucccaugccaucccucaccaagcgaacggaugaggcuggagccaagguuaagagaaaaccuaacacagaagggggccagcaaagauaugaauaccuuguuuuguuuuguuuuugauuuuuaaagauuuauuuauuuauuuuaauguauaugacuacacuguaguuguacagaugguugugagccuucauguuguugggaauugaauuuuuagggccucuucuuguucccaaauucauuuauuauuauaaauaaguacacuguggcugucuucagacacaccagaagagggugucagaucucauuacaggugguugugagucaccaugugguugcugggauuugaacucaggaucucuggaagagcagucaguagugcucuuacccgcugagccaucucgccagccccuuggauacccgguuuauagcuaggacgugaacccuauucuaucaguaacaugagccuagaaacacagcauauggagaaagccuccccgacuccccguggccuccuuuugaacauguuuacagcaaggucucaaugauuaaucugggcuggcuuggaaaucagcauucuccugccgcagucuccucacagggauuccaccucacuucucaugucccugccccaccucaacacugggagcccagaauaucuacucccccgaagcccccccagggucuaacugccccaaguucaguugaguuuauaguuuucuuguuuguucuuccuccguauggagcaucugggcucuuguuuuuucccaaaggccauucaaccaaaagccaccuuccaccuccugggcaacgcauggcuggugucuccagguucuuuccaucaagcaagcgcaugaugccuacccaccaacacuuacaggucuccuucaacacagggcuuuuauuauauuuauugaggggugcuauagugcacguauagaggucaaaggacaaugugaggcagucauguggguccuggagauuaaagccaggccauccgacuuagugacaggcaccuuuuaccuacugagccauccugcuggcccagcacagaaugcuguugcuuuuucaauaucaaaaauggaauuaagggcuggagagauggcucagugguuaaaguacuacuuccucaguucaauucccagcaaccacaaagugguucacaaacaucuguaaugggauccgaugaccucuucuggugugucugaagccagcuacaguguacucauauacauaaaauaaauaauuuuuaaaaacuggaauuaauaugacaaaugugguggcucacacccagcacuugaggcagaggcuggcagaucucugugaguucaaggcuggccuggucuacauaaugagauacagggcagcuauggcugcccaguaacacccuaucucaaaauaaugauaaugauaguaguaauauaauaaauuaauaaaaacaaaaagugucccuccagccccaucggacccgggggacaccucugaaaauggacucgaggcaagguggcuaaaggaccaauccagucagcaucggcccgcaucaacugcaggaaagcugguguuuucaacaguuuccuaugguugaggguggggguggggggagaucagaagaaucuucuaaaaagcaugaaaaucacacaaagcucacaguuccaaucucucaaguuagugucacugggaaugguaaugcuuaccucgugacaucaugccuugacuguccccccacuaccaaccaccguguacccuguccucaaacuuccagcgagggccgugaugucugaccacaggauccgauccugccuugguaacacuggcccaauugguaucugggauuuuguccuuggggaggguccuucuggccccuguguaaauucccugccucugccuggcuuuugcuuccuccccugaacagcaggguugaguagauccccgcauacaccaaaggacagacucagcgaccccacacagugugcucaauaaaugccugcucuuccggacucccaccugcccucuggcccccaguggcucugaccuucaugcuuccccagggaccacaguggaggucccggagucucagaugggagguaaggcaaugagaaggaggggauggucaccauggagacaguggggcugagguggcccuugcucucugacuccugaaggcuaagcugggaggaagcaggguuggcaugggguugacacagggccacagucucaccaggaccaagauguuaggcaguacaauguagucacucucugagccaugcgacuugucaggcuggaaauggaggcugcgguucuccacgaaggacacggugucguugucauugaaggugauguugaccuuuugucugaacucccuguaaaaaggcauugagucagcuguggcucugugaggucacaugaaagcacccaucaucucccagcaugcccuggggugaugguacacugauacccaacagcaccaaggccaccaaaucaagcuugccaccucuuguuuauauccucgcugucuguccagggcaagacacugccaccaccaaucagcucuucucugcuuucccuggugagccauaaggcucuuugagccucucuggaaaacaacuccaacugcugcccccaccccccacgucucccuuucacuugacaaccagcauggagcagauauccacacaggcagcguuuacugagaguuuauggcauggcagacagagcuuaaguggcuccaacuaacuaucucaucuuauccuugaaccuacccacaguggguaccauuaccucugucucacagauggggcuaaaauaggcauuauggaaguuaaaacucucuguccaagguggaggaccaggcagccgcuccuggauccaguuuucaacucagaauuccaccugccucugccucccaagugcugggauucaaggugugugccaccacuacccagcaccgcucacuucuuagaugcugcguaacuggcuucacuucugcauguuuguuugacuuuucugacucaacagcagccauuuugcccauuuugugcgcuguuggguccucugugccccgcccccaugacaacacauuuacacucacauuagcccucaccccaggacacgcaugcgaguaugcacucgccucggacagacaccgccucuccacagacugucagccacuguggccuccggcuucucuguguggcugacagucuguggagaggcggugucuguccgacuucugucucuggagcaaucaaucuccaaaacucagcauggcagaacaccccccuccacacccacacacccacacacagucccaccccacccugccuggccucaccuguagacauaggguccacgcucccggacuacuggcuucuggccguugaggaccucguuuggguugaccacuucgaagaaguagacagacaaguagaaagggacggggaucuccuuccacaucccgaaggacaggcugcucgggucuaugcggacauucuguggggagacacagggaggagugugaggaggggcuuccccacuuuacggcucugcaacagcugccugagacuuggccugcgccauggacccuccaaggcucaucuggaagggugucugggguggucugaaugagaaaggccccacaggcucagauauuugcagcuuagccuuuaguuggagaacggcuuggaaggauuaggaggugugucguugucggaggaggcgugucgcuaugggcagggauuagggggugugucguuggaggagguguggccuugucggaggaagaggcgugucuuugucggaggagguguggccuuguugaaggaggugugucgcuaggggcaggguuugagguuacaaaagcucacuccaagcacaggguccauuggucucccucccucccugucucucucucucccucucugccugugaucucagcuacugcuccaacacuaacuugcuccaacacuaacuccaccuaacuugcaccaugcucccugccaugaggauaacggacuaagccucugaaacuguaaacaagcccccaguuaaaugcuuuauaauacagaguugucuucguuguggucucucuucacagcaaaacagaacacuggcuagguagugcucaucgagggaggugcuccuagggcuggagcucugcacagguggcugucucuccauucuuucagucaauaacucauccagaaagccguucguucguucauucauucauuauucacugaucauuucacauuuacucccgcauucuuuuguucuuuucuucauucauucauuuggucacucauucauucauuuuugacagaugagguucccgcaguagcagacaggagugggaaguagacaggcuggcugucuccagucccgugaagcuuuuaccaaaucgggaagacaagggcuuuaugcaccggguggggggguggggguggggggggguggagcgggggcagagccagugcugugugauguacugaggagcagggagagggaagaggaugauucuugagucaccagcagugagggacagaagacaguaagcaggaccgggggcggggcuuagugauugccuagugugcaggcagcccuggguccagucaugcagggcugucauccuagcacuugggacacugaaggaguuagaugguaacuuugaggucagccugggauacacagugaaugagacacucugucucaaaacagaacuacugauuuucuccaaggcuaggaggaagagguggaccauucccugaccugggaccucugcuaaugccacagagcuaagagucaccacccccagcucaucagagauagcaguguccaaaagccaaacagcuuugacuuugaacucgaccugccaggacaaagacaaccaccccacuguccccaaacagccagaaacaacaggcagaggcuccaggggagguggcaagccagaacuggcaggucaagcccagccccacgucagaguagacuccgaggcaggcggacacugggccacacucucucaggccuagcuuggcucucugggccugggguuuguccuugaguacugcaaggccggagucaugaaagccauggcugggucuggccuguccuccucgggacccacugaaagaaaaauccccugcugaguccaccuaagagauguccugccgcaccuuccguuggucacccacagccugaacaucuggcaaaaacagagaggcauuucaagacccuggcacccuuaggcagcugugacuccugcaaacuacccugcagcuuaucagccugguaagaucugcccacggacgcauuaguggcacggauauuauggguuuagccaauacucucugacuggauuuaaggccuucuccauaggacgaaaaacaugcccgauacuauaaaucuggcugagaaucaaauggcugagacaggcucugggggugcuguucccccaugaccccagaacuacuauuuugcuuacugccacacaguguaaaacugccccuacaauauguauaugggccacagcaauuggauugaguggguaaauaagggggaaaaagaaaagacaagaagaaaguacuggcugugguggcacgugacuuuacuuccaacgcuugggaggcagaggcacaaggaucuaugugaguuuaagaccagccagcacuaucuagugagauccugucucgaaggggugaacaaaaccaaaaccaaaaccaaaauggauauaaaaucaggaguggccuguagggggaucugggaggaguagcaagcguguaucauugaaauacguuguaugaauguugugguucucaaagacugaauaaacgauuuuacauuuaaaagaagagaagacauagaugcagcucaguggaaaagagcuuacccagcccgugcaaggcccuggguucaaucccuaccaccacaaccaaaucaacacaugguggaaaacuaaaaaaaaaaaaaaauuaagagcuggcucucggggugcacgcuguuggagcacacgccagucacuuuagcgcucaggcagcuaaggcagaggguugacuggcuuucugaggccagccuugcugcauggcaaucacccgcuucacaacagcaagaggacaaaacaaagacaaaacaggcuuugccaggaaaaggucccaggaggguguuccagcaaaggcuggccugccgagcaagcgugcggggcuccguguccacccaugacaggaguguuuauaaaccgagacucuaggaaacaucuguggagcugcugggagauuaccaaccugccucugccaacacgagacaagucccacgggugcucauggcuccacucgugugugugugaccugguggauuaaauuagauccauccccagcccugaacaaagugggcacagugcccaccucugccaccccagcccuccagaagcacaggcaggaggagcaggagucccaggccauccucagcuacauagugaauucagggcuagccugggcuacguaagaccaucucaaaaagaaaaagggaggggaaggggaaggacucaguauacuacugggggagagaauacagaaggaaauaugcacagggcguugugaguccuacugugagaaauuccagaauaaacaaggcuggcgugucucaauaaagguuuuuauauucuuuuaaucucugcaguuacuuauuuguguauauggguauguguguggguuugcuuacgccagggugcauguguggaggucagaggacaguucucccuccuuccaccauaugggccccagggaucgaacucaggccauuaggcuuggcagcaagugccuucacccacugagccaucuugcugcgcccuccauugaauaccgaaacugaaaugcacccaucauuuuuaaaaggucagcuguaaagucaaguagacuauacuuccccagaacacugcaauaggaagcugaagcuaaauaagugagggcaugggugagguacacagcccgggcagccagcggguacuugugugcacuucuaacauagaucauaucugugcagugcccuauggcucugcggagccucuaccugggacaacaccccgaauaccagcucccaaaugcugccugccacccagggcaaccucuccaguacaaaaugauuuccaccccaacuccaggauuucugauuugauauguagcugaggaugacucugaaacuccugaucuuucugccuccgccucuucaauguccagauuauagggagccugggguaucauuacaccuggcucacacuguguuuuagacuuuuauauauuugcuuguuuuuaauuugcgggggugggguggggguggggagcuggcuuagugguuaaaagcacuugaggcuguuccaggagacugaauucaguuccuagcaccccacacucaaaugugcgugcgcguguguguguguguguaugugugugugugugugugugugugugugugugugugugagaugagacauacuccucauaaccucugagccauuucuuuaucaccccaucaucaccagcacacucccgccauguuuuaaacaucaguugcccacacaccccagggaugucacaaccgauaucagaaagauaacaucccaguuugaaaacucugccccggagggauucucaagguuugagaggccaacagagcgguggagagcgcccgaagguccucaucucagacagauugucucccuucgccacccagagaacucucaggagagcaggaaaggcagccuccccaaagauucugcuuggcuuuuuuggcacagaggacuaggcagaaucucacugaaaaccauggggugaugggcgguucccucugcaagcaggugguugggguguugcgggaggcugaaccacgagguaccucauguacagccaccagaguggggaauggaaugccuguggggaguggccuuccccuaucugaagcccagggcccagcaucuuucagauuguggccugcaaaauaaaggagcuuaaucaccaagccuaaggaccagagcuggauccccaggacccacacaacagaacagaagacuccaagacauuguucugugucuucuacaugcacccuggcauauguauggccauccccaaaccaaauggauuguuuguuuauuuauuuauuguaaauuuuaccaugcuaacacugaccuauaagccuuugcccaucuggcucaguggcaucucuagggcugugucuuacugauacccccauuaguccuuuagaccagccuggcaugcuugcucugccuugccuguucacacacucucacccaccaggcccuugcacuggucgucgcuucuucugccuuccauguuugcagaggaagccuccugggauccugugucugugcucaggaacccccacagagcccaccccgagcccugggcucccucuuaaacucuuguuuauuccgaggcucucccugccuucuucccgauuacguuaaugacucauccuguguauugugcucacgucucucugccaggccauaaaccccaccaaugaugcucaugcuggauccgugaacucugagcagugccaggcaccuggaaggaccucagaggacuuggaggaaggagcccaagccaauucuggagcgccauaauccaucauuguaggaaacaaacccccagcauccugugggcaccuuugacauaguguguucuugagaacagaguuuggaauucuagggagauggcucagccauaaagugcuugcuucauaaguggaaggagccgaguuuggcccccauacaaagccaggcauggugguguaugcuugugaucccagcucuggagagguggagacagcgggauaaugcccagggcuugcuggccagccaggcuagccuaaaaauggcgagacucacauccuagugagagacccugccuuugaacaacaaagugaggugguucauugguuagagcauuggcuggguucuuccagaggacccagguucaaaucccaggacccacuugguggcucacaaucaucuguaacucuaguuccaugggauaugacaucauccucuggccuccaaagucaccgaguaugcacaugugcacagauacacacacacacacacacacacacauuuauauuucuaaaauaaaugaccacagcucccacuuccugggccagcugucaccaaagcaucccugagcuccagcggugagccucucagccucguacagccucuuggcucccaccccugcuucucuguccccuccucuccacugcacauucuuuucugucuucucuaaaggacacucauuggcccaccagaucauuaccuuaaaaaugucugcucugcaaacacuuuauucucgugcuuucgguggcaguuggagacuuggucucugacaugaagccuugggaggggacccucaggaggcuuagccccacugggaaagggcuggggauuggugguggggauggugcagacuuucuuugccuucuggcuuccccacuguaaucucucggcucauagcugcuccaagcaguucgcaacaacaugaaguggccccaucagaugugaugcuaacaccaagccugugucuuucauuacagcaauaccgacagacuaaugcacugagguuuccuccuuccguggggagccauacgcuaccucgacuccauucugcaagccuuggggauguccaaaaugcacaccaagugcccgagagacaggaaaacuggagcaaucuccaugcuccacaccacaaaggucugugagcauucugaucauuugcuuggaccccugcucccccacgaccccaguacauacuaggcaugugcuuggcagcagugaccuggguacagaauaagcacagaauaagccaucugccuuccagagagggauuggguaggguggcugggcaucagagaaacaaaggcuuugagucugagguggggucugggcaagccaaacugggagugagcaccauaauccggggguuagcggguucucugauggccaggauauaggucagucugcaggaaccgaacacacuuggacaucagaggcuccauucaaaagaaaaacaaacaaaaaggcagcuggagcugaucaaggccgccacaugaggugcuagggacccaacagacccucuguguggguaacaggacacuucuggucacuacaccucuuuaacucucugaccauauaucccaggugcacaggcaucaggcucagaggccucugguucaugaagaucacagagauggaagcucccccagccucuauccccacacaggacugcacaggaucuccaggacacuguaccuagccucuccaggcccugcucaguguggcucagcucaggugcugcagcccucgcaaagcaaucauuaaucugaccugggaaauugcaaaauccagucccuccucccccaagaaucacagcaaacacauuucagguucaaaaaaaaaccagguuuuugagccaggcugacagaggucggcucacaccuuuaauccaacucuuaggaggcagaagcagguggaucucuguguucaaggcuaaccugguggucuaccagggcagcuagggaugcagaaagaaacccuaucuccaaacaagaggaggaagaagaggaaggagagaagaggaagaagaagagaaggaggaggaggaggaggaggagagggaggaggaggagggagaggaaacaguucuggucauugccacuggguucaccagcccuggaucuggguugagacacauauccugucagcucugagccagccagccagucgcaauguacuagcccuguagaguuacuauguauacaggaaggaugggccccaaaggacaauccagccuagggcaugaagacaccacacaccaggaacacaccaggaauggcuggagagauggcucagugguuaggagcacuggcugcucuuacaaaggaccuggguucaguuccuggcauccacgaggccucugcugagcacccagugcacaagaggcugugugcuaggccuaaaccacagcagggaagaaaauggacaagggcuggagagauggcucagcaguuaagagcacugacugcucuuccaaagguccugaguucaaaucccagcaaccacaagguggcucacaaccauccguaaugagaucugaugcccuaugcauacuguaggugucugaguauacuuacauguaauaaauaaauaaaucuuaaaaaaagaaaaaagaaaauggacaggaccaaucuuuguaacagcagccccucccaccacacuaaaaguuccggugguuucagugaaacacccgccacccccacccagaaauucgguccugauggagagagcuacagagcuaccuuggaucaugggaaagcuuugagacugaaaaccauacccaaaggaugacagagcauaaagacugguggccugugacaucauaaagcccuccccaacucuggacauaucccccaaauucacaagaaucucuaugacguauaccagcacagccaaaaggagacggauugauaaucacaaguguuggcaaggcucuggggcaaccagaaugcaugcacgaugucgguggaacugugucggcgccaugguuugccugcuagagcuaaguaccuguucacuguacauccuggggaaacgccagcaccugcccgcugguuauccauaaauguuuucaaggguuuugcuacaguagcuuaauacacaagggugaagccgacguccgauugaguggcugggagaugcauaaucucauccucaaaugaucccuagacgucaaaggguguggccggugagucccucgggcuauggggaaacugguuucugcuccggugacacaccagagcaggcagauacaucuuagggacagaaguagaaagguguccucaagguauaagccuugugaccucacuuugaccccagcuugacaaagcagagagccuguccagcuauaaaagucagagccccaggaaagagggcuaagguggcuccaucagaaggucccagcauccucuagggcaacaucaggaccuagugaguuucccuggagacaaguggagugagagccacuccaggguucuuaggaagcucccugguuggacuggacuggacgcaaacacgugggcaccuauguguaugucaauccccggaccauauuccuucugcucccaagggcuaccccaauaaagucccucagaggagaaccccuaccaugcugaccagggagcaggugcgcauaucaaccgugucuggcccacagacagcugucagugggagaagcuuacgggaggcgugugagguuggcucucgcucuggggccuguuacuguuuaacaggcuucuggugugcaguaauuuucccagacucgauagaaacuccaacgcucaagucucaagggccaaaugcuaacaucggagcacuugugugguaugugcacaggccccuggcuugcuacauacauacauacaugcauacauacauacauacauacauacguaggacagaagcagcuuaaggaaggcuaaucuggcucacugaucaaagccgcaguccaucuugguggaaaggcaauagaggaagaagccaggggcagcuugccaggcuguguccacagucaggaagcagggaggggugaaugacugcuaggaucuuucuccuuuuucucugcuccagcaguuaggauggcuccaucacagacacauccagagauuugucuccaaggugauucuagacccugucaaguugacaccacacacuccccagaaaagaaaaggaaacaaacaaaaagcaagagugucuaugugcccaccccacccccaaacccugucagacauaaccaagguuagucucaaaagccucguuucugacucccuuuggaaaacuaggugcugcccaacaaggguugcaccccaacacuggugcagcccacaggcagccuucccucuaaccccaacuccauggcucacauaguggccacacccuuugacauucccacucagcccugacccagaacagcacaggcugagaacacuucauucauucauccuuucaucagucauucauucauuuagcuguuaaugaaccuguuugcuccuuuuuuuuucauucuaacccgccccacucccccgcacugucgaggccccaaacugguauuuaguacuacgaagcaaaguuaaccgaacuggauucugcccucagggaaacgguugugaguggagaagaggccuccuaagucugcaugacucagggacaugagaggaaguacucagagcaucagacgccuaugccggcaucaccggguaacagccauuaaaguagaauacugaagccugucacccacucccaauuaucugccaucugucacucaauccuacacaucgcucagagagaugaaaacaaccagugagagacuuagcgagauuccuagaggccuccaucacagcccuaauccggagcccacugaccagggaccaguuugcucauaacaugaccaccagcaccaagcagcaaccagcuaugacuuguaagcaucucaccagccucaggcugagcugcaccaagccacugcagagcuaggucaggcugccacucugaaaucgcagaagcaagucgauggagagcccagcucaguuuaggucaagccaauccaugcagaggaggcuaguauaacucacgucuacaaucucugcacuuaggcuaaggcaaagggauugcugugugacuuccacgagagccagagacacagccagagccuaucucaaaaugaaaggcuuucuggugccccaaaggauucugggaguucuuguuucuugauccuggcgccuaagugucaggcuaaugacaaugguuaucacuuaaccaagguccaagccagauggugaaugcgaaucuuuucuuguaguuuuucugacagguuaugucacccaggcuagccuggaccucaguguauagcucaugcccaugauccuccggucucugcuucucgacagccacaugccagauaagaaauugacacagaagcagauuaccuuguugcccacccaaggccucucugccuccuaccccucuagaaacacaugugguucaccuguuggguagagcccaaccauacagggaagguagcccugacuuuagacugagugagaagucuuugggagacuucuagagaaugcuuucaguagcagcuacagacauuagaaacgugugaguucuccauugagccagugccacacaaggccguugggguuggccaggggccccauccucaggucucuacagccuaauccccaggcuguugccugguccccuuagggcuccuuccaguggcacugcaugcaauagccuggggcacaaggcugucccuaggaagauaccaacucccagacacuucaaggaagacauaucacagagccuccagcuguagacuggcugggguucaagaacaaucccagagcccugccaaaccucagaggaagggcaguggcagccagcaucagcuaucagcucagggccauauuuccagggaacuggguuuuuucuaagacacucaucaggcuggaacauagucacuauggccacugggucccccuuuuacaaaccagaguaaggagggcugugacccaugucccuucaggggacaucagccauaaugauuuauucauuuuuaucaugcuaaagucuccagacuuggguuuuguuuugucacucuccccccaagcccccaaccccagacaugguuucucuguagccucagcugucuuggaacgccaucuguagaccaagcuggucuugaacucagagaucugccugccucugcuuccacugcuaggauuaaaggcagugccauuuuauagcauccauucugaugguguuaaguacacccauggcuugggcaacuguccccaccaauggccacgcccuuccauguccuucugagacccugucuccacuuaacacucucccuggccccuuuccccucccacuaccuccuuagugucccauuucuccaaccucaucaauagguacucuaggggccccaguaaacgaaaucacgcugcaaccauccugccgucucucagaaucuaacuucagcauucauccauguuccagugugugggagaauucucuccucugcagcagcuaucgcaggacuuuaaagcugaggcaggaggaccacgaguuugaacuauuuaccuggggacuauauaaugaaacccugucuccagauagauagauagauaaauaaauaaauaaauaaauaaauggaaucucucucuuccuuuauacggcugcauacuauucccucuuggagagcccucuuuucauuucugaagauuuaaucuuaauuuuauuaauguguguguugcucugugcacaugagcacagucccuaaagaggcucccagaagggugucagaucuccuggagcugauauuacaaguagcugugacucgccugaugugggugcagggaacugaacucugguccuuuggaagagccaugugagcuccugaccucugaaacccucuccagcucaccucucuguauuucaucugcuuuuccuaucugcccauccagcaucacuaaguauugggacccuucuaccuucagcuguugugugguguccagacuccccaggaggacggcugcacgggacagugaccugacaccagcuucucauggcagcugcacccuuuuacaguaccagcaacaucaccuacgaccuacuaaguucaacagaggcuguccuuguggguuugcacgaccuuugaccuucagcaaccugcagcccagugacagguguccugagcaucuaucugcuccagggcucucaccaccuguaaacuacuucggauacucauuucguuuucugucagguggaaaugcuccuugccuggcccucagaggggccugcuucuccucagcaccagaggccccucccucaccaguggccuuguuagccacacucaccacaggccagucacacugccccucuugugcaggugucaaguccugcagacaguccaucaagacccuguuucucugcccaccaugcaacuccagggccugggaggggcccagcaugcaacggggcagucagcucaacaggaagagggaacaccugcuuccccagaagagccucagacuccuccuccucucuacccugcuccucugugucugucccaucugccagaucaauaauccccaagguuuuggugggacugaaagacaccuggaggugacuuaaggcaccaagugucuuaaaucgacacuuagagcuggaguuuguggguaucccagcugcuaggagacaggcaccuuccaaucccacagguuuuguguuguuauuguuguuugggggguuuugguuuuuuuuuucagccagagcucagcuagaccccgcugugggucuggguagggggcaauggcacucucugaggccaggcuauacauauaggguucuuccacaauggcucuccauuggccucuaccuugaaacaaagcccauucuauaucucccuuccccuucucccccgccuccacuuccacaugaggacucggugacccugacugcugauagcucgguccacuuaucugcuccuggaccacacaccaugaaagcccagacugggaaggucagcuguggggagaccucgaaggccaggcugcucaguccacugcagccucccgcccacagccauggccauuucccuggcuggccucuucuccucaccuuucuuugacucguccccuugugugagagguccccggggacaccuucaucaucaucaaugacucccaccccagacaacagccuuauagguaggugggcugaccccuaaguccugacaacuggauacaggaauuaacaccaaccacucugcagaccgggaaacugaguccuugggagaugagacccugacugagucggaagcuagaccugggcccgccuccuccauucuacuccauacggccaucggccauaaacuuaguggagaauuacagaaaacacaggacacuucuuagacccuuucaauuauuuuuuuaaaucacauuuacuuauuuguguauuuauuuauuaugugcacaggcacagaugcaccacagcacacguguggaagccagaggauagauaacuuauaggagucugucuguccuuccaccauguggguuccagagauccaauuccgguuacuaggcuuagcagcaagaacccuuccccgugaugagccgucucucuggcccucuucacugucgauuugaauuggccaccuugcuacccaugccagccagcagcuggauccgaucccggcaacaccucucugauuccccaaugauacccauuuaucucucucagccccagccccacugacaagcaggaaaccaaaggcgcaaggaaucaaguucuugcccucagccacacaccagagaugaccauccagagaggagauggucuaaagaucaagauccuuaaggggacagcucugccaggggcugccacauaaauccugccaucuugaugcacagcaaguuccuggacauggggauuugagucaagguucacucaucuggccucacacggguaccucuaccucagugccugugagccuccacuugcagaaaaugccuugaguggaccucaguagaugggagcggaucuggaucuggugagcuugccuggaccucacacagcaugguaccuggaggguagaccaggcuggccuugaacucagaaauaugagccucucaagugcugggauuaaagacaugcgacaccacugcccggcuguucuuuuuuuuuuuuucuuugagaaaaguucuuacugugaagcucugagggugacuaaacacggcaagugacuucggggaccaaauucuguguugauuaaccuuuacucuuuuacguacuuaagccacaacuuugagcuaagcacgcccaaugaugugucuuguccuuuaaaauuauaaccuugcagcgguuagcucuggcaaccugacacaacguagauuccccugggaagagggucucagugaaggacggccugccuacauuuggauuggccuguggggauugucuaaaugauuagcuuaucugaccugagaagaccuaguccaccauuggcggccccauucccuaggcaagggguccugggcuguaugaguggagaaaucaaacugagcucaagcaagcaagcgagcaaguaugcugaaugggggauaugucaggacuccuggggcccuagaggaagcucagaucugguggcaccuuaauccacagaugugauuuccaggcacccagccaggaguaauuaguggcgucuguagaaacaaauauaucuccugagaaagcuccggaagacacgggaagauggugcuggaauaggcccaauuucccagagacaugcuauugaaugcacagccauuccccgcggccuuggcugaugggaaacacggcugaucccuccagcgcucuggaaagaagggggagacccagagccaucugagugcccaauccgagacugcaaagugcaggaagugcgcacggguaccgggggccaggagagggaggccagggagggcagggaggggcucuucuaaacacaaacauguuuuuugcagcaaggaacaaagagccaugaaccaaaguuaccucugugcuugggacgcugggggacgcgagugucaugucaccuuugucuucccagagggucauuccccucuggacuggcuucaaacucacuauuagcagagaugaccuugaacuucugauccucuugcuuccuaccuucaagugcugagagccggcuaucaggacagacuggugauuuuuguccuguaguuuauuuucacaguaggggcugucugggcaaaagguacucugccaugcaucuauguagguggugauccuaagauacuugacugugcccugugugaccuuaaucggaaauagggucuggccagaugucaaguuaaaaauaucagaucagcgcaguggcacaggccugucacuucagcacuugggaagcugaggcaggaggauugugaauuuaaagccugccugggcugcacggugagacucuuaacucaaaauaggaaugaaugucaaaguguuuggacuuagguugggucucaaagaagagcaggggagcuggaaagauggcucgauggaugcaggcaucgguguucgguucccagcagcuacgugguggcucacacuaucuguaacuccagguccaggggcucugauguccuccggccuucauggggaccaagcacgcaugcuaugcacauaaacucaugcaggcauaugcacauacacauaaauaauacuaauaacucaguuuugaagaggaaauggaaaauacaaaggaggccacguugagacagagauagagacagaaacaggagcauugaugccgucaacugaggaacggugaacaccuccaggaauggagagagccaagagcccucaagacacuagaagcgcccagccuagccaugaaguucccacggcuuaaggacacaaguuuagaccuaggugacuaacacaggccucucuaggaggcuggggcaccaccacugaaagaaacacacccugauuucagcucuggugaugggacagacucguccuuggccucuagcccuuggcgggacguuucugcuggccucuaucaaacugucaucccaggcaagaugcagacacuccugagccccaugaccuucaucacagauuccuuuuugggggccagugucucucuagcccagauuggcuuccuacucccuagaguagccaagcagaaucugagaugacagauagggaccaucauauaaaguucaugggguccugggggcugcccccggggccucgugugugccaggcaagcagcuacaaagugagccacaugcucagcgcaacacaaaugcucugaagaagugaagcccaaaccucagguuagccuguuaaaguccuucaaguucucagagccuuacucacaagccagcgaggcucagcaggcugcacagacggcucuagacacaaguaccagccguucaagcugaggacccgagugcggacccucgccccagcacccaugaaaaagccaagugggucaucaaacccagacauacaggucuauaacuacagcacucugggcauugggaucaguggagaaaggaggguuccugaagcuugauggucagacagucuagacaaucagcaagcuccagauucagugagagacccugagucaaaaauaaacuggcagggcuggagagguggcucagcagguaagagcacugacugcccuucugaagguccugaguucaaaucccagcaaccacauggcucacacccauccguaaugagaucugacgcccucuucuggagugucugaagacagcuacaguguacuuacauaaaauaaauaaaucuaaagauaaaucuauaaauaauaaauaaauaaauaaauaaauaaauaaauaaacuggcaugggagguaggagaguggcagagagcuuaacuagcaccuacgaagcucugggcucaaacuccggcaccaccaaauauacauuuacuuauauauauaaauauauauaacauaaauauaguauacauuuuguagauuuauauaaauauauaauuuauauacacacacauaauuuacgaucaagugugguggugcaugccauuaaucccagcacuuaggaggaaaaggcaggugcaucucuguaaguucgaggcuagccugaucuacauagugaguuccgaggcuagccugaucuacacagugaguuccuggucagccuacacuacacaauaagagcuugccucagaauaaacaaacaugcaaacuugagaaucaugggggagaacacccaaccuagacucugguauccacaaguacacagaaaugcacccaccuacacauauacacacacucauagauguaugcucacacacacacacacacacacacacaccucagaaaugcaaacugaaacacccacaggucgucuucuucaagaaggcuggucacacagaacucugagagggugaauggacacuuguguaaccagccugcuaacaguaggcagccagcugccuacucaaacaucccagggaccaaucugaagccacccaauguggcaggucccaggaaguguguugcguaugcuguauaugguugauagaguuggaaaaaccagggcaucugucaccaugguaacagacaagcucucacagacauuaaacagggagaccaggcaacagcaaggagccaggagccagauaugcacacgggcaacccagauaagaugguaacaccuggcuaagugauuggccagugcugggauaugccaccaccucccuggacacuguaaccagaauacuagaaucuaccuuuauucccacagaaaaugacagaaaaagaagacaccugaugucaucuuugggucuguaggucuguaugcacacacacacacacacacacacacucgugcauacgcaaaaacucaugcacacacacacaaacauacaugugcacguacacacacaaguaaauacauaaacaaaauaaacauaaaacccccugggguuuuuuuuuggguuuuuuuuggggggggugguuuuuugagacaggguuucucuguauagcccugccuguccuggaacucacucuguagaccaggcuggccucgaacucugaaauccaccugccucugccucccaagugcugggauuaaaggcgugcgccaccaccacugcccagcaaacccccuguucuugugugauuuuuccuugagacucuuucuauucaccccaaagugacaccugaccuaagaggagauucuggcccaucagauggggugcagcaaugauacuggggucacuuauagaagcacggaugacucaaaggcagcugugugaccccaccccaucccuagcaacugcuuacugcauggcuacuccagggcaccucuucauucccacaagacccagucuuucaagggucccagccacuaaucacagagacucugauuucaagguguccacauagcgucauugccugaagcguuccaggugccgaaccacucccaccugucuaccccacccccaugccucaaacuguauuggaauguacuggauucagagcccaugauggggccacaguagguuaaaaaaaaaaaaggaggcaauaaauuagucaggauggucccugaugcggugugaccggagucuacagcaagaagagcuaggagagagauacugaggauagcagcagggagacagggaaaggcaggcaguggcugcaagcuagacagcaggagcagccauggcagccaagggcaugcagccuccagaagagccagaaaggaagcggauguugcuuaagucacacagcugauggccuuucacgaugauggccugguaaagcaagucaccuaaggcagagaggugagccaauggcacuaggucacauagcugggagaaggcugagccaacaccuggaccccagcccaaggccucggaacguaagcucucacccacagugauguggauggaugggacugaagcagauggaagaacguacucaagaucgaagccagagagaggaugagccacagagggagacacugacaggaggagacagggaaggagagagagaggacaugacaagugagcauguguccacaccccacagcaccacgcuccccacacccacaagagccacuagcuaccugcugccaccggcuaaagacagauaaacacaaugugacaucuauaccauuaaaaaccgcacacacacacaaaacauuguccagucacagagaguuaggaggcacagguauacgcuauuacauagaugaacuugaaaaaaacgggccacagccaggaugcaaauguggucaggcuuggcggugcgcaucugugggccuugcaugccagagacugagacagaaagacugauaccagguuagucugagcuacagagcaggcuuggucuccaaacaaacaaacaaacaaagcaacgaaagcaaaaugccacagcaauaaagucagaguuuguagacacuaaaggaaguucaaaaccagaccaagucggauauauagggaugguucuacaaaaggcaaggagcacccaagggugguggcucccuccagcagggccucgggaccaugaggcuccaucuuuucaccuggggcugauuuaaccugacggauguguauuaugaccuuuguuagaacuuuguacuauuucacaauaauaagaaaggaagcgcaagaggcacagugagggcugggaacagacaggagaaggagaucccgaggccagcgcaggucaggaccccagcuacaauggagcacuggcuaagaugggcucucagcccaggggagccuccugggcuaagaggccagaugaggggaccagggccagggcuuagaauuucugcagggcucagaggucaggauggggguugggguggcgguagggagcagagcaggaugagcccccaggucccaccuuccugggccuccaacuccagaaggccagcucugacaugccaggacuccuacagcugcaagggugggugggagcccugagcuggccucagccuggucgucagagggaucaacaccucuccgaacauggagguggggcugggaaagccaggaaacucaagcagaagcuggugcaagaaacucuaagccccgcugcucgcacugccugcucagccaggauaacccuaggcaguuuaugugcagggucugugggaagagcacauagcaaccacaaccagggcgcccugccuagaagguggccaucagcuccugggaaacaaggcuugcagaacagguggcaagagaggccugguuguaccacugauaggaggaaggagauccacacaggacaaaccucuaaacuuaacagcuacaaccaaauauggacucugugggcaagccugccaccccaggcuaaagcaggaggacugaacauccaaggcuagccugggacacuuagugagacuaacuuuaauaauaauauuaggaaagaguugggcuuucaaaauggcucagcaaguaaaggugcuugcugucaacaugacagaaaagggaacugacaaacuagggauguccucuaaucgcuauacaaacaaacaaacaaacaaacaaaaauaagggccagagagaccgcuuagcaguuaaaagcauggagugcuauugcagagacccuaaguuccauuuccaguacccuauagucagguggcucacuagaacucuugcuccaggggaucuggcgccuucauguggccuccacaggcaccugcacucaugugcacauacccacacaaagacacauaauuuaaaaaaaaaaucuuuaaauaaguaaguguaaaaagguuuuuaaggagaaaggacuggggauauggcacaucaagcaggagaccccagguucaguuccuacccuggcagaaaauaaguaagacagauuugaauggaaaaaggacagagcuggaggcagaggccucacacacaggggccagccuguagcugcaggcugugggcaggaggauaagugaccuugacucuaacagaggucuacgcacauucucugcagggccaagagguuugggugagugccaaugugacccacugucccauugugucagcgauuuuuccaaaacaauaauuuuuaaaagaaaaaccuagacguggggagggagaacagccgguggcugaguuuacugggacauggcuagccagcaagguacuugggcaacugcagaaucagucuugagacauccccagccacucuuaaggcuggugggaaagcugggugugccaugagcaugcccugugacaucucagagcaggauguagaagagaagucaguugcaagcauugaugacagguccccgaggaugugugcaucagcauacugagcgauacucagcagcuuguuauucuagguguuuaacagguaugaucuccucagacacaggacacuauuaagaacacggugaaaaggcacagaggaauuaaggcacuugcccgagguuacccagcagggaauuggcagagccaucccccgcaaggcucaagcccagagacuuuccaauggguuuacaaccuuggcagugacccuccaggaacacacucaccucccaccucuccuccaggcagacggcaaacauguggguagccagagagcccagcucggcuuacaaagagacacuagcagaagcucagcuucaguccccauacugcuccagaaggacauggcguaccucagagucuuggguaagagccaacagcugcucugucuggggcgugagccgacuccugagcuauauugcagaacacguccagagcagauuaccuccucugcaucugagccugaugccgaguguagugaagggcgcggaggcuugggcugguucucgcuguuugcauccuacggcgcacucagagccucagagaaggcgcauagagcuugaacuuugguauaccggguccugacaucucuccuacuuuaucaaaacaccuccucccacuccuacagucagaugagagcaaagaagagguaggugggagggagcugggagacugcccgaagucaccagaaaacaacaugacuagcccucacuuaccgagaucucuuaucuuucccuagcccagcaccccacuuccccggccagccuggcaguuaaccuggcccacgaccagcuaacacuggcuaccaacuauggccuugaacagaucacagcucccucugagaucuggguccuuaaagagaaaaauaaaacacaggcgcuaagcugggcggugauggcacacacauuuaauuccagcacuugggaggcagaggcagacagaucucugugaguucgaggccagccuggucuacugauugaguucuaagacagucagggcuacacagagaaacccagucucaagaaacaaaauaaaaacaaaaacaaaagcaugagggcaggagagaugacuuagccaauaaagccccagcagccaagccugccugaguucaaccccaugcauaaugguagaagaagaaaacugacucuugcaaguuguccucugcccucuacacauguguaguacacauauggcaccccuacccuccacaauacacacaaauaaacaaacaugugauuuuaacaaacaaaaagaugggccaggcacuacggcacaugucuuuacucccaggauuugggaagcagaggcagaaggauugccaaaagugugaggccagccugggcuacagugugagccccugccucaaauaauaauaauaauaauaauaauaauaauaauaauaauaaauaggaaggagaagcagaagcagccguagcccguagcaaaaucugggcguggugaaauacucuaauccuagcacucaggagggagguagaggcagauggaucucuaugaguucgaggacagccuggucuacaaaguaaguuccaggccagccaggacuacauagagaaacccuguuucaaaaaaccaaaauaacaaugaggauaagaaugaaauaaaauaaaaagagagaaacccaaguaaguacuugaagacccaacaaccuaagauuuauaaaauuuacccuggcgcgcugccuccccaaucaaaaaagccuggagccagcgucaaaaaaagcacccauguacguacauaagaggcagcgagcggaaccuggggugauccggugcuaacuaggggccaaggguucuguccuuacucuggcuaccugucucccuugccuccugccaacccauagaacaucgcuccauccccuccugaguccucagagagagcgccucuuuccaaagaaagcuuucuugacacacacugauuggcucaaacaugagcaugugaccuaagccaaucagaggcaauggacagccccaagccccgcccccuucucccagcccuuaacgucauugcuuugcauuuguuauuguuuuuugcauuuguuauuugaguguaugugugaggagugugaaugugccugagguacacccacagcggucagaggacaacuugaaagagccuguucuuuucuuccacugugugggucccaggaucgaacgccaaucaacaggcuugguggcaagcauuacucacugaacccuuuagacagccucuuuagccagggcuggccuccaauucccucuguagucaggaugacuuaacaccugguucucuuguuuucgccucuggaaugccaggauuacagguguguaauggcacccaguuuauuuuuguucuucgcaccugugagccacaccucccagguccuucuauauagaucacuggcaggagaaagcagcuguccacugcaccccgcacugcaucccgcacugcaucccgcacugcaucccgcacuggggcagguuaucuggaacuccggggaggaagugacuucgcuuuauucauaaaccuaaacuuguccccugcggaggacuguacacggaccacgucaaaccaaggcugcugaagacucccguucacucccgaaggccgugcauugcaaaccugcaccccaccuccuggucucucccgcccuuggcuaagacaggugugauuuauuuauccaccgcccacagccaucccgaugacauggcugagaacugggucucuuccuucugguccacugccuuuguggugggacaggaagagguuacugggggaagccagcagcccuggcacagacaccagugaggaguugcuggagucaagagaaaacaugcagagacucagacccuggaucuagggucaccugccagagacucgggccaguggguguggucugggacauaugaacaccaacucacccagguggcuucaagaaauggcauccaggggacagaggcucauggucugaggcuuagguaguggcaucaggaggcagcccccuggagacagaggcacagcccuugcugggcagugguggcgcacgccuuuaaucccagcacucgggaggcagaggcaggcagauuucugaguucaaggccaaccuggucuacaaagugaguuccaggacagccagggcuacacagagaaacccugucucgaaaaaccaaaaaaaaaaaaaaaaaaaaaacaaaaacaaaaacaaaaacaaaaacaaaaaaacaaaaacaaaaaagcaaaacagaggcacagcccccccccccccaauggagcagaggcagucagcaaggcuugugaccucagcgauggcugcuagggucccaccccagccaggccaccacugcaggaguaaagcuauguacaaaacacaccagauccccauccugguaggacaucaaccaaaggaaugaguucacuagagaugggcgcaaggaaacuuccaaaggucaagggaggucagggaagcugggaccaggaagugucuucaaaaacauccccacacaggcuuuggguguacuggugugagaacacuugucuaguaugagugccucucugugucccucccaagcaccccaaaauacaaauacgugucauuuauuuugaaacacaggagaggaacugagugaaagagccaaggggaaaaguaucugggcagaaggaacuuccggcgcgugugagaauggaggaggagagagacuugugggcuuagaacagaaccgcugacuggccagacagguuggagccugugaagaaaggacugauggaucggggcaagagugagugagugugugcgugugucugucugucugucugucugucuuuguaugugugucugugugugugugugugugugugugugugucucuauaugucucuccuccgucucugugugugugugugugugucuaucuuucucuaugccucugugugcauguaugucucuaugugugugucucuguggguguauguguuuggcucuuugugugugucugucugucucucuggguguguguguuugucugucugucugccucugugggugugggucucucucucucccucucucucucuguguguguguguguguguguguguguguguauguauauauguagaggccagaggccaauccaaccucaggugugcucccuccagcacuaucuaucuuuuuuuuuaagaucgauucuuucuaaagccuggagcuccccaguugcguugcaggaaugaaucccgggagccccauggagucuccugucucugccuccccagggauggaauuaccagcuuguuugacgugggcucuggggaucaaauccacaucaucucaccuagcuggauccugaaacagcuuuaaacuaaagcacugugucuucgaaagagcacucugucugugacagggggaagugccggaucagccggaucacccauggcaggacaguagcaccacggcacccauggucuagccuggcacaggacuuccuagugccaggguaccagaacacccugugauucgacccuguccacuuuggguaaacauuugggaacccaaggcccagugucuggcaucaguuccaacgcuggggacaaagaacaaacaccacagagguccuugcccuccugagccuggggacuccccauggggacaacguggcagaaggaaaaaagcccaauguacauguaacuaguguggcauauugggucugaauugaccucagcggagucccacuuggaaaugucagacauuagacuauagaccuagcccacgcacgagaggaaucaagggguggggugugcaagccagaaagguaucagagggcaagguacuggccucuugacacaugggaaggaccuagggucuguuucuggcugcuguacugggagcugggaggaacacaagagacagaggaaaggaauuuaaggauccagauaagaaaaugacagaagucagccucgggaaacggacaaaaaggugggagacgcucacuuccccagggcucacgugugggaagcagagagggcgagggaaggccgcugccaaggucguggcuugcugccgccacaagcuagaagaccacaggccaagcuaaccaggaaggugaagggggacaggccuggaguugaaggggaaggucaggaaaaaguugagccaccuggcacaccagacuccuuugaggucaaggcccaggaggggacaguuuggggcugagcaggggguggggguggggggguugggggggaaguuaaggcccugagcugugaauugggccugggcauauuccaccagagucuggcugaggcaaagggggaaagagaaccccugccccacgagaaccauggagacaacccacagccagagaggccccagccaagacccuuuucuagaagcuuccagagaggguggaaggaacuucauugaaaagccaggaagcaagcaagggucaggucacuccuauuccuuccccucccuaggcagcugaagaucacaaagcagaggagaugggagcuggggagaggccagaaagcccgggaucugaggagagggguggaaaucuucccucggcagccauggaaccuccucagccacugggacucagagccaggcugagccagaccuggguuuuuuuguuguuguuguuucucuuuguagcucagccuggccugacccugcccuaggccaguggaggccaaggucaccagugagggagagagugaggagagaggagagagguaaaaggaucaaguguuuuuguuuucugguuuuucauuuuuauggaauuuuuuuuauuuauuuuggggggaggguagcccaggcuggccuagaacuagcaaucccccugcuuuagccuccuaaccuguuucuauuuugggcagagccccaccuacacccccacccaccccugccaggcuaaauccuccucaaacuaaauugauggcacaggaucuggcacugaagguauugaguuucaaacccugcacaaaugguuuagguggcuaguuaacauaucaaagcagaccuggcugccacguucucccagcaucccucagucccuaccaguuucagaaccccuucaggcuggcauacccugcccccuacccugaacucuauagcccagagggcugggcuacucuccccaggauaauccaaccauuuugauugcccucccuccuucuuggcaguugcaccuggcuccccucucuccucuccuuuucccucccccuccccucaucuagcucaggguucaaggucauguccacucuggacucuuccagcggucucugccucuagcuauguucucccguucucccuuuuaucuacaauaaaccuucuccuccacuauacccaagagcauccauguuuucuucucucucucucucucucucucucucucucucucucucucucucuccccccccccucucucauucagaaggccucucagcugaacucaugguccuuaagagugaaaugucaaacauccaguggcaaccuggggagaagcucacgguagcccagggccucucuuuugcuggccaaggaaggacauuugaauacuccucuguacccuaaaagccacagaaggccacagagcuggcagccugggccaagccuccuaggaaccaagaugcaccuaggauaagcucugcagagaaccaaguggcucucuccaggacuggccccagagucggcugcugggauccaaggccagagaacaggauuccugguagccgaacuccaggaauuggagcgaaugaggggaugagucacugugggaagauagcaaagaauccauccuuccaggaagggucccaggguaacuuccuuccaggaaugcaacaggagagucuggcuucaaaauaccagcaccuaacuacugcacacagugaccaugcagugcccgugaccccuucugucugcugcagugcuaaggucggagcccaguggcuugcaccucgaaggccaucauucugccaugcagccauguccacugcccacccccagcaaauggaacaggcaucaacauaugugcaugugucuacaugggcccagacaaugacccaugugccugcauccccuuccuggcuuuucuccauguggauagguuguagcucgugcgguacacagaaacacucacauccauggaugucagcacuggaccauacauacaccaagcucugucugugugcuacuauaccugggggacacuauuacguggacccgcaccaaaagguguguauaccaacagacacacacacugaagcuaugaggacuuguggauguacgaggagccagaaaggaacagaaauaaaugcuugggacuaaaaauagguagucuauagccacagcugcacccugaagggaacuaaaauaguuccacacaugccagggggaccggaagccaugggaaccggaaaccaggcaucaggaaagaggaagaaaacagaagaaaucccagcacacccaagcauucuuacccagggcccagagaacagggaacuugcagggacacccauccugacaucuggggccccagucuccacuuggggagcagcccacgauggcccaggcagaccuugaucccaaggucacagggugguacaaacugggaaaaggcagaccuucccacuuaagaguccuccugaggagguaccaaggggugcugaaucugcagccuucucuugugggagaaaacccuggaauacacccgcuagccaugcacaucgauggaagagaagggagaaaaagaaggaacggccagucaaggccagcuguucaaggguuacaaucuuuuagcagaggcuacaucuugguucugucaccuaaaucuggaaugcggagguagaggguugggguggggagacaugggacaccaggggacaaguuuuacuuaaucucucuuugugucccucucccuagaugaagcagagagcaacuguagucguuuagauacuuaauaaaaggcucugaggagcaucguaacacaguaucuaucuacaaggagcuaucugccaucagggacaccuuccaagugucaagccaaugggcucugccagaggucacaaaacaacucaggaacagaguagauaucccaggcuagcccaacuccuagcugugggagaagggaucagauuagaauugaggcaaggagggguagagagccagcuauuggccagcauccagucagcucccuagcccuucaccuggcugaccaacuucucaaucaggaaaaagagcgagccacauccaagccugugacagaauaaggauggugggcuggagggauggcuccgagguuuacaagcacuggcugcacccauagagaaucugaguucgguucccagcacccacaugacaggucacaguuccagggaauccugacaccucuuuugacccuccucaagcaccacacacgugaauacagacaaaacacugaaaauaauaaauaaaucauuuuuuuagggggauagggcguuuugagacaggguuucucuguguagcccuggcugucauaaaacccacucuauagaccaggcuggccuugaacucagagauccaccuaccucucugccuuccaagugcugggaauuaaaggcaugugccaccaaagggacacgccagggccucugaagagggacuaggucuaaugggcucaaaccaggagcauagugguguggggguggggugcugaauugagggugggaaagagaaacaaauugggagccuucaagcugcugagaggaauuugggguucacucagaaaaagacgggaauguuagagagucugagcagggugggcaccaucccucacuagaagagcaggauagacuaccacacggguccaagcaggcaguaaggccauggggguagaggggucauaaaagguaauggugaagcagguaugagguagcagaaagaacaacggagcaggugagggcagccugaggcuuccgcuuugcaccuaggggacacaugggacagaggagggaggcaucagcagaugaacagaucacgcacagugcaacaggaaaugccacgucaggacaguggagcugaugcagacccagacuugggaaagauuaugaggcucugugcugaaggcgguggcccuguggacgggcaagccgcgugccaggcuggguucuaggugagacacacagggguuccagggcugguggguuucccuccgugugacacuuacacacacuccaagaaagucacgggguacuucuuaccauuuucagcuguuuccuuaacugacaaggaccugugucaaccacgcugccugugccggcuagcuuugcgucaacuugacacagucuauugucauuugagaggagguaaccucaauuaagacaaauuccuccauaagacuggggggggggggggggggggcuggagagauggcucagugguuaggagcacugacuguucuuccagaggucgugaguucaauucccagcaaccacaugguggcucauaaccaucuguaaugagaucugacgcccucuucuggugugucugaagacagcuacgguguacucauauacauuaaauaaauaaguaaaucuuaaaaaaaaaaaaaaagacugggcaaugggcaagccuguagaacauuuucuuaauuagugauugauggggaagggcguggccuauugugggaggggucuccccagagcuggugguccucgguucuguaagaaagcaagcugagcaagucauaaagagaaaguucguagcagcaucccuccauggucucugcaccagcuccugccuccaggucccucccuuguucuaguuccugcccugacucccuuccaugaugaacagugaugaacaagaagcugaggcaggaggauuucaaauaaagccugaguaauacaacgaaaccuugcccuaaagaacuacaaacaagauaguaaccauugggcucagugagacggcucggcagccugacgaccugaguucaaucccuaggaccccacuuaggagcaggagagaaaucacuccucaaaguugucccaugaccugcauaggcauguugcagcaccaccccuccacucacacaccaacaaauacauacacauaauauuuuacaaaaagaaucaugaugguuuggagauugcucggugguuaagagccaggcuggccgcucugauacaggaccuggguucgugaaauuccuagcacccucaugguggcucacaaccaucuguaaguccaaguuccagaggaucugauguccugucuggucuacaagggcacugcaugcacagagguacaugcaggaaaaacaccccuacacauaaaauaaaacaaaaauguacagagagucgugcagccagcauuaucuaccuugugugucuggcacgcacccuuccgcaccuuuuucuaaaccauuuuggcacuaacacgagucuguugaaaauauagaauacuguuaggguuuugaugucauucuugucauuuuggguuugguugguugguugacuuguuuugucuugagacaggguuucucuguguaacccuggcugacacagagaucacucugucucugccucccgagugcugggauuaaagguaugagccgccgcugcgaccaccgacuggcugagggauuuugguguguguguguguguguguguguguguguguguguguguguguuucucuuuauguuuugcagugcuggggauugaacccagggaugugcacauacugggaagcagucuaucaaucagugagcucuaucuucaguuuuccacuuaccuauuuauuuauuuacuuacuuauuuauguguuauuuauuuguguguuuguuucuuuaugagacaggaucucucucuauagcccuggcuauccaggcacuugacuugacucagagaucugccugccucugccuucugagcgcugggauuuaaaaauaugcacuaaugcaccuugcuuacauuugauauaaagacaggggucucacuaagcuccccugagcuuccugugcaacccaggcaggcucugaacuuccuccggcuuugaauauucauuccuccugccucagacuccaaguagcugggaugccggguaagaggcuggggaagagggacuuuaauaguaacagagccuuuuuucuaucaugcaugucuuccugaaaccuggcccuucuuaauucuuuucuuggacugcccagcagcucacuguacagaaagagagggcucuugcuugcuuccuacuucccuauggaagguaaaccgagcauggccgcuugaagucccucccagcccaccacaggccauguuuaauaaccagcugccgaccuuugcuaugggccagaucccuuaucuguagagaggaagaauucgcagccucugccuguuucacaacgcugccgugguuagauugaguccagaagcaggcaagcucacagggcauuuccaaaggccgcuuguaaucuccuuugcaacuugcuaaucccucagggacagcaaaccagaucugaccccugucucacugcugggggaaaaacuuggcucucuugagugaugaaccggcuccagcuagcacaugguacaguaggccugagccccugagcucugaaaacugucaccuacacggggaucacguuccuccugcccaaccuuguggcgcugaagaugugaaaucaaaaccacagguagccaaagagggugaugggguuuagaaaugacacuucauugccaucgaaguggauggucccacagcuugacagcgggagcaauaguagagaauuccaaauuccaaacagagcgcaccuguggguccacagcuaaggcucagaccgugcaaguguuccuggacucacacaggacgcuauguguucucuggagucugagacaaagacauggccagucaacagaggaacuguaaacaaaggaaucccagcacaguaaggggggaaaaggcaguaacagacuuggcauguucggccugucaaaaccuuugaaaggggcugggaagaucgcccaguggguaaagugcucgcuggaggaucugaguucugauucucaaaacccaaacaaaagcucaacacagagccaggggugguggccuauaccuuuagucucagcacucaggaggcagggagagccuacagagggaguucuaggauggccagggacacgcagaaaaaaaaauagcugagcacgucugauacaugucuggaaccccaguaccaggacaggcggagacaggcagauuccagggaccuguuguucaguggcuagcagagaaggcacaccucauauuuaaugagagagccugucucaaaaaaauaagguggagagacacuguggaagacacugcacuucaaccucuggucucaccgcguggcaagcacguccauacaggugcaugaguauacgugcauguauguguguguacacgugugcguguauacacacauacacacacaggcauacacacaccccuuugaauacuaacacugaacagaaaaaccauacuauuuaagccaggcaugguagacagaccuuuaauccuaacacucaagaggcaaagguagguggaucucugaguuugaggccagccuggacuaugcacugaguuccugggcuaucuagugagaccacgaaucaagagaaaggagaaaaaagaagaagaaaggaaggaaagaaaggaggaagaaaagaagaaaaccacauacuauccaacucggguuuuguaaaagauguccacgcuaggcaaacaugaggaccugaguucaaacucccagugacauauacaauauugugcaucgauaggauugcaccuguaaccccagagacagggggauggcugucuagcucaucaagagacccuaucuguaagggaagaaaucaggugaccuacacacacacacacacacacacacacaauuuaugucaaaaaaugauaucaucagaagaaaauaagagugaaaucucucucucucucucucucucucucucucucucucucucucuguguguguguguguguuggaacccaaggccguugaaugcaagguguguguguguguguuggaacccaaggccuguugaaugcaagguaaguucucuaccacugagcuacaccccaaguccugaacuuguuuucuuaaacaaccuaguauuccugacuuuuauaaaucaacuucuuuaacuuacaaaaaaaaaaaaaaaaggaaagaaagaaacacacacacacacacacacacacacacacacacaaagacaaggcuuccauucaaguagcacagaacgcaagaauccaaagucaacuccagggucccucccugcuccccucgcugccauccucccaccauccccugaagugaacuuuuuuuuccucccucaagaggucggcuuccagccagggccucuaagaagaggcuguuuugggcuaggcgugucuuaggcucuuccuuccuucacgccacucagcccccaaccaaucgccuuugggauuuucacaaguaagauuguggaagccgcucgcucaaacgugaagccccaagcuaccagcuauggggcaauucugccagucguggucuuucucaagcacgggcagaugggacccugacugauggagcaggccugcgcagucccaacgcuaacgugcacgcccacacacaccaaccccccccauccuuagucucugugccaacccccaaaagaaaacauucccgaaaggaguuugagaaggaaccagcucagauucccccucacccccaaaucgaagaacaggggauaucugcucacucuacccacuacaggcuggcugagcaggaaacccaguccacgugcggagugcacagggcuggguucuuacugaaaccacaggcugccacugagacaaggcugucaccacuacuuugccaaaccuaacagaaaggcccagagcaauucugaugcuccaacaagaaggaucuucccucuacccaagacagggcaacuccugggaccuucauguacaaggguugaaaauucuaagcaagagaaaugacaguguggccaagagaacucggaaauacccaccacaacuccaggaaagccaccuguggcuccauccugaagacccgccaggaccuggcagguagcggccagcccaagagggaguaucccucauucauucccuccuuucagcgggcgaugggacaugggacacgaagccauucuuaaacucccaguaaacaaacccgcuaagaggaaagaugucagucaaacccugugacaacagccccuucuggaucccagauccaguucuaacuggauguucccugagagccagcccccguuuccccuuccgcaguaacccugcgucucagaaaacacaauuacucgguaaucuccaggacuuaaugagcucccggcucaaauagaaggacaccggaucccagggcagagucuguggcuggaccggcaccacccgccuaauaucggugcccgguugaaagggcaaaacagggccuaaggcugagaucaagggagaggcugggcugccuauccucggcagaccugagucgugucuaccucugccagagcguggggggcagaaagcagcuuaacucucgagacuggcaggcagugugggggcgagccagggcaucucuggggcaucugggcgggaggaaacaggcagagcacccaaagaacuggagcccgugggagccucacagauguacagggguuucgcgcagcucugagguuacuagguacagucaccggccggcgcguucagaagggcuggaggucgcgacagcuacagucgaaacucagggacaaccaggccauacuucugcuucagugagguuuaggcuccugggacgcuggugacucagaccaagccucuggggugagccugggccucccugguggugaggagguagcuccaccgucccacccugcgucccgauccccaacccccaucuccccaagacacuucacucaccuugagcaccugcugcuugaugagggagggcaccaugaggaucaugacaacgccgagcgcagcaaacagcagccccagggcgcccaaccccaaggccacccagcgcgcccuggagcugccgcccauguccgcgugcgcggaaggggcucucggggcucaggaccugaaggagacggagacagaggugacggaggccacagagaugacagaagccgagacucccucagcagcaaggugugugccuggcgguggccggagcagcaguagcccugcagguggccagaggcuuuaugcgccauggcccgggcagcccgcccccgaguucggcgcgggauuccggcgagg

SEQ ID NO: 2684 - RNA, 7370 nt, Mus musculus
augaagauuuuuuggaaugcaagaacuuuauucaaagugcaaugaaacuuguuaacagcuuaaaagauagggaaaacuaagacaccucccccaucacacccaagaacaagcacaaggagggcucuuuuuagauacuguggugaggaagguacgucugucuuccuguuugaccuucuuggugguaacacugggcucgacguccagggugauggucuugccugucagggucuucacaaagaucugcaugccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaugccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaucccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaugccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaucccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucaauggugucacugggcucgaccuccagggugaugguuuugccugucagggucuucacaaagaucugcaucccaccucugaggcgaaggacuaagugcaggguggacucuuucuggauguuguagucugacagggugcggccaucuuccagcugcuugccugcaaagaucagccucugcuggucaggggggaugcccuccuuguccuggaucuuugccuugacauucucaauggugucacugggcucgaccuccagggugauggucuugccugucagggucuucacaaagaucugcaugccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaucccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaugccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucaauggugucacugggcucgaccuccagggugauggucuuaccaguuaagguuuucacaaagaucugcaucgucugucacaaaauauacaaaacaauucacaggucaggaaugacacaaauauuugugggauggcaucaacauuugucaacuggaugcuauaagucuaaauagcaaggucuaucuacacagauucugucuugaauccaauccccccaccccgaaaaaccaucaagaaaauaagauuguugacuaacaaaguuaagaaaccucggcauggugagucuuuuuguauuaccaaauuuacaggauggagacuucaguauaccaacagcugaaagucaauuucugucuauuugaacaguuugcagaaaagccugaccucugggagguuaugaaaccacagcagucccggauucaguuucagaaugguaauauagcaaguuacuacugcaaaacuaagucugagcccaugccuaucgcugaccucagcacuggggacacugaggugggcagaucucuaacuggaaggucagccagagacaguguaauccugccucaacucuccuucccccaaaagaacaccaaacuuuugucugaacgauuaaaauuagucuggaguggugguacuggccuuggaccucaucacauggggugguagaggcagagauuuugacaguuuaaaaaaaaacacccuugucgcaggacaaugguggugccuuucgucccaacacuugggaggcagaggcaggaggauuucuggguucgaggccagccugaucuacagagugagaugcgggacagccaggacuacauagagaaaccgucucgaaccccccccccaaaaguuucaguagucauaguuguacagcgacauucuuaaaacgaaacaggacaagaauggcucacauuuccccucugaauuuccgguuccuguuuacucuggagaggcuaccggaggccgagacccaaacccuguccuacaaccgagggaaagcuaaagucaagauagugacgucacuauccauuaggaggccacgcaacccgcgacgucacagggggcggcaggccaggcaggcugaaccgccgcccaacccccuuccggucucgaucgcacuuccgucuuucagcaaacgaacggacgaacgccgggccaaucgaccucucgggccagcccaauauccacggcucucacagcagaggcuccuacggcgcgcaacccuaauucaguccccaccccacagucuccgacguccccggcuuaaccggagggcagcggccucgcgggccuuuuuccucccccaaccucguccugcgcgucagagccccgcgucuucccccucaggcuuccaucuggccgccaucuugccgcccaguccucugccucggggcagccgcgguccgcgcgggccacggaaaccaaacgucugggccgcggggcugccucucgccccgucucgccuccagccucccguccccgaccgggugcggcggcuuucuccucaccagcggugguggcggcaguccucacacagcagacggaacucgcagucuccacggaacuagcugcggcacgcccggcgucucuuuauauagucaccgaagccccgcccccccccuuccgcgcggucccuccgcgggcaaugcggucagggacuacuuuguaacgccggguccagucucggcagcgaaagcgacaggcuaaaacuaucaagguaccucucucacggaguuguuucacgguggcguccagagauugaggggcuuugugugggagggcagggcugugaccucgggcgacuccgcggagggaucagcgcgcgugagacgaucggcacgaaaacacggcugggaucacugaggccggagcgggccuuggcgcaggcgcccugcggcuucgcggccuggcgccccuagucaggccaccaccccccacccccccuguuuucuuuccgcgcuagggggacccagggcuuuggcuccugucacacugggaucccauuggugaccucgccuccucaauccccucauccccggcgggucacuaugcccagcccucacuguuuuggcacagugacaggguggaugacugugcaaaucuccuaacaaggaaaaugacaaaggguuuuuaauaaauuuaaaaaaaaaaaauacgaaggagggaaucucuccccgauuuggaaaaacgaaucugaguuugucaaggaaagcagacagucuacacaguucuugaaaacuguuggcauuagaucugaagcccagcagaaccugaucuuuccagauuuuuccuaaaccuuguguccuuggauucgagaagguucuauguuuucuaugugcuugucacuaaguaaaggucaaaauuuccaaauguuguucauauuuguuguucauauucugagacugaacccacugaagcccugauuuuuaaauuuuuguuguucagauggggguuucucuguguagcccugccuguccuggaauaugcuauguagaccaggcuggucucaaguuuauauagguccuccugccucugccucccaaguauggucuacagaucaaguuccagaauggccagggcuacacuugacuugaaaaaccaaaaaccaaacaaaaaacccccacaaaaacaaaaaagcacaaaugugcacguguaguacaauguucagauuacagcaagcauauaucccacuuauacgaaucaaauuauucaggguuuuuuuuguuuuguuuuguuuuguuuuuuuuuuuuugguuuuuugagacaggguuucucuguguagcccugacuguccuggaacucacuuuguagaccaggcuggccccgaacucagaaauccaccugccucugccuccaaagugcugggauuaaaggccugcgccaccacugcccagcucagguuuuugaaauguaaggccuaagaccuuagaagguaagaauugaaucccugauggggagagauggcuccccaguaggaacaggucuuuuuccagaguacaugaauucaauacccagcaacccugucaggcagcuagcuugugacuccagcuucaggaggguccaaugucccuagggacacuuucacauacauguggcacacacuuagauggacacacacuauuaaaugccuuuaaucucagcauuuuuugaguuuuuuugagacaggguuccuauauguagcccuggcugcccugggacucaugacauagaucaggcuggguucuaacuugcaguugauacuccugccucuaccacccagacgcugagaauucaggccugucuggcucccugguuuaggaauucauaaacauucaagaucagagguauuguucaaaauauacuuuaacugcagguguuguucagaauagacuuaauuuucugugauuuuuuuccaugaaucgaggucauaugccacuauaaaauuaaaaugucauucuccggguuucugggaagccacagugauuucugaggcagaguucugggcaggucaguucuuucuagaauucagacagaaguuugaggaagggaagaaaacacugaaguugguucuaaagugauucuggcuuccggccacaccaugcuauauuuggcugucgcuuugcuucagccucgugauuccugguucuuggcugagucaccagcuuuguggcaucagguuuuuuuccagagucuagaagauucagagccaggcagccuugauuuuagaaguagggguggggguaggggcgaggaagaagcaaagcuugagcccuggaccuggccaaggugagcuugaaaggaagagauccucaaggcucugggguaaggaagaaaguaccuaguguagaagaacuacaugaccuaauguccaacaaccaugaugaaaaugcauaucauacugaaaccuauugcuacauguaaguaaugaaugcuacuuucugucaagagaagaaaguauuuuuggcucaaaggauaaauucucugaaaaucgacacauggauuuuguuuguuuguuuguuuguuuauuuuaguuuuaguuuugagacaggguuuccucuguguagcccuggcuguucuggaacugaggaggcuggccaugaacucacagagcuccuccugccucugccucuugaaagcuggggggaggagggggcgugguaccccaccaccccuaguaaaauauauagguuaaaauaaucuuugagaauuucauacauacaaugcuuuuuuguuuuguuuuuugagacaggguuucucuguguagcucuggcuguccuggagcucacucuguagaccaggcuggccucgaacucagaaauccgccugccucugccucccaagugcugggauuaaaggccugcgccaccacugcugggguguuuuuuuguuuuuuuuaauucuuuuuuuuuuaauauuuuuuuauucauuugaauccuaauaucagcuccuuguuuuguuuuuaauaacccauccacaguauguucuuacaacagaggugaccuacuucuuaaagggcacaggcagccaggaugggagcaaauggcuucccccucagagcuggcugcugcucccgggcacagccacuucuuagccaggagccacccaguaaguuuguuacaucccuugaggguuaaggaggagaauaauacuagucacagaugccagagacacucauagacaagucacagugacaggcacugccacccauauggaacucuguguccucagauuuccccuacagagaaccugggagcagauuaauggcagcugcuggucuaguuucugaaaaggacuccaaugucccauguccuacuuggccucaaggacuuagguaucaagucacagcccuaaagucccaaaccuccugaccuagugcgaggggaaaugcuagaaugugcuagaagccccgugacucacuggauuccuucugcaguucguuccacacccagauccguccuuugcaggugaccagggacuaccgcuuccgagccggcaccaauggggaccgagaaagggccccagcaacagagagggauuggcugaggccgccuacgcgagaugggcuguucugggcuuaggcccccagcugcgugauggguggggggagggggggggagauggguggcugccgccugcaugucccugcagcugggucaucccggucug

SEQ ID NO: 2685 - RNA, 7370 nt, Mus musculus
cagaccgggaugacccagcugcagggacaugcaggcggcagccacccaucucccccccccuccccccacccaucacgcagcugggggccuaagcccagaacagcccaucucgcguaggcggccucagccaaucccucucuguugcuggggcccuuucucgguccccauuggugccggcucggaagcgguagucccuggucaccugcaaaggacggaucuggguguggaacgaacugcagaaggaauccagugagucacggggcuucuagcacauucuagcauuuccccucgcacuaggucaggagguuugggacuuuagggcugugacuugauaccuaaguccuugaggccaaguaggacaugggacauuggaguccuuuucagaaacuagaccagcagcugccauuaaucugcucccagguucucuguaggggaaaucugaggacacagaguuccauauggguggcagugccugucacugugacuugucuaugagugucucuggcaucugugacuaguauuauucuccuccuuaacccucaagggauguaacaaacuuacuggguggcuccuggcuaagaaguggcugugcccgggagcagcagccagcucugagggggaagccauuugcucccauccuggcugccugugcccuuuaagaaguaggucaccucuguuguaagaacauacuguggauggguuauuaaaaacaaaacaaggagcugauauuaggauucaaaugaauaaaaaaauauuaaaaaaaaaagaauuaaaaaaaacaaaaaaacaccccagcagugguggcgcaggccuuuaaucccagcacuugggaggcagaggcaggcggauuucugaguucgaggccagccuggucuacagagugagcuccaggacagccagagcuacacagagaaacccugucucaaaaaacaaaacaaaaaagcauuguauguaugaaauucucaaagauuauuuuaaccuauauauuuuacuagggguggugggguaccacgcccccuccuccccccagcuuucaagaggcagaggcaggaggagcucugugaguucauggccagccuccucaguuccagaacagccagggcuacacagaggaaacccugucucaaaacuaaaacuaaaauaaacaaacaaacaaacaaacaaaauccaugugucgauuuucagagaauuuauccuuugagccaaaaauacuuucuucucuugacagaaaguagcauucauuacuuacauguagcaauagguuucaguaugauaugcauuuucaucaugguuguuggacauuaggucauguaguucuucuacacuagguacuuucuuccuuaccccagagccuugaggaucucuuccuuucaagcucaccuuggccagguccagggcucaagcuuugcuucuuccucgccccuacccccaccccuacuucuaaaaucaaggcugccuggcucugaaucuucuagacucuggaaaaaaaccugaugccacaaagcuggugacucagccaagaaccaggaaucacgaggcugaagcaaagcgacagccaaauauagcaugguguggccggaagccagaaucacuuuagaaccaacuucaguguuuucuucccuuccucaaacuucugucugaauucuagaaagaacugaccugcccagaacucugccucagaaaucacuguggcuucccagaaacccggagaaugacauuuuaauuuuauaguggcauaugaccucgauucauggaaaaaaaucacagaaaauuaagucuauucugaacaacaccugcaguuaaaguauauuuugaacaauaccucugaucuugaauguuuaugaauuccuaaaccagggagccagacaggccugaauucucagcgucugggugguagaggcaggaguaucaacugcaaguuagaacccagccugaucuaugucaugagucccagggcagccagggcuacauauaggaacccugucucaaaaaaacucaaaaaaugcugagauuaaaggcauuuaauaguguguguccaucuaagugugugccacauguaugugaaagugucccuagggacauuggacccuccugaagcuggagucacaagcuagcugccugacaggguugcuggguauugaauucauguacucuggaaaaagaccuguuccuacuggggagccaucucuccccaucagggauucaauucuuaccuucuaaggucuuaggccuuacauuucaaaaaccugagcugggcagugguggcgcaggccuuuaaucccagcacuuuggaggcagaggcagguggauuucugaguucggggccagccuggucuacaaagugaguuccaggacagucagggcuacacagagaaacccugucucaaaaaaccaaaaaaaaaaaaacaaaacaaaacaaaacaaaaaaaacccugaauaauuugauucguauaagugggauauaugcuugcuguaaucugaacauuguacuacacgugcacauuugugcuuuuuuguuuuuguggggguuuuuuguuugguuuuugguuuuucaagucaaguguagcccuggccauucuggaacuugaucuguagaccauacuugggaggcagaggcaggaggaccuauauaaacuugagaccagccuggucuacauagcauauuccaggacaggcagggcuacacagagaaacccccaucugaacaacaaaaauuuaaaaaucagggcuucaguggguucagucucagaauaugaacaacaaauaugaacaacauuuggaaauuuugaccuuuacuuagugacaagcacauagaaaacauagaaccuucucgaauccaaggacacaagguuuaggaaaaaucuggaaagaucagguucugcugggcuucagaucuaaugccaacaguuuucaagaacuguguagacugucugcuuuccuugacaaacucagauucguuuuuccaaaucggggagagauucccuccuucguauuuuuuuuuuuuaaauuuauuaaaaacccuuugucauuuuccuuguuaggagauuugcacagucauccacccugucacugugccaaaacagugagggcugggcauagugacccgccggggaugaggggauugaggaggcgaggucaccaaugggaucccagugugacaggagccaaagcccugggucccccuagcgcggaaagaaaacaggggggguggggggugguggccugacuaggggcgccaggccgcgaagccgcagggcgccugcgccaaggcccgcuccggccucagugaucccagccguguuuucgugccgaucgucucacgcgcgcugaucccuccgcggagucgcccgaggucacagcccugcccucccacacaaagccccucaaucucuggacgccaccgugaaacaacuccgugagagagguaccuugauaguuuuagccugucgcuuucgcugccgagacuggacccggcguuacaaaguagucccugaccgcauugcccgcggagggaccgcgcggaagggggggggcggggcuucggugacuauauaaagagacgccgggcgugccgcagcuaguuccguggagacugcgaguuccgucugcugugugaggacugccgccaccaccgcuggugaggagaaagccgccgcacccggucggggacgggaggcuggaggcgagacggggcgagaggcagccccgcggcccagacguuugguuuccguggcccgcgcggaccgcggcugccccgaggcagaggacugggcggcaagauggcggccagauggaagccugagggggaagacgcggggcucugacgcgcaggacgagguugggggaggaaaaaggcccgcgaggccgcugcccuccgguuaagccggggacgucggagacugugggguggggacugaauuaggguugcgcgccguaggagccucugcugugagagccguggauauugggcuggcccgagaggucgauuggcccggcguucguccguucguuugcugaaagacggaagugcgaucgagaccggaaggggguugggcggcgguucagccugccuggccugccgcccccugugacgucgcggguugcguggccuccuaauggauagugacgucacuaucuugacuuuagcuuucccucgguuguaggacaggguuugggucucggccuccgguagccucuccagaguaaacaggaaccggaaauucagaggggaaaugugagccauucuuguccuguuucguuuuaagaaugucgcuguacaacuaugacuacugaaacuuuugggggggggguucgagacgguuucucuauguaguccuggcugucccgcaucucacucuguagaucaggcuggccucgaacccagaaauccuccugccucugccucccaaguguugggacgaaaggcaccaccauuguccugcgacaaggguguuuuuuuuuaaacugucaaaaucucugccucuaccaccccaugugaugagguccaaggccaguaccaccacuccagacuaauuuuaaucguucagacaaaaguuugguguucuuuugggggaaggagaguugaggcaggauuacacugucucuggcugaccuuccaguuagagaucugcccaccucaguguccccagugcugaggucagcgauaggcaugggcucagacuuaguuuugcaguaguaacuugcuauauuaccauucugaaacugaauccgggacugcugugguuucauaaccucccagaggucaggcuuuucugcaaacuguucaaauagacagaaauugacuuucagcuguugguauacugaagucuccauccuguaaauuugguaauacaaaaagacucaccaugccgagguuucuuaacuuuguuagucaacaaucuuauuuucuugaugguuuuucgggguggggggauuggauucaagacagaaucuguguagauagaccuugcuauuuagacuuauagcauccaguugacaaauguugaugccaucccacaaauauuugugucauuccugaccugugaauuguuuuguauauuuugugacagacgaugcagaucuuugugaaaaccuuaacugguaagaccaucacccuggaggucgagcccagugacaccauugagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagagguggcaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagaggugggaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagagguggcaugcagaucuuugugaagacccugacaggcaagaccaucacccuggaggucgagcccagugacaccauugagaaugucaaggcaaagauccaggacaaggagggcauccccccugaccagcagaggcugaucuuugcaggcaagcagcuggaagauggccgcacccugucagacuacaacauccagaaagaguccacccugcacuuaguccuucgccucagaggugggaugcagaucuuugugaagacccugacaggcaaaaccaucacccuggaggucgagcccagugacaccauugagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagaggugggaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagagguggcaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagaggugggaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagagguggcaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagagguggcaugcagaucuuugugaagacccugacaggcaagaccaucacccuggacgucgagcccaguguuaccaccaagaaggucaaacaggaagacagacguaccuuccucaccacaguaucuaaaaagagcccuccuugugcuuguucuugggugugaugggggaggugucuuaguuuucccuaucuuuuaagcuguuaacaaguuucauugcacuuugaauaaaguucuugcauuccaaaaaaucuucau

SEQ ID NO: 2686 - RNA, 971 nt, Mus musculus
uuuggaaugcaagaacuuuauucaaagugcaaugaaacuuguuaacagcuuaaaagauagggaaaacuaagacaccucccccaucacacccaagaacaagcacaaggagggcucuuuuuagauacuguggugaggaagguacgucugucuuccuguuugaccuucuuggugguaacacugggcucgacguccagggugauggucuugccugucagggucuucacaaagaucugcaugccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaugccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaucccaccucugaggcgaaggaccaggugcaggguggacucuuucuggauguuguagucugacagggugcggccaucuuccagcugcuugccugcaaagaucagccucugcuggucaggggggaugcccuccuuguccuggaucuuugccuugacauucucuauggugucacugggcucgaccuccagggugauggucuugccugucagggucuucacaaagaucugcaugccaccucugaggcgaaggaccaggugcaggguggacucuuucuggauguu

SEQ ID NO: 2687 - RNA, 971 nt, Mus musculus
aacauccagaaagaguccacccugcaccugguccuucgccucagagguggcaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagaggugggaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagagguggcaugcagaucuuugugaagacccugacaggcaagaccaucacccuggaggucgagcccagugacaccauagagaaugucaaggcaaagauccaggacaaggagggcauccccccugaccagcagaggcugaucuuugcaggcaagcagcuggaagauggccgcacccugucagacuacaacauccagaaagaguccacccugcaccugguccuucgccucagagguggcaugcagaucuuugugaagacccugacaggcaagaccaucacccuggacgucgagcccaguguuaccaccaagaaggucaaacaggaagacagacguaccuuccucaccacaguaucuaaaaagagcccuccuugugcuuguucuugggugugaugggggaggugucuuaguuuucccuaucuuuuaagcuguuaacaaguuucauugcacuuugaauaaaguucuugcauuccaaa

SEQ ID NO: 2688 - RNA, 20331 nt, Mus musculus
gcaugcgcaacccggaagucuccuagccagguucgguuucccugggagcugggcugagggagccacgcgcguggcgcgagggagccauggggaagcugcgacgccgcuacaacgugaaggggcggcugcaggccgauccccggcccgccaagggcccugaagcgccucccguacggcuggaacuggagggugagaagccggggaccgggagggucgcuggagugggagccggguuccacaugacccgcacagggggcgugacagccgcucuaccgcgauauggggguacugcccgcaguauggcgcgcagauuaguucuuugcauccacucccaggccugucggaaucaucuccuucccagagacccguaaauguguguuucagaccaggccgguuagcggagcgccaggcugaguguucgggugcuggggugucugugaucaccggggacacuguuuuggucucugggaauagugacagcagaaucggagauggaaaacccugucaacuccaggcaugccugcauacccggagccgacaagcacagagaaacgauaaaauguguaguaaauggcagucacucggguaggugcuagagggauagagcagaagaugggagagagcgguguacuggggaaaguaacauggauaguaaaaugucaaaaccuucuggagaccuggguggggaaacccaaggacuaggggacaucggaguuugcgaguuguauagaugauugggacaauaugguaguucauuccuguaaccccagcuuaggaguuuggggugggaggaucccuacaggugugaggucagccuggguuacauagugagaccuugucuuaacagacaaacaaacaaacaaacaaaaaaggcuguguauaugagagagacagauaacacuuguaaaccuagcucuagggagugauacucaucugagggcaccuggaccauguagcauguaccaggccagcuuggugcuggcuacaaagcaggacauugccucgauccccaacuucuaaaagaggaagugaagagcuauggaagacuuagcagaagagggacagggugaaagguaacgugucaccauggcauauugguugugccauuaagaaaagcauuacagguugaaggaugauggggagggagguugggguugaugcuggaacgaguguuuggauucugauguauuccgaaggagagcuggcuggagcugcugacugcugcuuugcgccuaagcacaaaggugaugagcacgggcauuggucagguugugggagaaggcaaaugugggguaugaguacuugaggcucugcagacguucaaaggaaaacugaaagcuauugacucagcucucaagacaggcaaguucaggggaaacacuuuuguagauagauggcacuuagguaagucugaugaauagaguuuuggcucccugagaagagagaguccagcccugaaggagaggggaguagaggagagcagggaggagggugcugacccagaacuugugaaaaggacucaccuuuuugguuggaauagcagaaggcauggucaggaucaggcauggacaggaucaggaugguucaggaggggggaagagcuaaagcgauccaguagaauaaaguauguugggcuggugagauggcucaguguguaagagcaccagacugcucuuccgaaggucaggaguucaaaucccagcaaccacaugguggcucacaaccaucuguaacaagaucugacucccucuucuggagugucugaagacagcuacaguguacuuacauauaauaaauaaauaagucuuuaaaaaaaaaaaaagaauaaaguaugucuuccuggcuccuaagacuuggguucggggcaugucacuucacuuaccucuaccucgguuuucauaucuauaaaaugggacuuacuuuuccucaguggaaucauaacaccuucuggcacagcccacagcucaguagccuaguucugagcacuccaucccaggcuggccuguguagucaggggugacugaacuucugguccucucccucaaaugauuccuuccccaacugccauacuugguuuuauguggugcugggguuggaacccagggcucucagcaugguagccagguucccucccaccugagcuacauccccagccccacccccagccccucaagaaugugauagcuugguaaugcuaacaguugcagcacacagacccuugugcagcacucagagauugguaggugaccuuggccaccugcaggagguggugaccucauuugauauuugucaugaguaagcauggaggacgcccugugacuuuuugcccccuagugagacucuguucgucuuuucaggcaaggauguguugaaaggaguugaugaaagcaauguucuggugcugccugggaagagaaagaagaagaccaaggcgccgcccccauccaagaaagagaggaagccccugacaaagaaggagaggaaggugcuacagaaggucuuagaacagaaggagaagaagagccagguacaccucacuguggcuggucugcaccagcucuccagaucagggggcuggaggggaguuugucccuccuuguuaucucugcagcaagauugucuacuagaacuuccugaaaggagggaaguguuuugugucuauccagagacacaguagccacuagcuacagguggcaucauugggagccucugggugugcuggccugauuucaaaauuagguacauaaagagauguguacguaaagcauaaagguaugcgucaaaaucaacgaaaccaaaacugccguggaucucaagggaugaaagaaaucacauggccauguggguagccuagggacuggccaaaaugagaagucacaucuguccucaggacagcaguggauaucaugcuuuauucagucugguugcugugcauugggacagccagugguuauagcacacgaugcuacagagcuguggcucaugaugcuggguucuguuaauggcaaagaaagagcuaaccuaugugcucagaacaccucauagcuguugggugacaucuugcccuauaauuuaaagucaguauuaacuaggcuaagaucccccaaaagccuggccuccccaggagaaggccugggaccuggucaguggucaguagcugccugguagccagugcucucauaccuuucccagcgugccgaacugcugcagaaacugagugaaguccaaguaucggaggccgagaugagucucuucuacaccacagccaagcucggcacuggggaccgcauguaucauaucaaagagugagucacggagccugagagggcuuauaucucauguuuucuugcaaggggaggggcgggaagugggggguuauccauccugaaugcaccucuaguagugcaccugacuggcagcugauaugucacaaguaggucaguuccucaucagccaugaccuugauuuugcaccacaaaggccccacucgccaugaaaccaccucuugauguucugugugacaucaggacuucaguggcuucacauugaaaacccacuucccccuacuggaacugugaggccaccccaggguggcauuccugcaaggcaucacaccccagaccagccacaagcacucgcacacacaugcacaugcagacacacacacacauacacacacacauagcuucccuguucagggcacugauguugagugagugugcccugccccagccucacuggaccugagguagaacaaggagcaaaauguuuauuucccuuuggaaggcacugguguuuguuagccaaauauuuauguaucugcacccagaaaaugaacccaaagguaaggcagagacaaggggccaucuaggaaagggacugaacccagugacacacagucucccggguaggugacuuugagcagacacuugagugugaugaucugcaagaagugugucucagaguaggaacagccagugcaaagguccugagguagacgugguaugggcucuagcgagaggcccccauaccuauaucagauguccuaaagucccugcuucaagucucugcucucccaggaggaagucuggccagccugcugcccggggccaggagaaggucaguagccucagcggggcccaccggaagcgccacaggucaucaucaacagaggaagacucugagucuucagaagauucagagccugaggaagccacagcugaccaaccuaggaccagcacagggacagagccagugcauccgccaccagcuccuucugggaucaacagcccugcacccaccccgcagcccccuccaucugggaucucugcaccuccaaaaacaccagccucugccccgccuccacccguggccaagccugcuguauucauccccgugaaccgcaccccugaaaugcagguucguucuucucuucgggugguuaaagagacagguuagugggaccucuugauggaaagaagccacaguguccacuucuaggaguggggacaugguuguauauguauggguguucugcaugccuguauauaugcacaccacacgcaucccugcagaggucagaugaaggcauuggguccauuggacuuggacuuuaggugauuguaagcugccauguggcugcuggaaauuaaacccagguccucugcaagagcagccagugcucuuaacugccaggcucucucuguggcuccuggcuaugcacugcagacugugugcaugccucugugggcggggcaccuccucaccugcucucugcagccugucucuccaguaccaacuucuucuuccacaggaggagcggcucaagcucccgauccucgccgaggagcaagccaucauggaggcgguggcugagcaccccauugucauuguguguggcgagacuggcagugggaagacuacacaggugccccaguuucucuacgaagcaggcuacagcagguggggcugggccgggggugucccucuacucccuggggacaguggccacuuagguuccaagagccauuaagggccugagcuccagcagaccuaguccuggcucugcuuugugugcugugugacuucagacacauuuccagccucucuuggcguauuguaacucauggggaugacacuaagcucaguggucccauggguucagugacaaaagcgucaagugccaggcacauggaguaacgugcuuccuagcauggccaugucacacugcacucauugugaccuucuguaucccaacccccaccucguuccccgugaagugaauucaguuggcagaagaguugccgaggcgaugcagaacucuaguguccucuucaccuggggccccugcucugucagcauuucuaggugguacuugucccuguugucugagcucaggcuuucccuggacuuaaccagucuauucaggaaugauaugcagcucagaaaccccccucuccccccuaggagaauuuuccucauucugauagcaucucuuggagaugggucccagcuguguacugaguucugcuaggucaccaucagugcugugcagugugggcugcccccuggcugacuuguggcuaugcuguacugacaccaggcaggcgauguuuguacccuguuuucugggucucgccuucagugacuagugacguugaaguguauguugauggcuccgggacagacagucauggguaaugugucuucuuccccagugaggacagcaucaucggugucacagaaccccgccgaguggccgcaguagccaugucccagcggguggccaaggagaugaaccugucacaucggugaggcccugauuccuggggauauaggggacuuugcaggcuugcugggaggagggugcaggugggagucguuuugccucacucccagggaugguccagcagagaccucucaaccugcugaggcagggguuuccgggcagggaaggagccauccaggcaggcacccagugcuugcugauggauacugccuguguaggagcgaggcuagaagcaagugacagccugcuagucagccagugguguaaggccguguaaacacagaauucaguccugaaacccucugcccugguuacauuucuuuacacaauggcacugggaauggaaguuggggccuugugugugcuaggcagccacucugcuaccaaguuccuccucgccagccuuacauuuuuaacuuuuuuacuguaaaauguuuauauguccaauauuaaauugagagcauaaugagccucagguaccugagggugucaguagcugcugccuguguccagccugcagcgucucuaccguauugucaguauauggcucuggauguaaaguucugcuugucucccagugagcuuaaccaugcucuguucaaaccuacaaugugccuggugaugcgguuccuuaaucuggagcuucccccuguccucagccccagggacuagagcuugggacaagcauggcugggaggguccuccucugucucccuugaggggaccaugcaaccagagucccagccggcuguagcucuggagacgucacuaacccugagaugaacccccccccccccgccccccaggguugucuccuaccagauccgcuacgaagggaaugugacagaagaaaccaggaucaaguucaugacggacggugugcugcucaaagagauccagaaggucagucgccugcccgggccucguacaggacauggagggguggagaguagaaugucuccuugguugugaucaccagugugcucgccacgugugguguugagcguguccguucuuggaaucucaguugcuugaucagacagugauggagggcacagggucagugugagcugagaggccauggggugaguaagcaagagggacuggggaugugacucaggugguagggagcucuccuagcauuccugaagcccuggguucuagcccuagcaccacacacaaaccaaaacagaacaaaacaaaagaucugcuugucacccaagcacuuaggagguggggucaggagaauaagagguuugagguucuaggucacauaguucaaagcuaaccugggauaaaugagagacugccaaaagaaaguaagggagagcagacagcuuuuuuuucuuuuucuuuuaaaggaaagaauaaagagagcuugcaacauucaauagcagccuggcuccuggcuauucacaauagcuucaggcagucaggaugccccgcugcuucucccaugggccucuaggggcugcugagggaguggaagcagucuggggauuggucaugugguucagugccugugguuguggggucuugguggcacucugguauaacucucccccccacaggacuuccugcugcugaaauacaagguggugaucauugacgaagcccaugagcggagcgucuacacagacauccuucuagggcuccugucccgcauuguggcucuccgggccaaggugugugggugugggaagugugcagggagggcagacuaaagucaccuugucagggguagcagaggacacagcuucacugggcgugagucauugccagggccaggcucuagcauucccuucugucccuguugacucacaggcccuugguccagugucaugcauagugagugaucucuccccauccaagaggcucaggcggaaagcuaaaagugggcaggccuugcuggagccagcuaaaggguacccucccuccgcgucaggcucugcagguucauagacugcuggguugagcucgcuacuccccaggccugcccuacuuuccagcucugugcucagacaguggaugcaaggggccagcucugagggcauacugucugaaggggccuugauaagcagcccuguuucugucccucaacaggcagcucaguggagaggugggcguucugggggugccacgugcccagccacauugaagguaguagggauggacaaugaccaggaaagggugguaugccaguccucccuccuggagccacccuuggucaagguggcaggcaguaggccaauucaggauugugggcuggaggccgucagcugagcccuccccugucucagcgcugaucgcaucuuucacuuggcugucucaugaagguggagcccugccaugguuccuuuagcugacuucauggucagggcucuggccugugucaccugcagaacccaagcagaaaggcucccuguggcuggguuucauuucccccgggggcagccugaggaaugcuuuugcugguuauauguaaccacagagcugagcgguguauaucuccaugcacacugucuccaugcugagccugagucaccagacugucuuccacagaggcaccugccccucaagcugcucaucaugucggccacacugcggguggaggacuucacccagaaccagcggcucuucaccaccccucccccggucaucaagguagguuuugaguaagcccacuaccagcuucaaccuaacuuugacaugugagaacuggugguguuaagguuuaggucagaagucagagagacuucugugcuguggcagucccauaucuuuguggaccuguuacagguugagucgaggcaguucccugugacuguacauuucaacaagcggaccccauuggaugacuacaguggugaaugcuucaggaaggucugcaagauccaccggaugcugccugcaggugaggccugaugggacugguacagcccuccucguugaggacacagguuugccuuucaucccucugauagcacagggaacagucagaguggcauggugacuucccaagccaccuggugccccucauaucuaaggcagagguggcaugucaaagcauccucuugaaaagggcaagcauggacggccucuggucuugagaguccaaacgcagcaaacccuguugagugugcuguuguuaggugcccuccccacucugcuggccuccgguagcuggcuuucacccacccagaaccuaucucucuggguccuagcuccugaaugucccaggccgucagcaggugcuugcaaggguaagucugucagguaacuggcuugguucucucugcagguggcauccugguauuucucacagggcaggccgaggugcaugcccuuugccgucggcuuaggaaggccuuccccuuucguugcucccagccacaagguaacuacacauagccuccugucggagcucuccaccugcuacccugagccaggcaacuggugcccugauuggggcaucagcucccaccucaguguccucgaggagagccugugccuuuguacccccaaaacaguaugcucaucauugcggcaguuuugcuguugagugacaggaguaaagugccagcugccuacguuggcuacagaagucuuuucccacucucuuccuccuuuacagaaaaggaagaggacucagcagaagggaugcggagguuuaagaagucccggacaagggcuaggaaggcccaggccaugguacguggaaguccuggagaccugcacucugcuguugccagcuucacaaacucuuuggacuuaagggucacuagcaugaaaugaauguaaaaaucuauuucgccugauguggcugggagccacaggcggggguggggggcggguacaggggggcgaggucuggggucacacugguccagcccuguuccacagcagaguccugguggauuacaauucuagaggcuugcaauguugagugugugucuguuaugauuuacaacacagggucugccugagaggauccuggagcacaaagcacaaauagagccauaggugcuugcugaaguagggagaugugcugucugaagcugaggggccagcaagagagggccuccccaggcacccugauagcuggaugcagugucaguggcuucuugguggcauguacccucuuuauucauuuaaggugggccaggcagcuuguaaaaacuguguacauaacucacaacagccuugugagaugaccccaugcucauauccgacuuauuuguuuguuuauuuauuuauaugcuuaguuggacagaauugucacuauguaauccuggcaggccuggaauugcuauguagaccaggcugucuuugaacucacagagauccauuugucucugucucuagaauacugggaauaaagguguguaccaccacaccuaacucauaccuaaauuuuuagaauuucuuuagauucauuuuauuuuaugugcaugaguguuuauauaugaguaccaugugcaugcuuggugccuagggaggucagaggagggagucagacccucuggaacuggaauuagagaugguugugaacugcugugugggugcuaggaaucaaacccagguccucuaagaacaagugcuauucacugcucagccacuauccagccccccauaccuaauuauuaauuaggaauggggcagagaaggucguuguuuaguggccuucccucguacggcacugugucguacauggcuugguucacacccagguugccugagcccaugguguuggcauguccucaggccuugccccagaucaaccuggacaauuacucugugcugccagccggcgaaggugaugaggacagggaggcagagauggacgaugaagaggaggcccugggcucugaccuagaucuggaccugggugacagugaggcaaaugaaggugcggccugcagagcuaugcgcuuggguucguugcucucuggugucagcacaggucugcugagcccuauugcaugagaggcccuguuggccacugggaccagaagaaucuaaguccuguccucacacaugggaccaaaaacauucuagcaccuacugggaugugaguuaaaggugcuccuuucugguggcuuuguccacuggggucuccuaaggucuuaauacuuugacagugcuggggucaccaucuccaggcuggccauuccugggaugacaugggccucaugcaauugaugucuagauucucagggccccugaguauguugauggggaacuucuuguuacccagcuugagcuaggcugggguggggggauggggggagaaaagacagagagacacagagaaagacagagacagacuuuuaugauuuugugucccaaaaaaggcucuuucuguacucaagccugccacacugcacacugucuggacacauacagggacuggggccagcuuacucucaggggauccuguguguagcagauaugucagauccaugcugggcagcaauaacaggucucaggagcuuccuaguacucuaucuaaacaagagccccaagccuggguuggguagugccucucacuuguguggaugggggggauuuggagguagcuggucagcgaggagcagcccuaugucugcggcaucucuucaaccuggauucuggugucccaugcuuuccugcaggugagcagccggaugccucccugccccuucacgugcucccgcucuacucuuugcuggccccugagaagcaggcacagguaaugggacagcucuuuagagcauuaagauguugugggucaagccuggggugcuuuuccaucuacucacacaccagaagaaggcauuggauccuauuacagaugguugugagccacaaugugguugcugagaauugaacucaggaccucuggacgagcaaucagugcucuuaaccgcugagccaucucuccagccuugucucauagauuuucaccugauucugauguugucuugucuacugccacuucccaggucuucaaaccuccucccgaggggacgaggcugugcguuguggccaccaauguggcugaaaccucccucaccaucccugguaucaaguaugugguggacugugggaaagucaaaaagcgcuauuaugaucgugucacaggcgugucuuccuuccgugucaccugggucucccaagcauccgcugaccagcgggcuggucgugcaggccgcacagagccaggccacugcuauagguaggcaacuugucccugcaucacaggcguugagaaguagaacugcaguugccccucugcagugagugggccucaggaggaccacagcccuccccacacugcuggcugcuuuacccugccuuugcccagugaucaacugcugauccaaagguuguccucauucuaaauacuuucauagcugggccauugucaccaccaucaaucagggcagugcuccugugaguggucacuccccaagggcccccuauaagguauagccugccaggagccacccagagugaugaguuuucagggucaccuuaccauguuucuccuaguggcugagucccuuucccacugcccugucacauuguuacuguccaucucugcuggacauugaggcaguuguuccuuuaucccauugugcauacacaugucccugugucaguuuggaugucuguacucaucuuuggcccuguggaguucuuacuuaugagggaugagccacucgccacucaccagguacccaggaucuucucucacaccuuccccucauguucguuugcaguagcaugaggaaggggcuuaugucaguggcuuuggguccgugcuccccucaggcaagugcucuuagugucuucugcacugccuuccugccucugugccuucccagaaauugucauuuugggccuuuccucaguucuuaggcuccgcccaucugcugauggcuuggaggagagggcucuucugacggcugagaguuagauccguguuagcuaugccacuggccauuauuuuuuccuaauguuguuacuuugaauagcucuguugcuguucuuccagcuccucuuuaguuuauaggauagaagauguaaaagaauacagaguauauagucaggguagcuggaggggggacuaacugcccuggugaggcgagggccuggcucugagugcugugcguggcuugcccagaaguccggcugacuuuccuuuuuccggucccuacuucuccccacuuaggcuguauuccucagcuguuuucggggacuuugagcaguuuccuccuccagagaucacccgcagaccaguggaggacuugauccugcaaaugaaagcacucagcauugagaaggucagccucaggcacagccgccucccuuccuguuccauccucagccuggcgcauucugucaccccagagcugcgccugccggggaaggaguggucuccccagggaccgccaaucagaagguguccugguggccuucagucccuaaugagaacaguuuuccuggacucugggagacagaagcuaauggacagccaggugccacauagcuugugggcacucagauguccugcugacuccuggauggaggcuucacuggcaugguccucugaugaguugggguucuuuucuccacuccaggauggggugguuacacguuccccaugucuuucucacucuuuugagaaggccugcuugugcuauauguugucccccaacccuugucacaugacaaccagauacccacuuaacagaugggaaaccaaggcagggaagagacagucucuguucaagaacauaucuaaugagccacagaacccagaaggcugaaagugcuucugguccugguccugucccugaacccaaaagaaaaguuaaaaaugaaggcucuugcuuggucuagagagguaggcucagucaggaaaggcgccugcugccuuaagucuggaggaagcacaugguagaaggggagaaccauccugcauguuguccucugcccuccacacuugcacccacacgcauagaacaaagaaauguaaaguaacagccuucagaauaaagacuguguagccagggaaugguggcucaugccuuuaaucccagcacucaggaggaggaagcaggcaaaucucagaguucaaggccagccuggucuagggcuacguaaagaaacccugucugcaaacaaacaagcagacaaaacaaaaccaaacaaaacaaaauccauacaaacaauuguacauuuacauauacccuuggcaggggauguagcuugauuaguugaacacccagcacuacacacacugggcgugagauacacagcacaguggaaccgugucuuucucacucuuuugaggcagggccugacuauauagcugugguuggccugaaccucccuaugugaaccaggcucagacucacagagaucuuccugcugccgcugccacccagccaggauuaaaggugugcaccacuauaccuggcaagaucuugucucuuaaaauaaaaagacuguacccucacugcaugugguagcacaggccauugcucccaucucucuaguggagaaaucugucccuuuaagaggggguggggaaucccccagugauuuuuuaauuuguuacaaacaacugauucaaaaucaagaaaaaucauuuuagguuuucacugagaacuuauguucauuucugugacagucaugaccacaguuauauuuuucaaacauaauaccuguuuuccuaaauauugcauauguuguugcuuauaaacuccuagaguuuaguugcuuaaguauagccccuggcacacaguagguuuaauuuggggucauccuaguauaugggcuuggagacaucuuggcgacuuccuaggcauguaggccccaugucccauuuaacgugccccagggccuggggacaggcugagggaaaggggagcagcaucugcugcagccagugugaccucguggggcuugcuucucugcaucacugccuuccugugccugugcccaggucaucaacuucccguuccccaccccgccguccguggaggcccucguugcugcagaggagcugcugguugcccugggggcccugcaggcaccuccaaaacaggaaagguaggagggggagggugaacccaaacgugcagagccuccacgugcagguccaugguucuuacccgcuguaucucuugcccccagaaugaagaagcuacagaugucacagcugagcugccccaucaccgcgcuggggcggaccauguccaccuucccuguggcaccccgcuaugccaagaugcuggcccugagccagcagcauggcugccugcccuacaccauugccaucguggcugccaugacugugcgugagcuguuugaggagcuggacaggugaguuagugacagccuugucccucggagcccagcccgccaugcucccugcuauuggugcuggccuggggagccugagcugcuauaucugaaggaagggggagggagagaggauuuggucagagaaucccugagggcagcaggcugaaggccagccggccauguguguguuuacagaccugcugccagugaaaaggagcuugccgagcuaaagggccgccgagcccguguggcccagaugaagaggaccugggccgggcaggggccaucucugaagcuuggcgaccucaugguguugcuggguuagugccgccuccugggcaugagggagggugguugguauccuggagcagauuggagcuaagcagugagaacagccugccuuguucuacaggugccgugggagccugugaguacgcuggcugcucaccccaguucugccaagcuaacggacugcgcuacaaggccaugcuugagauccggcgccugcguggccagcugaccacugcagguauaguccaggugacaguguggauaggcaucugucccucuguguggguuugguaugcuagagaucucacacuugcucauuugucugcccaccaacauggacucagccccaagucaacguucagugcccuuagacagguuucucccccaccccccucaccuagaaggcugccccucaggcugucugccacucugguccucuuccccuguuccacucaggaccuuucuucccuuccauauguccccaaaguucucaacccauggguucaggauuccuaugcagccacagguaacuccagucaccucuaucuaggacucaaggaauguccccauuaagauacagaguggccacugggugaagguggcaucuaauugggaacugagugcuguucugccaacuguagacuucaagcaucaguggcuguuuccuagcccacuucccccggagcagggcaucauuguagccugcuuuccugccugcugucacaugcauggagcuguagccucaggugcaacagccugcaauuguggacagccaccuaacacuaaugacagcagguggccauguggagccacaggccucuccaggccaccuuucagcagcgggguggacgggucugagguuccuguaacuguccuaccacaugggagcuggggugguugucccuuggcagggcucugcuggcgugggacucuagguuuuggccuaggaaagggcucugggcuuagcugauguugaccucuguaucagaagcaagcacugugagcaaagcccaagugccaggugauuuccugaaggacugucagccuuccucugacagagacuucaugcaccccuuucucaccuuccuugcagucaacgcagugugccccgaggcugggcuuuuccuggaccccaaaaugcagccuccuacugagagccaggugacuuaccugcggcaaaucauggcagcuggucugggugaccaccuggcccgccggguucagagugaggacuugcuggaccccaaguggaagaaugccuacaagguaggacaugggccugcccuuagugacuaaccccauaaccucugggaacgcuuccagcaaagagcaggugaaggcugcuguucgugggaacauaggauguuacccucggcucacgguuacuuucuagagaugcaucuuacaccauacggucaaccuggcuucacuguucagcauggccagcaucggaccagucaacuugagacaguuucucuacccuggagaaaccugagcugccuuccuccccauuuaaccagauggacccacuuggggcuuggugugugcuggggccaccucccucccuagcauuguaucucugggguccauccucagcugcuguuuuugaaacagguugauccuccugccucacccuccuaagugugagggucaaggcccccacucggagauuguguuucauuuuguguguuuguguauacugcuguggaacauguauggaaaccagaagguugcaggaaucuuuuguucuccuucuaccaugugggucucaggaauugagcucaugucacuaagcuugguggcaggugccuuuaucugcugagccgucucacugggcccugacauuggcaaguguuuuucucauugagccauuuucccagcuccaggcuucagcucugaugauggccaaagagcaauguacccuggguagugccugcucauuggcucacuggcuggaugguuggauccugaaggguggacuugaagagccuagagcgcucagguuuuucucugaccugaacguccaucuaccucucugcagacuccucuucuagaugaccccgucuucauccaccccagcucuguacucuucaaagaguugccugaguucguggucuaccaggaaauuguggagacaaccaagauguacaugaaagguauugcauaggggccaaagggcgacauugguggcacuguggagcacccugucuaggagagcaugugagaccugacgccaucuccuguccucaggugucuccaccguggaaauccaguggauccccucccugcugccuuccuacugccaguuugaugcaccccuggaggagccagcgcccaguuacugcccagagucaggacagguguugugccaccgggccagcguguucugugaguuggggccacuuccuugguagccuggucaccuacagcuucuuggacucaucagcucaugcacugcucuugggcaugugccugagggggucacgcuagcccuccugcuucuccgaagggcuggggguggggagguugauacagcaguugcccuucaucacauguuuccaucccccagaccgugugggcuggccucucccugccguccagguggacuucccugaaggcauugaccgcuacaaauacuuugcaaaguuucugcuggagggacagguagguucuugggccaccuguggccugucuccuaggugucaugaacugcaggccccacucaaccauccugugcucucuugucaggucuuccgcaagcuggcuucauucaagagcugccugcuaucuagccccagcaccaugcugaagaccugggccagguacaagaguauauuccuaaaauaucaggacgggcaguaguggagagguuucucuggggaugcugugucagucacauaugcuggggaugugacaaccacaggagcuuccuucauucuagagcucucagugggccucaggcauuucacccgaaagauggcaggggacccugcaucucuacucaggacucucccuaccugucucacucccaguggcuacaucauucuagucuugcccccuccacuuuucuguguccccuccuuauauggaucccaccuuugacagcagggcccagccuaugauaaggaacaucuguguccuucaaggggcuggguggacaugaguagggaggggugcugggaaggcugcaugcugccaccguguacacaggcuccuucugaccgagugacaggucccaccaucuguucauccccaguucugguucuagucagcuguccccuuucuccaggcugcagcccaggacagagacccuauugagagcccucguggcccacaaggcugauucucgugauucccugcuggcugcauggaagaagaaccccaaaugugagugugacucagcgggggucaggggacauugcucaguggaaggaccuaaccaaaccaugggccuguggcgguacguccaaccaugcaagccccgggccuugcgcucuaacccugccugccucuucccacagaccugcuggcugaguacugcgaguggcucccaaaggcuaugcacagcgauguugagaagaacuggcccccuaccacugacaguugaccacacacccagcugcacagucaacuggcuccuaggcuguuaccaggagccacgcuguggcccugacagcccuuuucugcccaauucagaagcaagcucacagcuacacugaccaggagugcccuucuuugugacuguuauaagagcagacaugguuugucuuccacauuccuacugucuaagacggacucuucaggugacauuagacccugcagaugcacagagcaacacugaaacaggaaaguggacccuucucccagagcccugucuggccucauagcaucuuggacagcagguguacugcagacuucugugacccagugacuuuccugaaagguuaaccccagaugagggaugaucaccccagagcuuugcuccacauagauggagacugguuuccgggguccugcuuuggcaucaguagacagcaaguucugucuuuagugggccuuggcugguaaggaucacaaaugcaaggccaaccugagcuacacagcaagacugucuucuauuuguuugguuuuuuuuuuuuuuuuuuuuuugguuuuuggagacaggguuucucuguguagcccuggcuguccuggaacucacucuguagaccaggcuggccucgaacucagaaaucugccugccucugccucccaagugcugggauuaaagguguguaccaccacugccuggcuauuuguuuguuuuucaagacaggguuucucuguguaacccuggccguccuggaacuaggccuguagaccaggcuggccucaaacuuagagaucccccugccacugucugccuuaaguacugggauugaaggugugugucaccaccaccuagcaagacucugucuccaacaguuuuguugagaguaaauguuggugaugugcuguuucacuucagcuugucugucacaucacacaugcucacaugcuaaguagcugucaccguaucaguuuccagaaccuucauccucacaugacuuacugauuuucucccucucgaucuccccaacacauggagcugucugucuguuuguguggcugaauaugcgccaucaagugucaggcugcaucagucgucagcagaauagagugaguuguuuaccucugggugauagcaaaugcugcugcaguucuuuugucacuugggccacuugucacagaguccugggaaugcagccaagcucuuuucaguuaacacucaguaaaugcuuucucucugugggcugacuaugcucuugaucauguccucugaaccacauacugcuuuaucuccuguuagccaugcc

SEQ ID NO: 2689 - RNA, 944 nt, Mus musculus
guaaaaaucugcaauauuuuuuuccagucugaccaaauguagacucuaaagccaguuuuauaguugaauauauauaauguguauauacauauauaugcuauauauauucauguauuauuuguauauauacacuauauauauacauacacaagaugccuucauuuuaauuuuuacaucuaguuauuaugauuuuuugagacagggucucauguauuuaagacuggccuugaacuugcuaaguagcugagacuggccuuaaacucuccugcccccagcccgagugcaggaaugaugugcacaugugacuacgcccccauuguucgaacgccuuggggugaacgcggccuaugcauguuaagagagcacucaagaguccaguccuggauaccuucauucuuaguggaagaauguacaaaucagaguagaauguuacuugaaauucuaguaguuuuuuuguuuuuaaaaacuucaaccgggcgugguggcgcacgccuuuaaucccagcacucuggaggcagaggcaggcggauuucugaguucgaggccagccuggucuacagagugaguuccaggacagccagggcuacacagagaaacccugucucgaaaaucaaaaaaacaaaaaacaaaaaaaaauaaaacaaaacaaaacaaaaaaacuucagaugguguuacuguguuugaugcauauauuuuagcuuguuuguuuguuuguuuguuuguuuguuuuucuuuuugaggcagggucucucuacauagcccuggcuguccugcaacucucuguguaaaccaggcugcccucuaacuugcagagauccaccugccucugauugcugguauuaaagguguugcaccaccaugccuggcauuguuuggaaguaaucauagcccccaguaguuaaagauuuuuuucuuuucuucuuucauuccguggacagcuuauu

SEQ ID NO: 2690 - RNA, 75453 nt, Mus musculus
caguucuuggcgguagcgacgacaugcggcuccuguuccuggcaguacugaggccucacacuggcaacgcggucacagcugggcgccuacgguauguugcggggaccugagcaucccucgcguggggaugccggacugggccgggcgccggagccgcgcgugcacaaacggccggguuguaggcgcaggugcgggcgcgaggggcugcagcucugauuccagcugccugcugcccugucuggcuauugugagugcccuaggaugccgcaaagaggccgccugggccagcgcugggacgcggggugguggugggggaaaccagaggcucagcaaaggccucgcugcagacuugagcuuugggcagaguggccugggaugagaagcggggacccacguggcuggaaagacgcagagucccggugcaucggaugcuccagcacgugcggagauucaggguccgaguuccguggcugcugccauucccucccccgcgcccgcacuuccuaccugguucucuucugaacgcucagcuuauuuuauuuaauuaggccucuuuuugcuuuguauguuuaccugggacggaagccuggagccaggacaaggcagggaaggcggguccauucaccucuggccaucugguugccuggaucaaaccgggcuggucugaaucauuggaaaagcagacacuuacgugcccgugcucacuugcucgcucccccccgccccccgcgcgcgcucucucccuccccuuccacuugcuucaagacauuucccaauggcuccccccccccccccgcccccaguggguauguuuccucaucaugggaaagagccguugagucuucaagcuaaaaaaaauguuacaguuccucucaagaucacagugaacaaccaaaggcgggcagaugcauaccugaaguuuccccggaguggugauaguguugugauugugugagauuccccucccucuaauucagucacucuucgggcucucuguggacugagcucuuuccaguagaaaagugcaagucauuuacaaggagaguaaacacagggguaaaucauuccagggcgauugggaccauggagcaaauaaaaccaugcugggguguggccaauuugauagagugccaggcaagcauaggugaaucccuggguuccguucccagcagugcauaaacccaggaggugcgguuguacaugaccacaugcugauaaccccagccuuugggagcugaaggcaggaccauuagaaguucaagggcauccucugcuacugucaacuuccagcuacuugagagccuaucuccaaagcaaagcaauaccaaaacaauauaaccuuugcguuggaggggcuccuucaagugauaagguccaggcugggcucucggcagaaguagcuuguaagcuaagaucagagggaaagcacccacaggucccgaggccaauguuaacuuaagcuguucaagaaacagaagguuggcgagacaguuauccagcugucuugugcacaugguaagaggaagagauuguauuugcgauuaccauuuaaacauuaagcaccuuuagcuaacauuugacugugugggugggaaagguccaagauucuccggaaugacuugaucacggaugaaugaaauaguggaaaacaugcccaaauguaucaugugcauggaggucgucacaaaguagaaucaaucgcuaacccagaaguuuguaugccccuucccaugggggaagagggcuuggaggaugugugccauuccuagggggauagucugugguuagggaaggcccuggugggcuuagugagaagcucgcauagccuuggaauaaaguuguagacucacagaucagugauugacuguaaaugauuccuucagaauauuuauugggugaugccaaagucugaagcugaccuccuauauucccaucuccuguucccuuccuuuuuuaaaucauuauuuauuuuuauuuuuuaugugcauugguauuuuuuuuuaaagauuuauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagccccgugcauugguauuuugcuugcaaguaugucuggguaagagugucagaucuuggagucacagagaguugugagcugccaugugggugcugggaauugaacccggguccucuggaagagcggucagugcucuuaaccaccaagccaucucuccaacccuuucuuacauagagcaagcaaaggacaacaacaaaauacaaagagaauuucucuuccccaaaguagucauagaaaucugagcccucuuucccagaaaacaaccauaaaaccugaaaauucuacccccauucuuuugaaacugacacucucugcuugcagcauaagaacugacuuuccuagacaaacgucacgucuccggggcugggaagauagcucagugaagaagagugcuuguugccaaagcauauggaucugaguucaaaucccaccacccauauuaaaaagagggguucagguauagagaaaaaaaaaagacucaaaagcacacaguuuuugcagcagcuaugucuagaggcucacagccacugguaagccagaucccagggauccaacacucccuucuggccuccugggaaucugugcucacaccauccccacauagacacauacaagugcacaaaauuuauauauauauauauauaucuccaagcacaguaggauauaccuuuaaucacagcacuugggaaggcagaggcaggugguucucugaauuugaggccagccuggaauacagaaugaguuccaggacagccagggcuacacagaggaacccuaucuugaagaacaaaacacuaaaguuucuaugaggcugaguaauuagaauuuagugauucugaguccuuucauuggcuuggugaggacugguggucaugaaucagggcaucacagugugacaaggcagcuaaucugcccgagucaggguugggcaugaggcuggaaauaagggcaagguuuuugucacaaaaggccaagaacagccauaaaaugaagguaguguuagcuguaggauggcagguaagagggacugaaccugugucccaugcguuuuagaagcaaugggggcuguugguagagugcuuauggcucaucugguagagugcuuguagcucagaguacuuguggcuuaguugguagaaugcuuguggcucagggugcuuguggcucaguugguagaguguuuguggcucagaguguuuaugauguaguugguagagugcuuguggcucagacuacuuguggcuuagucgguagaaugcuuguggcucaggguacuuguggcucaguugguagagugcuuauagcucagaguacuuguggcuuaguugguagagugcuuguggcucagggugcuuguggcucaguugguagagugcuugcuuagcagacauuaggcccugggguccacccccagcauugugcauaauggguguggugguacauaugugcgaucugaucaggacuuugaaugcggagccuaaggaucaaaagcuuauggugauucucuacuaaguaaagaguucacaugagacccuguaauaaauacauacauaaauaaauaaauggaagcaaauaaauacacgagcaggcaaacagaguguggaagaaggcagaucuuugugaguucaagaacaguuuaguuuacuuaagugagcuuuaggccagccaggggcuacauaaugacagucuggaaagagagagggacagggagagaggaggaaagaaagaaagaaagaaagaaagaaagaaagaaagaaagaaagaaagaaagaaagaaagaaagauaggaaggaaggaaggaaggaaggaaggaagagaagagaagagaaagaaaagauggagagacggugcagcaguuaauagcacuugcuucucuuuucagagggcugaggucuuguuccuaucacaucaggcggcccacagucagcuguaacuccagcuccaggacaucugacaugguuuuaaucuccuuggggcacccacccauuugugcccauacaugcacagagacauacacauaaagacauuaauaaaaccacaacuuuuuguucguuuguuuuuugagacaggguuucucuguauagccuuggcuguucuggaacaggcucuggagacaucagccuggccucugccucccgaguucuggcauuacaccacugccauuuugcauggcuaaaauacaacuuuaaaagaaaacuguaaucagaagccuagaacacaggcgggugugguggcucaugccucugaccccugcauuuagaagacagaagcaggaggacuuucaugaguucaagguuagauagguuacauggaccugucucaaaauaaauguaacccagagaacaaacuucacuucgccuugguggagaaaaaaaggacacgggaaguagaugugaguaggaaccucaguagcucuguccagcuagugcugggcccagggauuucagagcaucuuuccucucauggagaggaggcugagcccccaaaaccuuucaauaauucaaguuaaucuuaaaacagcuuccugggucaauccccgcuuuuguggauagcuagcuucuccagcucccucucaacccccuccccgcuuccacugacaguccugggggacagggaacacagggucugacgcaugcccugcagucagucaucacggggcugcauccccccagcuaaccccugcuuuuauaaugagacccccagaugucuuccacugucugggaauggcuuccucaugacaguggucgaugagcagcugagacagagaccauccuccagaaacccaaagacaucuugcuuuccacucucaaauuggcuuuccugguauuuuugaaauguguugcugcuuuuaguuuuuaucauuugcguauggguggguuuuguuguuguuguuguuugccggaaugugucuauaugcguguauguuuaugcacugcaucaguaccugcuguucaugggggcuggaagagggcaucagauaccccuggagcuggguuaacagauguuugugagucacugugugggugcugagaaaugaauguguccuagaaagagcauccaguguucuuaaccacuaagccauuucucgagauggucaccaccaccaucacuguuugugaaacagucggcuauagcuagggaugcucuuaaacacucucccuccccucccccacacaccucauaaugagaauaggucuggcccccaauagagaaggacuugaacuucugauccucccaucucucuccugagcccuuggauuagaggugugugccaccacgccccuccaugccccuugaccuuuguuucaaauccuaggggaacucagugucuguggcacucccgagggugaccagaaaaugcugccaaguacuguguaacccuuggcucucaggagaacacacacugucagggucaaguugguuuagggcagagaguguugagccagaauugucgcaggagaacuggacuuugggcaguggguggcagcuguucuuacuucauccacagagggcuagugaacaacaaacauguuuacgguugaaacuagagagaagguaccucagggaaaggcagcaaucugaagccaccugggaaaacgucuuuugcagccagacucacuuucuccuuccucaucacccccucuaucauuucccuccugaguucugcugcaaugaccagauuuuaggugggaaagcuuuuuggugaaucaauaaggggagaauuucaaguuuucuggguuuugcuguagagcaauggguuucaaccucccuaaugcuguugacucuugacuacaguuccaaauguuaugcugauacuccaaccauaaaauguuuucguugcuaacuguaagucugcuccuguuaugagugguaauggaaauaucuguguuuuacaauggucuugaguaaccucugugaaaggguuauucaacucucaaaggggucaugacccacagguucagaacugauguuuuauaggaaccaacuagcuaacuaauaaauuaggcaacucugaugagccuggcaaugguggugcacaucuuuaaucacaauacucccagagguagcggcagguggcucuccaugaguuugagauuagccuggucuagaguuaguuccaagacagccaaggccacacacacacacacacacacugcucccccccccccaaaaaaaaacccaaaccaaacgaaacuaaauucacugagagggaucagagacagaaagcagaauuuguaugaagguuucagaucucugaguguggagggccaagcccuucuccaaacccauugauccauuugauugauccaucaguaucauugagguuuucaggaaucagucaccacgcaaagacuauacagagcugcgcacacacacacacacacacacacacacacgcccucaacacguaugucucacacucaaaccauaccaaggacucagagggcaucaugggugccugggaagugcagggaaacagacuauuuuucuuucugccuaaguugaacagaaaaagaaaaaaauaaaaagggaaggaaaagacaugagugcuccuacuagguacaauggaguggguaagguucuuuuuuuauagcuaugugggagagcuuagccagaggcagagacauuggggagaguucagaguggaccagacugagcugggacauguggagagagggagaggaggggguggggaccagaagcagcagccaagaggcuaaaggaacaaaaggggcagguaaccaaaaugucucuuauauagggcagagccucugggggaagggcagcccagcugggcugcagagugggggcagggcaugccagccauaccccauaacagguagaggcugaggaaugcugggagaacauggcagccaggccagcuuugauaugcuaaauagacauugugaggcaaguggaucuugccaccagucagaggaacugguaagguugagcuggccuaacccccgggaaaucucaagaguugagaaugguaggcuugaggucagcucccuaccaaauuaccugaucuggaacacguaaccaugacgcccuaccgagaggaucgugauaauugguagcauaaaacccuggaguucucaaugcuaaugaggugucuagauaggacuugaggguuuagccaaugagcuucccuucccgggauucuucccgcaaaaaguauuuaagcccugguucaccgaguacaauguauucguucacauaacucauaagcaaauaaaacaguuuggacaagcaaggaccgucucauucauuaagguucgcuuugagugcagagaccuucguuguaaagagaugugacuaaaucuccaggagaaggcuuucuaucuccccgccccuccguacucacucaggaccaaaugggauugccgcacccccacccccacucgucccagacucagccauccccuuccugucuagcuuguagggaaaguggagucuggguacacaggaggcugggaaucacggcgccuguccaaguccccaguguuucucaccuggaaaaauacuugcugggacccuaccaugacucgggaaccccaagcggugaggcagacacacagcccgacaacacaccucauccauuuguccagaguuugaaacuuaacauaagcagcagguguuggagguccgcuaacauuuagacacuuagcaaaugaggacuaaagacuagguggcacuucacccaucagagcaccaccaccccugaagccaguagccaggcaaccagagcugugcguguguguuagagccaagcaugaccguuuggaagaagguucugcauguaaaugcacaaaguauuacccaguuauacugugagaauccucugauggagaagugugcggagauggcagccugggaaagcgacuuggccauacgcuacagugucugagaaggcugccuguagaaaugucucuuccuuuccaccugagccacacucaacacaccauaaaaccugcccuuugaaacgguaugacucauggcacuggagagguggcucagaggccaagaguacuuguugcucuugcugagaacccagguucaguucccagcacccacaugguggcucaccacugccugucgcuucaguuacaaugggucugaugcccucuucuggccacucuggguacugcaugcacauguugcacaugcaagcauauagacauaauuaaaaaacaauaaaacuuaaucuuaaagaacgggguuguugcuggauggagaugggugaggugauuucuaaucuuaagucaugaacaugcaaauuggucaaauugguauccuuuuccuggaaguaaugagagcuaauuauuaaagucuguguguguguauguguguauuaccagcuguuuuguauuguuuuguuuugagcaggguuuuagaccacuggcugcccuggacuugcuguguagaucaggcuggucucaaauucacagauccaccuuccuccugccccuugagcagugggaucaaagguauuggacaccacacccagcucagcuccugucuuuaaaaaucuuuugcugggaaagaagaaaaaaaaaacauacuuucuugggcauaauagguacuuugugaaucuguuauugaauugaguuauccugugagagagggaagggggacaaaguaauuggaaaguguuauaagucagccgggcaccggaguuaagauuucagcccaccgaguauuaagauuaaaguuauuuuucauuuagaauguuuaugagaccauucaaugagugucacagugcuguuuaaagggcauuuaguaggcgaagagcaucuuguaauugugacucuccuuauccacggccacgguccccuuucccuucugaauggauucagcagagcucauggaucucucucgaguauucauucucuaguagaauucagaguugcugccaucugccagcagcuucucauuuccuagagcuuucuggagaugaaauagcaguuacagcugcccagaacacauagcauuccaacucacgaaugaugugaguuucaggcugaggaaagaauuagcugcagaguugacaggcucccuugugagugcuacccaggcaccaccacugucaucacuguugaacguggggagggccgugcuauugaccuccgaugacugaucaaaguuaacaaugagaaugguacagccaaauuaugcaacgcgagcuaggcguagugacacaggcuugguaucccaguuacuugggaggcuggggcaggaggauugcagguucaaggucugccuggccuacagagugaguucaaggccagccuggugaccuggugagccccggggauguaauucggugauaaaaucuuguuuagcuugcgucaagcccugugcugaacaauaaguaaagucaguaagaaccacaucaaaaacuucagacccauuuugcuuguuuugauugacuuguauuuauugauugauuuuuuuuuuuuuuuuuucgagacaggguuucucuguauagcccuggcuguccuggaacucacucuguagaccagucuggccucaaacucagaaaucugccugccucugccucccaaaugcugggauuaaaggcgugcaccaccacugccuggcauguauuaauuuauuuuaaaagcacuuuuuauauuaaaaguuguaauauacuuuugugugugugugugugugugugugugugugugugaaguucccacacuggccagaagagggcaacagauuccccuggaacuggaguuacauaucguuguaagccacagauacgugcugggaauugaacccgggguccaaugcaagagcagcuaguguuccaaccucagagcucuuuuuccagcucuagguuuugcucaauuugcacagugccguuagcauguuauuuaauauaugccuuuaccuuaugcaaagagauguuagcauucguauguuagcacugccacgggccccauccugugucccagagugaacaugguacugaguacucagugaacaugguacugaguacuccuucagccugaugcuucuuccuaagcccuuuuuguuucuacagcacauuggacaccagaugauccaucuaguccaguccugcuuacaguaacaaauuaaccugaugcuggguaacgucagguuaauacagaaacggagguuuauucaguuccuacuucuggagauucaagaugggagcacauucugggggauggucguuaaaacuuuaaagauugggcuggagagauggcucagaugguuaagagcacugacugcucuuccagagguccugaguucaaaucccagcaaccccauaguggcucacaaccauccguaaugaaaucugacgcccucuucugguguaucuaucugaugacagcuauaguguacucauagaaguaaauaaaccuuuaaaaaaaacuuugagauuauauuuauuaauuuacuuuggagcaggaagcauggugcuugggggguggggagugacuucacaugcuguaugccacagcauacagguuaagguaaaaggacaacuugggacaguugguucucuccuuccaucacguggaucccaauaggaucagauucagauaguuagaaccaaguuuggcuuagcaucaaaggccuuuauuccauggagccaucaugccugcccuuugcaaucauuaaagaaacaaaugucaggggcuggagagaugacuccguggguaagagcgcuggcggcuguugcagaggauaugagcuugguccccaauacccacauggcaacucacgaucaucuagaacuccaguguugguagaucugacaccgucugacuucuguagguaccagcauuauaugugguacacagacacgcaugcaggcaaaacacucauaaucauaaaaugauguaagccuaaaggaaacauaaaaaagugaguggcagcuacuguaagaugcacaucgggcaccaucuagagcgaagggacaguggacaaaggcaggaguggagucagagagaugcagauggagccccgagguaggccaaugccacugaauguggugagaagcuuuugugucucaaagcugggauugcccugaccuugaucccagccacaguccuggguccugcaggcuggggaauggaugacuacuguggucaucuucaaacuuccaucuguguuucaguacagauugccucuccccccaaccccccaaaaauaaaagcagcucagaaaagaguuacuaugugggacuuacucaaagcuuugucucagguaggguuuuacugcugugaaggacaccgugaccaaggcaacguuuauauaggcacacauuuaauuggggcuggcuuagguucagagguucaguucauuaucaucaaggcaugacaguaggcagauaagguguaggaaaagcugagguuucuacaucuucaucggaaggucacuaggagaagacuggcucuuuuuuuauuuuuauuuuuuaaaauuuauuuaucuauuauacauagguacacuguggcugacuucaggcacaucagaagaggaugucagaucucauuauggaugguugugagccaccaugugguuggcugggauuugaacucaggaccuuuggaagagcagucagugcucuuaccagcuaagccaucucaccagccccagaagacuggcuuuuauguuaggagguucucauugcccacucccauagugacacacuuccuccaacaagggcacaccuccuaauagugcuauucccugggccaagcguauucaaaucaccacaugccuuaaccaaggugacaacuccaaccaacuuuucccucucucuguuuuguuuuguuuuguuuuguuuuguuugguuuuguuuguuuuguuuuguuuuguuuuguuuuguuuuguuuuaauaaagggaccaccuagaagcugcaggccacauguguguucugagagaugccuuugauuuugaaagcccaucugaaauugccaaccugaucauggaugaaaaucuggaagcagcacuagcucuucaccucuaccgaggaggcagacuucugcaagguaccccucucaugcuuccaaagucacacggggggguggggggggggaguugggggagugcugaaaaaaaugccagguguuacccaaggacagacugaaggauuauacaaggucucugucuuuuucuauuaaacaauuaucuaaaugugguaaccuugccaguucagaacagauagauauuguugaugucuguacuguauaaauauuuauuuaaguguuguccugaagccaggccuggugugguacaugccuguauucacagcacagggucuuacaaagcuguggaagcccuaggucaaagcauucaugucucuccugugguccacuuauucuucuguggccaagaagccucuuuccucccuacugggguuucuccaugggugguguuucaguuuaguuuccugugcugugauaaaaugcucugacaaaugcaaccuucagagagaaaggguuguuuucaguuccaggguacagucuauccuugaaaggagcuugaagaagcuagucacaccucugaccucaagagaaaugaagguacacagaguauguuucuuacaaauggcccuuucuacauucacacuguucaggaccccgugacuagggaaugguaacacccacagugggccaggucuucccacaucaauuaaauuaagacagucuccacacagacgugcccacaggucacccugaccuagacaagcccucacgaagacucucuuucugaggcaauucuaggcugugucuccagaugacaaugacaaugaagucacggguaguuugaguagcugucgacacaguggccagcuucucugauaaagaacauucuagagucacacacucagccucuaaagucaccuaccaugccagacauaggcauguacuuguaguucccagcacccaggaaguaaaggcaagaggauuccaaguuuugaguccaacuuaggcaaguauaaaguaaguuuacgauaacucaaugacaucuguucauaugugugugugugugugugugugugugugugugugugugugugugugucuguuuucaagacaagguuucucuguguagcucuggcuauccuagaacuuacucuguagaccaggcuggcucaaauucagaaauccaccugccucugccucccgaguguuggaauugaaggccugugccaccaccacucagcagugacaccuuaucuccaaaaauaaaaaaaugaaagucuuccacugaauccauagugucuuuucaccauccaggugaaaagcuacuaagcucuagcugagcaucaacauaaggaggugacuguucuggaguuugaucuugauguguacacacaauguauacauauauacauauacauguacauguacauauaaauauaaauauauauauauauauauauacauauauauauauauacauauauguguguguguguguguguguguguguaugugugugcuuuguauucccagaggccagaaaagaguaucauguugugaggcagugaggcaacccccuuuucuucuucaaauuauuaucauuauuauuuauuauuauuuuguuuuuuucgagacaggguuucucuguguagcucuggcuguccuggaacucacuuuguagaccaggcuggccucgaacucagaaauccaccugccucugccccccccuccccccccccgagugcugggauuaaaggcgugugccaccaccgccuggcguguauuaauuauauuaaaaguuuuaauauacuugugugugugcgugcgcgugcacucccgugcaagugugcauuccaugcacauguuuggaggucagaggacaauuugggaggguugguucucucugcauaccuaucuacccacuuaccaugucaguccugggaaaucaaacucagguaggcucgggagcacaugccuuuaccugcuaagccaucucaccagcccuuuauaaaaagcaaagguuugccagggagcgaucaggcaaagaaaugcagauuacaaggaagcacacagaggcaccauccauacacaugcgcccuggcuacagugccaacgcgucaguaacugguucaaggcuggcgcaauggcucagcagcagucaggagcaguggcuacucuuccugaagaccuaaguucgauucccugcacucacguggcggcucaggaccaucuguuaucuauaccuguagcccuaugggaucaggugcccucuucuaauguacagacauaauucaggccaaaacauuuauauacauaaauuacauaaauaaauaagucuuaagggaaaaaaacugguucaguuccugcuuuucguuaugguucauacuguccgaacccugaacuaacccagggaucauuccucccuccuggggauauauguaaaagaguuuccccuucuguguucaucaaugaguuuuccaaguguugaauggcaggauauuauaguuguccuuccuagauggugucuagccagggcacugugcaaggugcacucugagaacccucucauaggcuuuaacuagccuauaaaacauacggcuugcaaguuaauucgcagcagccuacggugcuuuaaugaaguuaaagaauaugccccagcuggggcccaguaaggaagcagauggagucauguggcuaagaacauuaaccagucugugaggauaucccgugaguggguagggauccaauucaaaugccccaccccauauaauuauucuguaguuugugugucuuuaaaaucgagaucguguacagcuuacaguuugguggucuuuaacuucuaaauuaaauugaucuguuuaguagggugggugugccacagcaugcacgcaugcaugugggggucagaggauaacuuuauaguguucucuccuucuaccacguuagucccaagaaucuaacucaguucuuuaggcuugguggcaagcuccuuuacccgacgagcccucucacuggcccacaguuaucugucauuucuguuguauguuuugaauuuugguugauuuuuuuuuuuuuuuuuuuuuuuuuugcuuuuguuuugguuuuuugagauaagguuucucucuguaacccuggcuguccuggaacucccucuguagaccaggcuggcgucaaacucagagaucuacccgccucugccuccgaaguacuagaaucaaaggugugcgccaccucugccaggcuugguuugaguuuuugagacagggucucauguagcucuggcuggccuugaacuuggguuguggauaagguuggccuugaucuccugcuccuauuucuucucaaaugcugggguuacuggaagcaccaccacauucaggcuuuugaggcagggccugucaguuuacuguacuggcuggccuugagcuccuggcaaucuuucugccuuggcucgcauauaugugccaguguacccagcuucagcuauuuuaccugaaauuaaguaaaaacauccucuaucuuugccaggucucccauagcaaucagguaggagugaugucuuuuuuuuuuuuuuuucucuuuuuuaauuaaacaguuucaucuguaaagauauuuugccuucgcgcacacagccuuuaccuggaacauguguuccaggugcccacagaaucuauaagaaaaguaucagaucucccggaaaugcaguuucacaccgcugugagcugucaugugggagcugggaauugaaccuagguccucugcaagagcagucagugcuguuuacagcagaaccauguccagccccauuaauauuuuuaugugugucuugccugcaguugccagaagagggcaucggagagccugaaacuggagcuacagacaguugaguccguccaggugcuaggaaugggggggucugaaugacuacaucuuauuuccacguuuuguuuuguuuuuuuccccucagacuuggcgugugauaaauuguuuuuguuuuugagaccaaaucucacuacagagccuuggcuaaccuagaacucauuugcuauguagaucaggcuggccugggacauggagaaugcugggauuaaagacuugugccaccauacccgugugcagaacugaauucaaagauacuuuaaggcugaacaccauggggcagucuggaggcagaggcaggcggaucucugagucuacagaacaagacuggcuuuagaagcuggugauccaucggggauccaucccauaaucagccaccaaacccagacaauauugcauaugccagcaagauuuugaugaagggacccugguauagcugucucguaugaggcuaugucagugccuggcaaauacagaaguagaugcucacagucaucuauuggauggaacacagggcccccaauggagaaguuagagaaagcacccaaggagcugaaggggucugcaacccuauagguggaacaacaaaaugaacuaaccaguacccccagagcucgugucucuagcugcauauguaacagaagauggccuagucggccaucacugggaagagaggccccuugguauugcaaacuuuauaugccccaguacaggggaacaccagggccaagaagcgggaguggguggguaggggagcagggaagggggaggguauagggaacuuucgggauagcauuugaaauguauauaaagaaaauagcuaauaaaauaaauaaauaaauaaauaugaaaaggggaaaagguaaaauaaaaauguuuauuuuguucaaaggaaaaaaaaaaggaaagaaaagcuggugaucaugagggagggcccaugccuggugaccuccaggugccaaugucuaacagccugggcuacacagugcugcccccugcagguuagagggugauaagcaggacccucuccuuuccccagccuucucuguuucauuugaugagcucuuugaucacaccccaggauuggugagcuugucucugauagaugguggugaucauguguguguguguguguguguguguguguguguguguguguguguguaugugugugugcuuaaaauugaaagcaaguuaauuugaaaaaugaaaaauagucuaaacuauugcaggcggaacuugacgugauuaaucuuagugugaguuuuucuuuguacauauuuuauuuguguguauggagugguggugguggugguggugaugguggugguggugguggugaugauggggagagaucuuuguggaagucagaagacaacucgcaaggaaaugauucucuccuuccacugugagggucccagagaugggacuuaggucaucaggcuugguggcaauuuccuuuauucgcuaagccaucucaacggcccuccuuacugguuuuuaauagugauaccugcucuccccccaggacgaaacugaaugcuucccaccuagggccuggggcuguaacucugcuagccaagccuugccuucaauuuccagagagauagaaacuggguguggcagugcuugggggaaaucucagccccuugggcuauccuaccggaaagccugagaauuacgaguucaaggucacccuccggguaauaacaagcucaaggccccucugccucaaaaacaagauugggccaaugaaaugacccacugggugacggcaauuucuccacaagccuggccauccaaauucccuggacacacagagguggagagagacaacugacgucacaaaguuguccuaugaccgccacaccagcacuguggcaaaugcaucccucccucuuaucucacacacacacacacacacacacacacacacacuccuacucucucacacacacaugucucucacacuuauacuucucucuucuucccucccuuucugucucccuaccucucucccucuucuccccccccccccacauauaggcacaugcacaaacacgcauacucacacacgucucucacacgcacauacaucuaucacacacacacacacacacacacacacaccucucuuccucccucccucucugucucucuccuucuccuucccuccuuccccugccccccacaucuagcagugguagugcacaccuguaauugcagcccaacuaugcugaggcaggagaauugagagucugaggacagccugggcuacagagcucuuugcaaacagacaagccccgcagcccaguguaugggaacccgggcuuuuguaucacggcugaggccagggugcgccuccugaugcccagucugccccacuugucauucugcaggucacagcauuccuuucggggucaucuuugguggaacugacuuaaaugaagaugccaaucacaaagaaaaaaaggaagucauggggaaaguucuggaggaagccagguaaggccauggcucucccagugggaagauuuucaucuugccagggaaaccaauucacaucaucacuaauaaggcccuugccaggcacgguggugcaugccuuuaauuccaaaacuugggagacagguagguggauaucugagacuuaaggccagccugaucuacauaccaaguuccuggagagccagugcuauagagagagagagagacccugucucaaaacaacagcagcaauaacaaccaccaccaccacccuacaaaacaaaacuggcccucaauguaguuuuguuuuguuacaaauucucaucagaaccaaacaggguuauaauguaccuggccuaccuuuguuaacacaggagcauucuggaaggcuuugugugguaggaagagagcccuagcacgugcuuucgggguguguguguguguguguguguguguguguuugcuggaauagggucuuuugaagccuacgcuagccuugaccaucauggauagcugaggaugacccugaagucugcugcugccuccaccuucugagcacugggacuguagaaauguaccacagugcaggguagaguagcuaauuuuuuuuuguuuuuuuguuuuuugagauagggcuucucuguguagcccuggcuguccugaaacucacucuguagaccagccuggccucgaacucagaaauccgccugccucugccucucaagugcugggauuaaaggcaugcaccaccacugcccgacuagaguagcuaauuuaagagcaaugcaggcccaagggccaucauuguaacuauucuucuguauggcuauucacuauucaggauggcuccugucuguguuccuuugugaguuccauaaaccauuugagagacagucaccagagaggcuucgguacccuggcuuaguccucuguuuauacauuacucccagccauccaggacuagagagccuccaagagcaucgcucuguuggcuguguuuggugcuucucuaugaugauacauccauuaguucugugagcauagugugggaagcccuguuccagacacuagcuguagccagcccuuuuugaacugcaugggcacuuugugugugugguacacgugugcacgcgugcacacacacacacaggaaaaacacucauaccaaaaaaucaaaaugaauauaucuuuaaaaaacaaaaacaaauaccaugacaaugaaaagaucacuuacuguuucugcagaggaccagaguucccuucccuguagccacaucaaaaguagcuccugguauaagugaacuacaacuccagcgcuagagggaaugcgcccucuucuggccuccauaagcacugcacucacaucucgcaaacacacauacacacacacacacacacacacacacaucaucuuuuuaaaagguggccuauuaguacaaaugccuuacuacuguuugcacauccugaagacauauugcccuuucauuuacaugguccgugcuacacuguccuauggaagaaaaguaauuccguuuacugaaaacauuaucggacaaauccaucuuacaguauuaucauuagggcuguuuauugcaucguucuuaaagcaaauauugauuuuuuuuuauuugggggaggguuauugauugagaccaguaggcaagagagacgcaugaaucaugaauuccuugucugacguugugcggcucauguuuccauaaaugagguuauugaguuugucugguuuuauaaugugcauuucauuuuuuuuaaacuuuauuuauuauauguaaguacacuguagcugucuucagacacaccagaagagggcaucagaucucauuacagaugguugugagccaucaugugguugcugggauuugaacucaggaccuucagaagagcagucaacgcucuuaccacugagccauuucuccagcccauuuuuaaucaaacaccuuuaaauugguguuauuuuuuuccuauagggggcugugugaauuuuuuuuucaggauuuucaaacuuuuauccuguacaguuauagaauuacaucuuaauuuuggauuagauuuucagcuucuaagacuuaugaucuaauaaguccuuaguaauuauaagaaucaaaauuaaauaauauguaucugaaaauugggaucauuuuguuuccagguccauuuuuaaaagauaauaucccuuguuauucuuuauuuuaaaagcaccaucucuuuauuuuuauuucccauguaugggcguucuccugcgugugugucuguguaccaugugugugcaauguucuuggaggcaagaagagggcaucauaucaaauggagcuggaguuacagaugguuuugagccaugugggugcugggaauugaacccagguccucuggaagagcagucagugcucugaaccacuaaacuaucucuccagcuuagccaccaucuuugucuuggagggcgcaguccuuucccauguauuuaaccccuucgcugacuuugugcuguguugagugcuuggguguguuggagucugaucccagccucuccuucacuuuuucccuucucuucaugucuaacacagucuuaaucuuugcgcuuuggggagguguccguguguauugcaagucucagccgugcauucucuaccuugaaugguuguuacucagugccauucauauccgauuuguuuuaguuaagguuguuauugcugugaugguaaauaccaugaccaaaagcaagucaggggaggaaaggguuuguguggcuuaugccuuccacaucacaguucaucaucaaaagaagucagguuggaacucacagaggguaagagcugaugcagaggccauggagggaugcugcuuacuggcuugcuccccuugacuugcuuucuuacagaacacaggaccaccagcugaggaaugacccauccuuaaugagcuagacccucccccaucagucacuaacuaagaaaaugcccuacaugcccgucuacaucggaucucauggaggcauuuuuucaacggagacuccuccucuaugaugacuucuagcuugugucaaguugacacaaagugggucaugacaguaucugucagucaccuuucucacugcugugacaaaaugcucgacaaaagcaacuuaaggaaggaaggaaggaaggaaggaaggaagggagggagggagggagggagggagggaggaaggaaggaaggaaggaaggaaggaaggaaggaaggaaggaaggaaggaaggaaggauggaagaaaggaaggaugaauccaggggugcuuaccuuucaucccagcaccuugcgagcaucucuuaagcucaaugccagccuggucuacauagugaguuuuaggcagccagggcuacacagagaaacccagucuuaaaacaacagccacaauaacaacaacagcagcagcagcaacaacaacaauggacuauauuguggcuugaacuuugaagguacaguccaucacaguccaucacggggaggcagcugguuauguagcauccccaagucagggagcagagagacagaugcuagugcucagcucauucccccauuacucagcccacaguuccaguccuuagcauggugcuacucauagggugggcuuucccaacuccguucuacugaucuagaaacucccccugcguccccccagauuugucuuagagauguccagagauuugcuucuuagaugauucuggcuccugucaagauggugacugaaaucagccaugauauuuacagagauugaaguggagauccaauucugugauugucacagaauuacacguguguaauuguauguauguauguauguauguauguauguauguauguauguauggcuaaucugaaaagcuacagaucugucaggugccaugaucacagaacuguggacuuugcuuauaccauuucccaacuggcuugauuuuuaaaaaagaacaacuuuauaugguuccugugccagagauguuguauaccuaccguucuauuaaaauguacccgauacgcuccuuuuguggcaaaggcaaucuucuuuuuuuuuauauaagauuuauuuauuuauuauauguaaguacauuguagcuguccuuagauacuccauaagagggcaucagauuucguuaaggaugguugugagccaccaugugguugcugggauuugaacucgggaccuuuggaagagcagucggcacucuuaaccacugagccaucucgccagcccccaaaggcaaucuucuuaaaauaccuuuauuaauucaguaggcaugugugagcaugcuaccacagcucucgaggagagagcugguucuguccuuccaccaugugaauucuaggagaucaagcuuaggugguggugcucggcagaaagucucuuccugcugagccgucucugcuugaccgacaaacaugaucuuagauagaggcuugccauuuucuuagcaccggagccccuuaggacuugcugacucugcuauuucucuuuuaauuuaugucauguauaugccugagugucugucuguguaccacaugcuuuaaaaaaaaaaaaagauuuauuuauuuauuuauuuuuaugacuaugcuguugcugucuucagacacaccaaaagagugcaucagaucccaugacagaugguugugagccaccaugugguugcugggaauugaacucaggaccuuuggaagaacagucagugcucuuaaccgcugagccaucucgccagcccccaaaggcaaucuucuuaaaauaccuuuauuaauucaguaggcaugugugagcaugcuaccacagcucucgaggagagagcugguucuguccuuccaccaugugaauucuaggagaucaagcuuaggugguggugcucggcagaaagucucuuccugcugagccgucucugcuugaccgacaaacaugaucuuagauagaggcuugccauuuucuuagcaccggagccccuuaggacuugcugacucugcuauuucucuuuuaauuuaugucauguauaugccugagugucugucuguguaccacaugcuuuaaaaaaaaaaagauuuauuuauuuauuuauuuuuaugacuaugcuguugcugucuucagacacaccaaaagagugcaucagaucccaugacagaugguugugagccaccaugugguugcugggaauugaacucaggaccuuuggaagaacagucagugcucuuaaccgcugagccaucucuccagccccauaccacaugguuuuaauagguauauauuuucauuauccagggcagauccuguaacacacacacagauuuuucacgucaagcuccuguauccuauaccucuugcccuggaguguucuuugcauuagggauuaacuauggcaccuacugaauuuuguuuucuggcuuuuuauuuccuaaaaauguaagugcagcugggugguggcggcguacgccuucaauuccagcacuugggaggcagaagcagguagaucucugaguucaagggccuggucuacaaagugaaguccaggacagccaaggauacacagagaaccugucucaacaaacaaaaaccaaacaauuaaacaaaacccccaaagaagaaacaagcaaaaacaaaaacaaaaacaaaaaacaaaaaccaaaaaccaguaaauguauguuagugugcaugccacaugcguacaagggucaaagaugauaucagaucccccagaguuagagugacagguacuugugagccaccccacgugggugcugggaacugaaucccaguccucuggaagaaagguaaauguucuuuaacuauugagccaucuccccagccuggccuuugaguuuuaauuucugcuuccccugcaugauucaauuuuuuuuaaagauuuauuuauuuauuauauguaaguacacuguagcugucuucagacacuccacaagagggcgucagaucucauuacagaugguugugagccaccaugugguugcugggaguugaacucaggaccuucggaggagcagucagugcucugaacagcugagucaucucaccagccuccacugcaugauucaaaaggaacaagagaaauaaagagaguuugagcauuguugaguuuauuucccauguacaacuuuuucuggugugggugaagaugggggucuaaugggcagugaccgggagucaugacaacacaauggauggaacuuagagcuggguccucuccaccucucaugggcugugggaagagcugggucucaguugguuaauugcauuccagcccaauugacuguuaucucuauccauggaccagguuugcuguggcuuucaccgaggcaaugaaggacacagcucaggugcaguggguauguauuccuccauuguccuuucuucaguggggcuuggggacaggaaagaagucaguuagaccugcugguauggcauagugguguauugcauuuccccagcguagauaccugaaaaaguucagugcaaaaacaaacuuuuuuuuuuuaaaucuugugggugaaguccagccgcccugcccggcccccccacccccuucuuuucaagauagguucucuguguaguucucgauguccuggaguuugaacacagagaucugccugucucugucacucaaauguugggauuaaaggcauuuguuaccacaaccuggcugccacucccuuuuaauuuuuuuuuuuuuuuuuuuuuuuuuuuguggaaaguggcagacauguugccuguuccgcuauuuaucaggcuuuuggcuuuuauuuaaccccaguggaggcugggacgaugcaucucucaguggguuauugauguuguccucuaagcuugaagaccugaguucgauuccuagauccgacauagggcaaggagagaaccgacuaccuccaguugucuuccaccuccacacauggcccacagcaugugcacacaccccaaacaaauacauauacauggcccacaguauaugcacacacaccaaacaaauacauacacauggcccacaguauaugcacacacaccccaaacaaacauauacauaugacaauaauacaaaacaaaaccaaugacuagugcuucaaauaacuuauuggccaucagcaaugaaauccaauucugaaucguaaagcuucaguggccgggggcaaucuucugagagugagguaggcagcgccauggcacucagguccucacacuacccugggucagccagaucugcgcgcagacaguccucuuccuggaauagucaccaggcauuugaaacaaacaaacaaacaaacaaacaaacaaacaaacaaacaaacguugagggacuggagagacagcucaucuguaaaagcacugacuccacuuccaaaaauugcagguuugguucccagcacccucguggcagcucacaaccaucuuuaacuccacuuccaggggauuucaugcccucuuaugacaucugcaggcugcaagugugcacgugguacacauauguacaggcaaaacauaaacacacacaaaauaaagaaaucuaaaacaacuuuuuuuuuuuuuaauuaaaaacugagggcugcaaagaugucuuggcuauuaagagcagaggaccugaguucaggucccagcaccagcaucaaguagcucacaacugccugcaaguccagauauaggacaucuggcgcccucuucuggccuccauggguaucugcacucaugugcacuuacacagccacccacacacauguacauauaauuaaaaacauuucauuuuuuaacauaguaaacauuaaggaagaaacacacuacucgugaaguagcuaagauggcuuggccccucccagaugagaauacaggagauacugacaaaaaccuaauaaaagaugagauuaucuuguuuccauggcugggggauaguuauuauauuugaaagugaagcuguuuuuaauacgcauuuuuuguccaggguuguggguggauuuuucaauaaaguucagcccaauguuuuuauuugauucgauuucuuuucaaauacaaauauguauaaauaauauaaagguagcuuacucagcuguacuuauggaauucuuuuagguagauuuuggaggagagacuuugauucauguaccgugaacagcagaugauguguuuugagcaauguagucuuaaucuugcuggaggaaaagccagcuuugguuuugaacuuuaugugcagacuuaacucaggcuguacuuuggguaauuguaccuaauuaguccaaagcgagaccagauaucaguaauccuaguuugaaagauaagauuacgggugcuuccacgucccuggggcuuucuuuccucuuucuccuccuccuccucccucaccucuuccuccucccuccccuccuccuccuccccuucucucccuccuccuccccgcucccuccuccuccuucuuuucuucuuuuugagccagggucucacuauguaguccuggcugaccuggaacucacuauguacaccaggcugaccuugaacucaaagaggugggcccgccucugccuccugagugcugggauuaaagguuuugaagccgccaccgugccuggcacuuugugacuucaaaagagagaauguggaggcugcagagauggccccaugguuaagagcacuagcugcucuugcagaggacccaaguucgauucccaauuauccauauggcagcuuacaaucaucuauaccuccagucccaggaaauccuauguccucuacuggccucuguggguacugcaugcacauucucucucccucccuuccucccccaaccccugagacuuuuuuguuuguuugguuuuuggguuucucuguguagcccuggcuguccuggaacuaacucacuuuguagaccaggcuguccuggaacucagaaaucugccugccucugccuccugagugcugggauuaaaggcgugugcuaccaagcccggcucgagacauuuuuuuaaaggagagaauaugugcauauauagauaucauguaugucaauguacuuuuaagcaaagaauccaguucaaaacuuaaaagugcauuuuuuuucuccaucuucauuuagaaggguaauuaaguuggguguggugauaugcuaaucccauagcagccuagcuucuauucuccuuagaaacacacuuuucuaauacaaguggagaaagucaagaugucccuuucaguucccccuuucuacgcgaaauuaauuaagcuggcaacugaacucugucacuggaggaaauggccguaccuggagacuugugaauuucucuauucauucgucucucguggcuguuucucugggauuuaaugaaaaacuaaaaggcugagaacuaaagcagcugugugugugugugugugugugugugugugugugugugugugugugugugauauuuuaagaggaagggggagaguauuaagacuccauuuuaaggcuccugagaacuuauuagguaauuugacuaauuauuugaugggaaaagccagcauccuguaagguacaugcucuaaaauaagcacggcuuuguaagagacccauuugauagaauauuacuaaaaggggugggagggggcacggcuagguuaagaaugggcugggcuguagagcaccugcuuagaauuaaccagggaggggcuagggcuucguuuagaggcuuuggaggugguacagcccuuggaugaaggguuggggcguggcucaauaguauugccguuggcucugaucugggagcagcacaagauaaggacaaagacaaaagaaaagaaggcucagaucacaguuacaaaaagaccucucauucucagguuaauauaaaaggcuaaucuucuggaauuaacuuucugccaguggaaacuccauuaagaguucuuguaauagauguagacucuaaggcucaaccggggcagcaaaaaauaaugacuuugauuugaaauuacaaaaaaaaaaaaaaaaaaaaaaaaagacuuccaauuguagcuuuuugaaaagaauuuauauaaugguuacaaauugcgcagaggaaaucaccacccgugcacacgaggcucacacaguguaucaaugcagauuacacauacauuguaucaaugcagauuacacacaaauuggcacuucuaaaagagguccuuugcccuccuguucuuuuuucauagaaaucucuuaccaagcaaggagagaaaguaacaugguaaaaccaggcaaggcuucacugugaaaacauaccuggguacgaaugggaggcuuuucuaacugggcuggguguaguucaguaggccacgggccccuaagcauguaggauguaguuccauccucuagccccacaaaacuuugguguggugcuccucuguaaugcaaguagucagaaguggagacgccccuuacacaaggucauccuuagcuaccuagcuuguuugaggccagccccagcuacuggaagcccccccaccccccaccuuuuuuuuuuuuuuuuuuuuuuucaagacagggcuucucugugcagcccuggcuguccuggaacucacucuguagaccaggcuggucuugaucgaacucagaaauucgcuugccucugccucccaaguguugggacuaaaggcaugcgccaccacgcacggcggaagcccccuuuuaaacaaacaaaacaaaaccaacaaacagagagcuugagauggggaugugguccuaaguauggaauccagcaugggaggcuuugaaccugaagaugagaggucuggagagcuggcaaaagcuggauuugaggcaugacacaagaucgauggaggcaugcugucuaggcacaggggguguggacuggaagguucugagaaaguucgugcucugaagcacugagucccuaaagaaggcaacccauguugaggguuuaccuagcaugccguuugaacuuguuauuuucucucguauaugugcuggugaggucuaggaggccacuggauaacuugucugucuccaaccccccauuuuauguuugcuuuuguagccggucucuauuaucuucuuuaaacaggagaucucauuuuguucggagguagggucuugauguaucccacacuggccucaaacucaaggcgauccucuugcuuuacucucccaagugaugacauuacaggcacccgcuccugugccuagcugagaagugaauuucgaaauacuuccuuauaaagggcuuucgaguucaugggauucucucagcgacaccuguaucagcuggaugcaaccuugaguaggacagggaaaacuuuggugggccagggguucaaaggguuaaauuuaaaacggcaaugcugaggcaaaacccaaacugaagugaacagcucuguccuggaguggaagcugccccuccucauauccguggcugguugccugucuucccauggagggucugccuggcugggcuuugucaccacgacuuguuccccaaccugauagauaaguuugagaacuagugugugugugccguuuacagugucagggccuugcuuuguuaguauguggugcugugcccccacauacauguaugugugugugugugugugugugcucgcuuguguguagaguguguauacacacgacagaaugaugaccuccggcuucaggugucacuuccugacuucaucagaauauuuaggucacaaaauaaaaauauacacaguguuggucccuauugauccuguccaggggacucuauuuugaccacagccaucagcauuugagucccuccuuugcuaugggacagaggauucccugccccucuccagcucccacuucuguccagacauuuaaugcgcacuagccccuuaucucuaaugggcuuuuugccaucuagcaggcucuugugcacuuuuaccagagacuaucacaaagaauaagaagcugggaucuugguacgaagggagaaggagagaaggaagaggaggaaggacaaaauugaaaaaagaagaagagagagagagaggaggagggaaagaaggaggaagggggcagaaaaggaaggagggagacagcugccucuggugggauucugggaacacugaaggcgcugcuuggucuugaggucaacauguccuucccacuggcugccacuugugcuuuuugggucugucucccaccucuuccuuuuuuuucuaccucccucucccccuuuucuucccucuccccauccucucuuugucuucucuucuuuccuuccuccuuuggccugagggauagggaauacccuuuuccacuuggggacaaagcaccccugaauggcacuuguccaccaccucuccuucagccacagguacacuccugggcucuggggacucuccugcauuaagcccgauuucuuucuuuguucuucuuaaaggcucuguuauuaacggcaaaacccuuuaggaauggaaguaacucugugcuccuaacaagccauuugugggugacuuagagauguuuccaaaaggguaauuuaauuaucuuggucucugaaaguguagaauggucggaccauuaaauuuacucccuaccuuucucuucccuuuuuaaaagccacaugcaacugggaagaucuuuguccagagucaagguaagaacuuuuaaauauauuuguaauauauauuuaauauauaauauguagugucuauaauuucaaguguccauauaagacauauaugauuuauugcguuuguuuuacucauuuguguucaugugcacaccacucacuggacacacauggaaguuagaggacaacuuucaggacuugguuccuaucucuagccuuagcuggaauuacaggacugaacuuguauaacaauggaggcaaauuuuugccuugaucugggggcuguggacucuucuguuacacagcauuuucaaccccucccaggaguucccugugacagugacacacagcucucuucucuaguggcugaagcagggagaacuagaaugugucggccccacaggccccucuuggcuucaucaugucacugaggcuccucuggaccucugagaccccagcacucugcagaugaacuuagaaaggucagaacugagugaguucaaggccagccuggguuacaugagacccccuagcuuauuuuucaagcucuagucauaggagucucuauugcauaacagaugugcccaaagggcugguaaaggguuuccgaaucuguguaggcagagucugguccuccccuguuuuguuucuuguccagagagacugggcuccuggugaacuggcuugaucccuuuguccggccacugucugcauagacugcaguaagcgccuaccucgcaggucuuagggcuguggguccugugcagaagguaccuaagcagcacuuucugggcaagugaugaccuugaagcaagguuagagguggguggaugauggaacuuaugaguccaacccuccucucccuuccucucuuucuucagagccuuuuucuguaaguccagcuuuccuuggaacuugaggcagccaucacucagggcugaguuuuuuuuuuuuuuuuuuuaacuuaaaaaaaaaauccauccgaggaaaugaccgagggcucgcaaccgcacaauucauugagugucgguuuuaggaauuguaagugaaggagagccuuuaccuagagcaguagaauucaagugccgauguuuuagaagacuuccugagucucuuuaaagagcucaaggucuguaccaaccaagguggucgguggggauggugguugauugggaugcuacaucccuggaauccacaggugcauucaaccugagcccaagggcccaggaaacuccuaaguugaauggauuuguaagagccaaaacuuccuuuuuuucuuuccuacucuguccaccaggaauugcaacaauaccaaaugccaacuuuaacuggaacaccuuccugcagcaaucagguaaggcguggcucccuucuuggcccuuugcgggagcaucccuccgcaucugcugucagauguuucaaagcaucuugcuggaauuggcuuuucucuuucuacauuguugcaaucugcacuaacagagugguguagccuccacucuuugaguacuccuagauguuuucuuaggaggcauuccuaaugguggguuugugugaaacuauacaauuaaucugagcuccgugcaacuuucaagagugucaccuggcagccaggugugguggcccaugccuuuaaucucaccacucgagagcagagguggauuucugaguucgaggccagccuggucuacaaagugaguuccaggacagccagggcuacacagagaaacccugucucgaaaaaaacaaacaaaccaaaaacaaaacaaaacaaaacaaaacaaacaaaaacaaaaaccccaaaacaaaagaaagugugagcgguggcauaaggacacaguccauagauggugccggggguggggguggggcuguuucuggucuguaguggaauucagagaaacucaaccacuucaacuuccauucacugugugaaauaaacucagugaugcuggauggacaaaaguuuaucgugaaaagucuuuuagauauagacuguuuagaaacaaggucuacaguauauguuuuuuuuggggggggggaucaaaacucccaaugagauugccacccuagacauuuuuggucauaaaagcuagaacaggcaaaagcugucuacugucacaagaucugaauuuuaauccaacauguuuucccggggaagccggagcucuucucuaggguuguuuaccuaugaguucauucaggugugugcacauggguguguuuggaggucagaaggcagcccauacuuuggagcuguccaccuuguuaagacauacagcucaccaaguaguccaggauagcuggccacugagcccauaggcauccucuugucucuuccuccccagcacugggauaaaacguacauacucuuuuuguuguuguuguuuuuugagacaggguuucucuguguagcccuggcuauccuugaacucacucuguagaccaggcuggccucgaacucagaaauccgccugccucugccaaccaagugcugggauuaaaggcgugcgccaccaccgccuggcuuaaaaguacauacuuuuaggccuggcucuauuuauuuauuuuuguguggauuuugcggauagaacucaggucccucauacuugcuuacugacugaaccaucuccccaggccuguauuuaguaguuuuuacaagguccaaauugugggggugcuucaacacccccccaaagauacacaggcuuugcuauaaacuuccaagauucaaaauuugaaaucagcucccccauccacaguugaugugagggcaccccaaauccguuuucguucuaaaaaccuuacuauaaaucuccaccacacaccgcaugucauccuuaguuucuguugcaaagaaaaaucccaagcauuuucuuagaaaaaaaauucaguagcgcauucaucaauccccaaugacagcggaguggcuguucucggcauuauaaaugaacccccaagaccccauugcuucuucaugucagcauguggauacaauucuucaggacagggaggggggguuuaaauugccugccuuuagguuauuucaguuucaauauauuauaggacgugauggaggcguaacugagacccauaauuccugaaagccaaacggcuuuccgucaaacuccuuagucucaggacugauguuugggcuuguagucgagugaguaacaggacagccaagagauuuaaaguacuccgcugaaggcauuccccccccccgccccccccccccccacacacacauggggcugacuuggcuaguguuccauaucacugccaacaguuagaaauuccgucuguucagaauccaugcgugcagggagacccuggcuguggcugggguagcugauuaccugaggaagacaguaaagcaagcaaggggagucgcuagaauuguuccgagaguuuaacaaucaugugugaguucccaguuguacaguugaucaacccuagugaguuuggauuuuggggggagggcccaucaucccaucucuggcucaccugggcuucuggaguuuuugugacccgagauuguaagcugauacucccuugagccucagaugaggagagcagaaguuauagaacagugguucucacccucccuaauacugagacucuuuaauacgauucucgugcuguggugacccucaaccaucaaauuauuucauugcuacuucagaacuguaauuuugcuacugcuaugaaucauaauguaaauaucugacuuguaggauaucugcaacccccaacgggaucuugacucacagguugagaaccacugauuaggauucgaugcaggcucuuggugaacaaacguccuauuauacauagucuuccaguucuuauagucacuuaagauuggagggaagcuagguagagcaggaccucauguaaccaucuauauuggugagucacggaaggucuccuuucuccuuggggucauuggccacccacccaugagcgaacagaaguagagagcaggguucaguuggcugugagcaugacagaaggacuucuagagacagcuucagugagagcauucauucuauuuuauuguuccagggguaggauguauaagggcucuuagggguacagguggaaaggauugugugaagguuuguauaugcucuguccagggaguggcacuauucgaagguguggcccuguuggaguaggugugucacuguggccguggguuuuaagacccucauccuagcugccuggaagucaguauucuguuagcagucuucagaugaagauguagaacucucagcuccucuuguaccuugccugccuggaugcugccaugcuccugccuugauaauaauggacugaaccucugaaccuguaagccagccccaauuaaauguuguccuuauaagaguugucuuggucauggugucucuucacagaagucucuucacagaagaacccuaauuaagacuaguugauuggucuuaaccuugcaccuaauuaacauaugggcaggaagcuagggugggaugugugugcugaguuaugcacacacauaacucauucuucagagaaggucaggcauuugugcucagagacacucuccaaauaagguuaggcagagaaagagaagcucugaugagaaaggaagucuuccauuuugcucugaguuuggaaagguggaccgugaccuuaauaacaggguuuuccaacaagucaccuuaaauaccugaugcuauuuuuuuuaaagauuuauuuaacauacaugaguacacugucacucuucagacacaccagaagagggcaucggauccuaugauagaugguugugagauaccaugugguugcugguauuugaacucaggucuccuggaagagcagucagugcucuuaacugcugagccaucucuccaguccccuaccugaugcuguuuuaaaagaauauguauuuauuuuuauuuuaugugcauguuucaccagcguacaugccugugacccuugugcauacaggagcugggucuucuggaagaacagccacauuccuaaccacugagcaacccucuccauccccugauacuauuuuuuuuuuuuuacagugcccucccucacucaggauguugcagaguuucugaucugcucuaucucccagccuuggcucacaaaucacuguuguaucacuuuaaaacagcaaaccagcugugugucaucaagauuccauauucuaacagauuaaugccuugccaugugcucuuuaugcucguuuuucugaugagcauacgaguauuuauaccaaguuccucauauggucagugagguuucuagucucuuccaggugcguggccaguguugcuaugacaguguucugagauucuugcauacaguugccuauaacccacauaacuaaagcaaaggaagucaugggcccucaaacccagaaccccagaaagaggaaagcuuagauccaugagguuacccucuccacuuucuguuuuccacucccuucauuuccuguugcugugauaaaacacccugaacagguagcacagcuuagaagucaaggacuuauuucagcucacaguuccagguuacacccgucacugaguuccagguuaucauggcaagaacuugaagcauauucaccaucaagagcaacaugaagaaugcauguaugcuuauauucagcuuacuuucuccucuuccuaugauccaggacccaaaacucagggaauggugcugccuacagugggcugggucuucccauaucaauuaaugucaucaacacaguuccccacagauauuccuacaggccagccuuuacaaucccuugcugagacuucccaagauuaaacuaaccauuuuacuuuauuuauauugcuuauuuaucuuuccuccuccuccuccuccuccuccuucuuccucucucucucucucucucucucucucucucucucucugucucucucucuccuucucccccucucccugaucccccuccacacacacuacuacauuugucucugccuaucuuccuccuuccacucagaauuccucuuucuugaaacaaggucacggguagcccaguuuguccuuuaacuugcuaugcaguggaggcugguccuuccuaagugcccuuccuaagugcugggauuagacguaugcuacuacgcuucauucuccucccaucuuccccccaauucuccuacccccauuuguuuuucuaugugguagagacucuugacauccuaacccguuccucuuucuugucuauucuuaagaaaaccuauuugguuucccuaugaggugagggugcuacuggaucuucaaccccccccccccaaaaaaaaggguuucuuuguguagcccuagcuguccuagaacuuacucuguagaccaggcuggccucaaacucacucauagagauccaccugccuccgccuccugagugcuaggauuaaaagcacgucccaccacugcccaacuggcucucuauuuuuauacagccauaaaucagauaccuauucuauaaucuagacuccagucagcauaacacccucugcuaaaguuuuucaagccucuucuuuccauauaguugagggauaggagaggugccaaggcaggguaugauggcucaugucaaugaucucagcacucaggaagcaaggggaaaaggguuaucaaaaauucaagucuagccugggcccuacagcuaauacaggccagcuaggguuaugucaaaugauggcacugaugacagggaaggaagccacagcaaucuccacuuguccucacgcgugaucagacagcccuuuguuuagucuguugcuggcaguggaugccgacccccccacaccacacacacacacacacaauuacaaauacacuaaucuauguuaaauacaugcauaccuauauugagauuuugccuuuuaccauguauuguaaugcuaaagugagggcccccaagacuuggagucuguauauaaaccaguggcccugcccccaaguuauuucugauugguaaauaaaaaugacaacagccaauagcuggguaaaagagauauaggugggguuuagguuuccuggacuuggggucacagagggaggacaaggagaaggcagccggaggaaggagaagcugccguggguuaggacucaagaaaacguggcccugagggcuggccaauuggaguuaaggacaucccagaugaaacauaguaguaacgcaaggguuauucauaggaaaguagacucuggcaacauagacucugacaucauuaucuauuuagcucuugugcuaauuacagcuuauuauaaauauaaaggcugugugugucuuucauccgggaacuaaaugauauaaaaauaggguagaacccccaggucagauuuaaauaauuucuacaacacaccugcugggcucacacccacacucagccuaaccuuaugagggcacggugagggcacgggcaggcuguaggcacacguuuugauuuaccagugaggaucagucacucaagcuuuagguagcaugcgcuuuacccaggccuuggcaggcccaucucuugcgguuacccuuuuaagaacaaagaacaaacgcaacacuuuuccauacgccaccaagggcuggagggugcuggccaggucacacagcaguggaucuuaaucuucccaauccugcaacuauuuaauauagaccucaugguguggugucccgccaacuauaaagucauuuacauuguuacuucauaacuguaauugcuuuuauugcuauggaucguauuauaaauauguuuggagauugagggcuaucaaagggguugcgacucacagauggagaaccccacauacuagacagcacccaaucccuaguaugccggucucuagcccuuggcucucuggcaggguuuucugagcguucaucugucugaaaauaagccuucuaucuaugggcaggcugugccagguuuuucuuugaauuuucuuucuuucuuuuucuagaagaagacgaggcaugggaugccccugucugucauuccucuaauuuaguuuccugaauucucauuacauuuaaucuccagcccagcacgaagauuugaacagcacaauggauauaggauuaacuccgucucucccucuagggucuucugggucaggaggcucaaaaucaauuuagagaguuggggggagugagcacuuuaaaaaguugaauaggaaauaucagggugccuuauacgucgucaguuugaagugugcauuucuauuuuacugauuuucauuuaaauuacuuauuuuggagagagggucuccuguagcccaggacagcccugcauuugcuguguagcuaagaaugaccuugaacuucuaaucccccugccuccaccccaaguugcuaacauugugagcaaguaucaucaccucugguuuauuaucacuugcuggccagugaaucgagggcuuccuccaagcuagacaagaccucuacaaauuguucccuagucccauuuuguagauuucugaggcagcuuaaagagacaggaggagacaggauucuaaccuuucaauacaggucauuguguuuauugguacacacagugagggggcagacuauuucccucaggggaaaaagggcagaaaaaauugcaacccauagcucagauuuccuuucuguagccccugccuuucagaguugccuggacaaagcaagacagguucucccaccaugaccaaagagcaagguugaacaagauugucuguaggaauccuguuucaagggugagguagucuaucaccagccaccugaaaucgggagggagggagggagggagggagggagggagggagggagggagggagagagagagaucacuuaauuuuuuuaauaaguaaaaaauuuuaaguaguuccuaguuuuguuuuguuuuuuuuuuaagauugauuuauuuauuuuauguauaugaguacacuguagcuguacagagaguugugagccuucauguaguugcugggaauuaaauucaggaccucugcuuguuccggucaauccggcucacuccagccaaccccaccugcucugucccugcucgcucuggcccaaagauuuauguauuauuauaaauaaguacaccauagcuguuuucaguacaccagaagagcgugucagaucucauugcagaugguugugagccaccaugugguugcugggauuugaacucaggaccuucggaagaguagucagugcucuuaaccgcugagccaucucuccagccugagagagcacuuuaaggcuauuuauuuauuuacauguguauguuuuucugugugugaguaugguagcauauccaugccuggugcccacagaagaggcuaucagauccaagaacaaggaguuucagguggcuguaugcugcagugugggacugguuccauguuuucugcagaagcagccuuuaaccauuggagucucuccagccccuggaguguguuuuucauugugugugacugcugcgugugacacucagccaucauggcuucucagcugcacuaugaugcauaucuuccuugcgagugauagguagcauccugcagaaauuggagcugaggaccauggaccggucucuucccagggcugucguuccaaaccauccgggucccaggagacaccaggcuagguuucccuaguggcaacaggugcgguaacccacuaacugggccaaauagauguucaagcaguuguuuaaagcaggugacccagguaagcaagaagguggguguguccucagcaccaugucacacaggggcacaggacaguugcuuuaccaggugcuaggucuccccaaguaauugugugaguuucuggaaugguaucuuggugcagcauuuggaucacauauuuauauuuuucucccuauucaaugaggccaauuucccaccuuggggguacucacggcucucccacugucugucuuaacucuucuuccucucauggauuuagugcaucucccuuuaucaagggugugaguagacugguguugugucuugcucuggacuugguuggauuguccuguugcugacgguaauuuuugaguacacagacucuuauaccuaaguaugcucuacauacaucuauguggcggugugcgguguauguggguggcauguggguugggcaugugaauaugcagguccugugugggggccugcagccuccugcuuuagccaagcagccuccucucugcuuuucccguguacagaauuguauucccuuugaaauuaauacgcaagucugggaagguaguuuugauguccauccccagcagauguacagucugaggaucagauccaacauuagccgcucaucucugggaacgaaggcuuaggcugccuucucauuuugacccuuccuuccccuuagauuuuauuaaggaggagagcuuaucauuuauuaaagacaaucgcuugacuccugaccuuggauuccggugccugaauuccaauucuccgaccuugagaccacaucuguagcuuccggcuccgacuuuagucaaauaugcacucacuaagguuugccugcugaggcuaguucacgagauucaaaauauuggggagggcauauagaacucucaaugcaaccuagcgauauugucaaagguuaauucagacaccguggccacuuuauauuuacauucauuaugcauaagauacauauuuucacacgcguauauaauguuuuauuuugaagauuuuauuaaauuuuuaauuauguauguguguguggguaugagcauuugggugcaaugcucaaagcgggcagcagggggcauugagugccucuggagcuggaguugcggacccuugagagccaccacaugggugcuuguaacuaaacuuagguccugugccaagguaguaaucucucuuaaccgucacacccuuucuccugccccaacauauaaauaucuuuaucauauucaccuggaauuuucuuuauuuucuuccuuuuuuuauuucucuuuuuuccuucuccccuuccccucccccucccccucccccucccccuccugcucccgcuccagcuccagcucccgcuucccucccucccucccucccucccucccucccucccucccucccucccuuccuuccuucuuuccuagccagguuuuuguuguauuguacaugcugguccugaacucccuguguagcccauccggccccaaccuugaugcuauccuucugacuuagccuacuaauuacuaagacugaauguauaugccaucacaccuggcuuagaagugugugugugugugugugugugugugugugugugugaguugaguguguggguaguacuggggaccaaaccaagauauucaggcaagcaccuuaccacugagauacacccccagcuccugugauugugcuuaaggcuuuccuaggacaaggcugucacucuucacugucagugugauucuguccagugucacucucguuauucuauuaucugugcugaccaugucugucuuaagguuuuacugcugacacagacaccguguccuuauaaaggacaacauuuaauuggggcuggcuuacagauucagagguucaguccauuaucaucaaggcaggagcauggcagcauccaggcaggccuggugcaggaggagcugagaguucuacaucuucaucugaagacugcuagcagaauacugacuuccagauagcuagggugaggguuuaaaagcccaugcccacagugacacaccuacuccaacagggccacaccuucuuauagugccgcucccugggccagguguauauaaaccaucacaaugucccucaugcacauguaugacacaugcaguaugccacuuuuauucucaagacuuaaguaagcucagaaaaaaaauauauggacaagugcccauccuggaaaagacaaccuugcauguacuugcuuuuacggccaauuacacaggcuguaaaugcugacaguuuaggcuagcuuuugugcugggucuauuaacagcugcuauuccaucaauuauauaacaguugccauaaaacaccucaagaccucagacaacuguggcuguuucucacgauuccugugggcgugagcuguugugguuuuguggcuuaaccaggcacccccugcuuguuccaggccugcuaaugcuguucccagaaugcucaccucagggcugggaccucacucugccaggaugagucucuuuaucaagacauuuuuuuuuucuaagaagguuguguggccagaugaccaaggaguaacaaggccuuucacaaccaaggcuuauaggucauauauagcuacuuucccugcguuuuguuggccaggaaaguucccacucucucucuaguggucagggguuuucagcuucaccagucauaagaagagucacaaaaaccaaaccaaaccaaaccaaaccaaaacaaaacaaaaaaagagucccaagacuggugcccacugcugucuugcuuuauagauauggcacuccuaagccuucucuguauuauuauuauuguuauuauuuugguuuuccaagacaaaguuucuuuguauagcccuggcuuuuucuuuucuuuucuuuucuuuucuuuuucuuuuucuuuuucuuuuucuuuuuuuuuuuuuuuuuuuuuguuuuuuuuguuuugguuugguuuuuuuguuuuuuguuuuuuguuuuuucaagacaggguuucucuguauggcccuagcuguccuggaacucacucuguagaccaggcuggccuagaacucagaaaucugccugccucugccucccaaaugcugggauuaaaggcaugcaccaccauguccagcuuguauuuauuauuauuauuauuauuauuauuaucaucacuauuauuauuguguauggcuguuuugucuguauguauccacagaggccugaagagggcaucacaucucugaaacuagaguuacacaugguugggagcuacuauguggguacugggaauugaaccuggguccucugcuaggaccgccagugcucuuaacugcugagccauguccccagccaguuuuccucucuguuguuuuuuuaaaaagcuauacagauaacucagcugguagagugcuugucuagcaugcagggagcccuggguucgaucccagcccugcaugaauugggaauggugguaucucccuguagugcacuugggagguggagucaggagaaucagaaauucaaggcaaguuugaggccagccuggacuauuauaagagacacuauuucguguacuacccacaagaaagaaaacacaaauaaacgagaaagagaaaaaaaaaaaaaaacuacuccauaaacauacaugucuacuuuuagaacuguuacaguuuucggagguaaaguugacaaauccaacuggcaaacgcagaaaaaaacaacaggacugggagacguaugugugcguuuccgauucccagggacauaugcucauaccuaccacgcaucugugaauuccccagucauccauccacaaagccucuuuucuaguugcuucaacuaaaacugcccaaguccuuccugggccugcugauuccucucaguaguagcuggaucagccccccacccccacccccugcccccguacccccauccccauccuucccccucuauggcagagaccuugcauuucauagcuagaaugaagcucagaccuauguaaucuaaugugugcgacaaggcauuuagagaucacacuaggggcgggaaggccagcgugggcugcugaccucuggucugcuugccucaaugccgccacugcugccggguaacuuagccauauccuccaugcccacgaaagugucccgcgaucuuauguugcagagauugaccaaagcgcugacaaccuguacauauuccuuauaaucuguggacucagaccggugaaggauccucuguaccuuguggaugcauucucagguauguguuacgcccuccucgaggugggggacucgcaaguagagaugugccuuggcuuucuguucguacuggccuccaacucucaauccuucugccucagcaucccaaguguaggaguuacagugugagcuuucaugcccagugggacuuuagcccccacccgcuuugcuuauugcauauaagcagacuguuccuagaugaucacuuuggacacagccaguauccauuugguaacuuacaggauuaauaucucuguguagacuugcagcuucacgugugaaggaugucagacaaauuagaaauaauuaugagccuaaauuaauuaaaaaaaucuuaccacuuuuuauaaagauccauuuauuguuauuuuauguguuugucugacaguguuauauguguaugcaguaccuguggaugccagaaggggucaucagaucccccagaauuagaguuacaggcaauugugagcugccaugugguuguugggaacuaaguucugauccucugcaagggcagcaagugcuuuuaaccaccgagccauugcuucaguccaaaaagaaagaguucuuuauguaaaagcauacagugacacauagguguucuaaauaaaugaaauugauucuggauagacugaaugaaugcuuaaugaacuaagaagacaaaacucaaaguggagucauuuguaguuaagcugaauuguuuucccagcugugucuugaaagccaugggagcuccauucuaaguccuuuuucuucuucuucuucuuauuuuuuuccuuuuccuucccaagaauggcaucaagaaacacccaauguuuacauggugaucguagguccugaggugaguucaugggcugugaaugccuaucugauagcuguuuuuuuuccucuugacuuuguuuuuguuuguuccuaagauuuauucauuuauuuauuuauuuauuuauuuacuaaauguaaguacacuauaacugucuucaaacacuaagaagagggcaucagaucucauuacggaggguugugaggcacuaugugguugcugggauuugaacucaggaccuucagaagaguagucagugcucuuaaccacugagccaucucuccagcccauugacuuuguuuucuuuuucuuuuuuucuuuucuuuuuuuuuugguuuuucgaaacaggguuucucuguauagcccuggcuguccuggcacucacauuguagaccaggcuggccucgaacucagaaauccgccugccucugccucccaagugcugggauuaaaggcguguaccaccacgcccagcucugacuuuguuuucucaaguuguguguguguguguguguguguguguguguguuucccauuguggccagcagagggcaguguccuucuauacccagauucacaagcaguugucuggugcccaaugugggugauuagaauggaauucauguucuuuguaaagaguaguauauauuccaacugcagaggcaucucuccagcaucucuucugucgacacauuuucuauaacugguuuauguuccucuucuacaugucuaggcauuuuuuuucuuuaagaaacugaaguaaguuugcuuuuuuuuuuuuaauuagaugcuauuauuuauuugugcuguauguguguguguguggggggguauucauguaucauaccacacacacagaggucagagaauaaccuucaggagucuuucuccuguguagaucccaaggauugaacucaggugucaggcauggugguaagcaccucuaaugacaagcuaucuccuuuggcuaauaauuuaccuuuuuuaaaaaaugaaaaguaugaaaaacaaaaacauaaagaaaaguauggagcuggagagauggcucaccuguuaaaagcacgagcuacuauuccaaaggacuuggcuuugguucccugcacccaaauggcagcucacaaccauuuguaacuccagcuucaagggguccagugccuucaucuggcucuucaggcaaugcacacauguggugcgcaugcauuuaugcaugcaaaacauguuuacauguaaaauauguuuaaaaaaugaaaaucagccaggcagugauggcacaugccuucaaucccagcacuugggaggcagaggcaggcagauuucugaguucgaggccagccuggucuacagaaugaguuccaggacagccagggcuacacagagaaacccugucuugaaaaaucaaaaauaaauaaauaaauaaauaaaaauaaaaaaaaauuuaaaaaaugagagaaagaaagaaaaccaucugaaucauaucucagugguagagcacuccccaaaguugaaugugcaaggccuuggauucaguucccaaaaucaugugggugacaugugugugugugcgcccgcacacacacacacacacacacagaaggggggagguagagggagggagcgagagagggagaggggaagggagggggaaagaaagagggagggagagaggggggagagagagagagagagaaagacagagagacagacagacagacagaaagaaagaaagaaagaaagaaagaaagaaagaaagaaagaaagaaagaaagaaagaaaacaggccaaaguuaaagauuauaucuguugaucucuuauauggcugauuuacuguaaagauuacaauuaauucaaacuaauuuaugacugcaaaggauaauuagcuacuucuuaugggaaagccagugggucauaugaagaggaacuuauuuuaaaauauaaaagacaaaguuuuucuaagucacugcauaagucaaacucuaugaaugguccaaaauguuucaaacuguggaugcagaagugauccugaacccagagucagaucaugcugcuggcugcuguuuagggaccuugugcuguugggcaccggcacacauacacacacacacacacacacacacacacacacacacacacacacacacacaccaccaaguuugacauuugguagcucuagccaggaaacuuacccucucggcccuguuuugacucuugcaagacgcauggggagcagacaucugccuaucuccuagcccuccucaugaauguggccuuuuguuugccccagagaaguuuggaaaaccaaguguacucugugcuccuagccgcauggcucucuuccuguggcuucuguucuaggcuuuccacuguguaucuguuccuucuaaacacggcuacugaaauucuuuuugguaauguaaugagauaaggccucugugagaugcccggacccaggggauggagggcgcccucaucaaugugaucagggcccauauaaaaggagccccagggagccaccuugccuugccuuuauucauuguguguggacccagcaagaggccaccaccuaugaaccaggaagcucaucucagggggacaccuagccugcuaaugcccuaauccuggccucuuaccuccccgacucccugcuaaguuuguaggacacccaagugacaguacaucaaagcagugcccugggugagcugagacaguuacgucaucugcugaguagaauucucaucugugcaggaugagccccccccccccacugcuuuguuuggccagauggguaauaggcaaggugggaguguuugcuaauggacacccugacagagaccgagaaaacuaauguguacaaguccgucuuggugaaccaaugagauuauuggugacaggagcggggaggacucaaaggcagcuaaaugcaucaucaaacccccuauccccgagccuggaugaugauacaucccuaaagcucccugcccaacuugcccccagcucuacugaagggugcccuccucgccagcaacugcuucugcgaccucaggaggcccagugaguagaguggcuagcuugugucuccccuaagccuccacccaggaggaaaugcuucgaucugaaggaaacagauucuccaauauugcauucauugaguggcuagccucacguucacucacucccucagaagcauccccugccgccccccccccccccccccagggauugcuugauaucguuucucagacucucaucuauuugucuuauuuuaguucccuguggaccuucccagcaugcacagcuguucuuugcauucucccagacuuugggaauaaucgugucuaccucucagaaugaggcaagaagaugauaauaaagacaaacuaagaggggaggggcugguaaaacggcucaguggguaaaggugcuugcugcuuagccugauggcucaaguucaaucccccggauccacaucagggaaggagagaaccaauucccaaauguugucccgcgauaugcaugcagccagacauauaaaaaggauuugaaauauacuuuauacacacauacaaaaacugugcaaccgugucagaggccacccacagcaacacgggaucucgaguuacucucaugacagagugcauaauacaacaaacauuagaaaccccguggucuuaaguaaaaaauuccaauacuuuaaaauuucaaagucucuuuaaaauagcgaagcuucuuagcuguggcuuccuaccaaguuccaaauaaguuacacacuugucauuuuuaggcgggaagaaccagggcucaguuagcauccgagcagggcagaaccaauccccaacacuguucauuguaaacaguucauuguccaacaucugggacccucgugaagcaggcucuaagacacguaggcagacccagcucuagguucugucacuguccugcauacuugggugagcuccacccaacaccugccacugucccugaguggucacuauugucuggcaucuucaauauucuggaaggcuucaacccuuaccagugguuucucucacugccuagccucugccucucccucucuccucucucuccaaccccccucucccuucuccccauuuccccuucuccccucuccucucuucccuucucccccucuuuccauuuccccucucccccucuccucucucccuucucuccccccccccccgaacucccccccccccaacucuacagucccgagaccgccacugcaacugaggcuguaccuuuucuuucuggccucuguuuuagggcuguuuuuaucuuccuuccaaacgcugugacccauuaacacaguuccucaugcuguggugaccccgagccaugacauuauuuucauggccacuucguaacuguaauuuugcaacgguugugaaccauaauguaaauaucuguguuuuccaaugguuauaagggacccccaugaaagagucauuugaugccacccccgccccccagggucacgacccacagguugaggaaugcuguuucagggauucuggcccugccucauggcaucaaggcucagauucucuccaugaccccuucaagccuaaagccucuguuagagcugaggcgauauaccuccaccaaugaucuucuaaccucucugaagggacuccagccccgccacagguuguucuaagucccacccucccaggaccacgguuuacaccuaaguuugacugccagcuugaaccucgaagccucggccuccuggaccacagcuucugagugccgaccccaccuucuagaagguguuagugucuccuaaauaaaucgcagcugacuuuucugucccagagaaucaggaaccagagacuugcaauuucaaaaccucacaggaaggaaugguccugcuaguguuucugagagacucucaaccucuccucagguaccagugagccgggucuccaucauguaugccgcucucggcauucuccuccaaccucccacaacagcaaaccagcaguacucaauggcuccuucagccccaaacuaucaaauccuuccacaauccuaccaccaaccccccccccccaaaaaaaaaaaaaacaaaaccaaaggacaaauaaacaacauggccagcaagaugcagcucucugacuccagcccuuguuuguuuucugccccugggauguucaccaucauuaaaaucagcuuagacagggaaaggguucauuugacuuacaguccaucacgaagggaagccagggcaggaacucuaauggugcagaaacugaagcaggggccauggaggaacgcugcuugcugcuuccgggcuugcucaguuaguuuucuuauacaacccaggaccacccaccuaagggaugacgccgcccacagugggcugggcccuauccacaucaaucgacaaucaagaaaaugucccacagacuuguccacaugcccgucagauggaggcaggucaguggcucucccucccaaggcuuguacgguuguugcuccucuugagaugagauuccucagugauguuucuggcucagguccggguccucagauacgcucuucugaccucucaauacaaacucauucuuuaccauucccaaaccucuccacgucuguaaugcucacgcccaagugcucaguuuauccuuguucugaagucuggaacaggaggagacuuaagccacuuuguacuugacuuugaguauuugcugcaguaucagggacucguguacugaugagguggguuugccaaguguccacaugucaggacacauuaaaauucuucuuuuaauggccaaagcauacagugcauuaauaccgacccuuacccucccauaucuuccugucuggauccugauaugagcgcacuuucuucuaguccauuucuugcucucugcagagcccgagucucaaauagcacuuaugguguaaagagggauggacgcucagcaggcuuacuucgcuuuuccaggucacauccuaaggcuuguugcaaaauuguaucaacuuggcuagaucaugaccagugaagcagucuagcaguuacuguggaaucacugcggcguucagcagcaacuaccucugccaccuuccaggaaucccauuuaugggucagacucuggugaagacacuguaggcucacugacaugccucaucuuaagagcucaacgaggaaaucauugggaauaagcaugagacagcucacugggacaagggucacucaaggcugggcgccuaagauuuaaaaaaaaaaaaaaaaaaagagucccucccacuuugcuucuaagaccugcuguuguuccagguucaggaagagggugucaggguguccuuuaauagggagagaggaccguucugugaggccacucaccagacccuguucaguggggagaagugaggaugagccaggagcuggugggcugagacgcgggguugcauggcaauggccacaacaacagaaucccaaacugucuauguaauacacacauguuguuuucaagauuuauuuuauguacaugaauguuugaccuguacuauggauaugcagcacaugggugccuggugccugccguggucucacuaccaugaccugauggccggucaguuaacucugccccgucucugggccagaccugccucuguguugugagaaaagcuaggucauauggcuugucugaagggugacaugcccuucauugacuuugaugauaguuaccugacugcucuugacuuaaccacgugccucaguuuccacgucugcaaaauaggaaugauuaagacaguaguacccuucuuccugguccaguacuaaugaaagcgaacucuuccuguccuugggggaguguccugggaauacaggaagcauaagggacuauuaaagccgauguucccuucccgcucugacugccgggauccuguucuagcugcaggaugcucugaauucagcguggguuuccaauggaugcuccuuugaucucucaguuucucuguuugagagaaguguucccacucacagggcaucuuguauggcaccuucccgagcucuuugaugaggcgugcuggaggcgagggaacgcuugcuuugggcaugacagccuaaugacuucccccagcaacuucuuaauagcaaagauuauuuccccuaagccuucgaguugaaacaauaucuuuuguuaggaaauaaacaagcuuggaaggaggaaaugagaauucuucucuugcugcuuucaaagcuuuccuccccacccuccuuuaaaaauuucauuaaauaaaaacauccacuccuccuuuccucuuuaucuuguguuuuguuacacucggcuucacuaagagauuugaaagugaaccgauguggaaaguaaacccagagaaagccggcgucgauuguaguuucaucuuaagacuuguuuuucacuccuuagcuauguccccagcuuugcauucuagccgucucggaacacaacuuguauccuugacaaauuaucuuuccccagacaguucaucuugagagccagcgcaugcuaauaaagacaaaaagaggacugggcuggcagaaacaaacccauguaaaaaauuuuaaggugaaaauuaacauguagaaggaaaggcuuucccuuuuuaaauauuugugugugugcgcgcacacacaugcaugcacgugcaugacaugaugcaugugucuagagaucaaaggacaacuugcagguauagguucucuccuauagugucucagguuggggggugguguauccccgggaacaagcuuaggucauugugcuuggugauaaccaccuuugcccauugagccaucuugccagcccagaagggagcuuucccuggagggcugacuuucacauuguaauaggcuaggguugugcuggcaucugguugcuuaauaauuugagcaugaggccucaggagugggaagucaaaaggggguucucgugcacaggacuguucuagucacugcgugggagccagggaaggagaccgaggugcagcggaaagagaggcagagcggaaagagauagugacccugggcguggcagguagcaggcaggauaguuugguguggggaguuguggcuucuggccaggacugucagggggagugaaagcauuuuagagauaggacacuggcugcauccuagaggaggaugacuccuggagacugggaugcagguuggccagagggagaacagugaggaaaguggcaggaacuucauggguuuuuauaggcugcaugcgcgugugugcacacggauaugucuaugugugccugugugugcacgugcucaugggcucacugcggaugggugcaguuuccugugggggaccaucuaccuuuuuuguugucguuuugagaaagggucugucguuguccugggguucacagacuuggcuacuaugcuuacucuccaggaaggucaaguguccuccacuccuuuccccccagcuagaaauaugagcauguaccguaauucuuuauuuaaauuauuucuuuugcauguaugugugugccugauuauaauguguguguucauauaccuacauauacccuauauauguguguguguguguauguauguauguauguauguauguauguauguauguauauaauauuauucaccacuugaguauaggggcuccuggaggccagcagaugguaucagaucccauggaacugcaguuacaaaugaugguuuugaguuggccagcauggauauugggaaccugguccucugcaagagcaguuaguacuauuaauuaaccacggagcuaucucuccaucccugacaccuagauuuucuuaaaauguggugucuggggauugaacucaggucuucaugcuuacaaggcaaacacuuuaccaacugggccaucucuccagccucuguuccuugagcuuuguaggagagcuaucugaugaaacuaaacagaaccaagagaacuuggcuuccagucugcccagacuagaacacuggcccaaucguuuuccugcucugggacucuggugaaguuacacaaccucuuugaguccuccuguauagaagcguucaguaaugacauuguugcuagaacuaaguaaaugguuuuaaagggcuuagcacauguuuuucuggcuuagguggccacugaguauuaauuauaaacagcuaaaacaguagcaauuuguuguucauagcuaugagcucuucucugcacagaucuuccuagggauaauugcaaauucuuaugcauucauguuugauauaauauaaccccaccaauuuccaggcacauaguggccccagggcugucaguaaauguaacaccaucaguccuuaagcaggcauccuaacaguuggaaagauucaaggcccaccacacagugcuuccugucagaagaaagcgaaacaguguuucuagacaaaggcauuauaucaccuggcauuauaaagcgagcuguuccggcauuugcuuucagcuagccagcgugcuuguaauucaugauggcuauuggcaccguguaaaugagaacaggaauugaagcuacuuuccuugcagccuggcuggagccauagucaggaggggcugcuagcaucccgaaucccugagcuggguucacaaccuugcugugucuuugaagcaaggucugggcuuaaaaaaaaaaaaaaguuuuaaagauguauuuauauuuucauuugugugugugcaugcaaaugucauugagcuuucuuucuucauuccuccugaaauaaguuuucuuuucuuuucuuucuuucuuuuuucuuuuucuuuuuucuaugugaaucaugaucuuauugugcaugucuggaugacucccuacauagaccaggcaagccucauucuuacaagagauccacuugccuuugccucucagauauugggauugaagguaaaugucacaguccccaaggagcugaagggguuugcagccccccuaggaggaacaacaauaugaacuaaccaguacccccagagcucccugggacuaaaccaccaaccaaagagcacacguggugggacucauggcucuagcugcauauguagcagaggauggcuuaggcagucaucaaugggaggagaggcccuugguucugugaagguucgaugccccaguuaggggaaugccagggccuggaaacaggaauggguggguuggggagcaggggaagcagggaggggauaggggguuuuuggaggggaaaccaggaaaggggagaacauuugaaauguaaauagaaaaaauaucuaauuaaaaaaaaaaggugaaugucaccauuccuggccccuauuuuuuuuuuaauuacauuauuauugacuucuuuuuuuuggaggaggcaggugugccauggugcaugugaguccuggauuuucaccucaggucaggcuugauggcaagcaccuuuacccacugagccaucuuuaucuuggugacacuagaguuuugugcugaagaaugcuuuuuuuuuuuucaacuguuugaaaaucguauucacggcugauaauaguggccaggugggaggcggaggggccaaucugacgggaguuagucaguuggguguagccuguuggaugacucagggaagaguuuguggugaguugcaaggagauugaugagucuucugccucagggaagggaacugaccuugaacucuguauggagcaugaccuugaacuucuaacccacuugccuccacccccaguccuguaucacaggugugcaccuccaagccuagccuaggagaauguuuucuggagucugcuacugcacaauguaguccuuucucuuugugucugaauaauacucacauggauaaacacguuuuauaauucaucagccuaggggcgugcccuugcuuuuaaaacuguacuucugagagggcuccugaaagcaaaccucaguuccaugggcugcuuugaugaaggcuucccacucguucccuugauugcuuuuuaugacgaauuccaucugcauuguuuaagaaagcaagccuuuccccgaaggauuggacaguuaaauuguccugucaguaggcacucuccacuauccuuugaagcccuuggguuucccugggcucuacguucagagaggaugucacacacagacccugcccacuugucuuuucuuaucuuccuuguguaagggcuggacuugggcuguucgucucuuucuuguauauucuuccuuucagaacuacugggugggcuuugauccuguuaggauucgugugcugaagacuuagauuuagguaaggcuugccccagccccagacaaagucuuucaaauaucccgggcugguuuggaguuugccacacaguggaagauggucuugaacucacuguccuuuugcuuucuugcauguguugaggacaccggcuuuccauuaucacaccugguuuauagagugguaggaacuggacuuagggcugugugcacgauaguuaguugcucuaccauucagucccaccugcauaauuggauuuaaaaaaauuguguguguguguguguguguguguguguguguguguguguacacacgucauggugcauaugugaaggcagaggacaaugcaguuaggagucaguuaucaccuucaaccccgugaguuucugggaucaugucuagguccucaggcuuuugaggcaagggccuguaccugcugagccaugugccacuuuuaaggguuucuugucccuccuuuuuccagguagauccaguguuuacaagggaagugaaagagcgggugaggagguaagaaugacgggcaggggcaccugcaggucgacagcaucuugcacacugggaauucuguguggcagagugagcaguucaaggagccccagcuuacugaccucugauucugcucuaagcaggguugaaagugcagccuccuauaauguucccugugaccucccaaggucaugcuuuggguuacgggguagaggccaauaaauggacucacucaaaguguaagacacucuaucuccuuagucaucuggggaaaggccagagcgaagcacuugguuucggcuaagggucuugcugcagaucccaggcuggccuggaaucagaagccucuaugugacugggcccuaggugcacgccuccauaccugauuuagugaagaggucuugaagaugauaggguuguuuuuguuuuuuguuuuuuauuuuuuuuuacuaaugacacugggaaaaaaugcaauuauuuaaaauaacaaagauuuggggacuggagaaauggcucaguugguuaagagcauugacugcucuugcagaggacccagguucaauucccugcacccacaggauggcucacaaucacuuguaauuccaguuccagggcaucuggaugggaugccgucuucuggccucuguguguaaugcagucacgugguacacacacaugcauucggucaaacccugauacacauaaauaaaucuuaacaaagauuuggaaggaugaaggggcguccuuguauuuagcugaugacggugcagacugcuauagucucuuuggaaauacugaucaguguaucugucuaaauugcauuuuuuuuuuucugccaauaauaagggacccaguuucacuugauauacaaguugggucuuaauuguuuauaaaauugaguggggcugagcugggcgugguggugcacgccuuuaaucccagcacucgggaggcagaggcaggaggauuucugaguucgaggccagccuggucuacaaagugaguuccaggacagccagagcuacacagagaaacccugucucgaaaaaccaaaaaagaagaaaaaaaaaaugaguggggcugugaacagggcugaaacagcugcgcuaccucugcucuguccucuucagggcugcaggggugcggcugauccgagagaugugccaggaagaucugcaugcaguggugaagagcugcuuugcgcuggucaacagcuccgucuccgagggcaugucagcugccaucuuggagguaacugcagcucgaaugcccaggaugugguaccauucuuucucuucuccaauuuuuaaaaaggauuuauuuaaaaauuuuaagugacacguauauauauauauacacgugugucuguguggucguacauacaagugagugcaguugccgguggauaccagaugagggcgucuagauaccuuggagcaaguaugaauuugcaucaauugcucuagaagugcaugacacgaucuugugucaucuuuguguccggcaaagaagccuguguucugugauaacugucagccuuggucgggugcucagccccagccacuggggugguuugucgcccccagaaacuaacuuuuaaaccagaguagagaaggugcccaauuguucuuccauacacauuccccucucugcuccuauuucuuaagaaaaggccaagggccugaaguuugcugaaugguuuucugagcagcacacccugcuuucucugugucguaacugcuguggcacucggcuggccuccuaggaaaggcagcugcuagcaauuccgaugcucuugaagcgucgucgcuguggccuuccuuugagaaggcaaaauaaccuuugcgagaccggcucugaaagaaguugauuuuagggggaguggucagcgugucucuucagaaucccuucagauggccagcguguuaaucgcggaacacacgcccauccacugggccaggaagugaacuuuugaccuuuccgaaucugcuuucgggagcaggcaaguacaaaugaccguuggcuaaaauacacgcuuuucgcagaaaaaaaaaaacgugucaagagcaaaugucagccagaugcacaguaacccggugauuauugcuaaaagcccgccaggccuuucccacucaagcauaccauggauuugcaauacuaacacccccucaagcccccgcccaguagaauuaccuuaaaggagggagauggagagauggcucaguuaguucagagcuugcugugcugaguccaaugcccaggacccacgggaaaagccaggcaugguugcuuugugaguguaaucccggggauggagaaggcuuggggagacagguauaccccuggggcuggcuggacacucagccuaauagaggccagcgggagacccugucucaaaaaccaaaacaaaacaaaacaaggugggcgguuucugaggacggccacgccaaguuuuccuuugucuucuacacauccgcacauacucccccccccccccgcccccccauacacaaaggguauaaagggcugucuucauauucccaguuuuccuguuuggaccaccaacggagauguagccaacaugcagaccagaccucuggguuagguuuugggaccuuggugggagaaggguggaagaucuaaagcuaagagcgagcaggagcgugcuugacuauagccagucacgcuagcucuagugauuggaaaaccuugaaggacccuguaagagaguuuuaaaaugcuugugccauuuuggugccaaaguauggggggugggcggugagauagagagagauugauuuuaugugggggcacgggacaggaccauuccuuauucuuuugaaaagcaagccaaagcuauuuuucaagugucagaacuagaaagacuugcuaagggcaugcauuugggauguggaagcuguaaggaauuuugcaaggggcuggguggucuuugcauagacgaaauacacugccagccggccacuggccaaccucacccaagccacucuccgcucaguucugugaguuuguagggacaccuucagaucaagacguucucccauacuagcagugaucagucagaauggucacccaugccacaaagucgcagcaaauccuucuucgagauaauagagauagagauaauagagauagucugacucaggacugccuggcugcaaucuccacacccugcaggugagcugagcaucccuaaagccuggcuguucucuuuuuauggggugcagguuccagcagcuguguuccucaugccauuggaagauaaagacugguucagccagguguaguauauagcacacaccuuuaaucccagcacacuggaggcacaggcaggugaaucuaugaguucgaggccacccuggucugcagagugagguccaggacagcuaaagcaaggagaaaguuugugucaccuccccacgcccccaccccaggcagcucuauuaagggucgggggcugggccacagguauauuagagagcaugaaggagaaggucugcccaccccacaagaggagcuugaucuagucuagggaggccaggugaguccguuuuggaaaagggaagcuguaugucucauguccuggcauuuugugugucugucccccagugccgggcucugccccuccucugucuuucccugccugcucugugcauuuacucugaacucgagcaggccuauuuccaaacaccgucuagcgcggggcugugccagcuccggcucugucaggaccaacuucccaaaguguucgcagauucucagagcuuagcucuucucagaguuugccauuuuuuuuuaaaaagagauuuauuuuuuauuuuaaaugauagacgcucgugggugucugugugggggauuguacacaugugugggggugucccugguggccuggaaagggcgcuggagccccuggaucuugagucaccagugauugugaacugucauucagcuuggguacugucggcaaccaaacucuaauccuagguaagagcagcgagcacgcuuaaccucugagccaucucuccagccccaacccaaccaccuuagguuuuugagagagggucuuucacaaccuggagccugacaaauaggcuggacuggcuggccaguaaguuccaggggucccccugguuuggucccugccaccgcacccccagaauugagauuauagguaugcaccaccaugccugguuauuuauuuauuuaucuauuuuaugagaguuccaggagacuggacucagguccugaugcuugcagagcaagcccuuugccaccuaagccaucuucuuccggcccccuugccugguucucagaugcuaccuucauccucauuccucccaucuucgcaggcaauggauuuggaaguucccgugcuagccaggaacaucccugggaacucggcugugguagagcacggagucacgggacugcuguuuucaaacccucagguaaagagaguccuuuccccuguguuugccucauuggugugaguucugacuaugugaagaaagcucaugaauucgggguucuucuaagccuccccgcuccugguggagguagagccguccaacguacucagugacuucuuuucucacccuggagggacacgcagcaucuagacuuccaggguacuucugacccgaggauuuuagcucagccggcugaacguucgcuuggcauguauaaaccaggcauggugguguaaaccugucugucauagaacauucaggccauuuuuaugaggauuuuuaggaggaucggaaguuuaaggucaaccucuguuauauagcuaguucaagacuagccuacaugagaucuuaucuaaaacaaaaccaaaacuaaccccacaaacaaacaaacaaacaaacaaaacaaaaacuaacgcacaaggacuuugcuggcuagucuucuccgaaguuguugucugggggcaggguggaguagaagaaaaggucuucuagcuaccugaugccuugugacacaguguauucugggggcugggggcacagcacccugccucucucauguucagguccucucaggugagucuuagucccugagucacagaggcagcccaaaccucccaucccugucacugcagaacuuagaacuuuacucgcagaugugucuggacccaccgucuucacguuggcuuuaccgacggauguuuagaacagcagcccuuccuaguucuguguggggagagcugcgauucuucacacuccgaaauagugcgcgagacacggaugucacacguacccaguguaugcugggauauguugcuuuaaaaacaaauaacgcaagcuuuaaggaacuccaggcuggcauuggcuuuaaucaaccacagaacuuagacucggaugcaggggcagcuagagcaauuucaaauaugcauucaaauauguaugagaaccagcacuucauuuauuaagaagaacuguccugucagaccaccggcuuugggaguuaaaauauguauaugcagugcauagcacauaaauaaugcguaagcauaaaugcucuuugaagucaagcuaaauauaguuacucauucugcguuaacuguuauuccuuaauugagaacauaaagaaaccugguuuuccaauguagggcuggaaauaaaagacugaagugcucagagagauugggagauuggggccugugcaaggggguggggugcauggccagaaaccuuggccagagucuggggcucaguggauggucagcaaagaaggggggucuuguuuugcggacuaugaaaguugaauuuguccaggcaccauguaagagaugagggcgaggacgagggaaaccuguggaucauacaucaagccuggguguggagacugaagaacguggccauuuuagaugcugggaugaggcucagcuggcagagugcaugaagcucugaguucaagcaccagcauugccugaaacuggacauggcaguacguaacuacaaaucuagaacucaggagaaguucaaguucauccuuggagacagccgugcaguccagggugcccagccuuuaucucuuucuuuguuggcacuuuccuggcuccaaccuucuccucagguacccuuuagagggcucaacccuucaaagugacagccugcuagugggaaauggagauuuggugcccgcucacuuucaggauuugggccucugccggcucugguucuucagcaccugagacagcacccgccccuaagccuuuguucuuugacagugagugguaaaaagucuuacacucaccccugugacaggagcauagaaaagacucuguaaggaagggguuguauuaguguucuauugcugugguaaaugccauggccaaaagcaacuugggaaggaaaagguuuugugugccuuacgcauccaggucacaguuccaucacugaggaauucagggcaguuacuggaguaggagcaggagcaggagcucugcuugcuggcuugcucagccugcuuucuuauacaacccaugacagccuugcccaggaguggcaccgcucauagugggccccgcucccccacaucgaacaaaaacuaagaaaauucuucccagggaugcccacaagacaaucggauggaaacaguuccuuuauugagguucccucuucccaggugacaaaaacuaagcaguauggagcauuuguuuggggaucuuacaaggagauccaacugaagcaucuaccuuuacauaucucuccaugucuauaucuaugucuguaucuauaugcauaucuccaucuuucuaucucuaugucuauaugcaaucucaccauauagcuaauguagagguauaucuaucucucuauauauaucuagauaauauaucucuauauuuauauuccauacuuaugccuauaucuauuauuuuuuuuaucuaaaaaguugaugacuaagcacauuucacugucgggacagaauaaucucugguuuuguacacuucaccucuggaaaauuucaauuugaaggaagcuucccgaaccggcucagcauugauuucucauuaccucaacaaucugguuauuucuccauuuaagaaggaaggaguccagcggcuuuccuagguguuuuuauagcucaguuuuauagcuucaaaauuaagaucuauaugacauuuaauagaaaucgugaauucauauucugccaggguugggcucuucaagggcgacucaagcugaucugcuagguuuucuuuuuguucuuuagacaacuaucaagaaauaaauuuggggauacaaauggcggugguggcuaauguuuauaaaggacaugcuguauuugagcuccuauucuuaguggccaacaugacauggcuuaugugucucugucucuguuucucucugucucucugucucugugucucugugucucugucucucugucugucucucucucucucucucucucucucacucacucauaugagacaggguuucccuguguagcccuggcuguccuagaacuuacuuuguagaccaggcuggccucaaacucaaagauccuccugccuuugccucccaagggcugagauuaaaggugugagccaccucuguacagccagcuuauguuuaaaauacacacacacacacacacacacacacacacugucuauguagcccaggcugucuucaaacucacuauauagccaagcaugaccuugaauguccgauccuccuguccacuccgucccaccucccugcugcagagauuauagauggccaccgacacacugagcauaugugguacuaaggaucagacuuaggccaaccgugcaaucuaucuacugagccgcacccucuucucaaggcuaugccuuucuuaaagacaucuuuuucuuuaagcagggauggcuuugauuguguuuggggaaagcaagguacucugggaaaugccauucucaaacuuguguccuaccuggaagguagcagcgcucaggaguccuguucccauuugaaauccacaguggcguguaggcacacucgguugugugcuguuccuucauccagaagauggagauaagacucuuccuuuuggaaguggcagaugccgugccaaucgcuuugaagaagauguuugaaucauugaaucuagagagauuucacauugaaauuuagagccagcaggaucgcucaaugguaaaggcacuuagcacugagccuaaagauuugaguauuagccccugggaccuaaaugguggaaggagaggacagauuucuguaaguuguccugugacuucuauauguuaaaaaaaaaaaaagugcaacccccccacccccccagaaguuaguuaaacagucaguaagcauccaguccccuaucccugugcauguggaugcucaccggcccccagcggaauagaccaggacuguaguguuggacagaggggcccugggccuuggcuggguuucucggaagaguccagcccaggugagggauguagaaaugguuacauaggcacacgaaagcuagcacucauucagacauauacuuaugcaaauaugucccauucccccccacacauguugauaggugcucucaccucuuucugucucugugacucugucccccuccauuccuucauccuccccuccuucccccucccucccuucccccucccucccuuccuuucucccuucugcuucucaccuaacaccuuccucuccccacacacaaagugaagucucucaaccuuuauccacccugguuuaucaggagaagggacauuucccgacugaggcccacagcugccccaugcuggcaacagauggcacagucuggcagaacugaagccccuagugacccauggaaccugggcuugaugaauguggcuggauagaaagggccaccagauggggcucaugccucaggaaacauggaaacugcaccuggggugagcucuggccuggaccucagcaucucuuaggcuugguguaggccugaguaccaaggcauugagggcaacaucaggagaaucuugcuugucaagaagucucccaaaacacgagggggagaagguacaugguuucuuuagugaccuccaugguguccuuaccaucuucugcacagucaccugccgacucgcaaacuugccucuuuguugcugaagaagcaacgaugaguuagggaugggccugcaaccugggaaaggagccagugugacccagagggacagaaagggaaggguucucuuuccuuccuucccuuacucuuucaguacccuguacuuacaucuaccuguacccuaugagggcucaaccaaucccacugcaggauccuucuucaagcacagagauguguggauagcuuugguacccagguguagggcagaucuaauggcauccuugccccuggcugaaucagagcagaacaguacuguuccaugagaggucagcacccuggaagucaucaggugucccuuagaggacacccuugggcugucacuggaaggguaaugcuggaggagaaggagggggcugcaagcaggcucagucaccugccuggugccucugcuuguguuuccuacuguccccacguacugugaauucugccuccacgacagagccgaacccagugucuauugugucccaucucugucagguagcacuugauccugauagggcuauuuaucucagcagccacuuccauuguagugccuuuccuggcccugagcaaaggaaccuguuugaaauaguggagauuagucacaugucugagaacaccacugugcuucccauuuuauacagggagugcuauaugugcuaggcuauacugccuccacccccccaaccccccaucacacccaccaugcucuccucugcccagacccacugguuguggcccacaggggcuggucucugugcagaauggccuucucaugcuagcuccucugcuggagagcucuucuuggcccagggaacagcuggcuucccaccauagcaccagauccacaguuuuccuuccuucuuuuaaucaucugugaaugagccagcugccuccucauccaucccaagcuccuggaggccagggcugaaagaugaggaggagagcuguggaaugcugucugcugggcaggaugugguccugguacccacgaacuggcaacggcuaugugccuugguuacguuccuguuguggugauaaaacaccacgaccaacgcaacuuacagaagaaagugguuaauuguuuauauaguucuaaaggcuuaguguccauaaugguguagauagcacggcacacggggcagaagcaggaagcugagagcccacauucuugguugcagucacaaagcagaggacacauuaaaaguggcuguagaguccccuuucaucucaaagcucgucucccaguagucugcuuucuccugcaaggcuguaccacuuaaaccuccccgaacagcgccaccaacuggggaccaaguguucagacgccuaagacaaugccggggguggggggcaugucucauucaagccaccacacucaguuaccuacauaagaccgguacaagaucaggccacacaaaacuccagcacagagggggaggggcuccaagggaugcagcccuggcugaggagcuauuggcaguugauggcugugggggcaggggagaguaaugcauucuugggaguaugugguaauugguaggaugcucacaacccaguggaugauccuaaauuaugugcuacuaauuuuagugaggguuuuuuuuuuuuuuuuuuuuuuuuuuuuuugcuuuuugucuuaaaagagggagaugaagcugagauguguuaagggcuggggugagagaguaaauaggauugagauacuuugcauacauauagaagauuuucaaugaauacauuuuaaauguuccuuuccuuucuuucuuucuuucuuucuuucuuucuuucuuucuuucuuucuuucuuucuuucagaaaggauacagucuccaccaaaagagaggaugacagggaaagagaguaaccucuaggaacaguuccuuucaugccccaagacaaacaaugguuguuuguaucacuuaaaaaaaaaaaaaaaaaaaaaaaaaaaccaaacagcagagcgugguggugcaugugguggcgcacgccuuuaaucccagcacagaggcagguagauuucugaguuggggccagccuggucuacaaagugaguuccuggacagccagggcuauacagagaaacccugacucgaaaaaccaaaccaaaccaaaccaaaccaaaccaaaccaaaccaaaccaaaccaaaccaaccccaacaacaacaaaacaacuuuuuuugcaggugucugagcaaggcucugcauaccugcaacccuggagguagcuuugguccgcuaccuuuucauuuuguauaguuggcuguauccuuuguguuucugagugacuuacugagugugcuccguaccccccuccacugacuacucacuggggggaugggagacacgugguuuuccuaaggcugacuuauaggcauccauacucauucacgucugagcucucugaagaccuguguuucuuugcaugguguuuauucucauuuucuuaagugugugugugugugugugugugugugugugugugugugugcuuucucugccuuuuacugaucuccgucagcagcuuucaagggggcaucacugguccuagagaaagcccuuuccucaaggccugcuuaagucagcacuuuggugacaugagucuguggugacaguucuguggaaccugggauugcuccagguuggcugacugcaaaucaaccucuguccccauuuagugugugcacuccacagacaugucccugaaaccuuuauucuguaguucuuccaucugucuggugugguggcccgugguagguuagagauauacagacugacauuacacacauagccuggacucgugugaggccauggaguauggaccagucacagacaucauagcuccugacccuugccaugaucccucaucuuugccauggcuccugaccucugccagcuucugcugguugggucguaagucucagguuuucucugugcgugagucaagagaauggguugggcucaccccacagcaccauagucaguauggacaaauagggucauccaugugagucuuuuccuuagaccacauuacauuaaaagcugguucugucaucugagaggaaggaaaaaguaacuucugggcuacaacacuggguauucauggcugagucccaugugggcacuucugcugcuccagcugaagccagccgcucacccaguaagcccagugaugguugugcuacagcugagcuggcgcuaagugguccagaauggccuuccucuugcaguggccugacaaucccauccuugaugugucauccucagugaggcugccccaagcaaguuucugugucauuuuccaaggugacuuggagugagaaaagcaaaaaaaacccaaaccuagaguuuacuucuaaaaugcacuaaagacuccuucuucaaagcuuugccuacaaguggaaaccaccacacagacacagcacacugagagagguaaggccacuugucuaccugcagucacaggguauggggagugagccucgaccccaacaggagccacaaagcaaagaccguucuauaaggcgaugggggacuuuauagacaguccuugaccaggaacaaauagguggcaaauggcuuagccacuuacaggaacaguauccaggcucaguagauagucacugcagggaaaacuuuuccuuccuuccuuccuuccuuccuuccuuccuuccuuccuuccuuccuuccuucccucccucccucccucccucucuuccucccucccucccucccucccucccuuucuuuuuuuuuuggggggguucugguuauuucucuucuuuccuucccccucuugcccauucauuaagccagccauaaguugcaucugauaucuagcuuccgucuuuucuuucuucaaacccucuuuuccaagacuucacugcuauaaaaauaaauaaauaaauaaauaaauaaguuggguacuuuauaagaaccuauccaccaucgcucaggauuuuguucuaaaauuauccuggguccuguggugacaguaagcaagggcccugauuucagcccaguccuucacaccagauaaaucacagauauggccggcguuguaaaguaauauucccaagugcuaagccugucgaauaauuuuaauaugaaugcuauucugacacgugguaggaauaaauauguuauuuuuuaauggugaaaagaacaccagcuuacuagaaaauguguacauaauacauaaaaauaaaaucccacccacauaaauguugcuauuuauauugccaaccauaaaaggcauucaacauuuaauuaacaauauuuuugaggauaaguggcuguuuccucuugucuggaaagugcuuuguguuaaucucaggcacugucuccugguuggaauuuacucaaccugaaguagaguaagguuacaauaguaauuaagugugcaugaguuucugcaugagagucuuagacaaguagacaagugugugugugugugugugugugugugugugugugugugugugugugcgugcacaaguaugcaugcaggugguggagugccuguggcaacaucagcuguuguuccccuuguuuguuuguuuuguuaugacagggucucucaugggcuuugaauucacaaggaagcuaggcuggccugccugugagccccagggauauccuccugucucugccucccuggugcugagcgacuacacauguguguagccacguagaaguucuuucuagugggugcuggggauggaaacucagguccucauguuugcaaacucagcacuuuccugacugcggccccgccccugccccagauucuauagcaacugccaccacugcucuggcugacaguugagucccagcugcaagccucuuugucucccucaggaaggggagucugugaacuuaaacccaggccuccuggcucagcauuccuugcaagccguaguaaauaaugaaugcuccccucucuuccuaaacaagcuuugauaucagaauacaucuuaauuuuucuaauuaggagaggcuuugaaauuaaguaguggucagcaggaggcucccgaugcaucaauuaauaaugcacacauggucugaagggaagcuacaggaguggaggcaagaaaacaaaaccgaggaccuucucaugcucccugcaugcagccugagggggugguggccuuugcucauucacagagaggaaacuaugccgacuccacgauagccuucaaauuggcaguuaaggagacuaggccuaaaucuguuuccaagaacugggcaauuccaggcagguccaggccucagaagcugccccgccaccugcucugaggcaaggacaaugggucagcagcaguuuccagaccuccucagcuacuccccccccccgcccccccaccucgccuaauaguucuggaaugccuggagauagaguaagauaaagugcaucuaccccgggauucuucagcaacaguuuccaggccccccauccugguaacaguucuagaccccugaauuccccuaaugugcuuuaagucaggccugcgagcucacuugguggucucucucucuaucuugguaaucagagacuccagcacacuggacuucugcagaauaaaacacucuuuguguuuauauauuauuuggguccaggauaucauucuacaguggaucauagacccucacaacagcuggccagugugagcucagagaugguaaccagcgugucggaaaucacacagcagagagaaaaggugcagaauuggaacccagaauuggcccugggucccagaacuuccuucugcaccaggcauugccuguggcauaacaaacuucucugaccccaguaugugagccgagcgucucuagcuauggccauaaaagagggaagaaauugugacuccugaaucacugcaaagaaagugauuauugauauuaacuacaauauuaauguuauauuuauauaucauacauaauacuggauauuuuauaauauuaaauguauggcauuaaauauaauauuaauucauauauuuauauuuauauauauuucaacugaauuaaaagccaaaagaaaggggggcagguuuauuugggaaugggcuccugggugaguucaccagucccuggggaugagagcagggguggggaugaggacugugggggugggguggggguugucauuggcauacuaugguguggaaguuucuuaaagacuguaaaggagggagaauggugugucugccacaugcugggcuuguguggggauggggcauggggggguguggauguugccugcuggugacuucagaugaaggcgguugggauagcugucaggaaugcaggacugggcuuucugucaccuuuuccauucccaggcuuuccaagugggugcgguuggagagagacggaggaauaaaacuugcugggccaaauccgggauaagccagggacucccaaccaaacacaaguccauccucagggaagccaagaacucaaacagggcgggaaccugggcgugggugagaauuuaagcagagacugcuuacaaaagcuacuuauaguugggcgugguggcccaugccuuuaaucccagcauuugggaggcagaggcaggcgaauuucugaguucgaggccagcuuggucuacaaagugaguuccaggacagcuggggcuacacagagaaacccugucuuaaaagaccaaaaaaaaaaaaaaaaaaaaaaaaaaaaaaaaaaaaaaaaaaaaagcugcuuacagguuugcucuccaugcucagccugcuuucucaggaccaccugcccaggggaggcaccauucaacagugggcugggccaucucacauaaaguauuauuauuaguaguaguauuaguaguaguauuguuaucauuauaaaauacuucauaaacuugcccucaggccaaaagaggcauuuuucucaacugagggucaccugaaaagacaucaaguugauacagaucuaaucaggacacucuauaucccguaucaaccaugaaccaguuacagauugucaggaaggggugagucccagucuuaugcaggugaacuauaacuguaacauuccacaacccgguaccccuuccuccagcucuuaccaucuuaacaucccacaugguguucccugagccuggaggguguggugaacacuucccacuuaccgcugagucacuuauaucuucacucugaccaugugcaagucucugcguaaccaccgccuacugcagaaauaggccaagagaugaugauucucguuggacuaaggaaggcuggggaagagccugauugacagcuccaggguuuccgguggacauucuuggcggguguuuaugggcacagaucuguggggaugugcguuugugugugugcugcuugaagguacaggucacugcaaagcugcuaugagaauagugugaauucaugguuguggggguagugcacccuggugugugugugugugugcauaugcgugugugugugugugugugugugugugugugugugcgugcgcgcgggaguguacgcauccuugugcauuuuauccacugaaccaucuugccaccugacauauacaauguuucuuuuuuuguuuuguuuuguuucuuuuuuuuuuuuuuuuuuugguuuucugcgacaggguuucucugugucgucuuggcuguccuggaacucacucuguagaucaggcuggccuccaacucagaaauccgccugccucugccucccaagugcugggauuaaaggcgcgccaccacgcccagccacaauguuucuuaauccuaaugcuugcguuauucugauccugcucccucaaagugauuuuucuccaggguucccccugcacccaucacgcauaugcguuucucauccacuuccugucuuucaggaguucauucaguuggcaaagagacugguuagcgaucccgcacuggagaaggaaaucgugaccaacggaagggaauacgugaggacgcaucauuccuggcagguggagagagacaccuaccagcgccucaucaggaagcuagagacgaacuuggaggauuaaaugauggaaguccgugcucaccacaucugucccaacaaccaucaggugcucagcucggggcagaugccaaaagaugggacccaguccuggaccacuggaauccuagaguccccaggaacacauccaaaccccaccccaccccaagucucuuccuguuuggcagacaguucugcugugcuuacagcucaguucuggauggacuuauagcucacuucugaaagugcuugugacucagucccagagguguuuacagaucagucaucagugggcuuguaggcucacugcucagucccagauggguuuguagcucugugcaggagauggaggugcaucucaggggccuuuggaggacuguuucaaggacugcuuuuacaacguauggaggcuuauuuauaagcaacaaaacccaaaaaggccaggauugucaauggaguggagcuggcagcauuuuugauaugaucuugaucaacaagccaucaugggacagggggguggcggggguugguagggaggcgggcugugguuggcaugcuaauuagcucuggagaggcuaugaauguaucauguugugucacuucucacuaguguaccugagagcccagcuugcuuuccagaagaggcccugcccccccuguaugacaucacagggagucuggcucucaagauggaggcugggagccuuaaauuca

SEQ ID NO: 2691 - RNA, 24113 nt, Mus musculus
gauggaaccacacccacuuccccaccccucgcgacgacccgcccaggugccuugggucccgcgggaggggguggggcaggcgcaagcgcagagagcgcgggcgcgguugccguggcagcgccugcccgagggagggcggcggcgcggggccaggaccccggcaggcagaggcggcgacgcggccaccggagagugugcggcggggcagcugagcggcgggugccccgcccugcuggccgguggggaugcgggaccggcugcccgaccucacggcggugagcagaaagccgcauagcggucugagccggcgggcgagcuguugugggucgggcaaaaaccccaggaagaaccuggggaguugggguggagagacgcaaggaggggaguccagaagcaagaccuuaggaggagucugaguagggggacggaggggaguccaggaggggaaccuggggagggagcuccgaggaggaacgccccuggaggcaacugggcagcgucucuaggagggaaucuaauaagaggguucuaggagccccggggccuccagaggcuucggugucuccagggauggcagggcguagucuucaggaaggauccaggcagccuccuagcagggucccagggagcuuucgguucuucaagagucacaagaugcacaagaggaacccaaucgguguuucugagcagagucucagggaaagggcucugggguccuuggcgucuucagggguguuaggguggggcuucaggagcauucuugggaggucuccaggagacccuggucagggcugcaugcaagucgauucuugcgacaaggcuccuggucuuccuuggguuccaagggucacaguuuguugggacuccaggaaugggcugugggagagguucggggccggugcugggagcaucuuacagggcacuucugggcacagaugcugguaggugucugaggugaguccucuccgccugcccuggcacuacuccuguguaccgauguuugggucggaguccucuuggccaccugacaggguugauuucagugggugagaguguggcucaggguuuuaggcaaggagcaagggcugcgcuugggcugauguuggacugccugccuguuuuuuuuuuuuuuuuuuuuuuuuugcaaggcucuuaucacagccucuccaacugccugccccacccuggaugauacccuuucuaacugcuuuauuucauggccugauacagaaugcugugcugagucucucacagacaccccacacaaaccuggagcucaggggcuagguaccugcuucggucagcacuacccacugggggccagaacuguauuuacguuuuaacacaggcuuuuagucacuagugagcauuuugagaagagaaaagcugagcuuuuuaacggggaguguguauacaguauaucugcauuugcagcggucaguuauuguacccaguuuugggguagaugugacauucagaacauauauacagugcaggcccagucauggcguuuggcccuacccuuucagguguuuaucauucuuuugggaugagaacuucaagaccagccaggcugugguggcgcacaccuuuaaucccagcguuugagagacagaggcaggcagaucucuuuugaguucaaggcuagccugguuuacagagugaguuccaagacaaccagggcuacagagagagaaacccugucuuaagaaacagagagacaaccucaagacccuccucacuggcuacugcaggcaucagccacagccacgcacugcgaugcagaacguuggaaggcagucuuuuccauccagccggaccccagagccaccugugugcgcugcucacguccauucuucccagacccuguaaccagucuguucucugcucccuugagcacagcagcuuuuacaugucuacacacggagcaucuguguugcugugcugauaggcuuuaugacccccccacuggccugggggaguuuguugggggggggagacccuuggcuggauugagggggaaaccugggaaggagagcaguuugcaaacugccagcgcuggacucuuggcagguuuuguggaccgccuggaagagcagcagcagguggcgcccuguagugucacagcucaggugcuaggagugggacccagagcaagugucccugggcagcucuuugggacuguuccggugacuaggugccggauccucuucucugucaccaccacuuccuuuuuaaauaauuuauuuauuuuucuauuugacgugcauugguguuuugccggcacgugugucugugugagaguguugguuccuggggucagagaaaguuaggcacugucguguaaguguugggaauugaguccugauccucuggaagagcaaucuuaaccacugagcugucucucuagccccugcuucucuggccuuuaagcgcuuccgugcugugcgccuccggccucaacucugacaguccucugcgccuuccuguuacucccuagagcuguugauccguuuccuucuaugcaaucacugacccuugugcugccgcugcugcugcugcugcugcugacccuugucuccagguuucuccccuauggcugcugcgacucaaugugcuuucaggcccucuacuccacugugagagcuugcugcaucugccuuucuccacaccaccaguccccucaccacugcgagcggguggagcaagaccacuugaaagaagccuguacagggcacucaccaaaugagcuggacagccugguuauauagaccggagaagugcggacccaucacagaccuccuuugccaaggaaaguuuguguuugcaccaccccaacacugccucuucgggauccacccacugauuuggggggggggaaaugguuacaggguuaccacaaguucacaaaggcuugugguaggagaaaguugaguggggacugaaaacccugguagaggcuguacccuuaggagcuggggcacucagcugcuggcauuguauagguuucucagagcgugcaauguugcacauggcuggugcuggccuaggguaguccagauggcugguugacugccagugcuguugcuuaaggcagcuggagagagacagagagccggacagagagacaauugccucauccaccaauggcuuucuuugcuugcugacaggaagcugaacacaagagagaaugcguaggauaaaacccuaagagccugucauugucccuaacccuguuuaacagugauuuagcugugugcgucacaaggagaggguccuccuuguucgucucaacuucauccaccacgaccagcuucgagguccuucucuacugcugcacacaaaguggccaaacuuugcagguugaccuuuuuuucaugcauuccgucucucugugaagaugccacuacugugaacgugguggucacugugaaacuggaguugguucaggccuccagaaucaaguggacuucugugucuggguuugcuuuugccgugacagacacagccucugcucucugcacagcuguggccucugaccagagugugaggcccacugcuguaauucccggguucucaaacauuuccacuagugaucccucccuuuuucuuacaugacccugcguauauguguaagagauaauacaaguggaguguuaacugguggugacaaagcacggguguguuuugauacacuuccuuggugcacacuugcuugcuguuuaucaaggaugacagcaaauaagaccgaccgauggacuugcuugauuuuuacauaaaaaaauuacaucuuggcuaaauauuugauaccgcaggauucagagcacagcguugauauuuugguuuuguaauacucggugcugagaaggucccuccauauaaauagaugagcagcagaaaauggcagaccuugccaagggacgcuucagaaguuguugggaauucuguccugaucccaaacugaauucaucauuuuuuuccccuuuuuuuccuaaauaaaauucaauucagcaacucaaauagcaauuuaaaaaaauccauaaacuuuauguuuuugcacaagugcaugcacuagaaugcacgcauggaggucagaaggcaacuugugagaguuguuucugucucucccauuugagucucagagucaaacugaggcugccaagcuugguggcacacugaccugcugagccaucuugcuggcccuaguaagucauugagacaggguuucucuguauaacccuggcuguccuggaacucacucuggagaccaggcugaccucgaacucagaaauccgccugccucugccucccaagcacugggauuaaaggcgugugccaucaccgcccaguguaagucauuauuccaggauuuugggaaauagggagaacaugugagccaggugggcuggggagaugagcugauugguuaagugccugccucgcaagcauggggccagggguucaguccucaaagcauuucaauaggcaccaugguacccacuguaauucgaacucuggggauguggagauggacagauccuuggggcucugguccagccagccuaaccuacuuguggaguuuggggaggucuaagacccucagaaaacaaagagggcauugcccagugcccaaggagugacagcugagguugucuuguaugcaaauagagagugacagcugucuuucugccucacagagagguguguaucugacccaagaagcucugggacaggauucgaggagcagaguacugugggcuuacacucuuuuaaaaaaggauuuauuuauuauauauaaguacacaguagcugacuucagacaccccagaaaagggcaucaggucucauuacaggugguugugagccaccaugugguuacuggggauuugaacucaggaccuucggaagggcagucagugcucuuaaccgcugagccaucucaccagcccccgggcuuaaacucuugaaaccuagguucuauguuuccagaaaguuagagaaagcaacuuuccccuuccaccuuaucuaaaugcugcuuucuuguggauaggauguggggguugaucuugggguuaaaauggcugcagugccgugaccauggugauucaagaguuugaaguuucccaggaaggcuucucauuagcucuguaugcguccaccugagacaaagguacuggugguagucaccugugaaggacuuaaaaaguagcuuguuugaaugaccacaguuccauuguuugggagguagaggcaggaaggucuugagucuuagguuagcucuggugaccuaggaagacuuuauugcaaaagaagauuagcuguggggcuggagagauggcuuagugguuaagagcacugacuccucuuucagagguccugaguucaauucccagcaaccacaugguggcucacaaccaucuguaaugggaucugaugcugucuucugguguaucugaagagagcuacaguguacuccuauacauaaaauaaagaaaucuuaaaaaaaaaaaaaaagaugaacuguggacagcaguuugcauuuggagauuuuguacgaucugucuugcugcccagaggggugcuucaggcuuugguccauugcucauuuucacacaaaagcuggagcaacuugccugggaucgcccagacucuuauguccagagugauucugucuccgaccucuggaacgcacaagcacagauaagagucccaggccagagcuagaugcggcccuggagacagauuugaguuggcuacgugcaguggugucccguggucgagggcggaagacugaggaggagcuaugaguugccuuuuaggacgucaguaaaucagaauggaucaggucauguauaagaguuuggauuuuuccauagaccaauuauuuccuguuuuugcucaagauauaucugaccucuacugccugagagcaucugccauugcuggacuuccucucguccucuuggcugcgggaugagccugcuuccugacagcuaccccgggccucugcagcccugcagcccugcggauugccucucucucugccucgcucgcucacaacuuccccaccaggaagucucugucuggcuucucucaguggcccuggcaguggccaccuucugucccagcagccugcauggagcugccguuuguuuucucucccugugcccccugauucugucaucacccuuucuugaacgucugccucaaggcaguguacccucgagacucugggcacguuucaggccauggcucgugcucagagaagauugccagaaacggaguucuugaggugcucacagucucaccccaccgugacccuccccucccccuccccccucucuccuuccuacuuugcauuaucuuugacuugcuguauaucccaggcuuagaguuuacucugaagcccaguuuagccucaaacucggaauccgccuaccucgauguguuguacagaguagcuucaaguuuguuugguuuguguauuugguuguuuuuuggggccucucuguguagcucuugcugcccuugaacuugcucuguagaccaggcuggccuugaacucacagagauccaccucucucugccuccuaaguacuuauggucuagcuugcuggcuucaaacuggagauccuccugcuccaguuuccuaaggcaauuugagacuucaggugugaaaucagggugucagcaucucugaaagccuggauuucuccuugcagcuccuagauucugagauacccaucuuugacacuccauccccaaggauacagagcucccugggccaaccucugcuuuguucucagcugccugcugucuuccuugcugaccgagucagcuugaugauuuuagcuuguccucacacacacaccauccccaaccccuggagugagccacccuaacaaggcauggcagugccccuauuccacaugugguucccuugcugagggcuguugggacagccuguaauucuucagcacugcccgucauuccaggcaucuggagagcagcggguaggcuucuugggggaagucacacagaaggggcaucccugugugugugugugugugugugugugcgcgcacgcugcgcuaugcuucaugaauauagaagauaaccuuuuaggugauacccauuuuucauuaagcuggucguggcuguguuaugucccuggugacaaagguugcucucacacuccuguguguguuuuagagcagcacuccagcuguaacuaaccagcugucuuauccaaauaaucagcacuagaggagaggggauaugguuugggaagagcugauugggccuuagugaggguccuguguggaaccaguggcuuuuuauuuuuucuucuucuuggcacagucuuucuguuguguaacucugacuggccuggaacucacuauguagaucaugcugaccucgaacucacagugauuccccagcuucuguauccugagugcuaggaauuaaaaaaaaaaaaaagugaaugaaugaaugaguaaauaaguaaguaaauaugcaccacacuccaacuuugaccaugcuucuuaaauuugcagauuuuucuuagcugagaacugcagugauaucuugucugcaagguuuccuggguaguagugggcaguaaaggaacaccucugugugucaggccugcaggguaaaggcugguaaaggcccccaagcaauggagguuccuaagaugccuugcugggcuuggcugccggaaaggaggccugaucgugcugacucauggcgcuggcugcccuggaggauagagcucagcaggucccuccccugcgccuccuggcaggcagggcucagcaauaggacuuagauagagaccaucuucgaggggccacguauagcuguccacaaaaacugcuucuggcuaacugagacuugucugugcugccagaggcuugggcagcccggaagagaggcugcccagucaggaccagcaucccuccugcauccugugcucucaagguuccaggcaggccucagaggcagcagcugggcaacucuccugacccaaggccaugcagggagcuucggaagugccuacuccuguugucuuggaucccgccuuaggcuguuucgaacaaguagccccauucuagcccuugucugaaaugccuucuucucccccacuguuauugauucugucuuccucaaccccucucuccuugucaggguguuuauuauuauuaaacacagugcgcgguggucaucgcccucuuagaaaguaugcaugcgccgacauaucuuggaaguuaccaugcacucaaaguuuuuguuuguuuuuggauaaggucuccuguuucccaagcuggccuugaacucacucuguaauggagcugaucuggaacuucuaaccauucugccucugucuccuaagggcugggauuacaggggcgggccaccaaaccugguagcagcuuauuauuuucauguguuauuuuuuaaaaauuuguuuuauuuuuccugcauguaugcugcacaccagaagaggguaucaggucccaugaggcuagaguuuuagaaguuaagagccacccugugggugcagggaacuacauuuaggaccacuggaagagcagccggcgcccuuaccacugagccaucucuccagccucuacccccaguagcauuuuuaaucuuuacagaaaguauaaacauuacagggauagugauguagcccaguguucagagaagauaccgagcaugcucagagcccugcgucaguccccaggaugacucuguguguguguguguguguguguguguguguguguguguguguguaguaaucucuucauggagaacaaucuguuucgaauggcccugacucugguguagauggcagcaccugccguggggaucuggccuucauugacucccccggcugcccccuuuuuuccagcccauguuucugucaccagguagaagcugcacuauuggaugguugcaggcuguggagcauggcuccuccccugcacuuggugucccgugagcugaggagcuggggcccugagucgcucuucggccuuugugacaccugggaaauguuuucuguuccaguguaggacaaacgacgauggagacacugcugucgucauuguggagaaggaucauuucauggacgguuucuuccaucagguggguauuuaaugacgcauggccucagacuuuaccucuggccacaguuaccucacaaguuuauagucacauguagagcagcacacuuguguacccugagacugcguuuugucuaauggcauacccugugaucugacugugaucccguguggcacuagugccgucaaagccaucugggaaguccccccgccacccguuucuccuuguaucccuaucgugacugacuugugacugacuguauuuuugcuugccuuaauuuuggaguuuccggaugacgucucaugguguguggcccagguuagcuuuaaccuugccauccuccugccucagccuccugagcauggcuguguuuaaaguuauuugaaguauguaaguucuuggggacuuucagcaucgucacaauaguaguuaauauugagacagccucaagugacugcgugcagacagccugggaggaaggguggaggcauugcagaguggagggccaguguacuggggucguggaucgggcccugugcuugugcucucccuaugacuuggaucuguaagaucucaagcaguacuuccucccuugggaagccagccacaucccuggaguggcuuuuuaaaggaucgcaccuugagccuugugacaucucaggaacccaggcuuccuagucccuuggaggcaggaauucuggcaucuagcucagugccuggggccacauuugcuguugcuguuggucaccugugaagcagguugcugguguucugaagccguugacugcgguuguuuuuaauccagauucccccaagagcaugagcugcauuugcuacagacuucauuucauaguuucuccuguggacugaggucuuagagaaggaaacaaacaaggcuuguuaauguaaggccauggggaggaaaggcccccaggccauacccaucacacagaaugcugcagaagacagacuucgcuccugaccagagagaguuugguuaaagaccaauaaagcaaggcccuguguggagagaacuuuucugagaagauaguuagaaggggcagaggagacccugugugggcagcuuguagucucaggcuagaccagcaccaauaccaccaccaugcacucuucucccauggaaccuccuaccaggguacuguggcccacaccugccuuuccugggagaaccaaucugacuucaacugcugugagggcaggggugaguagcgauucuaggagcugggcugucuccuugcuuucugacaggaggccaucaauguugcuuugaaaguggcacuuucaaaugaaauugaaaugccaucugugcacuggaaccagcacugugccuggauuucagccuccauagcaacacagccaagauguucaaauaaucuauuuuuuauuaaauuuuuaaaauguuggauguuuugaccacauguauguaugucugugcaucacacucaugcagugcccucagaggccagaagaagggguuggguuacccagaauuacaguuauaaauggcugugugcuacuauguuggugcugggaauugaacccaaguccucuagaagggcaaccaguggucuaacuacugagucaucucuccaguccugaggaccaacuuuuguugugguguuuccaugguugaugugacuacacuccugagugugugaugucugugcacucugguagcagugguaagggagauugccuugccucaucccagcaugaaggaaccacugcucugcccugcaaccguggaguuccauguuggauuucgucaaguuucuuuagcugugaagagacacuaugaccacagcaauucuuacaaaagaauacauuucacuggggcuggcuuacagugucagagguuuagugcaauauugucagguugggaagcaugguggcaugcaggcagacauggugaugcaaagguaguugagaguucuacaucuggauccacaggcagcagggacacagcccuggcuugagcuucugacaccucagagcccacccccagugacacuuuuccuccaacaaggccacaaguucuaauagcgccacucccuaugagccugugggggucauuuucauucaaaccacagcacacccaggauagcuucccagcucaagucuuaggccugugaagaccuuguuugccauggaaggcacuaucaggauguggacaguauaugguggcuauaauuacauaaucauuuuaaaggaagggaggaagagguggugguccuccugucucagcugccacaugacaucucuguagccagguuauaucuagguccauccuggauaaccccugagcuuccucaucucauauccccaguugaaucuguauaggguccuuugcuauagaauguaacaaucacaaggaccaggacacuggcaguugagugaccauagaguuuuagagacaaaaguccaccugaaugagucuugcagugaguugcucacaccaugcagggauucaggaggaugccugaagggccguccaccuggauggugagggcuuccucaugggugggggggugcucccuuggccuccgcgggcucggagugucacugcugacggcgcugugugguauggaguugcaugcuuuagcuucgcacugccucugcugguacuugggcuccaguguagagauuuuuacagcauauaguuuuugcugacaaauguuguuuuagaccuaagaguagggacuuugguagauuucuauuuuuaccucauuuuaauugcguauaugugcacauguuguguauguguauguacacacaugugugcacacucauguuuaugcuacagugugcaaguggaagucagggcagcuuauaggaguaagcuuucuccuuccaccagaugggacucagguugucugguuugguggcaagcaccuucagccaucuugcuggugccggguccccccaccccccccaacggaagagaugcucauccuuucugugggaucacgagucacucacuccggccucuccccggaggagauggacagcggagguggcuuuggccuuaucacagugucucccuccuagguagaggagauucgaagcagcauagccaggauugcucagcauguagaagacgugaagaagaaccacagcaucauccugucugcuccaaacccagaaggaaguaagucugucaacuguccgucuguccuccagcuucuccuuagauggugcagugugcucacguaggugaucgcaccuaggcccccuuggcaucucaggaauuuuguuuuguuuuguuuuguuuuguuuguuucucaagaaacaaagcccuggcugucguggaacucacucuguagaccaggcuggccucgaacucagggauccaccugccucugccucugccucugucucugccucugccucccaagcucugggauuaaaggaaugcgccaccacggccuggcuccagggugucucauaguguuugaaggcuccuaaauugcccaguguucagcuggggaaagaccaucagcuaggcaggauccaaaggauaaugagugugccccaugggacucuggcuuagccgcagcucuacccuaagcccacaguugagggguaguggaucuuguguuugaggacauuaacaacaggcugauugggaaaguagugguugcuugauggaguugggcuagcgauggaggugagugagucuggaggccaguugugugccgcauacuaacagaggaguaagcaccagcuagauuuucauuuccuuaggauaucuuucuaaaucucagcucuuuuuagaaauguuaaaugccuuuguuuagaaacuuugaauguuggcugccacuuacauuaaaaaaaaaaaaaaaaaaaaccuggaaacuaagacagugucuggucacucccacacaucaguuacuguggagcagcuugcucaccugugcucacuccacugcccucaaggagcuaaucugccugucugcuggcugcauauucugcuuccuccuggggagucucauagggucucugagaucacacuguuucuggucacacugggguuuuguaaggccucccuuacaucugccagguuccaguuugcuucaccucauuggguguuuuaaugacaucacaucagauggcaagaaagacucuggguggagucccccagaaucuccauagaugccauagagguauagacauggcaguggacugcugcugucaguuagcugcagccagugaccuuuuaccccgagaauggcuggggcaccaaaguuggcucugaaggucuagagccaggucuccaggagggugacaugcgugguaugucugauggagcaacagggaccaggaagacagcgacagcagaagggacuucuggcagcuucuuccugggugugguugcauguacucugugucccagugaagguuagcaucagagaucugauuggggugagccugcagugcuggcucaccccagcugugucugguaacacaguucggggucuaccaggagcuggcccggacacggcacugguggcuggggaggugaacuuggacaggcacugagaaaagaaggcugguugcuccuucucugugcuuggccugcaugccuguaucuguaguguaaagugguccaucucacaugcuucauuucccccuuuuaaagaaauaaaagaagagcuggaggaccugaacaaagagaucaagaaaacugcuaacaggauccggggcaagcugaaguguaaguuugccuucuugggugcuggugggguguggaaguugguaccuuuuuccuuagaguuuuauuauuauauuucccaaaaugaaaauugagacugcuucuaaguagguugguuaucuguaaucccgugcuauaucucauugugacucaguaggugacauugggcagguguuugagaaaguggggauagcuuuccuagugacucgccaagcucucaggcgggccucuuagcuagaauguucuuuccagccccuagaagcucagcugagaucaugguccucuguguucaggaugacgccuuggcuggguugaggguuguggcuuuuugcacagugcuuaaacagaaguugcuuuccuugaucugugaggaagacauauguuuaacuuuuuuauuuuuuucugagacaggguuucucuguguagcccuggcuguccuagaacucacuuuguagaccaaguuggccucgaacucagaaauccgccugccucugccucccgagugcugggauuaaaggcaugcuccaccacugcccagcugacauguguuuuaacuuacagagacacaucaaaaggaauaaaucucaucuccgcacauacccucuccucaggaacagugacucccagguagcaggcacucugcccagauccuaguaggcuccuggcacuccucacugggcucaaggcagaccuuagagagugugcaccuuaaaaacagcguuguucccaagagcgcaaccacuuuaugucugagucagacucauuacagugauugggugauuaaaaauacccggcacaccccaucuguacacacaauauacuuacacaagugcacacacaugcaaaugaaccagagcaacauagagacaugugguuacacacacacacacacaaacucagcauaugaauccauaaaaacaaacacguaaggcccauguucagucacauaccuauaugcauauuugugcaugauuuuguuuuuguguguuuuucuguaugcaugugccuaugauuuugguaugcauguacacauaaaacauguuugugauuguccauccaccugucugucauuguccacaagugcggacagugucauaagcauuccuuaugauggcuggacuuuagaggacaauuuccagaggucaccuauucuuuaguuuuguggggaaaguugaggccaucccugagaccaaugucguaucuuggugacucuguccugcuuccuuccagcuauugagcagagcugugaucaggacgagaaugggaaccgaacuucaguggaucugcggauacgaaggacccagguuggccuuccaggcucaguuaaagcgauguggaagagcagcauuaugcuuuguccagacucagagcaauuucaguuuuuauuuuuuuauugugcuggaaguugaggccaguauccugcacaugcucagcaagggcucugucaccaagccacagccgagcaucacaucugcccuuauguaaugucugucugcaggggguggggguggggcuggggggcugcaucucuuccaugugaagagaugacucagcgacucggcuaccuauaugcucugugccucagaguagaggacuagccagaccaccuagaugguagugguuugguuuuaaucaguuuuuuuuuuuaaagauuuauuuauuuauuuuauguauauguguacacggucgcugucuucagacacaccaaaagagggcaucagaucccauuacagaugguugugagccaccaugugguuugcugggaauugaacucagguccucuggaacagcaguccaugcucuuaaccacugagccaucucucuagcuggguuuucaaccuuccuaaugcugugacccuuuaauauauaguuucucauguuguaaugaccccaaucauaauauuaucuucauugcuacuuuauaacuguaacuuugcuuguuaugaauuguaauauaaaugucugacaugcaggauaucugcuauuugaccccaaagugguuguuaccaaaagccuuaacuauuagccuuaacuauucaggguuuaugguugaaacugggaugcucaacccuguuugaccaagccugccagcuuagggcaggcaguccacgugccugccagcuggauucaaccugugauaacgcccucccucuagaggucagcuggcugcuccgggcuccaacuuauuuguuguuguuauuggugauggugguauuuuguuuuguugagccagaaucuuacucuguaucccuggcuggccuggagugagcuuguuacauagaccaggucgaccuugaacucacagagauuuauuucccucucccucuguauuggaauugaaggcaugcgccaccguccugguggcccaggucaugcaccucccauugccgcucuuucucuuacuuucuucugggauggagucaugguuggggcuucuuagucgucaguuuuaccucuuucaaaggaagggguugcccccacauaguaacacgguauucuccguguucuagcacucggugcugucacggaaguuuguggacgucaugacagaauacaaugaagcgcagauccuguuccgggagcgaagcaaaggccgcauccagcgccagcuggagaucagugaguagggcgcaugcgggagacgugcuucaggacccaucagauggcaagcgccccacuucuaacugcagaguaaaccgaaaggcccuuugcugcagccugugccuagagucaggcagauguguuaugugucguaagcuucagaguucugagugcggggcuguaguggcuugcgauugcuggugcugcuauuucacgcaucccgaaaucuugugguccugauuucuuaaggcauuuucguguccugcagcugcuccuaccuggcugggagaggaucauccucaugugccuccuucagcuuaacucccucuggcuagaagcccugugggacccgagcauagcugcuccucuguaacaccaggguaggguugugacacauugcaucacauuucugccacauuacuguguccaggaaaguauuuuagaaagggcagggaaacccuguuguuggcaauguuaauggcucaguuaaggcuuagugaagccccgacuuagcuaggguuuuauugaugugaagagacaccaugaccaaggcaauucucauaaaggaaaacacuuaauaggggcuggcuuacaguuuggagauucaguccauuauuguccugacggaagcauugcagcacgcaggcagacacagugcugcagagguagcugagaguucuacaucuggauugucaggcaucaggaagagagagugacacugggccuggcuuaaacauccaagaccucagaccccacugccaaagaaggaacuuccucuaacaaguccacaccuccuaauagugcugcucccgauugagccugugggggccacugucaugcucacucccacacacccacaguugagcagcccuggcugcugugucaggcugcguccucauugcaguucccguugucucucagcugggaggaccaccacugacgacgagcuggaagagaugcuggagagcgggaagccguccaucuucaucucggaugugagugcccuggcgugaaugcacaugcuuaccuacaugguaagccuuuaacuuaccagccagucugaaguuaguaaugcuuuccuuuuuaucuuccaaagauuauaucagauucacaaaucacuaggcaagcucucaaugagaucgagucccgccacaaagacaucaugaagcuggagaccagcauccgagagcugcacgagauguucauggauauggccauguuugucgagacucagguaacgagacaucucccagacagagcccgggugcggagagucuuagaugcagccugcucuggccaagaaagcccuggcuugguauucagucucaaaauucaggaguugauugcaguguuaaugcugaguugaaaacucgaguauguacuugcucauaggauauuggguaguuauaggagccaggggacagucacauacaggccagcuacuuagauagacagccucaggcaacaaacauugggcgcuuguucauugagaauaaugagaucuucaaacaucugugguggauuuuacaguaaaauaaaaggacauacagaaaccuuacuuuagccauguaaguguaaguauaugugaccucagcuacauauaacagugcucccagacaaaggagauggccaagccaagcauccugaagacagcaggacggugggggcauuggucuuccucucuuagggcucuaucccacaggagugacuaaacaaggauuggggccauggcuaaacaggaaacugaccagagcucacucucauucugugguguucuugccugcccugcugcucaggcagggaggaccagagagugcaugcaaguauaaagacauuaggaaaaauucagcaauuacugggaagagaggcccauuggacacgcaaacuuuauaugccccaguacaggagaacgccagggccaaaaagugggaguggguggguaggggagugguggggaggguaugggggacuuuugggauagcauuggaaauguaaaugaggaaaauaccuaauaaaaaaauauuuaaaaaaaagacaucaggguguguaugcacgugugauguguuuguacugacucaguagcagugggaacccgcagagacuggacuagucuucccaggguuuucagaccccucgggaaagucuggggcaggcuaaagugcagguggccuccagguuccuugcccccuuugugagucagcugucagggugcuuugcucauagccagugauguucugugguuaccuggauacagaaagugcccgucccugcgugcccugccagccuugugaagaaugguguuuauuugggugaaccuuaucauaaaacuuugaaaaucucaaguaccacacaccuguggaagacaccuagcacuuaacaauuguguggaggugaagauaggcccugagggguuggaauuggguaccaaugggcagggaugggcacugauggcagggguggacuugugugguuuucuuugagauggcguggaccaguugccucuuggucuaagaacugaggagugagguaucuggcaaguuugcagauguucagagggaaagcaagaagaacggcgaauugauuuuggagacgcgaagcuuuguaauagcucaggcuuuauuacaccacgccccacaguuacacacgccacuguuuguggccucgcuucccuguuagaagccugucacuguguuacauccauaguccagagacggacuuacuagugcauuuguuugugaaugauaagucaccuguccauccuucuccaaugcuuugcuauuggcugccacagacucugucuccuccuggacgggacccagguaauaugccccuccccagguaacgucgugucuccuccauuuucauccuugacugucaguucaucaucaccucgggguuguaccuauaguuuguugauauugucgagauaaacacugacgauuuucugugucagaagagacgucauccuuagcgcguggaauguuuucugcccugaguucguggcccucccuuuaccucauguccgagaagagcacaccugucaggucacaucucauuuguggacggucuucaccugucuccauugcugccacccccuuuucugcugcuucuaaaacaugaauggaauuggauugcuuuugcuggcccuuccacaccagccuagcccuucugccugaccgugagggagccugucucuaucccucucaugcugggcuuacaugggagccaucucaggagauguggcagagccauuugaaguuugcugaauugcaaccuuguuuucagggugaaauggucaacaacaucgagagaaauguggugaacucuguagauuacguggaacaugccaaggaagagacgaagaaagccaucaaauaccagagcaaggccaggcgggugagucgcucuacugaagaugcagcccugggugcuuuguccucucuuggccucuagcugaggaaggagcaaaaugccuuaaauauacauuuuuauuuuaaaaucaaaaauaauuuuuuucauuaaaauuuccuaggucaauuggcuuauuuguauauuagcgaucuagugggaggaacaaacugauaggauuuggguuuucccugaaaaaucacugguggcacauggucuguuagagcuguuugcucugcuggguaaccggcuggcaguggcuguaggugggccugguacuugaguaggagcccugggaggcagucucaaaggaagccgucccuuugccuaggcucuguccugcacccagacugucccaaggcaauucuggagcaguggauguugcaggugcagaauucuggagguauccugcuaacuugaguaucucccgcaacaucucuggaguuuggguuugaguuccaugccacugccugcagaggugccaaggaugaugccugcuuggcaaugaguuguaacaccuuuguccaaaucuucagauuuagauacaugggcaugugaguucuucugggacagcugagggccugcaaagggcaucacugucugaugugggugggaggccuaagcaggcuagguuucccagucagagcucugacuuccaggccuccuaggaaaguguccuguguuccaguccggcaaaaacuggugugagucuguuaugugcccaggcgaaagcuaguguuaccggguuacauagcaggcugacucuaggaggccugacgccauacaucaagacccucugggaagugaagacugcucuaggucucaggccugcccauaacuuagauuucaacaugaguucuggcagucgcuucgcuccagugaaggauacccuugacgguggcagugugcaaucaauaugguguaaucagccugcuuuccuuugacagaaaaaguggauaauugcugcuguggcgguggcugucauugccguccuggcucuaaucauuggcuugucgguuggcaaaugauugcguagauggcgcugggugcuugccucucccucaggguggcaguaagugacuaaucaacuaauuuacuuauuaaccuucucaaucagccaguaguguuguuuccccaguguuacuaugcucaaaauucuugggggcuugcccauugagcacuuugcuucaggcguuaguggccucugcuuacugaggcgacacaggcggcacaagguggcagcucccuugccggcucccuggaaaacuaaaugcugcaguucuuacauuguuauguugcaguucguguuacguuguaacuuucuggauaauggcagcaacugcuaagaacugugaaauacucuuaacugcucaguucacagugggacugagagaauggaaccgagcucuguacaacagcaacagaccaaacucuuccugggucccugccuggcagcaucuguucauuggcaagcaaacccugauauuuaauuagccgccugcuaguuccugcaggacccugaguguccugcgcugucuggaagggcuccuuucguugguccugagccuuacuguaaccccuggguccuagugcugcacugggucauccuuguggacacaggacagccggugcuacuucuuucuuaacagugguuuuccacaguggcagaaaggaggcuccuccgagcugcaguccuuacugccuugccaccugcgagacuucucuugauuccagcaccuggguugcagagagagcucucauccugggacaagaaagaccugcagccccuucucuguugccccagagguucauacaucuuuccugauguuguccuccuagucugcugaaaaagaugacagauugauuuuuuuuuucuucuacaaaaugggacuuuucaacauuuucauuacuuuguaaaaccauguguuuuguuuuccuguagcaccaugaggucaguugugcugugaaaauggucacagagguacaaugguggcacucagcaugaccagugaagcaccugcuuuuugugggugcccauaugcucuucuugcuaggacccaggagagcaggucugagccucugccuugggucagcuggccauuugcuggagugcuuguauauaaaacacacgcaugcacucacacacacaugcacgcacaaaugcagaauaauacacauucuuuccuucccucaugaaacuagaggagacagcugggcccugucuccagacgugguuuucuguucccuccugucuccuaaagauggacaaaagucacagccugccgaguuacaguggggcaucaugggaacggugcuugcuuucucucugcacugcagacuccugucucuuuucuugcagaaggugauguucguccucauuuguguagucacuuugcuugugauccuuggaauuauucucgcaacagcauugucauagcaaccguaccccaagagcucuuuguccucggugacuccgaccauaccugcagcuuagucagcauccuguccuuccacgagugaaccucagacuccagggcuagcgccgagcacugagguuuuuauuggugaugaagaagaaagcaccgcagagguuucguaccaugaaacaccgcgagcccaguggaugcgacaugccagcccagagagccugggucucucucaaggacaccacagagauuucacaacaguggccuugccuugguagcuuugaaauaggaaugauugaaaaagccuaauuuuuaaagacaaugucaguguuaaaaauguauguuguguguaauuagggugugcucugcgcucagcuggcagugcugacgaagagacuucgugccaggccugaucucuguucaugucuuguuugcagaaucaucacagaacuguuuuguaaggcaucuguaaguuaaguuccuuaaucuauuaacaucuaaacucccuuucuaagcuagacacugccuugugaaggacaaugggccagccccgggcaagcaugaacacugccuuacagccccucagggcccuucuauagugccuucuggugacccugacuaggaagugugagggucugaagagccuugaacguuagcucacggaggggacaagcagucacaugccgcacucauguuacucuuccuuguucaugugagcugauggagucucaaggcaaggcgacagugacgauggagcaaacuuggugcucacuaaacucaagagaauggucccggguacauagccacuccuggauggcaccugaaggaccagguccucagcccaacacccacgagugcccagaguuccuaagaaaccaugaagugugggauaaagcugugcacugguuuacacuugugaauagauggcccagcgaccaaguaugugaaggauaccaugacuagugaacucugccaacugcugacugugaugagugcucacucuaccccagccucacuuggugggauaugauguagccaugccgggucagaacaccaagugugagcaagugcuacugaacuaucuaaaaaccaugauccuuucaguggugagugugccacacugucaccuccucacaccuccuggucugacaccccaugugccgagagcuacugcagcaggcugggcuguggguccuggucuagaguuagccuguagugcagccacuccuggcugauagcucacccuuccuaacugggagcucacccuuccugccuggaagcucacacuuccugucugggagcucacccuucuugccugggagcucacacuuccugucugggagcucacacuuccuuccugggagcucacacuuccugccugggagcucacccuuccugccugggagcucacacuuccugccugggagcucugaagaugaaccugggccuuugcagcucacccucucugcaucagucagugccaucggauuuagcugcagagaccaugcguaccacccaggcucccaccacccacagccaggugucccuccaguccagccugagcccuuggccugcagugugcucgcagagcgcucaggagaccucucgaccaggcaggcagcugaaucuggauuuccagugaaucaggggugugugggugacugagucagcacuccagauacaucucucugcugacuucauagccuauuuaaaaauauauuuacagauucccuuguuaccuuuuccaagcauuucuucaaauauuuuguguuuacauuaaaaaguucucagagaugcaaacaagaaau

SEQ ID NO: 2692 - RNA, 944 nt, Mus musculus
cuacugucguuggagggcggccgccagguguggagacaaguggggaucuuguugggaacgcgucuuugccguccuagugagacaguuugcuccuuucuaacagcccgauuuuuagaucacuaggaagccuagcccuggccgccugacugagggcguuuccaggacuugugagcccuaaauauucggaguggcgggcuuucaguggcuacgggcuucaguggcggagaaagacuccagcuaggagacagcgcuacggguuguuuccuucuggggagcagauucuuucccuuucccuuuuuaaaauacaggaugucacugugauccaaauuagacucgaacucugacuguccuagcucaguuaagaugcuaguauuaucgacgugaggucugcagggcugcaguuuuuucuggugucugacccagaugcuugauuuucuuuuucccccuuucaguucugaacauggacccagggccucaccauugcuagguaaaacacuaucauugaguuauaucauugcuagguaaaacacuaucauugaguuauaucugcagcccuuuuuguuuuaguuucaagauagggucuugcuuagugccccggggugacauuuaacuuuaauuuuuuuuuuaauuuuuacuuauuuuguguguauauguguaggcgacucgaguuagaucaaguccgacuggauggaaggagagaagaacuucucagccacggacaccccccucccuccccaaauaacuuagguuuuuaaaaaguggauagugauuuagaaaaacaacugauguugaccucuggccuccauaugcauuuguguacacacgugcacacacacauacagacauguacauaguacaccagaacgaauacuaaguaaaauaguuaugauguggagaagguugcuuugcagaaauguuugugucuacuuuugaaacaguuggga

SEQ ID NO: 2693 - RNA, 24988 nt, Mus musculus
cggaggcgggcgggcgcgcggcucagucccgcggagcggagcggugcgggcgcggagccgagcgaggcgcggagcuggcugcuggcgggugcggggacccucgccacccgaccugggagagcgggaugggacgccgcccgcggggaccuggguccccccggggaccuggcccuccacgccccgggccggggcugccaccacugcugcuuguacuggcgcuggcggcccaugggggcugcgcagcgcccgcgccccgcgcggaggaccucagccucgggguggugagugaacgacaggggcacgggacccugggcacucgggagccgaguccccaggcgcucacgaggugcaagggagaagggagacucgcccuugcuccuuucggagaggugcgcgaaucccggugaggcgggggugugggggggaacccauuuuuaagacagagaaacugaggcuggggcucgggcugcucgaggcucacgcuugcaggucuaggaggaugccggucccuuucccgcuccgugcagucgugcgccgcagccgcgggcgccccggggagguggucgcccagccggagccuggucucugguuaaaagcagcuccacagagaccucuggcggggugaccggugucacagacgcccggagcggugcgccccgcgagcuucgcggccggagugggaggucaggggcgcgcaccccaggccggggacgcgccugugggcguccggaaaaccugggguucccgaguuugccccgcugacgauguuagaagagccucccgcacggcgagcgugccgcgaccccgucucccuccuccaccggagcgaucggccuugucccgccggugcgggugacaaccucugcugugucaagcccgcugccguccccaucccgccaacucccacugccagagcuuagcuaggcacuccagcuuggggacccggguaccggcuucuucccaccucuugcccacccuccugacugaagucggguuuggaaacccgcaggagacccggaagguuucgaucagacuuuauggcuccgcaggcccgcgaagcccucugcaaaggcgcgcgcggugacuagagcccgcuuucgaggaggaggaggaggccccggccuggguuccuuagaucuggagacccggccaggcgcggcuuccugauuggcacaagccagccaauauccuaaugggguccuggcagaguccgcuuuccacgggcgguuggcaacgaggacuccuacaccucaggucuaggcaaggugucauggagauuuccugcuggaggagacacuggggcgggagcaaccuccaguuuggcaacauuugccccuggaucugagaggggcagacucugccaccccccaggcaucugagguggcagcgacccaugcuuucucugcccacuugcagaugucugaggguccccugagguggcuucuucccacuccaguggccucuaaaauagggguuccucacguuccugauccuaggcuuucauagcuggcuccccgaugccaugagcauuaggacauccagacccaguucuggugggugacaacagaguccagacgcacccucccccccccccccccccacacacacaccgucuuccuucaagcuuucaguguaucucuaacgggacugguuaggggacaggagacagagcgagggaggagucagggcgagggagccccugcccauccaaguucuuaaucaggcccaguguacuuaggaaguuugcagcagcggaccucggugguugaggugggguuggcuccucccccuggcaccugugggcuucauccgacuuuuccccuccccuacugaguuccugagcacuccagggucaccaacccaccagcacccugaagaucucacuaaccaggguaugugacuccaggcuugccagaggcagcaaaacccugucguccaauccuggguaaggcgggagggugccgcaggcagccuccugcccaggacaauacccucccgggugugggaaccggguccugcccgccucuccuuugguggcggugggggcgcccucugguggcccucuagggaauggcaccuaagagcuuggggcgcaggggcacucacugagcugcaaacgaugggcgggcuuugggugggagcuuucugaugccccucagaccgcccucugcgggcuguugagcgcauucaggucuggaugccucggaggagaaggacgccuuuguguuugugaucagccgcugccagacaccgcuaaauccacggcugggcagggaggggcgagcgccugugaauaaagccgggaagaggcccccaggcccccugaaaggacccgcaggaugugguuuccucacagcucaguggggccuggcuuugucacuccguuucuuaagugguugcacagagccaagugugcaaccccagggaagguucuggagaguggcgucccggaggccuuuccaagcguccagcuggauagccagggggaaguggacaguucagacacagccagaucaggcccuggguggcacacucugcagguuucauucgccaccugucuuggaaaauguuucauccgcugccuggcucugcagguucugccgcccgucagccccucauauuucauuuacaaaugucauaccacucagcccggccuagcuccguaguggaugccguguugccgugucucagaagcaccaagcagucguagcuucugauggcccacgguuccugggguucugccugagagcccccuucaugcuacucgaaugagcccagcaaguuucuacccagaagucuccuccuguggcaaaguuucucccacugucggcaccacacagcagggcagguucagaucuucauugcaaauaugccuacaacugaaggcuaguuacugggggaauaaacaaagacccugagggugggaccaguggugacaggugaaagcagggacacagagugcuggguuugcccgugugacccccucuugaagccugagccaccuaccugugcagaccuuaaacucccucagcucucagcaucuuuucuggaccaugcaggaauucccucuucuccccauggcuucauucuaggaacuacaguucacugugaauacaaaccaagauagccaggagauuaaacagagauugagccagaccugcugauacaggcacucauuaugggugcccagaaacugaggcaggaggaugguauuaaggccagcguggguuauggggugacucucuuuaaaaguggaaagaaggcuuagaggcauauuucagcacagagcacuggcugccagcccuagccccaccaaauaaaccuggcaugguggcacguaccugugaccgcagcacugggaagcagaggaaagaggauacgguauuuaaggucaucuuuggcuacauagaguucaaggcuagcccgagcaacaugagaugacuucuuuaaaaggaccaauucugggcguggugguguauguacccuuaauccuauaaucccagcucacaggaggcagagguggaucuuaagaguucaagaccuggucuuuauagggaguuccaagccagccagagcuaccuagcgagacacuguuucaggaaaauagaaagaagaugagucuggguguuaguuuuaguuggucuuaguuccgugguucucaaccuguggguggagaccccuuugggggucgaaugacccuuucacaugggucauguaucagcuauccugcauaucagguauuuacguugugacucauaguaguagcaagauuccagcuaugaaguaacaaugagaauaauuuuaugguugggggcauucuccaccacauaaggaacuguauguaugaaagggucacagcaucaagaagguugagaaccacuggccuagguuuuuuuguuuuuuuuuuuaauugcuucgaccaagguaacuucaaaauggaaguguuuauugacacagccccagagggguagaggucacguuagcaagguugaagaacuagcugccagaacagccgagaacucaugucucagguggcaggaagcaagcacacugggaaugguuugacaccucaagccagguccccagggacacaccuccuaauccuccccaaacagcaguaccgacuggagacggcguguucauacagaagaaccuggggugggguggccacuuucauccaaaccacugcagagcucauuggucuagcaugggaagugcccugaguucugucuaacacacacacacacacacacacacacacacacacacacacacagagagagagagagagagagagagagagagagagagagagagagagaaacuaggaaacaaaauguccuggcuucgcacuuugcuuugguuugagacagggucucccuguauagccauggcuaacccggagcucacagaggucugccugccucugcuuccugaaugcugggcuuaaagguaugugucaccacaccuggccacccuguggauagcuacuguugggacccuuuuaccuagaccugggcugggucccacacuacugcuuaaccugcucugugaaccaacagaucacaggccuucagucuucucuccuuucaaaugggccuguaggagcaggcugugcuuagggggagaagcuggggaaguucaggaggcuugcagggcacucuccagugaggacacugcugggggccgucuaggguacguuagacgucuuugcucuuaacuguaaacauggaggauuuauuaacacuuggcccugggucugcguacaggccagugccggcacauggaggagaaacagcucaagcauugcugggcaccuggcuugcagaaacgauggcauggauguguggucuucacacagccugacauccccucauagcuccacgucucacucugggcucaucuccagacccuucacucacuggugugcauguccuuucuagacucugaugcuuagcuacuuccugcaucaaaggcucacacccacuccucccaggaugaauguucuucccagggcuccucaccuagacaaucccgugucuacccagaacaacuuccuggguguccgucuaacuguccccucugucacaucucucccuucccugucaguggcuacaggauaagcucagaagccagccggcuccagccccaguucugcacucucaggcugugugacuggguccgugcccucccucaccucucuaugcuucucuccccucgauuguaaaaugggguuacggcagcucccauuucauugggcagacuuacccagugccggcucugcucaaaggagaccacagagaacaaaaccaaacaaaaaccagagcucaccauccuccacacauccuggggcuuguggggugcuuuugcgauaggaagcauucagugggccuuagcucagggucacuggagcaguugucaccagaaccaaagcagccugccacacugugcgcauggccuuccuccauccuccccuccucucuagacagaccugcccuggucugccuagcacuccacagacagcccuugccacagccaggaauacccaggcaugggaucacuccggcuaccuauuaggaucuaucuucauaaaagggucaugcaggggcugcagagggguucacccgguaaagugcuugccgugcaagcaugaggacccgaguucaacccccagaacuuguguuuacaaagcuggucaugggccuagcgagauggcccggccguuaagagcauggaccuaagacccacauuugauucccaauuccuacaacaggugacucacaauugccugucacucuagcuccaggggaccagaugccucuggucugcuuggucaccugcacucagguacaaguaccacaagaaauauauauuuauuauauauaaauauaagcuuggcaugguagaacauacuuguauuucuggcacuggggaggcagaacugggggggggguccccuggagcuuucuggccagacuuucuugccucuucagugaacuccaggccagugggggacccugucucuaaggagcugaacagugcuccugaggguaacaccuggcuuguuguccccuggcuuucguacacaugccuacacauuaauaaauaaacgagucgaguaucccaugugcuguguaacuguggacagguuacccggcucguccgggccucgguuuccuccccuguaacuggggcucccacugguguugcccuuacaagggucuggggggcuugauggggaagaggauaguagguaggaaguggguggccaaagguggcacuacccauggacuauagcaccuauuguucucauuuauauauuagugauuaccacaaacuucauauacaugugauacauauguacacacacacaucaggagcugcugcugcuucugacacugguuagaaggacaagaaucugaauacagcuucugggccucaguuucccuacuugugagaaguggcuagcaguauguuugccuccagcugguggguccaauuggagagggauaagggauggcuguaagauucacagcaauagcccgggugccaggcaagcucugcaggcuccuggggcuacacauggcaccugaccaaggcuguggguagagcugcccagguuccaagagacacgguaaagucagcuaccgggggcuugggcggcggcugcacucuauaaauuugcuaaaaucgucugaaggauuuuagcgcuguauauauuaugccucguuagagcugugaaaagaugcacauugugucaaauggugauaaacgcaacagcaagaugggaaagaggagggagcccggcauucacucacugacugcguguuuacaucugugcaggaaucccugacuggcccagcuagcugacuuaguacuggucugcaguaauggucccguucucugacugggcuaacaggaaaggguauccgcccuugggggugggacuccccuucuccuggccccaccccuucccuaguggccuucuggaagguucacccugagccucacagcauccgccugcugcagccuccguugcccaggagacagcggucugucuccguggugacaguggaaggaggaccaggccgccaagcaggaagccagcggcccaggacaggguguguggucccagcucuauagguauuaggagacagggagagaaagugaggggguccggaggucugaccucuggccauccuguugcagccgcugagguugggaggggcuuguacaucuucaaggauaagagcaggucaggugaggugauaagggacuggcugguugcuagcuguaaggugcugguccaggcugccuauucugcagaaaucguguccucucgguggcuuuugucagccuaggcagcccuaaguccccuaggcuaagugccaccucaguggcccguuauccucauuuggcauuuaacagccacaagucccagaugauaaugugacccucuggguguuugagguucaccuggcuagagcuggaugagcuggcugcccagggcuuccacacccccauacucugaugcuaugggaauguugucagugucuaccugaggccaacgcuggccaucacccaccucccccaaccaaugccaacuguagucagccccucccaggacuuaaggcugugagaaacgccuugguuggauacugggagggggcuagcaacaugcaaaagauugagcuuucucuuggggggggggaggggcaucugagauugcaggugcaguguugcuuagucccaauuauguucuauucuagacaggauggcaccaacugccaugccagcuuagggggaaaggcaugacccuacccucccagaggaccucaaauccucucuguuccccguucauguucacucuugggagauggacccccauccccucugagguguuccauggaugaguuccgggggaagcuuccugcaagagggaauaauggccaugaggccuugggccccuggcuugagccugugagcuuggcagggagucuugaaaucgugugugugugugugugugugugugugguuugacacuugacaauaccaaaauauuuuuuaaaaaaaauaguuuuugagagaagucaaaacaugaucuuacccaagcuugccucaaacagaauccaaaauggggcaguagacagaucugggccugcacccagggguguggcucuaacuuccaggcugcucuggggaauguugcccuguccuugaagguccugcccuucagccuuagaagcaggucucuggcaucccguacacacaggcagcuuccggccuggcugcauggagggauggagugagaugaauuuugaaacagcaaccccagcaaagauacacauuaucuggggagacggccugggaggcacaccugcuacuauaugcaaauuacaucauccaggcuggauugccuagccaugguugcuugccccugauuaaggcccugaaggauccuagggagaugaaggccaggucucacuacauccacugggcucccaagcaacaguggucagcaucaacagcuagcccaggaaacagagcccaaguagugugugugcguguguuugugugugugugugguuugacacuugacaauaccaaaauauuuuuuaaaaaaaaauaguuuuugagaggagaagucaaaacaggaucuuacccaagcuugccucaaacggaauccaaaauggggcaguagacagaucugggccucaggaccuggagggccagggaaggacaugaacggguugguauuuuuaaaguguccaucaaaaaggaagcagguuacuggaugugauggcacacaacuuuaaaugcuagcacuggggaggcagagacaggaagaucuauaagcucagggcuacaugguaagacaguguuucaaaacggguugugugagugacuggauuaauggcccagugguuaagagcaucuguuccuauugcagaggaccuggguucaauucccaguaaucgugugugugggguuuacgaccagccauagcuucaguucugggcaucugaugcccucgucugaccucugugggcaaucaacaugcaugugguuacccauagacauccaggcaagacacucucacacaaaauaaaauacacaacucuaauuuggaauaaucuuuuggagauuuauuuauuuuauguaugugaguacacugucauucucuucagacacagcagaagagggcaucaggucacauuacagaugguugugagccaccaugugguugcuaguaacugaacucaggacugggagaccagucagaucucuuaacugcugacccaucucuccagucccuagaauaauuaaaaaaaaaaaaaaagaguacuuuaauuggcucacaguacccacauuagcuggagucuuuuagcuucaacuccauggugcuucuagccucugaggucaaccugcauucauguguagagacauacuacagaaccccauaauuaaacuuuuuuguugcuuuuuuuuuuuuuuuuuuuuggucagggucucuuuauguagccccggcuguccuggagcgcucucuguguagaucaggcuggccucgagcuuucagagauccgccuccuucugcuuccuaagugcuaggauuaaagcuaugcaccaccacagcuagguaauucaccauuaaaaaaagaaaaaaguugaggagagagagcgcuugcauaguauacacaaaaccauagguucuaucccuaacacugcacaaaacaggcuucguaguacaugucuauaucccaucccuugggcaguggagagucagaguucaaggucauuuuuagcuauaaaguaaguucaaagccccuuuggacucugugagacccgcagaagcagacucugggauuuuaagaccaaccuaauguacauagccagccaagacuauacaguaagacccugugaaagagaaugagagaggagagagagagagagagagagagagagagagagagagagagagagagagagaacaggauauggaaggaaauuagucugcaggauugagccucuugcuugggccuuucuugaaaggaguaugguuuuggcucagagcacccugcccuacacaaccuucugagccagccauauagaugcaagucucaggcaggaugguugucaccaucagcauguggacuccagcgccaucuggugguugcuggccaauguugcgccugcacaugcucacccacauuucuggcauccgauuuauuaucugcguauaaacccagaucuaaggacagagauguaguaggggcggccagggcucaggaggccucucccuugcaacagucgugagccugagcagccccuccucaagugggcucuacucuaauaaccucucuguuguguguccccaggaguggcuaagcagguuuggcuaccugccgccugcagauccggcaucagggcagcuacagacccaggaggaacuguccaaagcgauuacugccaugcagcaguuugguggucuggagaccacuggcauccuaggucaguuguccgggaggcaccgggaggcuccugguuccaucauggcggugcuagccuggucauaccaucccuggcugcuuggggcccugaaauuagccacuguggacucagacuggauagagccagaaacuugaaugcuggcuuaacuugacuggauaugcgggggagggggagggggagauugaacacaccuggccuugggaccaucagcccugagggagcucuucacuggggagguggagucaggccuauuugcugaccuguguauacuguccagaugaggccacucuggcccugaugaaaaccccucgaugcucccuuccggaccugcccccuggggcccaaucgagaaggaagcggcagacuccacccccaaccaaauggagcaagaggaaccuuucuuggaggugcgugggccaggaugggggcgcccuaggcuagcaugucucuguccuucugccaucccuggggccagaccaggucugugaggaucccaccccuguguagacuagagaggguggggccggcccugagaaaucuuaucacccaggccaucuggaaagcuaaccuuugcuuauuacuccuggccucguaugcauucaucuccuggagacuaggaaaaggcagacaauaggggacacucacucauggagagcagcgcuugaccccagugggagguccagaaaggcaucagggacagcuggccuccacucugacccugacccuaggguccggacauucccacgggacucaccccugggccgggauacugugcgugcacucauguacuacgcccucaaagucuggagugacaucacacccuugaacuuccacgagguagcgggcaacgcggcggacauccagaucgacuucuccaaggccgaccacaaugacggcuaccccuucgauggcccugguggcacgguggcccacgcauucuucccuggugaccaccacacggcaggggacacccacuuugaugacgaugagccauggaccuuccguuccucaggugcgugggggaggacuuguccugaguaggugggacccugggccugaguagucccugugggcccugcagaccccacaguagcagccugaaccuauaaaagaagguagaugcgguuguggcccccagaaugaguccccacuuuggcuuaaagaguucugcccuaaguuagccacuggcugagacccguuggguucuucucauggcacugaaccacaaggggucugcagucagcuuggcaaacccggcuaguucucugcacagugcacaggagcccaaaucucucacauaggguauagggguugacacccacuguuuuugagccuggaaagcccaccaucaccaccaucuucacagucaccaucuucacaguuauggccaucaccuucacagucaucacugccaucccugucaccagcaccgucaucccuccaucaccaccauuauuaucacuacuguccucaccaccaccaucuucccaucauuacaaucauaguuaucaccaucaucuucaaccaccaucaccaucaccuucacgaaucaucaccagcaucuuuguuguucacccuuaaacacccuuaucugauccaguucagcaugauaugucuaauccuggguugucucuacuauggccugguccuaaaaagggcugacuuccauagcaugaaaauguaagagaccccugggaaacuccuuccagccacacagggccucauaggagcucagcgcagucucacauaaccacagcacacauuuaggcuaacuugagcccccaacacagccaggaugcagacacccccugagcucuuuauuccagcaccaucacuagagaggggguccugucccucuuuucucacacaguuucuguguccucagaugcccacgggauggaccuguuugcaguggccguccaugaguuuggucaugccauuggucugagccauguugccgccccaagcuccaucaugcaaccguacuaccagggccccgugggugacccgcuacgcuauggacuucccuaugaggacagggugcgugucuggcaguuguacggugaguguccccaaagcccaggagggaccguacggaggguggggcuaggaacaaaugccccaaguaguuagcucugcucagggcuguggccucuuagucuagaauacugugggcacaugauaucuacuggggaugggacagaggagagaagaaaggagcgcagggcgugggacacgggccucucugcuuucuaguacuggugucccagggacuuagagcccuggggauuucauaucucuuccucaaagguuugucagucuuggcagcaaugaaaauggacccagaccuacugggcaugugcuaaauuaaccaucuaauccuauaaugaaaggaggaacaguagccaugggguuggcccaggucaggcagcuuguccuagauagcucauaagcuugaauagcccuacaggaucaaggaggagcauuuugcccaggauagcccauaaaagugugaagauaucccuauaggacaagaauucaagcacauugccccagaguagcccacaggaccaagaggcaagcuagccagguagaguccuugauggugagaggaaggcagcuugccuagaauagcuccacgggaauauagacagccaaaacaggaacagagucuggcccaggaccacuuccaagacacaucaagaaguagauagaggugucucuguccccguguccaucuggaauacgaugcucuggaggaaggaucuuucauauacagaaacaccauucugcccuagaagagccaacccaccgugaccagccuccaggcucgccuugcaccuccuaacuuuguuccaagccuccucccgcuccccuccaccccaugagugggguuguuguuguuguuuuguuuuguuaugaugguaguguuuuugcagaauugucuuuuuuuuuuuuuuuuuuuuaauuuguaugugccugaaaauaugucuguguauagaggccagaagagggcaccagagccucuggaacuagaguuacaggcaguuagugagccaccauguggaugcugggaacuuaacccagguccuuugcaagaguagcaagcacccuuauucaccgaacuaccucuccagcccgugugauuuucuuuuuauguguggggauuucuugccuuacauguauguauguauguaugggcuccgcauguaugccuggugcccguggaucucaggagagggcauuaguucccccuggaacuggaguugcaggcaauugugagaugugugggugccgggaaccgaaccuagguccucugcaagagcagucagugcacuuaauggcugagucgucucuccagccccuguguguuauuuguagugcaguaaaauuguccaucuccaagggugaacacaggguuaagguagcacaaucacagaguucugcaagcaccacccuguccaggucuccccuaaggagagcugucucugaagauugccugaagugagacaccuuggggaaacagagcucuacagaaugaggccuucuguagcuagugaucugaucuucccccaagugugcuguuuucaagguuucuccuucaccggagucagaucagguuccuuuucaagacuaaaugagcccagcacugaacccugggucacuucccugucaggcucuugugacccucgcaguggacauugcugaagaauccuuguagcucuccuggcuuccaucuuucccugguguccacccaggaguguggugguuagggacgcugaugcguuggacaagcucuuggggcauaguacacuucacaggcaugcugugguggucugcccuaccucggcagccauuaggcugcauggaaauaccaggaaaucaccugcuagucucacggcccacgccccgugcccagggcccuuggaaaggcggggugaacuagggcccuggguugagugcagucuuccugucuacacaggugugcgggaauccguguccccuacugcccagcuggauaccccagagcccgaggagccaccccuccugccagagccccccaacaaucggucuagcacuccguaagucauguccuuugucacucuaccuuggccagccuguccugguccaaugcugcccuuucugggcucauaguacccaggauagcccaggacccuggggaaggcauguugcaugugcugacugguucuggggcacacuuucuucucuuaaacuucucaauaggagaugggggagcggggaggagcaguuaccccagggagcuauagugaaucucaaaucguuccucuccuauagccugguucacuaagcauagcaccuugaucuugcagccagguggcuggacugucaccauuauuuguuagggcuauggaggacucagggguuuuguuguuguuuuguuuuguuuuucgagacaggguuucucuguauagcccuggcuguccuggaacucacuuuguaggccagacuggccuggaacucagaaauccgccugccucugccucccaagugcugggauuaaaggcgugugccaccacgcccggcauggacucagaguuuuguauuagugcccgucccucugcauuuugacugagagcugaguuuauccagucaaucucccauccccugucccccaugccaugugucccccacuccucccaagccccccaccccugcacauauccauauccugucccuggggcuggggcuggggcugucagcacagcagcuagguucuguaauagaaggacguuguugaaaguucccacagcaccuuugcaaucaaaguacgccucugcuuguucugguuugguuugguuugguuugguuugguuugguuugguuugguuugguuugguuugguuuucuggggacaaugucuuugucuauagcccaggcuggccuugaacugcugcaauuuuucugacuuagccuccaagggcugggauuguagacaugaguaacgugugugugugugugugugugugugugugcgcgcaugugcgugugcguguguguguguguguguuucaugugauggggcuccuugugaaugcaagguacgugugcugagcuauaccccaaacccuguguugguugguugguugguugguugguacuuuccguuugguuugguuuugagauagggucucaucuaucccaaguuggcuucaaacucuuuguagcuaagaaugaggacaaccucccaccuccugccucuauuuuccaagugugagaauuacaggcauguacagcccaggauuaugcacugcuaggaauugaaaucugggcuuugugcaugcuaggcaaaugcucgacagccugaguugcauccccaacuugugaugguuaaguguguguauguacauauguauauacacacacauauguauaauauauuaguguguuuauguacauauguauauacacacauauguauauuaguguguguauguauauaguacacacauauauauuaguguguguauguauauguaugaauacauacacauauauuaguguauauauauauuaguguauguauacacauauguacacacauauauuaauguauauauguauauguauacacacauauguauauaucuuuaguguggguguggguugugagcacacacauaccacaguguaugcagaggugagaggauagcucaugggaaugaguucucgccuucuaccauauugauucuagagauugaauccuuguuauuaggcaugacagacagcaaguacuuuaaugaacugaaccaccucacucaccccacguugauucuuuucagauaggguuuuucuguguaauccuggcuggccuggaacuugcuacauagcauaggccagccucaaacaugugaacaucccaccucuaccucccaaaugcuggcauuuaggcauaagccaccacacacuuggcuuugcuuguuuuuucuuucugugauaauugaacccuggaccuugcacgucuuggacauugagagucauuuuucucuuuuuggccccucccacucaguccucuagguggguagguaugugugugugugaccccugcccgaggguucugugccuugucagagcaugagucuccuuaugaaugugcacacugcuguauggcucugcagguacuuuccugggaagcccucuccucuguggcagagccugagggcaggcugccucucacgaaugcccucaggacuccaucagggcacccucugcugcugaucaccaccggcuccuacccaccacuccugcuuacugugguagacaggauccacuccaucucugaaguaugacacuggcucaucugcagugugcgccagcaaauauucacaccccuuacccaccgggcucuacaugcugacacuuaucuaccuaggaaacugagaagccauucuuacuuccuggcuauugaggauuuaaaaaaaaaaaaaaacaacaugugucucuuuguggauauauguacuacagagaccagagacauuggauccgcuggaguuguaauagcaggcuguccugggccaccugaugugggugcuaggaacugaccuggguccucugccagagcagaaaauacuuguuuguugguugguugauuuuugagacaagaucuuacuauguagcccuggcuguccuggaauucacuauguagaccaggccauccuccagccaucuucuauaacuuuaggaagggccccucugaaucuuguaaguuucaggaacuuccugugacuugggaguuuuguuucccuucuaaauagcaagggccauagcuccuagaaagguuuugaauguuuuucauucucaggccauuguaaccuaacacccaagcugacaggaucuggugaucucccugccucaaccuccagagugaaggauuauaaguggugugcccacaaaccugaguuaaacucacauucuuuguuuuugguuuguuuugggauguugauguuguugucugguguuucagguuuagaggaguuggcuuugguguuuugagccagucucguauagccuaggcuagacucacaaaguaacuuauagccuucuuguggcuuaguucuaacugaccuuguuugccugguaggcacuggcuaccuuguggacacagguuguuguuauggguccuuccaggaugcucacccccgugguucuggcaggaauagcucacccagcugcuucgauguucucccacucagcccaucucacauucugcccugcaggccccagaaggacgugccucacaggugcacugcccacuuugaugcuguggcccagauucgaggcgaagcauucuuuuucaaagguaaacccugggguccuguggaauggcuagauggauucccauagccacagcaggcugugguagccaccuucccuuuccucacccaggcaaguauuucuggaggcugacccgggaccgacacuuggugucgcugcagccggcucaaaugcaucgcuucuggcggggccugccgcugcaccuggacaguguggacgccguguaugagcguaccagugaccacaagauugucuucuucaaaggugaguggaccgcuuccaugugcgugccccagcuugcccuggccucccucgguguugucugacuugccucagccucuccugcacccugccaaucuagagccacccgacuggugagaacagcuguacucauuggaugccuguauuguugccuacuggcggcuuggccuguagggggcgcuauagacacauagugagccaaaaaagaaaaaaaagaaagaaaagaaaaagaaauuuuauucacaggggauguagguggauguagguggaugucugauguugggagggaugaaaauuccuacacagaggaaggaguuuauuugaagcaguauuagaggugacggaggaaagcaagcuaagguaggcaaaagccuaucuagugcccugccauuaagcaaaaauccaaguuuauagucaauaugaagaccccgaggcagagacagccccucugagugcagagaacagccgggaccucagaggcaaugaaaugcaagggggaugugaggccacccaacccuggcccuaauucuaaagccuucagugcuggacuuggacaggcuguaucuccucuauccacaucuaugccacaggaggggagcacauuucuauaguccuagcacucaggaagcugaggaaggaggauuguuacaaacucccagccagucuggguuacauacugagacugucucccaaaauucagguggccuggggacuauggauauuguuuaauugauugauuaaauacuuggcugagcucacacaaagcccuagguuugcaccucagcacugcauguaccauguguguuaaucgcaacacuugagaguuagaggaaggaggauugucaguucgaggucauccuuggccacagagcaaguuggagaccagccuacguuaggaaggagaugcgcgcgcugaggugugagccuccugggcccaugcacagguagaaacgggacccuuccuaugcuagcuaugggacagaaaccugggaucaacaugagcaaguggcuuucccuuggcucaaaggugccaguguaccuuugaaggugguaccagacccaggucauucucccugcucagcucagggcucuacaaggacaccuggcugccugagccagcaugaccucguauauuacuugacuaugcugcaacaaauuaaaacuaaagcaacuuagggaaggucuuauuuuggcucccaguucuaaggcacucaguccaucauaguagagaaggcacugcuggagggaagaagagacagcuggucaucuuguauccucagccagggaaggcgcgggagggaggaugagacagcugguuauacuguauccucagccagggaagauggaugcuggguucagcuugcuuucuccuuuuuauucagaugggaaucccagccuguggagauggugcugcccaccucaacccaaucuaaaauaucccucccaggcacuaccagaggcuugauucuucacacuaucaaguugaaaacauuaacuauuuauuguacugccccaccaccaccaccaccaccaccaccaccaccaaugaguguagcucacuggcccagauuuacuuuguauccacaggcuggccagcuuuuucucaguugacacugagcuguguuguagaaaaacuuaaaucccagccugggguuucuaccccgccuuugguuauugaguucuuggauaaaacacacacacacagacuuuuuuuuuuuuuuuuuuuugguuuuucgagacaggguuucucuguguagcccuggcuguccuggaacucacucuguagaccaggcuggccuuguacucagaaauucaccugccucugccucccgagugcugggauuaaaggcgugcgccaccaugcccagcuuuuacuuuuuuuuuuuuuuuugguuagccuuuauauuuuuaauuaagccuuaagcaauauaacagcugggcagcugccuacccuccaugcaguuagaaucuacuuuccugucgauaacccggaguuauuacuauuuacuauguuccaucugggcugcucuuaacuccaauugggcaucccuaggggccacguucucuugacucuuaacccauggcggcuucuccuccaggcuauugaaaccuaaacuccacagaugucucuucugcccaacucuuggcugucggcaucuuuauuuaccaaucacaauuaacuggggguagggucacauagcuagagucuacauauguacucucucaucucuggggcaaccaguuuuggggagcccagauuagcauuagaaucuaagcagcaucugcccagcccacuacagaacugggaagcccaagacuaguuguuucuaagcacuggccccugagccaaugagaccacagcacagcaaguguacauuucacccauacacacccacucuugcaucaccagggucuccccuugcgcugugucuuugaacuccaaucuagaacauuccuucaggccuucagcaucuaccaucccaggcuccaaccuccaugugccauguuuccucuagauuaggaaugucacccacaaguguccugaucauuccauuuuaugguagucuggacaugguguaaacacagaauucuucauuauguuaccaucuccagccuauaguuaccaggaaguccuggaaauagccaagagcuaccugagcaucucgcccugggucccucccacacacugguaccccuggauggagcuugccugcuucccugaugcugccuugcuccagccaguguaucgaucuuuguucucacugagguuucuucaacgucuuaauucagugucucacagagaccccugcaucucacuuguaauagggucuggugcuccgugccuuuaaccauagcauucagauaggggaggcaggcggaucagaaguucaaggucauucuugggcuacauagugaguuugagacuagccugggucacaugaaacccugcccuauaaaggguuuaagauagguuauuugauuaagauauauagcuaucaguggagcaggguaacagguaucuuggcuccuugucucucuaaguggcugucagaagaggacccgauucucaggcauugauuaacugaaugaccugcaccaagcaaauaguaggugcucaaucaaugucagacgcagcuuuuccuugacgugaugagauggggucacuaccuuguccugccaccugggugaagaugggggggacauugggagaagucaagacuggagccuuugccacagcccauggcucuuucucucgccaccaggagacagauacuggguguuuaaggacaacaacguagaggaaggguacccgcgaccugucuccgacuucagccucccgccagguggcaucgaugcugucuucuccugggcccacaaugacaggacuuauuucuuuaaggaccagcuguacuggcgcuaugaugaccacacacggcgcauggacccuggcuacccugcccagggaccccuguggagagguguccccagcauguuggaugaugccaugcgcuggucugauggugagcaccgggcaggggacgaugcuguccggcauguuccuugucuguagaugggguuuggggaugggauucccuaaaucacuguauacuccacacuuaugugugugagagcucugagcgguccagggccucaccucucuggcuuugcucccucuuuguucccugcuuuucuuuccccaaacacacuggacuuccagccuuuguauguuuuccuaagaggcuccauccuccaccccaauacuaaaagagaugcucacagaacagaugcuagggaaacuguggcaaagaagaguggagguugacaauccaucccugugucccacagccuccuccagcuauccaagucaggcccaugcuucugacugacagauguggcccagauagccgaagccugcuccccacccaacccccgacccaagcucuguacucagccacgcugucccauguacagccccuugugauugagccagcagcucagccuuccuccuccuccccucauacaggugcauccuauuucuuccgaggccaggaguacuggaaagugcuggauggcgagcuggaagcagcccccggguacccacagucuacagcccgcgacuggcugguaugcggugagccgcuggcggaugcggaggauguagggccuggaccccagggccgcaguggggcccaagauggucuggcaguauguuccugcacuucagacgcacacagguuggcacugccaucucugcugcuucugacuccacugcuguggggccugugaaccucagucucugccaaggcauccugagggcagugcuagccuugcggaucaaggagccaaggggagcagggacacacuggccaguacucagcaggacuugugcuccaagcuuccggucccucgcuccuuccuuccuuccuuccuugaacccaggggugcugugccaucugcuggaguggucuccagcugggacaggacgucccaccaagggcauccaugcacaccuugccuaccuggagcagccauaggcagcuccccuucccuccucugcacaucaugcugcuucguugcaccuugccgggcugcccaagcccagcugucacaaccccaggaugccuugucugcaccugagcggcucugauggcaucugcacgugggcugaugaggggcaaacagggguuccucgugguauccguaggggccaccaugccuguuucacaaguaagagaguugaugccccgaugggggaacagggugggagaaaggcaccuacccagaagucugauccacugccguuugcagcagccagcgccguaucugcugggauaggggaccagucacacucaggaucugcccacagauucccagaugcuggccaggggccuugcuccaaccaccaggagcacagccaccucuccccguccuagauagguuagccauggaggcuguguccuguuaucucccucucuuuggccaggagagcauugugggucucccucgggugcuguugauggggguggggggcgcccauagagauauuucuucaucugucaguacccauugcuucagcaagaugcccccauauaguucuggccugagacccugcagcuuggacucacagcuguccccuccccagcugcagaagggcuucuaacaccuggaauaaaggugggcguucaguuuagggaaggaggaugguugggggagcccagggugauagcaagggggagcugcagggauaagugucaggguccucggggagucaugacaauguuaccgccuaacuuggagauguaggagcugugcacggauugcuucucugggugacaaaccuccaugguccagaaaggggcugagguugaacccaagauggguuaaugagcuccagaaaggaacagccaaguucaaagguucugggacaagacgggccugaggaacagggccacccagguaggcguggcuguaggguaagcaguuucugucauugggcacgagaugaaaauuagugaucacacgcacauaccccccuccccaacuggcccggucccaucucagguaagaaaggcuucugucuaccccaggccagguuugaguguugucaggaugagugagcagcuagcggggccuaaguuucuacccuccauuucccaagccuggccacacccuagacccaccugucagacuaggcaggacagagucagggguaggggcaucugagguuucccugucuuggaagccacccuacucugcccucauaucaaagcacgcuccuaugaugucccauguuguccaccagccugcaggacacagauguccuauacagcaacagggaaggguccaaaaaucuuugucacauagcacugaaagccaggcccgcaggcuggagcugucuagaugcuggugucacacucauuuuaaaacccaaacucuuaauaaaaauuuuguacacuggacagguugacagcucagugguaagguuuugggguugaucuccuccuguacaacucccccaccaccacccccaaaauucucuguaccucuggucuugggcuaaauggucagugggaacagaguucucugaacugcccucccaugcccugccugccuccauugcugcauucggaggucuugcagggagagcagaacagauugggugcuaauaaugcauggauuccugcaggcuucgcucugcaguuggacagaaugcauugcuggggccccugugguuuaugaugucgcugcccuuacagaggcuucaggaagaacauaagagcaucugccccgcccacaggcugcuggauaugaugcagacucugggcacguacugucccaugcuuccuaugggauaugacucccccugaggcgugcucuccagaaaaccucgggaauuccaggcuaucaucuauuuugagccuccuucaucaucccgaucaccuucucuccgggcaaaaagcuaacccagugccagguuucccaaaugcugacuccuacccaaccucugcaucugaucagccuaccugaagcuuccggagaccacagccugcggcaacgucuggcgugacaccacauggugucccuuucuagacaaguuguggcuaaacacauauuucucugucauucugacuucuguggucugugaguccugggcugagcuggcccucugcacuuagguggauggcccuccugugaccacggugaaacuccaggaaagaggucugaggacucgcaccauccagggagggccuaguagccaucaaggguagucaugggcucuugagccuuauaagcaaacacgugcucuguguuugggaagaggaucaaggaaccccuguguggcuucaagggccaggucacagccuacccaauucucauuuuacaacaaggcaugacgucuuua

SEQ ID NO: 2694 - RNA, 3381 nt, Mus musculus
ugagcgucaucacgcugcgcccaugcuccgccggccuugugguggacuccggaggugagcgagggugucaaccaggucuggguucugggggucagcagugcugcgucccgugucaguuucccuggugguuucgguagcgacugauucucagagcggccccgagucauagucucgucuuuccucuacaggaaccuggcucaccggccgaggucuugccgugagcccuuguguguacaguagcaggcuguaacugagacagacagcugcaguaagugcuguggccucgagaucgugcccugguaacgacaaggaaucaacaccgcagacucgagaguugagcgcuucaaacaaccccguuuauuaguaauacucccuaacccgggaccaguuccaagaaagguuaccaagugacaagguguuucuaaaugguuacagcacaaauaauaguggguaaagaguaaauaaggugacuugucuucuagugagcucguagguaccuguagguagaagagcuuugcucuguagagcuucugugaucaguagcaggggaauuuuuccgaaugauuaaguuagcuggucucuuaacugcuuauuuucccacuguauccuuccucauuuggauagagggacuccagugugaccaguuuacuugugugcuuacacacuaauaguuccucgaaacacuugugagcaggccauguuauuccuaacuuuucuguauagggaauaugaggguuagauccauuuucuacuuuguaacuauuauaaagauaagaccuuuaaggaccucuggccuggcuguuucagaaaaguagaaaaaaugacuacuggacacaggcauugcuccugacaaaauucacuugauaagcucuaaccaucugaaggcuaguuuaaaugggguauuguggcaccagccuguguauaauuucagaggauccccuguaacgggugcuacagagguuuugagccaccauaagggugcuggaaacugcacccagguccucuggaagagcaaccagugcuuagcugcuuagguaucgcucuagcccaacucaugggaggcuaauguagaaacaucucccaauuuaaggcaagccugggcuaccguggagaaagguaaacuucaaaaaaaugaaacaaagccauugguuuguuaauggauaggggaaagggggcaagacugugucuuaacaauguuaagcuuugaggguauuuucuuguuuuauuuuaggugcuuacagacacauaaugucaauaguccguucauccguccacgccaaauggguuguggggaaggugauugguacagccaugauaaaaacggcuaaaguaagagcgaccagacuuguuuuggaucccuacuuacugaaggugaggaccaacacuuguuuuaaaaugccaucgauaaaguuaccaacauuccacugcagcuguucucagccugugggucgcgacgcauuugggagucacaugccagauguuuacauuaugauucauaacaguagcauaauuauggcuacgagguagcaauggaaaucauguuauggucgggggucaccacagcaugaggaacuguauuaaagggucgcagcguuaggaaggcugaggaccacugcuuuagggucugagcggaaaagcauuucccuguccauaaaagauaaguugagcaucugcagcaaucugcuauacccacugcugaccuguagguguaaccggguucauaggaggcuuucaggagcacacacgucauucucagguuuccuguagugacuagcuaggcagaacagcacgggaacaggauaaacucuuaaccccuucuucccagguugccauaagucaucccaguaaagagacauuugagccgacccuccaguacaauuuuauuccuugaccggguagcaagagucuuuccaccauugaugaauacagcugugauagggcauggccuccugcagaaacagcaagugguuuuaaggaaucaaggacaguugcuuuguugcucuguuuuguuuggggacagggucacucuauguagcccuggcuguccuggaacucaauauguagaccagacuggcuuugaacccacagagauccaccugccucugccgucggucugcaccacuauaccuaggaauccauaaggaccagcuuaaggagugaggcaggggauccugcaaaaccguggaguagaaacaauaaagagcugaacuagagugacagcagugggaguggcgugggcaaggcagaccugggcaagaagggauggagcugugguuugugagaugaauagggagaggggcagcuucccggaguuguuuuucuguguguguguguguguguguguguguguguguguguucuuuuugcaucacagaucccagaugggaguuacugaucugccacucuccuucccuccacaguacuuuaauaaacggaaaaccuacuuugcucacgaugcccuucagcagugcagcgucggggacaucgugcuccucagagcuuugcccgucccacgaucgaagcaugugaagcacgaacuggcugagaucaucuucaaagucggccgaguuaucgaccccgucaccggaaagcccugugcaggaacugccuaccuagagagcccccucagcgaaccucgggaggagcucaaggucuccugaacccaggaaaggaggagccagaggcauuucugucuguguguuuugcucaaugguuuucauuacuguuucuccugugacauuaaaaguagucagcaaaguaaagagcuuagugcuccauacaggguugcauccuuuuucagauucucugaacugaagguacugauuacucuguaugccuaaggaugcggcaucauuuugugagcucucuguccuggaucguauguauugucucauuguucauugccucccccaaagaaaucuuggacugagcaccuuuguuuugaaagaagaaaaccuuuugauaaugacauaaaaggcuaaacuuaguuuuggcagcuugauuuuucaaaauuuauuguguguguguccacaaugccugugugggcacaccugugccaccacacacacacuguggcagccagaggacagcuuuguggaguccggucuccuuucacucuuacgugguucccaguaacacaccuguacccacugagccauccuauugacacugaguuuuaaugauucauauucaaaguaaauuggccuguuuuguuguguuuugggagacaagguuucucuguguagccuugacuguccuggaacuugcucuguagaccaggccggccuccauaucaaaggccuagccucugccucugaaguacugggauuuaaggugugugccaccacugcugacuaguaaauuuaaauuuuuucccccuua

SEQ ID NO: 2695 - RNA, 1484 nt, Mus musculus
guucucuagguucuugcgcaaaacucugguuuugaccuucaggaaacauuaguuaaaguucaagcugaacauucggaauccggccagcucguagguguggaucugagcacaggugagaauauugcagcuugguugugagguaaaccuaggugggggaagaugggugacaggaggaucuugguaccagugcugugggaaaagcagaaagcuuaugugaguaaccuaauagaagacauuugggaaugagagaagucaaaagugcauguguugugcgucaacagcaguguguccugagcagagugugcagcagucugcuaagcagugagcacugacuguaaggcauugcuaagaguguuuggagaagucuugguuacuaauggaagaguacuguuccuuuguauuuaaagucccugagguugaccugaugcagccugugauccuuucagaacugaggcaacaggaccgcagccuggaugcugucuugcgcuguaguauagaaaauucuuaucuuuugaaaaggaaaaaaaaauauggucucaauuggcccauguuuucuguuuuagaauugguaggguucauaaaauauaugaaaaaagccuuuggugcucuugguuauuugcaggugagccgaugguggcugcagagaugggugugugggauaacuacugugugaagaagcagcugcuacacuccuggugaguguacacgaucauggcggcucgcgggcgggcggcagacacagcaguuuggguugauagcucaucuguccucucuuccuccuuuucaguacugugaucgccaccaacauucuccuggucgacgagaucaugcgagcugggauguccucucugaaggguugaggccugccugugauacuacaggauguuggggggaaugguuauuuuuguccaagcuucaagugauuuggaaaaaaauuuucucuuccugauuggagaaaagaaacgggacauuugacaccuauucaaauuauacuguaaaauuuuauuuuauuuuugccuugaguaucugaagacacucaaagcagcucuuuuucaacccacugaacaagauguuuuagcuacaccgauacaaaaauuacauaagauaagcauguugucuacccuuguuccguaaguguucuuugaaaguuuguaaugguuuucuccuaaauaaggcauggugacacaugccuguaagccuagcccuuuggaaauaguccggaauuucuaugccaacucaggcuacaggagaccccaggucgaaagaauaauuuguuguggauguauuugaaauuauccagccaacucccuguuaaacauguaagauccuugccaguguaaaacacaucuggguaauuuauggguuucauaaugucuaauaaauacuuaaagagugaagcuacuggaucauucacacuugaaaugacugaaaaugcuucagaaaagcuaauaaagccaaguuacuccguggaggcuggaagguca

SEQ ID NO: 2696 - RNA, 17111 nt, Mus musculus
caccaaguaccaaaguuccgcaagaggagcaagacagcaacuccaauaagugucugcucaggacacagcuucagcccuuuguggucugcugucucccaagggcuccaggaccuuuggaauucuugucacuuccauucaagggccuacaaggaccucacggugaguagccaggcaguagaugggagcaaugggguugugaggcaaagacaggaaccccuuccaggucuguuugacccauuuccccuuaauccugggagagcacggauucucagagcaccugucaggcaguuaccuacagaucauggaucgguuguguucucugauuagcuuucugggauaucaaauuccaaaacauuagacuaucuauucucauuuagaacaccuccacaccccuagggagucuuggaacaagugucaggggauaaugaaacaguaaauccagauccaugguuggcucaagucaggccuuaagaacagggagauggacacacguauauuaucagaaaggguaaacacagccagaauuugaccagccuggcucaggcuggcauccuggugugagccaagaauugcucugaacucaaucacgcaagggaucugcugugccuagauaauaagugaggggcauuacaugcccaucuugggccuuuagaauggccuuucagcaaacaggcuuguuuuucaaggcauacuaacaccuucaggcucuguuggcuguugauagggucagcacacaggccuguuuccugcuauuggcaaaggagacaguuguuauucuaaaccuucuucugguaaccaggcacccagucgcuggacaccaggcuuccugcaaaggccagcuugaggcagccagcacugccgcuuggcuggucagcaaauugggccccuugggagaccaagcuuucuuggaaguggacaugaagcauguacccuuugccugcuugccucuuccuauugcugggugauuuuucugccuuucucaaacccugggucuggagcaggaauucaguuuccugguaggagccucuaugucccuggaacaagauaggccagcuuagcuucuccacauccaagauugagcacccugacucagggcugugggggauguggugcgguggcgguggggguggggcauagcucagcucagucaguggcagagugcuugccuagcauacucaacacccuggguuuuaucccuagcaccuaaagauaaaaauaagacgggcuggagagauggcucggugguuaagaacacuggcugcucuuccagaggaccuggguucaaucccagcccccacguggcagcucauuacugcccucggcuccaguuccaggggauccgacaccuucacacagauaccaugacacauaaaauuaaauuuuuuuuuuaaagcaaaguagaaauaagaguaaccgacucaugccaggcauggagacacaugccuuugaugacagcacuaggaaugcagaggcacaaagaucuauuuaucuaugaguuuuaggccagccagggcaacauagugagacccugucucaaaaggaaaaaaacaaaaaaaaaacaaaaaaaaccuuacaguguuguccacucugcuccaggacuacuggggucuugcuugccauugcuagguaggaucuacgguauccaucagcuaagacuuauacagugcaucaccuguccauugaaucauacccagcacuugccacacaccggugcugggcagaaggcacagagacaucuaagcaucacagucuaaugggagguuauagcagaggcugagaccaagcauuacucguccagcuccaguacagagcuuggcuuuuuuuuuuuuuuuaaguaagauuaucuugauuuuacauguaugacuguucuaugugugcaccacaugucugccugguccugauagaggccagcagagggcaccucauucccuggaacuagaauuauagaugguugugagcugcucugugggugcugggaauuugaaccugggccgcugaaacagcagccagugcuuguagccacuaagcuuuuuuucaauauccagcugcccucacucccccuuuuuuuauugauacaaggucucauguagcccuggcuggccuagaacuugcuauauagaucucacuagcuacuaggucuguuuucuucuucuuuuccuuccuuccuuccucccucccucccucccucccccccucucucucucuuucuuucuuucuuucuuucuuucuuucuuucuuucuuucuuucuuucuuuguuucuuucucucucuucuuucuuuccucucucucucucucuuucuguuauuuaagacagugucuucuuaucucaccuuggugacuaggcuggccuggaacauacagagaucugccugucugcugugcccagcauacccccaguguuuagcuuauuucauggcuauuagccaagagugaugauagcccaugccuguaaaccuaauggcaggagaaucacaagcuuuaggguuagcugggcuacguaauuaaucuuaauuguaagccagccugggcuguagagugaggucuagcucaacaaugggcuuuuuaauauuuaucuuuccccagcuuucuggcccacucccauucuuagaagugucuuucucccgggcgguggugcaugccuuuaaucccagcacuugggaggcagaggcaggcagauuucugaguuccaggccagccuggucgacagagugaguuccaggacagacagggcuacacagagaaacccugucuugucgaaaccacugucuccugugugagauacguuucgaaccggagcuccaccauuauggcuccaccauguggucgacaccucugucuccugcgggagauauguguccgacccggaguucauuaaacuaccucaugcuuuuacaucaaaaaaaaaaaaaaaaaaaagaaacccugucuuggaaaaaaaaagugucuuucuuuuucucaauaagcugucucuauucccuuagaaaacaaaacacaggggaggguaugggggacuuuugggauagcauuggaaauguaaaugaggaaaauaccuaauaaaaauaaaaauuaaaaaaaauuuaaaaaauuuuaaaaaguaagacuucaaaaucaaaaaaaaaaaaaaaaaaaagaaaaaaaaaaaagaaaacaaaacacacuccccucccucccccaagaaaaaacccacuaaccucuaagggcaccagacacacgugugguacacaaacauacauaagggugaaacgcuuguacuccaauaaaaauaaaauuggucaggaaaugaaaggcauagauguucugccauauggggaggagcuaagggcugagaaacggggaggggggccggggguggugguggugagagugcagaauacagcgcaugggcaugauggcacagaccagaccugaaacccugcacuugggaagucgaaagaucaggaguucaagaucaguuucagcuacaggcaaguuuagggacagcuuaggcuccaugagacucuuuguuuuuuuguuuuuuguuuuuguuuuuucgagacaggguuucucuguauagcccuggcgguccuggaacucacuuuguagaccaggcuggccucuugaacucagaaauccgccugccucugccuccccagugcugggauuaaaggcgugcgccaccacgcccggcuuccaugagacucuuaagccaaaagaagaagcaaaagagucgucgccgccagccaucauaggcagaauaacaacaaauacagaaggggugguggcuggcuuguugauggacagccgagggaggagcgguaugauguaugcaggaagcucacccuggaagggagggguaggaagguaagggaguccacagggauggaaggguaccacaggaugcaauaguaccaggaggaaagugcgaagcuuucuuucuuugccacaagugcagagaaaacacagaagaaaagcaaggguuggagagauggcucagcaguuaccagcacuggcugcccuugcaggcgccagaguuuaguucccggcauuugcauggcggcucccaacugcucuaauccaguaucucaggcucccucuucuuuaucccucuuuccuccucugcaggcaccugcauuagugugcacauacccacagacagcccugccugcuuuuuuuccaccuuuuuucuuauaguauuucaagacagcgguccucgguuuuagcucuggcugguuuggaacuacagcgguggcccaggccuuuaaucccagcacucaggaggcagaggcugugaguuggaggccagccuggucuacagcaauagauucagggcagccggaacuaaaacaaaaacaaaaaccaaaaaacaaaaaacccugucuuggagagagagagagagagagagagagagagagagagagagagagagagagagagagagagagagagaggaaggaaagagaaaaacaaggaaagaaaaacaaaggagagccgagugugguggcccaggccuuuaaucccagcacucgggaggcagaggcaggcagauuucugaguucaaggccagccuggucuacaaaguaaguuccaggacagccaaagcuauacagagaaaccaugucucgaaaaaacaaacaaacaaacaaacaaacaaaaaagaaaggaaaaaaagaggcgggaaaaaacaaacaaacaaacaaacaaacaaaaaagaaaggaaaaaaagaggcgggaggaaugggaacuugccugcuucuuuuuguaccccccucagagguguuugggaucccccugagauccacgugaccaugacccgggaugacgcccucccugacucgcauucugcacagacuuucuacgagaacuaugagcccaaggagauccugggcagguaagaccagaaccaccagcgacagacagucccugaccucagcucugaucgcagauuggcuccacccuccucacuaaccgguuucugaccccuuagcuccuccccguagggugagaggggaagccuguguuacaguccagggccuuugguguccugcuugauuucauuucuguuuucugaguacaaguguuucggcugugugcauguuugugucugguguccgucggauccccuggaguuccagacaguuguuagugaccauguggguacugggaacugacgccaggcuaccuccagucccuguacgguagccuuuggucaagggucuccgcuggaguacggagucccgaagccaucuguucucugcccccaaggggagucagcaguguggucaggcgcugcauccacaaacccacaugccaggaauacgcagugaaaaucauugacaucaccggaggaggaagcuuuagcucugaggagguacaggagcuucgggaagccacccugaaggagguggacauccugcagaaggucucgggacaccccaacaucaguaaguguauccuccaaaccccccuauuccuccgggcacaagccacggcagcgugcuuuauagugagagauucugcccuaauaacucaagucaggguguuaaguaagagccaccuugugugacgagcucuacccauucaagggcaucuugcucaguggcucagccagccaauuacugaggcucuaggugccucccucauuacucagaauggguacagccaguguugggaguagggcagcugggaaagcgggcuaugaagccccugguccuccccacaccacagcgauugccuuggaaaccccaucaccuucccaccccugccuuugaagucagccugcccuguggcccgugccaaggcuccugugauccuugagacuagcuagccuuuuccguuucaguacagcugaaggacacuuacgagaccaacacuuucuucuucuugguauuugaucuguaaguacccaacccuggagccaccauuauccucgggcuuaugaggcccuccagcaauccucaccagggggccaaccaacaucagcgcccacggugagacaccagacaaagacaacaguugauucagggccacacugccagguuugaaacuuggauaccacuuguggggggggggggaauauauauauauauauucuuuuuuuuuuuuuuuuuuuuuuuuuggugguuuaggggugggggaguuguuuauuucuuuuugguguuagguuuuuuuuuuuuccauuuuuuauuagguauuuagcucuauauauuccuuuuaaguguauauauuuuaaaagauuuguuuauuuauuuuauguauaugaguacacuguagcuguucagaugguugugagccuucaugugguuguugggaauugaauuuuaggacuucugcucacuucccucagcccugcuugcuugggucaacuccgcuugcuuagucccugcuugcuccagcccaaagauuuauuuauuauuauacauaacuacauuguagcugucuucugacucaccagaagaggguguuauaucucauaaugggugguuaugagcuaccaugagguugcugggauuugaacucaggaccuucaaaagucagccaucuugccagcccuuuuuuugagacaggguuucucuguguaaaagcccuggcuguucuagaacuuguucuguagaccaggcuggccuuggacucacagaguuccucuuguuucugccucccaagugcuuggauuaaagacaugaacuaccaccagcagcuuuaugaucaguuuuuauaaaaaaaaaaaaaaaaaaaaaaaaaaaaaaagccagguggugguggggcccauaccuuuagucccagcacuugggagguagagguaggcagauauuacugugagauucagaccagccuggucuacaaagugaguuccaucagagaaacccuguuaaaaaagaaaaggaaaggaaaggaaaggaaaggaaaggaaaggaaaggaaaggaaaggaaaggaaagggaaaaaagaaaagaaaagaaagaaagaaaagaaaggaggaaaaaaaauccuucgagugaggccaugcaugccuuuaauuccagcccuugggagacagaagcuuggugaguucgggaccugccuggucuacacagugaguuccaggcuagccaaaguguauacagagacccccaucucaaaaacagaggacaggccgggcgugguggugcacaucuuuaaacccagcacuugggaggcagaggcaggcagauuucugaguuugaggccagccuggucuacagagugaguuccaggucagccagggccgcacagagaaacccugucucgaaaaaccaaaaacaaacaaacaaaaacaaaaacaaaaaaacccagaggacaguaagaaggggaugagcagguggggagugagaacaggagggaagggaggggaagagagaacugcacuucaaagccugucuaggugguccacaucugcagugccagccagaggccgaggcaagagcaucaaaaguuugaagccaguuugugcaccuuaucccagaaaacaaaaacaaaaacaaaaacaaaaauauuuaauuugaucuuuuucccuuucugaccuagaacauggucucuucuagagcaaucuaguuuuacccuggagggcuccucgggacaccaguaaaaauagcuucuccaagccaccucgcuaaagguuaaagacauuugagcuguccccaaagguuacacaggacagaguccugugaauacagcagcauacugccacugggcaggggagagggccuuccuagggccaguccugugguuaguuaggaaaagauaaaacuaggcaccuuggggcuggagagauggcucagugguuaagagcacugacugacugcuuuuccagagguugugaguucaauucccagcaaccacaugguggcucacaaccaucuguaaugggaucugaugcccucuucugaugugucugaaaacagcuacaguguacucauauacauaaaguaaguaaauaaaucuuuaaaaaaaaaguuuaaaaaagaaaaaaauaucuggguaccuugguacauuccuauaacccaucucaggaggguaagagaggaggauuguugccaugguuuuagggcuagccugggcaacagugugagaacuuacaaauuuuucuuauauaaaucaugagaaaagaggagaccgaaaauauuagaggguucagaagcuacaauauaaauuguuucagcacuacaaaccuacugucauaauuuucucaaguaaauuuucucuuuaaauuaacugugacauacuggggugguggcacacaccuuugaucccagcacucgggaggcaaagccaggcaucugaucucugugaguuugagaccagccugaucuucagagugagagagaaacccugucugaaaaacaacacaaaacaaaacaaaacaaaaacaaaaaaauuaauuguaagguauggagaagucaagucacuccguguuggcuaguuuuaugucaacuugauacaagguagagucacaggaaaagagggagcgcauuugagaaaaugccuccauaaaauccagauguagaggcuggagagauggcucagcgguuaagcacacugacugcucuuccagagguccugaguucaauucccagcaaccacaugguggcucacaaccaucuguaauaggaucugaugcccucuucuggugugucugaagacagcuacaguguacucauauacauaaaauaaauaaauaauucuuuaaaaagaaaauccaaagguaggcaagccuguagggcauuuucaagugcuggagcuaaaggugugugccuucagaucuggccugugucuucauuauuuaaaucauuuguuuugaucaucauugaugugugagugugguguguaugugugcaggugugucuguauguggguaugugcaaguguugguaccugugcagaccacaggcucucuugaauucucuggaacuagacuuauacacaauuguuagugccuugacaugggugcugggaaccgagcccaguuccuccagaagagcagucagugcucuuaaccacugagccaucucuccagcccguuucuccguuuguuuuuguuuuugugacagggucccacguaacucgagcuagcuuccaacucacuauguagcugaggcuggccuugaacuccugauucuccuguguccacgaggauuacaggcauacgccuccacagcuggcuuuuaaacuuagaugggcagacuuugccuucccaacacuuacacgguugauucuucccauuugcuuccuggccaaaaaaaaaaaaaaaaaaaaaaaaaaaaaaaaaaaucccaacuccucuagaucuggcuuuagggguccugggcuagagacucagaugccuaaccuccgcccccagcgccaacagaucccagggugccaugaauguucauaggcagggacaccauauuuuccuagcuucuugcuuuucuuccaguucuucccagacaacuccucuacgcccuucccagguuccuuuccucagaggaacaguccaccucgcccucggcagcagcagggugggaacaacacaggucuggggacaaguaaggcgcugguggucuuggaaacgcuuuguucccacaggaugaagagaggggaacucuuugacuaucucacugagaaggucaccuuaaccgagaaggaaaccagguaaggcgcaugcgccuucugcacuaguacuagcaucaaagcggucuggcgggaggccuggcgugcguguuuuagcugaggucaugcuggcuucugggaucucccagcuccuuggcucaaucuacauucuagaugcuagaccguacccagccuauccuagcucuaacaucguaugcagugugguuagcaugugggcuuuggcuucccugaaucuucucucuguuaaguggaagaggaacauauaggggaacaaucaguucugugguauggaaaaaguuuugcacaauucuaaauucaaaaauuaagccauggggcuggugagauggcucagcggguaagagcaccgacugcccuuccgaagguccugaguucaaauccuaguaaccacgugguggcucacaaccgucuguaaugagaccugaugcccucuucuagggugucugaagccgcuacaguguacuuacauauaauaaauagauaaaucuuuaaaaaaaaauuaagccacuauucuuggagagaugggccagcaauuagaguacuuguuauucucacuuaaaaaaaauauuuuauuuauguugggcggugguggcacacccuuuaaucccagcacuugggaagcagaggcaggcagacuucugaguuugaggccaguuuggucuacagagugaguuccaggacagccagggcuauacagagaaacccugucucaaaaaaaccaaaauaaauaaauaaauaaauaaauauuaaaaaaauauuuauuuuuauguauaugagcacacuguagcugucuucagacacaccagaagagagcaucagaucccauuacagaugguugugagccaccaagugguugcuggggauugaacucaagaccucuggaagagcagucagugcucucaaccucugagccauaucuccagccccuuuguucuugauuuuuuuuuuuaauuuuuauuagguauuuagcucauuuacauuuccaaugcuauaccaaaagucccccauauccacccacccccaauccccugcccacccacucccccuuuuuggcccuggugauccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuguucuugauuuuugagauggggucucacuauguagcccugccuggccuagaacuuguugugaaggccagggcggccuugaacucacagagaucugccugccucucugccugcagcguguuggcauuaaauacuugcgccacccauauugauggcucacaaaugucugugacucccguucuagaggaucuggggaccuucugccuucugaccaccuugggcaccacauaaaugugaugguuuauauguacacucaggcacacacacacacacacacacacauuaaauaaauaaaugcacucuauuuuuuuaaaagaaaaauaaaagagucaacgggcuagacaugucucuuaguaguaugaugcuugcccggaauggauaacgcucugaguuccaucccuaguaucugggaaaaauacaaaacaaauaauuaaaauagauugaagaauggugauuaauaucuguagccucaacaagagggagccugaggcaggaggauuaugaguucuggguuaaucugaguuucaugugacaccuuguuucaaaaagggaaaaaaggaguaagccagcugguguuugccuagaacuagcaugcugagacauuucacuuuccagcacugcagaaacuggccggggcggcauauaaccuucaaucccagaauuuggaagacagaagcaggaagaucaggaguuuaaggucacccucagcuacauaguagguuagaggccaaccugggcuacaggagaucuuguaacaauaaaauaaaauaaauaaaaauagcagggugugguggugcaagacuuuaaucccaacauuugggacgcagaggcaggccgaucucagaauucaaggucagccugaucuaccgagaguguuucaggauaguuguggcuccguagagaaagccucucgagcuggagagauggcucagcaguugagagcacugacugcuuuuccugagguccugaguucaauucccagcaaccaccugguggcucacaaccaucuguaaugcccgcuucuggugugucugaagacacugacaguguacucacauauauaaaauaaauacaucuuuuuuuuuuuuuuaaaaaagagaaagcuucucuuaaacaacaacagcaacauaaauaaacuaaaaauaauaagccaaugccaugcaucucccuccagaaagaucaugcgggcccugcuggaggugaucuguacccugcacaaacucaacauuguccaucgggaccugaagccggagaauauccuuuuggaugacaacaugaauauaaagcucacagacuucggguuuuccugccagcugcagccaggagagaagcuccgaggucugguacuauguauggccuuggcccauaaagaggccucaaggguagagauugcaugauuuucuccccagaauaaaaauucuagcaugucaguggcuaaugagauggcucaguggaucaaaugaggacacaagcaugaggaccugaguucgaauccccagagcccauguaacuccagcaauaggcuggcagcuaggaggaucucucgggguugcuggcuggucugccugaaucagucagcuucaggccagugagaaauccugucucaaaaagcaaggugaaagcggggcgugguggcgcacgccuuuaaucccaagcacuugggagacagaggcaggugaauuucugaguuccagagucagguucccaccaccugagcuccacgcccgggugccuaaaaggaccuaggaauccacaggugacccuccgagccuguguagucugcuguuacuauugaguguaaaauaggagagcccucccaagcacuguuuuuguccugucucuuggaucucuuggguaacuucuuccaagggagggccccugguguccuguccugauagcagccguucccgcagagguuugugggacucccaguuaucuggccccugaaaucauacagugcuccauggacgacggccauccuggcuaugggaaggagguggacauguaagugaucugggggaccuaggggguugggggggaagagguggccugacuccagugagacuacuccugcaugcuuccccuacccgugaggcuaaaggugacacgaggccccgcccacccuccagguggagcacaggcgucaucauguacacucugcuggcuggcuccccgccuuucuggcaccggaagcaaaugcugauguugcggaugaucauggacggcaaauaccaguuuggcucaccagagugggaugacuacucugacacagugaaagacuuggugagaggccauggccgcccgcuccccagaugucaagggacaggagcauguuccagaguggagggaucacuguaucugucucaauaauguuaauaaaauaccuagcaaggggcuggugagauggcucagcagguaagagcacccaacuguucuuccgaagguccugaguucaaaucccagcaaccacaugguggcucacaaccaucccuaacaagaucugacucccucuucuggugugucugaagacagcuacaguguacuuacauauaauaaauaaauaaaucuuaaaaaaaaaaaaaaacaaccuagcaaaaaccacugaagggccaggaaaugguggcacaugccuuuaaucccagcacuuggaagacagaggcaggcggauuucugaguucgaggccagcuuggucuacaaagugaguuccaggacagccagggcuacacagagaaacccugucuugaaacgcccccccccccaaaaaaaaaaaaccuacuuaaggaaggaaggguuuguuuauggcuacagaucugugaggaccauccacagucaggaagcagagggagauuaauguuggggauuagcuagcucauuuucucuuuuccauccagggccccagcccaugaacuggaaccacccacauuuaggguguagcuuuucaccucaaccugugugaacaaucccucacagacagguccagagaccugcuuccauugugguccuaaauccuagcaaguuggcaaucaggaccgacacucaccccccgguguuuuccagaacgcugccaugauauucucaggucccuuauguucucccaggugucucgauucuugguggugcaaccucaggaccgcugcucggcggaagaggccuuggcacacccuuucuuucaggaguacguaguagaagaaguacggcacuucagcccccgagggaaguucaagguacugaaauuuaaccuucccuaaggcucuugggggaggcugcuguuggcuccugcuggcaccaggcucucagagcuuuaagcuaugagggaaugccuuguacccacuguuccaauucaauuucugguugcaggggaugucagcuaaccgacccuguuaccuaaaucccuacagaugcuuguagccugggaauaggggacaucaugaagggcacccccaaagccagcuaagguuucccgacaagcuuugcugcgggcugaggguucuaagugcugcccccugcaggugaucugucuaacugugcuggcaucaguaaagaucuacuaccaguaccgucgggugaagccgguaaccagggagaucgucauccgagaccccuacgcccuucggccgcugcggaggcucauugacgccuaugcuuuccguaucuacggccacugggugaagaaagggcaacagcagaacagagccgcccucuucgagaacacgcccaaggcugugcuccucuccuuggcugaggaggaggacuucugaagggcagcgggggcccaggggaaagcagacagagggacuugugagaagaggaugccccaaguagccuucugcaaaggaauagguggcccuacucugugcucucaaaggcuugccucuagaagcacaggguguucccaguaaacagcaguaauuacagcuggagcuggaugugcuguggcaugugccuguugccccgagacaguaggaucacggguucuagcccagcccgggaagucuagugaugcuuauuucaaaauaaaaaugaggcugggaauguaacccuguggugaguguaaggucuccaaauucaaccucugguacagcuaaaauagauaauaaauaaauaaauaauaaauccaacgcagcugagaccgugauaggcagaaauggaagggcauagagcacauguauucugggagcuauaagccuucuggcuucucuacugugcaccuuuguugaugucuauaguuuucuuguuuuuuuuuuuaagauuuaugcauuuuauguauguuuuagcugcaugcauuuuauguaacccacaugcaugcaguaccuguagaggucacaagaaggcaucagaaacccugaaacuggaguuguauagauagcugagcccaccuugugggugguaggaauugaaccccuccucagcaagaacaggcgcucauaacugucuagcuaaaguuauggauauuugaggaagugaaagcaggaguucaaggucauuuguggcuacacaaggagcuugaggcuagccugggcuacaugaaacccuaucucaaacaacaauuauauugugcuuccugauauacauaagaauuuauugaccucgggcuggugugauggcucaguggguaagaguacccgacugcucuuccaaagguccaguguucaagucccagcaaccacaugguggcucacaaccauccguaacgagaucugaugcccucuucuggugugucugaagacagcuacaguguacuuacauauaauaaauaaauaaaucuuaaaaaaaaaaaaggauuuauugaccucauaagauccaguucuucuucagggacaugucugcaggauacacagaaggcccuacaugauuagcuaacucucagagaagguucuggcauuugucuuccuagaggggcacugacuuugguucucccacaaugcacaucuucacuucauaaaucauuugcuuuacuggggcuuuuaaauagugggcgugguguguaaucccagcaggacccaggaagcugagguaggaggaucgagaguucgagaccagccuugccacauauugaguaucucguuucagaggccagcgaggcuagguucuggcagcaaggcuuuggcacaccucacaaaggaagcauuuuccuucugcagaauuucccagaagugaaagcugaaccagccagggagaaagcaaaaagggagagaguuuaaaaaaugucaucuuuuggacacuggaggguuugguuccuuuguccuuaauacugcacuuaagagacagcccagcucccagccuuggucauccagguccucaucuuccaggcuacugcagucccuucuugcaguccgaguguucuuugugucugucagaggggaggggcucaaaaggccacccucagacgcaugagcuugguagccagcugccucuggaacauggucacggagguacagugcugagagggugcuucggagaucucggucuggcugcucacagguccuccuucggucggccugcacuggaggcgcagcggaagcccagguugucugaggcugagucuggaguguuucccauccuggauggagaaggaagagaggugcauacugcuggggguggggaucugucgagaagagaggagcuguaguggucugaaugagaauggccugaaugcuuagucaucagggaguggaacuguuuuagaaggguugggagguguggccuuguuggaggaacuaucacaagggauuagcuuugagguuucaaaaacccaugagaggcccaggcagggucucugacugccugcugccugugggucaggaugugaagcucgcaaguaccccuccagcuccaccauguucugcuuccuaccaugauggccauggacuagcccucugaaacuguaagcaaucccauuaaaugcuugcuuucguaagaguugccuuggucguggcgucuuuucacagcaacugaaucauaaccaacaugauuggucugaggucaaguccagcaagugugccugccacuagggggaaggggacagagucgggcgguggguggccacaaaggauugcaauagagggugaucuuagugaccacucuaaguuuagcagaacagcucagcacagcugcacggcacgugauggcuauucuuggucgucaccucaacugcaucuggaauuaacuaaaacucagaaauggagggguauaccugugaggauuuuugcucaacuugaaguagga

SEQ ID NO: 2697 - RNA, 7903 nt, Mus musculus
caccuuccucccuccuugcuggacgcccgugggcguucccgaguuuguugugucuggacgcuuaaggugcagacaccgaggaugccacguggaagccgaauccgcacuucccgcgugacccuucuggccgggugagacccucgggacuggggacaaagcgcgggcggccaggacgagguucuguagcuuaagagcugcgaagccgagggugagauggagggagccgaaagggauccgcuaccaggggaggacucccggagaacggggacacgcucugugcacuccgggagaggacucugaaaugugacauuuucccuagacagguugggggaagggcugucgagggcauagucuaagaggaggugaggaaagaaugaauggugauaggugucaagcucuuggggguguuuuuuuguuuuguuuuguuuuguucuuacuguguuuuugauucugucaggcuagcuuuggacuucauaaguccuggauagccuuccuugauuuuccugacucugcuucucuggggaugggauuacagaguuuaaagguuuauagaaggggggaaaaaaaggauaaaagaaaauuacucguuauuuguguguggagguucgagaauuuuagaauucucucuuuccaccuuuuggguccaggauagcuaacccuuaguuguaauuacgcuacuacaagggguaucaacauuccuaaugcugcgauccuuuuguuguugugguggugaccccugaucauuaaaaaaaauuuuuuuuuuugcuacauuguaacuguaauuuuguaaguuuggucuuaggcgagcccugugaaaggguccugacccacaaguugagaacugcugcuccauugagccaucuccuguccacacgaaguaggaaauucuugacagcaucaagauuccagaugucccaucugggagccugugugaaggucacagggcacuuuaugggaguugguuguugaucuuucuaaggcucaaacucagguugucagcaguggguugcaaggacacucuacuucagcaccagcaucccccucucccucccccagccugaaauguuaauucagauguuaacuaggcuagggagaccccuuggucuaaaccuguggguugcuacuccuucggcuccaaaaaauguuuaccugaugguuuauuuauuuauuaaauuuauuuauuguuauauggaaguacacuguagcugucuucagacacaccagaagagggcgucagaucucauuaugggugguugugagccaccauguguuugcugggauuugaacuccggaccuucggaagagcagucagugcucuuaaccgcugagccaucucgccagcccacaugaugguuuauaacaguagcaagauuacaguuuugaaauagaagggaaaaugauuuuauauuuggucacuacaacauaaggaacuguaauaaagggaucauuauaccaucaggaagauugagacccacuggaguccauggcaguaccugucugauauuucuucuuuaauacuaugacauuuuauuugauacugauauaggaauaaaaugaaaacuguugguucacucuggaguucuuguccuggaacucacuacuuagacagguauagcauugauuugacagagauccuccugccucugccuccuguggccugaaauagucugguacacaaaguagcuguuuaacauuggaauaaauaaacccucaggggaucuuuccagcuuugucugucaguggguacauauacaugaagugggggugucagccuugaaaggccagaagcguagaauggccuagagcuagcugaauuucaucuagggggugguuaagagcuccugggaacugagcauggacccuguggaagccaguaucugguggucuuagcuauugagccaucucuccaucauccuuucuaacuuuuaauaagucuaugauuuuaugaaguauuggaauaacuguccuuuagagauacagugggccauguggagucaugaaaaguuccaaaaaaggacaaaauaguguguuauauguaauauauauauauauauauauauauauauauauguaaccaauagaaacaguuucuauagucuucuugcauguguaugauauggguauuuaaagauuuagaaugaugcaggaggugguggcacaggccuuuaagggcacaagcuccuggggcacuugggaggcagaggcaggaggaucuccaaccuccaaaacagccuggucuucagaguguguuccaggacagccagguguucacagagaaacucugucuacaacaacagcaacaacaacaacaacaacaacaacaacaacaacaaaaagaggcuggaaaguuggcucuacaguaagagcauugacuguuuuucccgaggacccagguuugauccccagcacccucaugguggcucaaccccaucuguaacuccaguuucaggugaucuaaugcccucuucuguaaugcaagugguacacagauacacaugugggcaaauaaucaugcacaugaaauacaauaaagugaaaagauagaaaauuggggcuggugagauggcucagcagguaagagcacccgacugcucuuccaaagguccugaguucaaaucccagcaaccacaugguggcucacaaccauccguaaugagaucugacucccucuucuggugugucugaagacagcuacaguguacuuacauauaauaaauaaauaaaucuuaaaaaaaaaaagauagaaaauuaagccaggcagagugacaaauggcuuguaaucccagcacugguugaggcugauguaggaauaggaaguuugaauauaguaguauaguaggcugguuguuuuguuuuuuguuuuguaaggaggacauuuauucucaggcuggccuuaagaugacuauguagaagaacagggaugagaauagauaugucagaguguacaguggaaagccagaguccucagcccugcauaaagaaaacaaugcuugcccagaggaggagaaauagucuccccucagcuagagcacaccaguuaguuauuuaauaccaagcggucagcccugaaaacacacucaugcaaugagcauacacacugaggcagauuauauuuaggaguguguagguauacacauguaugcauuuaguaacaaugacaaaagagccacaaauuugaaaucagcagucaaggagggguauaugugugggccgggguguuggagggaugauacggaagggcgagaugcuguagcuauuauaaucucaauaaaauaauacagcacguagaagaggaaauaagccacugugucgcugagggugaccuucaucugcuacuucuccgucucugccuucucagugcugggauaacaggugugugccaccaaaccuggcccguuuggucucuugaguagauugcaaagccauuugucugggaccugaggaguuuuguucuuuuccagccgggccccucagaugagggcugcuccccgaagagcaccugcagcucagccuccagcagcagcugcgccaucugcaguuggcucaccugccgcugcgccccggcagccaggccugauggcccagauggcuaccaccgcggccgguguggcugugggcucugcagugggacacacccugggucacgccaucacugggggcuucagcggagguggcagugcugagcccgcaaagcccgacaucacuuaccaggugagcuuuggggcagcuucuccuuucugagaugaguuggcagcuggcgagcaucuuuuaugaauaagcauuuacucugauaccaugaggaccugaguucaaauccuaugagcccacaaaaaaaucaggcauagccauacauaacuguaaccacgugcauuguggggcggagacaggcaguucccacagaaaggcuggcuggccugcugagacgaaauaaguaguuucugguuuggugagaggcccugucuccagguaauaaguaggaguggugaagggaagacagccgauguugacagccgaugcuuggucagucuccccaugggcacuucuuuuuuuuuuuuuuuuuuuuuuuuuuuuuuuaaagauuuauuuauuauuauauguaaguacacuguagcugucuucagacacaccagaagagggagucagaucuuguuacagaugguugugagccaccaugugguugcugggauuugaacucugggccuucggaagagcaguugggugcucuuacccacugagccaucucaccagcccccaugggcacuucuugagaguaucucacucaagcuagccuugaacucaugacaagccuccugggcuuuggguguuuaucuugacuacacuuauacuggguuccuguuguugcuuuuggagacagagucuucacugugugacccaaacccacucccauuuacgcuccagaugaugugauuuggcguuuguugcuuuugguucugaguuggcgaggacaucuuuguucuuuacaucguuuucacugccauguuccuggcuggcacuaaacuugcaccuuucuccaguuguuccccagcucccagugugugagcgcugcccuuggguggugcccugugcuuucucaucucaacacaagaugcugugucuuugcaggagccucagggagcccagcugcagaaccagcagucuuuuggaccuugcucucuagagaucaagcaguuucuggagugugcucagaaccagagcgaugucaagcucugugagggcuucaacgaggugcugcggcagugcaggauugcaaaugguaggcgacuugucccucugcucggggugaugguccugaacccuguaggguagugguuagguuauagccuguggguugagaccucuuugggggugaaagaccuuuuuucauaggaguucauccacggguacucagcagcgagauggcaucagcucaccaacccugucacacgcaccaugaucaauuacaggugaauaugacaggguuggcgccauaauguacuaaguggaccagucccaagugaagagagcagcuacuguguugaaagcaggaauauuggagguaaagggacacuuugggagucguaauuacuggguaaaugcaaagucaucaaguaauguagaaaaaaaaaucagaucacaggaacuuagucuggauguugauuguuggauguguguguggggggguguuuuuguuguuguuuguuuugacuuuugagaccagguuuuuuuguguagcccuggcuguccuagaacucacuuuguagaccaggcuggccucaaacucacagagaucagccugccucugggauugagugcugggguuaaagguagcugccaccaccuggaacgaaauuuuuuuuuuuuuuacuauauucagcuguccuugcuccugugaagguucuaugccccgauagaggggaaugccagggccaggaagugggagugaguggcuuggugaacuggggggggagggggggaauaggggauuuuuggagggaaaaccaggaaaggggaugacauuugaaauguaaauaaagaaaauaucugggacuggagagauggcucagugguuaagagcacuggcugcucuuccagagguccugaguucaauucccagcaaccacaugguggcucacaaccaucuguaaugguaucugaugcccucuucuggugugucugaagacagcuacaguguagucacauaaaauaaauuuaaaaaucuuuaaaaaaaaauucuaauaaaaaaaggaaaaaaauauacauacagcuaugguugcugaauauuucucccuugugauaauaacagguauguaaacaaaacaaaaccacaggaacccauagagaaugguacaucauaggaaacauuaauguacuccauuggcugagcuaugcuaaguauugucuuuguguuauuaaagcuauuuuuauggauuguuuucauuaguggaccaucccaggccaguggaucauggagagaggaacguuaagagaagaaaauauaaugaggguuuuuugcaguaugguuuuaccucaaccaucacaguaggaauugagagaccacagugugucauuuguggggugguucugucggcggagucgaugaaacccaacaaacugaaacgccauuuugagagcaagcauuccagcuucgccggcaaggauaccaacuauuucagaagcaaagcugauggacucaagaaagccagaccugauacuggcagcaaguccaacaaacagaacguggcagccguggaaacuuccuauuugguggcccucagaauugccagagauaugaaaccgcacaccuuugcagagcacuuacuguucccgguggccaaggacaggguucgcgucaugaucggagacgaauuuguuacaaaacugagugcagucuccuuaucuaacgacacuguccgaagaagaauacaugacaugucugcugauauucuugaucaggugguccaggaaauuaaaucugcuccacuuccaauaugcagcauccagcucgaugaaucgacagacguugcaaacuguuuacaguuaaugguuuacgugagguauauuaaugauggugacuuuaaagaugaguuucuuugcugcaaaccucuugaaaggacagcuacugcccuugauguauuugaggcagucgacucguuucugagacagcaugagaucucuuggaaaagcaucuguggaguuugcacagacggugccccagcuacgcugggcugucaaucuggguuucagcgccugguccuaaaugaguccccaaaagccauuggagcucauuguaugcuucaucugcaaacauuagcaaugaagacgcugccccaagacuuccaggaaguaaugaaaaguguccugaguucugucaauuucguaaaggcgaguucuuugaacagucgacuguuucugcagcucugcagugauuuagaugagccaagcaaaacccugcuacuucauacugaagggagauggcugucaagagggaaaguucuaaaacguaucuuugagcuccgugacgaacucaaaauguuuuuuaaccaaaaagcaauacggcaguucgaagcacuuuucagugauaacagugcauugcagaagguagcuuauuuggucgauaucuuuaccauuuugaaugaguugaauuuaucacugcaaggaccaaauucaaccugccuggaucugucugaaaagauccacucauuccaaaugaaacuucaacucuggcaaaaaaaauuggaugaaaauaaauuuuacauguugccuaccuuauccgccuucuuugaggaacaugacauugaacagcacaaaaggauuacaguggugauuuccgugaaagaacacuuggacaugcuugcaagugaaauuuccugguacuuuccaaaucuacccgagauuccguuugcacucgccaggagcccguucucagucaaagcugaagauguucccgagacugcgcaagaagauuucaccagacuuaccaacagcgacgcggcgagagcugauuucuccacaaugccagucacacaguucugggucaaguguuugcagucauacccaguucugucagagaugguguugcgccuccuccuuccuuuuccaacaacauaucugugugaaacaggguucucaaguuuguuaguuaucaagucuaaauacagaaguagacuugugguggaagaugaucuucgcugugcucuugcaaagaccaccccgagaauuucugaucuggugagaaagaagcagucucaaccuucgcacugagguuggcuuuuuaugaacaguaucccgaaauguagcaguguaguuuaugucaugauguuaagacuguuaacagugccacaccgugcuucaagacaaaaucucauguguuuguaauuaguaauaaauauuuccacaaagaaac

SEQ ID NO: 2698 - RNA, 14699 nt, Mus musculus
cgucaggcauauggggaaacgauccaggacuucaagcgacuuccucuuucugcagaguccagccuuggggccucuagauagccuugagccagcagcuguacaagcgcuugcccucaaccaaguuggcgcaggcggcuucucucgagaacaugugacucuuccaggucccgccucugcccucccagagaggaggcuaaaaagcccagccgcuggucggugggcagccuggccaguaugucccuaaaauggagugcguguugggucgcgcugggccagcugcugugcagcugcgcgcuggcucugaagggcgggaugcuguucccgaaggagagcccgucgcgggagcucaaggcgcuggacggacuguggcacuuccgcgccgaccucucgaacaaccggcugcaggguuucgagcagcaaugguaccggcagccgcuacgggaggugcgcgcucccugggacccggggucuggaagcuuccagaagucaggggaugggcggagggaugccuguaccuggagauccccuugugcucaccuagaggagguuaauauggguuugcaggcuggggaggggagcgaccagagcaggaagugggaccuggcaugcugagaaccgcaugguuucugcuaggcaggcgcugccccaggcaauggauuuuuuuguuuuuguuuuuuuaaagcuuuuaauuuuacuucauagugcugggacuugaacccagggcccugugugugcuugucacuacugagccuuuuguuuauguuuugaggcugugucuccuucgauaaccuaggcuggccuggauguccgggugaaucucuugcucccacuuuaacuuuccugaguguuguagauguuugugcacacgccuccugcaucccggugcacauaccucccaugcucuuucccaucuugugaaaaguagaauccuaggagaugcuacccacuacagagauuugggggcggggguagaggaggggggagcaaaugugacuuugcacagagcuagcagaggacccucaucccugcucuccuuuccuaccuagguaggguuggcgcagaagcaggcugaagcaaaccugugugcucacagucuccuccucucucagauucauucauucauccuaccucguuuccuauugggcucucuccucuuccucucuucucucucuuuguuuaaaauguguacccauuauuuauguggggugggggggcgccacccgugugcuacacaguacauguggagguuggaagauaacuugcuggagucuggucucaccuaggucaccagggauguaacuaaggucaucaggcuuaguggcuagugccuuuaacccaccaagucaucucaccagcucuguguguguguguuugagacagcgacucacauuaaccuccgacucauagccauguggcucccuuagccucccagguugcuagaguuacaagugaugaaccaccacaccuggcuuagacucucaguuuucaacugcacugcccagcauucagcaaaagaggaaguaaggagaggacauugccaccacaggccuucucuguuuccuugggggccccuguucccugcuguuggccuucuuccuuguagcaauggucaccugccuuuuaugucagggucuggucuuuccuguuuuagacuggccuguggcucuuuccauggaaaucuuggcucugguacuaucugcccugagaaagaacuugguuugaacagucuuuuuccaucaacuguccugcagaguucacuuguggaugcagccaguauuuuacagagucucuccccuguguccccuaugguucucuagggugcugggggcgcagucgugaagaauagacccaauccuucucuuuagccagagucuccuguauccucaggucagccucagauauacuaugaagcagaggauagccagggaaugacccugaacguccaucuuccuggcugcaccucucaucugcuaggauuacuggugcgcuccgccaugauuggcuuauacaaugcuggagucggaacacaggauuucaucggugguaggccagggcuuuaccagcugagccacauccccagcacgugacuccacuucuucuuucccuagucgggcccagucuuggacaugccugucccuucuagcuucaaugacaucacccaagaagcagcccuucgggacuuuauuggcugggugugguaugaacgggaagcaauccugccacggcgauggacccaagauaccgacaugagagugguguugaggaucaacagugcccauuauuaugcaguuguggucaguauagggagagguuggcugggggcaaggcagucugggcuguccagaagggcucugugucaugggucagagaaggguugcuuugugggcuccauuagaacaccauucuuccaucugauggcgggggcccucuucuggaaggggguacccaagacagacagcagagcccuguggccauuuacccucugcucaucucuccuugugucugcagugggugaaugggauucaugugguggaacaugagggaggucaccuccccuuugaggcugacauuagcaagcugguccagagugggccccugaccaccugccggaucacgauugccaucaacaacacacugaccccucauacccuuccgccggggaccaucgucuacaagacugacaccuccaugugagcagcauccuccccccccccccuccugcccagcagacuuccccauagggagaaugguucuagcucuggaucugaugagaccggcgucgcaugcuaggagggaaagugauugcuggaaguucucaggccagcuagaagguagaaccagugccugagguugucuucugaucugcacaugugcacugugguguacacacacacacacacacacacacacacacacacacacacagaggaggcggauuuaaaaagccacacagauaauggaccuuuguuuucccacccuagguaucccaaggguuacuuuguccaggacacaagcuuugacuucuucaacuaugcgggacugcaucgaucugugguccucuauaccaccccuaccacuuacaucgaugauaucacugugaucacuaauguggagcaagacaucggugaggaaucccggcgggaggcucugugcuaggcuggguccauuuuuaucucaauucccaagaggaaaaaaaaucccuaaggagaaaaaggcuucaagcaucuuuuagcccuccccugccucauuauccucagaagauaagacucagacugcccaagcugacaccuuucuggugggucuuccuuugcaaggaagugaggaccaaugacagguggggucuugucuaaagugacaucacucaaaacauugggucacuuccuuccuccuuguaacuccuaaucucugcacaguaagauuuaaaaaaaacuaaauaaauaaaaggacaagcaguuguucgcuauugucuugggaccuaaggggacuucugggacugguaugauaucuguuucugucccacagggcuggugaccuacuggauuucugugcagggcagugaacauuuccagcuagaagugcaacuuuuggaugaggguggcaaagucguggcccaugggacagggaaccagggucaacuucagguucccagugccaaccucugguggccuuaccugaugcaugagcauccagccuacauguacuccuuggagguaacggugaugugggacuggggcuaaggaagguccuuugcugccaccuggugacagcaggcaaccaggacagguggcuaaauggguacugucugagauuuccggcuuuuucagucacuuugugggagaguccagcugugaauugugaagguccugagaucauguucugguuaaagacagagacugucauuucugcaucucaagugcaggcuugugggauacguaggcaccagggguguuggagaauaagaucaaacgagcagucgcugaggucagccgggucucccuagugaauuccaagacagccagagcuccauagugagacccugucucaaacaaucagugugucccuccaacccccaccucccaacaaaacaaaucccaaaaccagccgagcugugguggcacauacuuuuaaucccagaauuugggagccaaggcagguggaucucuauaaguuggagccagccuugucuauggaguuccagaacauuuagggcuacacagagaaacccuguuuugcaaacgaaaccaaaccaaaccaaaacauaaccaaaaccaaacagcagagagaugccugccuguaauuuuagcacuugggagggacaggcaggagaaucaggaguucuaggucauccuuagcuacaagugaggccagccugagcuacaugagccuguauuuaaaaaaaaaaaaaaaaaaaaacuccagugguguggggugaggccuuccuguugggugacgcgcaguccaccuggauguucuugccugccacaucggcucuccuaggugaaggugacaacaacugagucugugacugacuacuacacccuuccuaucgggauucgaacaguggcugucacaaagagcaaguuccucauaaacgggaagcccuucuauuuccaaggggucaauaagcacgaggauucagaugugaguaggagcuguggcaucaauguguggcauguugggagucauugauaucuccuuccccuaccucugugcccugggaagauagcaucguguggugcuguuuguggugaaccuacauaggguggacggggugaguccaggggcggggcuuuagaagaaagugcgaacucuccagucacaaggguagaggucacgcagcccugcugucuccuagauccgagggaaaggcuucgacuggccgcugcugguaaaggauuucaaccugcuccguuggcucggggcaaauuccuuucguaccagccacuaucccuacucagaggagguacuucagcucugugaccgauacgggauuguggucaucgaugagugucccggugugggcauugugcuaccgugagugcccgcccccucgccgucuacgaugcccagcgucccuaccuugucuucgagccuuuggugaccuuuuccucucugccuccacagucagaguuuuggcaacgagucacuucggcaccaccuagaggugauggaggagcugguucgccgggacaaaaaucacccugcgguugugauguggucuguggccaaugagccuuccucugcucugaaacccgccgcauauuacuuuaagugagugcucuuucuucccugggcuuaguugggccucuggccuuagcacuuuggccugguucagccucuguaggcagccgggaccauggaagucaaccauaaccagguggauaggugcugugaugucaguauccccuucaucacuacuggagacccaaaucaacccaccaaaauuguggguuuucuacccauugacccuccuaaucauacuugagaugaaaucccgaguuuccuuggauucacacaacuguagaguuuuuguuuguuuguuuuguuuuguuuuguucaagacaggguuucucuguguagcccuggcuguccuggaacuagcuccauagaccaggcuggccucgaacccacagagauccgccucccucugccuuccuauggcucugaugaaagccauguguuacgaccauccggcagaacuuuggauuuucuguaauuuuaguaaauuuauuuuugagacaggggcuugcuggguuucccuggcuggccucaaacuggcacugaucccuuuggucccaacuucugagauucugggauuacacgcaugaucuaccaaguggauuuuuuuucuuuuuugagauugauuuuuaauuuauuucugugugugccauggcacacagguggaggucaaaggacagcuuauguccucuccuucuaccauggaaguccccaggcuugaacuccgaucacugggcuuggcacuaagggcugggucacuucuccugcuccucuauuuuuuuuccagacaagaucucaaucaaauagcacaggcuggucucaaguuugcuagguagcuaaggcuggccuugaauuccuauuccuccugucucugccuccuacucagugcuaggauugcagugugcucucucacaccugacauucauucauucaugcauucaugcauucaugcaugcaugcauucauucauucauucauucauucuagauggaaacacaugcuaaaacuauaggaaaccacuuugugauucuuugauugauuuaauuuauuuauuuaaugaaugugaguacacuguagcuuucuucagacacacccaaagagggcacuggacucuguuacagauggucgucagccaucaccuacuugcugggaauugaacucagaaccuuuaggaagagcagucagugcucuuaagcgcugagccaucucuccagccccagugggaacuaaugagacaaaauguuuuaaauguauuuucuggugcuggggauccaguucagggccuugccugugcaugcuaggccagugcucucccaucgagcuccaucuucagccacaguccuucaucugccaugagacugucacagccuucuggaugaauuauacugcuugucacauagaggcaaccgaagcuucuuaaucggccguuuucagccuuccuaacgcugcggcccuuuaauacaguuccucaugcuguggugaccccuccccccgccccccaaccaugaaaguauuuuuuggugcuacaucguaccuggaauuuugcuguuacgaauccuaacguaaauauuuuuggagauagagguuugccaaaggagucuccacccgcagguugagaacuccuuguucuccaugcuguagcugcaucccgacuccacgaaguaguauuuugagcucccagacuuuuugaggaggugguaaggaagaugcauucauucagggacaucaagaauaaagccaggacuggguaggcuggaguaccccagaguggcuuuugcuaauuuggagcuguuuugagagggcggggcucaggucuuauguccaaggcaauacacagccuucauauaagaagaguaacgaucaaaaagauguaaaagaaaaaaaauagucuccaauagugaucugugcuucguaggucccaggaaccaaacucuagcccuagacuagccauucuauuggguccucuccucuccauuccuccuggcucaauuguuaauucaauucaacacuaaugccuuuccuucaagaggcuucccugacucuuaauuuaaaucaugcaccuccacccacagccuuacagggagccacacccccucuuauugcugccaccaccucugccauuuugguuuguauucaucucugcucucauggcuccggacagccacaguguuagcagugagcuaccacugauggggaagacgggaaggaaagggaaagagacaggugucuaagagcccuucccagauugacgacgagccugucuucugccuuucauggacaggacgcugaucacccacaccaaagcccuggaccucacccgucccgugaccuuugugagcaacgccaaauaugaugcagaccugggggugagccuggagugggggggggguggucuccacacuccacgccucugcuuggucuuuaggcuugugcuuacuaccagcuaagcagcaguggccaguccagccguuucacgagugggcuucuggguuaaagggacuaacuuccugcuaacucacacggcguaggcaauguggcuucuaaccccaagaaggcugggcuggauccgggacaauguacuuguuuaacccugacaagagaaaaggccugguagucaagaguacuuguuguucuuacagagggccagaguacgguucccaguccccacaugauggugacucagccaucugucccgggggaccugccaccuccucaugcacauauaaaaggggaaacagccauuuauuaauuuucuaaaauuaguuuaaaauaauaguuaaaauaguuaacuaaauaguuaacuaguuaaaaaauaauaaguuaaaaugacaagagccagccaggcgugguggcacacgccuuuaauuccagcacccgggaggcagagacaggcauauuucugaguucaaggccagccuggucuacaaagugaguuccaggacagccagggcuauacagagaaacugucucaaaaauacaaaaacaaaaacaaaaaaaaaucaaaaaaaaaaugacaagagcccuuguuagcccuggcuucucugugucucuagaacccacccuucaaagaagcagagguugcagugaggcccagguggccuagccuggccgcucuagugcuugcccuaacuuccauguggacucagaaggcuuuacugggcgccccaugccugaccucuuuuccuagagcuugcuuuacgaagugaugcuacuucauccagucaccacagccuggagaggguguguggucccuuggaaagaccucaucguuccaagggcagcuuugaaauugagcauuguuucuagagagacuagcuugggugacacuggaggcuagcuagcuagacacggaacuuuuuuuuuuuuuuuuuaauuuuacgugcauuggugcuuugccugcaugugugagggugucgacugacugcuacgagcugcagauugaaccuggaagagcagccagugcucuuaaccccagagucagcucuguagacucagaacucuuugaugcuguuuagaccauaccuaucccugucccguggacacccccaccagugucugggaagaaaucuagccacucacagcacugccuucucaauuauaaaucagaggagacuggagacauggcucagugguacagccugugcucagcacaugcaagcccuuggcuuguaccccuaccccuccaaugccuggcccuaaauuaaggaccaggagauguagcucaauugaugaauguuugucucgaauucccaaaacccuggacuuguguccccagggaggcagaaagguaggugugagcagugcacaccuguggucccuagcacuugugagguagaggccagugggucaucaguucaaggccacccuuggacacauagaaguuuaaggccaguuuggccuagauauaagucugaacuccgaagagaaaaacuuauccacucucccuguuggaucgcauccccaggcaaggccacaggagaccaggaacagaacuagaaugaaguaaaauccaacaaggucaggggcuggauggaugguggcuuuguuuccagucaugacccagucagcagccuuagucccaguauuauauauuagccccguuugggucuggucuugacuuuauuuccuggguagggcgggcuaaccugugucauuugcaugugacuauucugaccucagugugugagggguaaauucacucgaccgcucuugucuuaggccccguacguggauguuaucuguguaaacagcuacuuuucuugguaucaugacuaugggcauuuggaggugauucagccacagcugaauagccaguuugagaacugguauaagacgcaucagaagccgauuauccagagcgaguauggagcagacgcaaucccagggauccacgagguaagcgguugauugucacgauggcgaugggugcuuaguuacuuaccucuuuucccuuucccugccagggacccggccucagcucccaggcaccucucuaagccuacacacguuggcugcugcaugcaggccucuguuuggcuccugcgcaucccagagacagcccauucuuugauguuuccacccugcauucuuuuguucugcguuucuuuccuaagaaauccucuguucaaugcugaggcugccucagauucacaaucucccuuagccucuggagggcugagaugacaggugucccucugcaccuggcccaauggcaacuuuaugaaaugagccugugagcuggagagugggcucagugguuagcgcuugcagccuuuccgguggaccucagucugguucccagcacccacacuggguacuuuaaaacugccuguaacuccaguuccagaggaucugaugcccuuuuuaggcaucuguggguaccugcaugacuguagugcacacagaugcacaauuaaaaaaaaaaaccgcacaaaucuuuauuaaaagcauuucucagccugggagaagguagcucaguugccagaguauuuguauagcaugccuaaagcucucuauccuaccccaggacuaccuagaccagcuguacuuaaugcaugccuauaguacuagcccuggagaauccgaaauccggggucaucccugccuacuuaaugaguuugaggcuagucucggauacagaaaacccugucucaaaacaaacaaaaaaauucuuccuaugucgagacagguguugguagauccuaggcgaugauggaaaugucucuaucuguccuccccagaaugauagcaaccagucacgaaacagcaacaggggguuugaaaugugggcaauaagacugaauugguuuagugugauccuaauuuagauagccacauguggcuugugacuacuguauuguguggguaugggacuauuuccauuaaaaaguaugauggcggcuggugagauggcucagugggcaagagcaccugacugcucuuucgaagguccggaguucaaaucccagcaaccacaugguggcucacaaccaucuguaaggagaucugacucccucuucuggagugucugaagacagcuacaguguauuuacauauaauaaauaaauaaaucuuuaaaaaaaaaaagaguagcaacuguucaaaaaaaaaaaaaguaugaugggcgaagugcccugugucuguacugccacuuggguggaggcaguugaguugcaggauacacagccugggcucugugagauaaagcacuugcugugugaugagcugaguucaaguccccccaccccuucccggacccacauaaugcugggugugguggcacacaucuguaacuccguuguccuauuaaaggaugagaauuagagacaggaggauccguuagcucucaggccagccacgugguauacacacuguggugagcaagagaccuuaucucaaaagaaauggaaguugaagacuuuuuuuaaagauuuauuuauuauuauuuauaaguucacuguagcugucuucagacacaccagaagagggugucagaucucauuacgggugguuguaagccaucaugugguggcugggauuugaacucaggaccuuaggaagagcagcuagugcucuuacccacugagccaucucaucagcccggaaguugaagacuucuacaagcauauacccguucauauucauacacacgaguaccuaugucauacacaagauuuaaaaaaaaaaaauucauuauguguaugucugugugucugucuggauauguacgugugucuggguccucacuaaggguaaagguaucagacuccccuggagcuggaaucacaagugauuuucagccaccucaggugcugggaacugaaccuggccucugugaggacaguauacccucuuuuuaacuuguuuuuguuuauguauguauguauguauguauguauguauguauguauguaugcacauugguguuuugccugcauauauguuagugugagggggucagaugauucccuggaacuggaguugcagauaguugugcaccaccguguggauggucgaaauggaaccuggguccuuuggaaggacagcuagugcucuuaagcaccaagccaucucuccagccccaacaaaagucaguccuaguuccacauacaggaguuaggucuggaugagucugccuucgaggccagucuggguuacaugcaggcuaugugguaagauccuaucuugaaagaaccccuccucccguacucuccuccccccccccccaaacuucucuagagcuaaguacucccagaguacuucagcuuuaagaacagcuggaggacugugccuuuaaaagggaauguacuuguucugugaaugugagaaacaaaauucagagccuuaccacccagcugggugcaaggcugguguggcagcauuccuuuaaccccagugcccuggaggaggagaugggauccccagagcugaaugucucaccaggcuugcugaaauagcaagagacccugacucgauuaagguagcauaaaauuaaggagcaccugauucccaacacaggcaagugaagagauaugacaaacacuuuuacuaauuaaaguuuuuacuuucuuguuugguuuuccaggcaggguuccucuguguagcccuggcuguccuggcacuugaucuguacaccaggcuggccuccaacucacagaaauccuccugccucugccuccugagugcugagauuaaagaugugugucaccaccacccuauagguuuuuacgcuuucaaagauuguucuuaagacagggucucacaguguagcccugguuggucuggaacucuugauccuuuuugugucggccucuuggauuaaagacaugggccaccuugaugacccccuccccaagacagggauucucugugcagcccaggcugucccagaacucguucuguagaccaggcuggccucaaacucaagagcuccuccugccucuccagugcugugacuaauggcauacgccagccaccacugccaggcguguccuuuaaagucucucuaaugcuagcugacaucagacagcagggucucugagccagcaucaguugaguccugcaguuaguacagccccgcaucaggacagaucuuuuagugguggucgaguggaucucacgucaggcccggcucugauacuccuuuugcguugaaucccaggacccgccucgcauguucagugaggaguaccagaaggcuguucuggagaauuaccauucaguucuggaucagaaacguaaagaauacguggucggagagcucaucuggaauuucgccgacuucaugacgaaccagugugagugucuguugggcuuagggauuguucucaggucggcguuuccccguccugggcauuuguaagaauccuagaaguggguuuggggagauggcuuagguaguaaaguacuugcuuuggucuaguuuacagugguuaaaaggagaaaaguaggcuucagauuggguuguaccucccucccccagcuuuggaugggcaucugcuugcucccuccaacacgugggugccugcgauugaacuuuggggugaguagguuucauagcaaguaucuuuacuuucugagccaucuuaucagcccuccuugguguguuuggguuguuuuguuuuagcaccgcugagaguaaucggaaacaagaaggggaucuucacucgccagagacagcccaaaacuucggccuuuauuuugcgagagagauacuggaggauugccaacgaaaccggaggucacgguucagggccgagaacccaguguuucggaagcagaccguucacguucuaaaguuacaacuaccucacugcagacucaaagguguccccagacacuuccugacacuaguguuucuauuugggauuuugugaacugauacaaggggacuuuagaagugacaucaaagcuuuucuuccguggggauaauaacuuacagugccuuaggcucaguaauauguccugcugagagguguccaagauaauuuguuaguuuuuuggccuuggcuuugugaacucuugaaagccugcugugugaacauucucacuaaauuaagagcuacuggugagaggcuggagugaaggcuggcucacaauuuaagagcacugacuguucuacuggagguuccagauucaauuccuagcacccaccugguggcuaacuaugagcugguccuccauuucccaggugauccaaaugcccuuuuggccccugcggguaccacauguaugugguauguggaucuacauguggggaaaaaagucauacaugcaaaauaaaaaugaaucuaaaaaaaaaaacuguuucuuucguuacuaucauugucgucauugcuguuugaggcaggguuuuucuguguagcccuggcugcccuggaacuuauucuguagacacacuggccucaaaaucaagagaucuaccuggcuccgccucccaagugcugggauuaaagguguuugccacugccgccaccgccaccaccaccacacagcaaauuuguuuuaaagugcugugacagauuguucacugcccugggacgacccccaugcuugaccaucuaaacaggcuagucuugacccagugagagugaaagagucacucaccaaaugccacagaggagcugggagugguggcacaugguuugaauccuuaaguuuaaggccagccuggucuacaaagugaguucuaggauagcaagggcuacacagagaaacuccugucuuuaaaaaacagggagggggugcaggggaagaagagacuauuguuaguucaaaugggaagaaauuuuagggguucuguauuucaugucaccauggaccucuuauauuuuucaaaauacccaaguuuugugucuuaguuuaauauaauuuuuuaaauauuuuauuauuuucuguguauguuugugagucacaugugccugggcugaugcaaauaaaggccagaacauauuagacccucu

SEQ ID NO: 2699 - RNA, 13126 nt, Mus musculus
caauuggcucuacucuuccaggaggcggggacaagacagaggggcagcggacgccauccggaccagaaaaagccaggagagaccagaagguaaccuggucccugagugucuugauccacuagguccagggaacgugggacagagggaacaaacaagaaggaacgcgaagucuguggugcgcuugcugagugcugcccacguccugcaagccgagcaggugucccaacuccgucccugccccguagaccucccgagccgaguuggucaguguggucuugucuuccagauucguaagacagaagcuccaggaggaggaggaaccgcccaacauggcaucagagguguguaggacugaggggaccuugcaaaggagcggggaggaaccagucggguuuaaccgcguaugggggccaucuccugccacacagaccugcagugauccugaaauucccgaccacacuuccaaagacuggcuucacguagacucagggauguccgcgucguuaucugcccauccagcgccaccuaguggcuuauguaaugaucucacuauuggccacuaugucgggcgguuuuccccguuuuuuuuuguuuuuguuguuguuguuuuguaguuuuuuuuuuuuuucucguuuguuuuuugagacaggguucccauguguaauccuggaacucgcucuguagaccaggcuggccucgaccucagagauccaccugcuucugccucccagagcgcugggauuaaagguaugagccacugagcccugcguuuucccuuuuuaaagaauuauuuuaaaauguauauuuguauggauguuuugccugcauguauagacgucugugaaccccggggcuggcuacucccuaugugggaucuaaaggaauggaguuacagauguuugagagccaccaugugggugaagaccaaaccuccaugcucuuacuggcugagcccggcucuccagccccuguuuuucuuucuuugagacaguggcuaacuuuuagcccaggcuagacuggaauucaccucuacucagacuggccuuaagcgucugacaagucaccugcauccaccugcugaguguucagauuccgggugugaccuaccacaugaaagcuuuccacuuuuuuuuuuuuuuuuuuuuuuuuuuagcauuguuuguucguacauaaguauguccaugugagcucucauacauguggugaucagaggacaaaaugugggaguggauucucuuuucaacaggcuuggcagcaagggccuuuacccaguuagcuaccucaucuuccuuacauaccgcuuuucaccccacauccucuugucaggccccacccaauaggauaacucucuccuccuauucgcuuguucccauguauaggaaaacuugagucccuaaauuguccuugagguccaucauauagaaccggccaggagggagggaccucucuccguggccccagugacucccuagggugucgcuguccucuccucugggccaggaaucccuggcuugucuuccuauuuagugaaaggugugcaagauauaggucucccgugggcuugguugguuuagcugguaaauggaaugaugacagcuauugggcuucaccuguaaggaauggaucucagagucauagcucugaacucuuagggaauggaggcuguagggaagcagaugccugcauguguggucccuucuggucuucguuagcuggcaacucaccuccuuccucguagcucaucauuccgauuaaagauuuaacucacuugaguuacgacggccugaucugcuuagcugcugggucaugcggagggucaggaacaagggcuggacuuuggagccaaacagaugugauuuguacaccaggguccuugaccucuuaguuccuuugugaaguagggguguugguguccacuucauaaaaggauguaauugcaguaccauguaauugcagcggcccaugccucuaaacccagcacuugggagacagaggcaggaggagcuccauaaguucaaacccagccuggucuauagacugaguuccaggacagccagggcuacacagagaaccccugucuugaaaaacaaacaaagaaaaaaaaaaaaacaaacaaacccacacuauuaauccuccuacaucugccucccuaaugcugguauuacaagugaguaccacuacacccagcuaacaguaacuuuuccgaugcuucucuugugcauuuaaacugaaucuuacucauuccacucggcccuuuuccccuucucccaggcuuccagcgugcagcaauacccucuccauuuguauugguccagccugaaccuaucuccacaagccaaaacacauggcugggguuguagcucaguggugaaacaccagcuuagaaucucucacuaagggacugggcuaugacucugugguagaccaccugugucucacaaacaaggcccuggguuaaauuccaaauauaggaauggguggggucaagggggagugugugucuggaagccugcugauggaauuagagcucagaguucugcacuccuggaacacaguggucugggcugcagauggccucagcuugccugaagccauucuguggguugauacuaauuguucuggcugcuguccugcuuauuaaggaguuguuauuaccaacaaaccaggcacagaggccgaaaaucuggaaaggaaggcaguggcaggaugcuuccugggccuuccccugcagccuccugacuuguuucuccauacugacugucuggcccugacccacaggccccaggggcccaggggggaaggguguugaaggagauccuucgaaggucagguguagauccucucacagagcugggggugaugcuggaggcugcuucugcgguucagaguccuucuggcgguugagcacagagggggugggcuccuagccaggggccagagcaaagcgccugcucccuugagacacuucagggcucaggaggcaguguugguaaacugcuugcuuugcaaggguaaggaccugaauuugggucccagugcugaagaaguugaagcuguugaccagccagccuagcugaauucaggaucagugagagacagugucucuaagaacuuggugauacacuguaaucccagcacgggggugggguggguggaaggggagacagaaggugaagaucuccaggaauuccagaccagcuucauuuauauagugaguucuaagcuagccaaggauacagagugggguccugggugaugguuugaauauuaacuaagacacccugucucaaaauuaauaguagcaauaaguaauaagguagagcgcaauuaaggaagacaccacugacuccagcauuccuguguguguguaggcacacacacacacacacacacacacacacacacacacacaaagcagagaaaacagagcacacccuaacccugaacacccucagucuuccuucaguauguauucgcuuugcaaaugauaucaaacuaaaugcuuauaacguugguucuuaaucugugggucacgaccccucugaggguggggcuuucccagggguuguguggggccaucagaaaacacagauauuuacauugugauucauagcagcaaaauuacaguuaugaaguagcaacaaaaauaauuuuaugguugggggggagggucaccacaacagggugaacuguauuuaagggucacggcuuauaacaagccuaucuuguggguacaaaccuuccuuauuuguaaagaggcaaaacugagacuucaaggaguuauaugguauacccaaggggaagaaaccuuauguucccuguggcuuuugcacacacagacucacacacuccauguccgccaccagugucccuaccaugcuuuucugcugguccuggguuagcuguuuccuguauauucugcaccccuuccuauggccuguccauauccuggccuguguccuucucuuuccaaacacaagccucucugaccuauccugcugcucucugguggcuggaggugggggaucagcuaaugucgucuuagaaaaacaaugauacaaaaauaggggcuggacagagugguggugaugcacgccuuuaaucccaacacucugaaggcagagacagguggaucugugaguucggaggccagccuggucuacagagugaguuccaggacagccagcgcuauacagagaaaccugucucggaaaacaaggaaagcaaaacaaaauaacaacaauuauacaaugugaucuaucggcuagagaaaagcaauuuugguguggucccgggaaugccacugucccccugguccaucccauguggugagaaagaacccugaauuguguuucuaucauaucuccuugcaugcucaccaaguucccaagccucugaguuucagcugcccuauuuauccagugagaauaaugucuaaugccuaggacgaugaccccacgcccuuucuggcuaacucucucaagggucccuuuugagagucuguuuuguucuguccucuuggccagagcgggaagcuaugggguggccgguuugugggugcugucgaccccaucauggagaaguucaacucaucuaucuccuaugaccggcaucuguggaauguggaugugcaggggagcaaggccuacagcaggggccuggagaaggcggggcuucucaccaaagccgagaugcagcagauacugcaaggguuggacaagguagucucccugucacaagccacacccuacauccauuccccugggaacccaggcuccuagcccaaaucccuaugccugacauucuccuuuuuccuccugcugaugcuggagcuggaacccugggcugugugcaugcagggcaaaugcucuaugcugagucacgcccccagcccaucauugggagacucuacgcaaguguucuguuguaucacugagccuugucccggcucucauauccuggggcauaggcaguagaauuccaggucuguugugugaccuugaaauaaguagaugguuacugccucagauggcuggugcuauaguuaccaccucucuccuuuuuauuuauuaauuuauuuuuauuucacaugcauuggugucuugccugaauguaugugugucuaaggaucucggacacccuggaacuggaguuacagaugaguugcggcugugguccgcaaugugggugcugggaauugaaccuggauccucuggaaucgcagccagugcucuuaacaccaccccaccccacccucuucccaucucugucugucagugacuccucauugcucaugaccaagguggacugggucugagagcauuccucagggauggggaaguagucuauggaucagcugccauacaagggcauuuaaccaugguggaaccgggaccaaggcagggagacuccuggcuccugaugcccaaucaaccugauauccuggguugcugcuaccuuguucagguugcugaagagugggcccaaggcaccuucaaauuacauccuaaugaugaagacauccacacagccaacgagcggcgccugaagguaugacacacccuucuucauaaguaaucucucuguaucucaccuuauccugucacaggcauccuuggcagaguagaaauggcaagagacuugggcagaaugggguugagggggaggucccuggcauagggaaggagccacagggucggcagggaccccuaccuggacggagugucaccacuugaacugugagcagggaguuccuaaccucaugccucuucacuccaggaacucaucggugaagcugcagggaagcuacacacaggacgaagucgcaacgaccagguguccccgucccuccugccuucuucuacgaaccugucaaccaugggcguccaggaggcucuuaaggcucagcugcuguccugguucucuagggaagcagcaaacguuaugcccugaguccgcccuucuccucuccacagguggucacggaccucaggcuguggaugaggcagaccugcucaaaacucuccgcccuccuccgggugcucauuggaaccauggucgaccgggcagaggcguaagucuccuggggauacugccaugggaauuuucuccuuggaggggaucuaagcaaggaaugagugugguuaacccuaaaccagccaugacaggaggucugcacacagcauggacgaugguuccaccagggcugcauaguagauaggggucuggucuucccuagucuuccccggucuguauacucuagcuccuucuggggccagaggugagucuauauccaacuaaggcagaauuacaucugaacaccugggaggaagaacacaauacucaagugaaguccaaagacucccgaacccuccugaaggaagagaauacuaguauuccacaggcccaguuggguuuggguuuuuguuuuccaggguauuuguuuauuugugguguuguuucuuuuauauguauaaguguuuugucugcacauguguaugugugcugcccgcaugccuggugccuguggagguuagaagagggcaucagguccuccuuucacucaagccgugaauuagccaugagccaccauguggggacugggagucaaaucccaggucuuucugcaagaccaaggggccuuaaccaauaagccaccuuuccaggcccgcaggcccaacuaugacaggcucaacgucccucaugaacaugucagcaguuugacucagaggauagagcccagguggccaccaggcucuguucuccucugaaugugagaccuagauggccuuggugaagagaguuggacaugaggcccugagguauuaggugggcucagagcucccagaacaauaaggagcagggugugacuuaccagcuccauccccuaccuaggccagcccagagcacaccaggcgacaguaucuguuuaaggauuuuuggagacugaagcuccaggugcccaaggaaagggcuugacuaagcgcaaagcaggcagccacucuccaaucuaggcugucccaucuuacuccacuccccacccuacacagaaggcagaugacagagccaagggcugccuccugccagccucgucccaugcauccauguucuaaugucccugggacuggcuuuguccccuucagacuugacaaaggagacccugaaauaucuuaguaucagaauuagggcgacgucucccauuucuuaacucugugucccgucccccguccugccccgucccgucccguccgucccgucguccccccccaccccguccccccccccccccccccguucauagaccucagcuuagugugaaugaugcaaaaggauaugaacugugggagggggguggacugcuguuaagaaugaggaagggguagugaauacaggaaauugaacauauugaugguuagacacuaaguguagccuggggcuugcuauguagcccaggcuagccucaaguuuccuuucuuccuuuccuucuuuuuccucucuuucucuguccuuuccucuccucuccuuuuauuuuuuuauuuuuauuuuuuuuuaaagacagcccaagccggcuccaaauccacuguguaacugaagccgcccuugaacuccugguucuccugcuucuccucccaaucgcuaggauuacagguguccgccaccucacccagagcgugggcuuuguguuugagacagagucucauccacaacacaaagaacucaccauauauggccaaagcuggucucaaucuuacugcaguccuccugccucaaccucccgagcacugggaccgcagacucgcaccaucaugcccuuccugguuuagucuuugagcucacugacucacuuccgguuuuaucgguggcgagcaucugcucccuuuuuaugggcggagcgccacaggucuauucuuaccuugccugaaaagaguguuccggguguccuaagcaagccuuaccugucccugccagaccccagucccucaggucuccugcuucuccaccugcuacagggaacgugauguccucuucccaggguacacacacuugcagagagcucagcccauucgcuggagccacuggauccugaggugagucgugcggagcaggggcgguagguaggaagcggcccugaccaggggcuuugauggaagaggaggcucgcuaguguccuaccaccaaccauccaccccuauucccuauuucccacagccacgcuguugcgcugacacgagauucagagagacucuuggaggugcagaagcggaucaaugucuugccacuggggagguaaggcauuauuaacccucgcucgguguccccuuauggaagcugagggcaaauugcuacccaaucaagacugaggaaagcguggagauuagagggaggggccuaugagacccugccccuuccucagggucuauauauagacagucgugguugcuaggggacggacauuucuucauugguuaaguugccagugcuccuauuggcaaccacucacgcauucgccuauuagcagcccuagugaaacucacugggucaccaacaaagacaugaaauguugagaaaaggaaggacucaucagaguaguaagaggacaagagaggguaauggaggagcaaauaugauuaaaauacauuccgcguguguaugaaaauggcauaaugaaaccagauuuguauaauauacaugcuaauugaaaagguuaggggcuggggagauggcucagcgguuaagcgcacugacugcucuuccagaguccugaguucaauucccagccaccacaugguggcucccaaccaucuguaaugggauccagugcccucuucuggugcgucugaagguggcuacaguguacucauauacauaaaauaaauaaauaaaucuacaguguacucauauacauaaaauaaauaaauaaaucuuuuuuuuuaaagaaaacuuuagggugggcuggagagauggcucaguguuuaagggccgcgcugcucuuccagaggacuaaaguucaguucccagcacccacccugggcagaacauaacccagccauaacuucagcuccaggaacuccagugcccccuucuggccuccaugggcacugcacacaugugacaaacauucacacauccauacacacacacacacacauacacacacacacaagaauaauaaaaacaggucuuuaaaaauaaaacaaaacuguaaaggcuggagagauggcuaagaacaccagcugcuuucacagaagucccagguuugguucccgaugcucacauugggugcucacaacugccucuaacaucaguuccuggggcucugagguccucuucuggacucuguggacaccuacgugcacuugguucacauacagacaagaaggcaugcacacaccuacacacaauauuuuuaauagaaaagaguuagacccugcucugccuuucagaucucuaacauggggauaaccaaacaagaaaaacgcugaaagcccagccagcuucccaucucgcaccauguucccugcauggugaaacuuuuuugggccuuaagguggacaggccaggaaagcagcugagcaaccaagguuugcuucugaguguugcaugugauugguacccagagccucaaccucugugaaccccgucucucuacaguggggccauugcaggcaacccucuggguguggaccgggagcuacuccgugcaggugaggcaccuuguucauccuucucuagagacugucacacuuagcuucugcuggucucaaagacacacaagaugacaugggagaggcacagagaacucgugcccacaauauaaacagcacaauuugguggaauuuuuccuggugauaaguaacucaauccuauaugcacaauaaaacuuaaaacaugguuacauugaaacucuuuguaagauacacaugacagcucccaugaagauggguuccgcagauuaggaucugguguggucucagcuacacagugcaaaaaucaccaggcaauuaacuacauccauucccuggcuucugggcagaaagcagguugugcauccgucccuuuguagucuaaccugcuguguaacauuucugguuccccccagugcuuauccaugagcaccaagaaccucccucauaucuugccuauggguauugagacuaaugccuaugucagggguaccuauugcuagggaaauuaaaccuccuuccauccucguaagaucuguaaagagacccuauuccccuccucauaccccucuucaauucccauuuccaagaaggggucuagggugagucugggcguccagaugugggcacuucuugccuuccaauuuagcuguuuuucccucucucaccuccagaacugaacuuuggggccaucacucucaacagcauggaugccaccagugagagagacuuuguggguaagacccccgaguccagggcugggagugcacaucagauaggagugugcuugcuuagugugugugaagcucuggguuugauccccucugcaugaacuggguauaagaugguacacacccauagccccagcacuugggaaauagagccgggaauaucagugauugauggacauccucugcuaauuaauuugugaccagccugagcuauauaagaccuugucacaaacaaacaaacaaaaccaaaauaacuacuaccaaccaaaagggccagcgagguuucucaguggguaaaaaggcacauacuacuaagcauggugacccugaguuugauacccugagccccaaaugguggacggagagaucugacuccugcaaguuguccuuugaccaucccugagugaccacacagagaguaaaugaaaagaaaaggccugcugucccuuccagcugaguuccuguuuugggcuucucuguguaugacccaccucagcaggauggcagaggaccuaauucucuaugguaccaaggaauucagcuuugugcaacucucagaugccuacagguaagguccauaucucauaccaacuggaaccguuuccucccaucccauugcaccgccaccuuugccagacuugccuggugccucuaagagcaggccagccaggcauaaacagaccuaucaguccuaacaccucuaucucccccccagcaccggaagcagcuugaugccccagaagaaaaacccagacagccuggagcugauccggagcaaggcgggccgaguguuuggacgggugagcugggcagagauggggucaaggcuuccagacauacccagcgggaguccuuaggggacuccaugucugacucuggugucccaguugcucagugucacucccccugcagugugccggacuccugaugacccucaagggacuuccaagcaccuacaacaaggacuuacagguaugaaccugggagugucgugaggaauccucuggucuauaccacauaaauacuucucagaguuuugagagagccagacagguacccuuagaagggcucccuccuguccugggcacacaguuugugccuacccucagaaguauccugccucuauuuaguagcaggggagaggugcuaaggguacccaguggaacaaggaaugaggcuugggugaagggcggggcugcgggucccuuaacugccacaccccucccaggaagacaaggaggcuguguuugaagugucugacaccaugauagcuguccuccaaguggccacuggagucaucucuacauugcaggcaagacuagccuucaccucccccaccucucccccacuaggcccagaccaggauuugcaggggaggggaugaggccagaaggccugggagggggagggcagaccugggaggaagagggauagaugggauggguuagauaccaaagccccagguuugggcuagaguaaguuuucuguuuugguugguugguugguugguugauugacugguuuguuuguuuguuuucugagacaugguuucucuguguagcccugggugucuggaacucacucugugcaccagguuggccucaaacucaagagauccaccuaccugccugugccucccuagugcagggauuaaaggccaccuggcuuagaccuaucccaaaagauaaaaacaaacuaauaauaaaaauguuuaagcggagaguggauuucucgugggggugggcugggguugagguauaacucaguugcugaggacacaguaggccaggcuccagggggucccccaagcucaccuuuugcuggucuuacgccuccagauucaucgugagaacaugaaacaggcgcucagcccugacaugcuggccacggaccucgccuacuaccugguccgcaaaggggugagugugaagcagccaggggacaaccgugucacaggagaaaacaaacucccaaccacccucugccuaugucuauagaugccauuccgccaggcccacgaggccucagggaaagcuguguucauggcagagacuaaaggaguggcucucaaccugcugucgcuacaggagcugcagaccaucagguguggcggaccccucccgcucaccaccgcccuuacccccuaugcccccucacucccagccccccaucugcaucuucaugcucugcugcaucccagaagcugauccugggcagcugcaggcugagaugcccuggcuacucugaccccauccucuuucuccccaguccccuguucucaggugaugugagucacgugugggacuacagucacagcguggaacaguacagugccuuggguggcacagcgaaauccagugucgaauggcagaucaggcaggugcgggcccuacugcaagcccaggagcccuagaucccgcccacccaaagcugcuccccaauaaaguggagcccugaagaaaccgagacaagcauaugcuucugccugugguccucaugagugggcugggggauuuguugagcuggccaauggggucaugaaggaaguagaaaaaaacaaaacaaaacgaaugccaaugcaaagagagacaggaacaaggguuuuuccuccuacaccuuaaaucccagacccccaccccccgccuugcagguagcauaacugugaaugcaagauuaacacaaaaucauaaacuuaaaacauccugaaggaau

SEQ ID NO: 2700 - RNA, 1386 nt, Mus musculus
ucggcagucagccaagcuuuauugaagucacauacagcaaaacacagauucccugccaggggagaagauauucagaaauccaguucaaaaggagggcuugagccuuuuggugguguacucuccauccacuuauuuuugaauggcuaauuuaaacaaauaggaggcaucugauaaagccacagcuuugcgcguacgcaugugugggcaggucagauggagaagaggagcccuguuugggagugggguuuucucuuuucucaucugugguuauuuaauuuuuuucauuuuuagcguuuguuuuuagcagucucauguaacccaauuuggacucacaauguuaugaagcugaagcuggccuugacuuccaaguacugauauugcagcgugagucaccauacucaguuccguuauuauuuauuauuauuauuuauuauacuagagacaagaguugaauucucagaaauccuucuaaccucucaagucgcugcaauuaaagguauuugcaaccaagguuuuccuuccugugugaguccacggaaaaagcgcuagcacagcagccauguccuugccagccauugguguugcagugcucaauuucuauuacacagcaggugcccucagcccuccacaacacauccucaaggacagccugcuuaggccuuuuuucacuggcccgcugcuauggagacaaaccagccaguccugggcccuuucccaggacacauggaccgggaugauaaaguggaguggccuggagcuucgcgccugcuagucagaaagccaaugaaagcaggaccacggugcugccccuaugagcgggcuuccugccaaucaggggcggaggccagcgaggacacagccaauagcaggagcaauuggguggucuguccuuucgggaaccgcgccgggggaccagcgcugucguugaacgucggaagugcagaacgcgugcccuuuagguggccuauaagaaugggacugaucggcaagccguugucaguugucacucuaguuugagaccucgaugguuggaucagaccuuuaaccgucauagcggagcuaaucggacacugccaguaguaggaggcgaccgggugaggccagagaugcuaccugcgcugugguugcuaugcgcagagagccgcuucccuagauaaguggccuggaccaagggagguagcgcucccguuaguuagauagccaaucagaauggaacaaacccaaccagacguguuuacccuauaauuggacaaugcucuugccaaucauagcaggaguucaugaaaccucggccaauagcaagaagcgccugguuccgauuugcagcgcaggguccacgcggugguugcugaucgaggucgucagugggcgaucaccuccccucgg

SEQ ID NO: 2701 - RNA, 10950 nt, Mus musculus
caauggcuggaggcagccaggucagaccagcgacuaacuguaggcgcguuggucguuagacuguuggagggcagcacaggacauccuaacugcuugcagguccucggcgucuagcgcccgccggcggcccaucucgucaugucaggcacugcuuggcuuuaguucuucaggccuccgcccacccgccuacccgaagccgcgcccaccgcccagagccagagggauggugguagucaccgggcgggagccagacagccgucacucggacggugccauguccagcuccgaagccgaagacgacuuccuggagccggccacuccuacggccacgcaagcggggcacgggcugccccugcugccccaggagguaccuggaucgagcgaugggggaagggagggcugaugggaagcgagggagagacuggugcuugcagagcugaccuugggcggagagccucccaaggagcuauccaccccugaugccacuccuacacuagguguauccucccugccccgagucaccugcacuccaagucccuucuucccguacuaccagaugucaguuccauuccuguauuucaugucaccuuuaucaacuagacgaggacucaacacauagcauguuccauacaauccaaaggaggaccuggguuauccagguguauccuccagcugccgggggaguggcauuagaaacuaccugcaguuaaccuaucuggugccuugguaugauuuaagaaaaggacacaccugaguggaccaauucucauccaggugccguuaugcagugaacaaucuccauuaccacaugggguaauuuuauuugcuagauggacaagagugaacgguagaggauuuggggucaagaaagcagcgagagcaaggacaugcaggagauaaauucgggaaauaggagggcaauggugaguugaacucagagcagagaugauggagggauuaggggcuucauuuaucaguugcuguauugugcuauggaguggcuucguuaguagcccuuccugugugugacacuuugcaccugaacugacccuggagauggauaggaagaugaauacagauguagagauggauaggaagauggauacagauguggagacucgacaaucugagggggcuggcuugagugaggcucuccggcagcugacaguauugugguaggguuagaauccccgaauugccagcaucgugggaaacuugugaacauaagcaaaauucuagacauaacucugcagucagggaaaagggccaacacggcggugacacuuuuuuuugugcacugucauugggcagaaguugugguuugagugacaggacacacaaucccacagacuguaggccagcuguccagucccggccuccugugagucacaucccucccugugaguucuaggacucuuuucccugacuuuuuuuguuucgcauauggagcaaagaaguacauuagugggugcugccuuuuagaaagaacuccagaagugcaaagcauuacaccuaagugacaucugagucuuagcguauaccuaaagugggcuuagcauuucugcagaaaugugaaaggcauuuugcaccgugagaguaagaguugaauuuuugggcuuggugguacacaccuccaauuccaaaggcagaggcagcagauaaaugugaguuccaggccagcuuggucuauguagugaguuccaggagagcccgagcuacacagagaaacucugucucaaaauaauaauaauaauaauaauaauaauaauaauaauaauaauaauaauagaguugagcucauacuuagaauuguaaauuuugugcauuuaauucacugauauuuugugaauuuuagucucuacuguaaggcaagucucagguacguuuuaucucaucuauuuuugucuuuuuuuuuuuuaaugaggcagggucucucuagguugcccacguuggccuggagcucacucuauacuauggaguucacuagucuagaacucagagagucuccugauucugccucucaauggcugggaucaaaggagugcaccaccaugcacaguggagucuuuuuuuccccccuaaacaaaggauguguggaaauuuggggaaaggacuauuuagauaacuacaaagacuuuagacuuucaccacggccagagagauguaacauugggggggggggaaucuaggauaaaauuuacccugagauuuaguuuaguuuuaguucaucuggagucagcugguuggaacugggacuugagguucuccaggcuaauaaccuuuacuguuauuuucccguccucacuuaguccuugugaccaaaaccuugggugacguggagacuaaucaaucgauauaaauugaaugggagagaauggggugagguagagagcgaugguuggugcugagugugaagcucugcgguagagcuccagcauagcaccugccaggcucuggauaagaggaaggcagugaggaguggguaccucgaugcagucacaaagagcuuuuggucucuguucacaacaggcaagcacacaugcucucccugccuuugggaugcuuggcaccuaggaaaauggguuggcaggaaaugguugccauuguauggagcuaggugcugucauugaggagaguguagugaaggaauaaggggggaauauguacgggauucuuucuuggacgugagauggagggaagagccguaguggucauggaauagagauggaauggacccaugcugccaacuguguggugccuugguguaauuuaggguuggacacacaccuggguggacagacaaaagugucauccagguguuuacacagugaacaaccuacacaccaccacguguggcaguuucauuugcuagcugggcgggaggagagcauuaagaacaucuguggccaaaaagccagcaugaguaaggacuuaaaggugagauguucaaaaaggaguaaaagacaaugaaagcugguagagguuggaggguuggggugaagagacaccccauuuaagggcuaucaggucgaaugaguaggacuuggugauggaugcuuaaggaaagcggggugggggguguccccuaguuugggaugacugauugugaucugucagaccuaggcagacugacuuggaggagcccagaucuugcugccugugccagucugaacgcuguggugguuccuuuccaguuuccugaagucguccccuugaacauuggaggggcucacuuuaccacgcgcuugucuacucugcggcgcuaugaagacaccaugcuggcugccauguucagcgggcggcauuacaucccuacagacuccgagggccgguacuucaucgaucgagauggcacacacuuuggguaugucugucucuuccucugcgaucagcuccguagucauagccagcaaguagccugggauugggucuugggcauuccacaguaccagaggagauagccuaaugguggaauuuaauaaauauucuuacugaauuguuauuaagaugcuuaaguuguuuuaccccagguaaaaacagcaagagaaauuguuugaguucuuugguuugguuugguuuuuuuugagcuaggguuucuguguagacuguccuggaauuuacuuuguagcccaggcugaucucaaacucagacauccaccugccugcugagugcugggacuaaaggugugcgccaccacagcccagcaagagaaagucuaauacuggcaggguuugauaaaacucuucccacccagugcaguuugagaguuggagaaucauuaucuguauggagaggaacacacuuggagucaggagaaugucggaaaaccguccuggagaaaaccuuuacauugagauacuuggauucaauaauaccaugcagguugggcgugguggugcucucgguggaaacgggggauugcaaguauuucuaggcuggcuugggcuauguagccagcaagacucugggucaacacucccaacaaacaacaaaagcuacugcagcccggaggggccggggugcauggugacgguucugaggcucacagugacuuucagcagacaccgugaggaugggcugaugccggauugcugcuccugcauuuugcuaagaaaaccuuaaaaaacaaggguagcaagggcuguggugguucgagucccuucagaggcaggagcagaggcagguggaucucugaguuuaaggccagccuggucuauggagcgaguucuaggacaaccagggcuacauacaaagaaauugucuugaaaaaaacaaacaaacaagcaaacaaacaaaacaaaacaaaacaaaaaucaaacuuguauguuagugggauuuuaacagcaauaauaacaacgcacacacacacaaacccacagucugauauguaccuauccuaaagaaauggaugugauuauuacaccuucccaugaaaaugcuucuggcaaacuuauuaaaauuuuuaugccuuaauuucaucacggguuuuuuuuguuacgauuuauuuuuuauuuauaugugcauaucacuugugugcgugaggcccgaaugggauguugaaucuccuaaagcuggaaccacaagcaguugugagcuguugauguggaugcugggaacugaacuguguccucuggaaguccagcaaguucucuuaaccacugagccaucccucuagcccucaguuuccuuguugacaugaaaaauaaguguggcugucuagugggcguaucagugaugguuaaggaaagagcuugugugugaccccgggaaggucagaucuucaaagcacauggcuagaauccucugcuccuucagucucuccuucgagaugacuagaggaucgaucuagcuuuugaccuugaaccagugaccagagagacagagacuucaaucgauguauaugucuuuguguugaccuccaaguaagagugcccacaagggucauuuuuauccuuacaaaggcgccucuagcgauauaauuuguuuugcagagucugguuuuccccagugggcuaucagcugccucugauggugagaaaacagagugucacaucacucuguggaacuauaaaaagauuuuuuuguuugcaggccauuuggggagggaagugcuggccccagcuggcaucucccauagcgcucuuagcugggccuugcccgggcuuuugcuugucagagcucauaaggguuuauugaacaucucagaggacugacuuuaaaggggugggcgugggcuggaaaggcggcugagaggcucaguguguuuacugcucuuguagaagaccugaguucaggucaauuggcucucaaccaccuguaacuucagcuccaggaaagccaauacuucuaacuuccacugagugccuguauucuuaggcacacacccaaacauaaugaaaaauaauuuaaaaauccuuaaagggguuguagggagggagaacaggauccaauccaaauugaggcuuagaugccacugucugcuggucuguauacugguauaguagucugcuacugguauaguagcauuuagacuuagacuacuggacugcaauagucuguggcuuaucagcgguaguuagaguuuuucaaaaauuuaggguauaaggucagggaaauuggaagguacacacauuucucugcuguuguagcucauacagacuugucuaccauccugggggcugcuugggucuggggagaggaaugggggucuucauugugcagcuggcauuguuugcuucagugaagugaggacaguggugguugucagcucagagugaguuaugucuggaccugagccugugccaacuguggcuccuccaacagagguuuuccauaaccuuauagaucccacuugggccacauuuauagacuggagcuaagagaaaaaccugccuuauaaugucauuaagaggaccaaaugggugguguaugguuaguggcuagauuaaugcuuaguguuagcuguuguugcuuuauggcuuagaugaauuauugauggaacagauagaucuagggguuuccucccucucuacccauaaccgcugacaauaggccugauuguuacccccggcacuaaagaguuugaagaggauuagaaagacuguacuuuccauguguggcuuuacuuagcugagacgccagcuaauguuagcucuugcaguuugguauuuugucuucccagacagcuauagaaugauagugacgguagcaauguggaauggguagaauguguuugcuacuauuggaagugugagguuauagcuauuccauuaucuguguacuuaggacugaacauuucuuuuuuuuuuuuuuuuuuuuuguuuuuuuguuuuucgagacaggguuucucuguguagcccuggcuguccuggaacucacuuuguagaccaggcuggccucaaacucagaaauccaccugccucugccucccgagugcuaggauuaaaggcauaugccaccaugcccagcuugaauuuacauuuuuguuguuguuuguuuuguuuugauugagacagagugucccuauguagacuaggcuggccuugaacucacagccccaccugccucugccuccugaauuugccaccauacccagcuuaauuuucuuuuaaccauaugaaguaauuuuuuuaaaaaaaucuuucacuuuauacuugagaacacugauagacacaaagguccaguucauuuggccaaaguuauaguuagggauauggcccacauucuguguucuaaccucuuuaauaacccucccaucccaucccaccacuugguccauagcugcuucucaccuuuuucuucucugcauagagaugugcugaacuuccugcguucaggggaccugccccccagggagcaugugcgagcugugcacaaggaggcccaguacuaugccaucgggccccuccuggagcagcuggagaacaugcagccacugaagggcgagaaggugcgccaggccuuccugggacucaugcccuauuacaaaggugaggggccagcugccuuccauccgggggaggggugaugaggcaucauuuaguuccuaggccuuucucagaagugggugaaacagcguucauccauauuaggagaaaauguccccucuuucagugacaaugggacuuuucaaguugagaaagcuaucucccauauacucccacuuucauccuguggggacuuccuugcuuuggcaaaccgugguccuuauugaaguguguccuucuugagucuauggagucccuugugaaaucugccuccuccuccucccucugcauccugucacuggaugugugucccugugucugucugucucacuccucuccuguuccaacucuguccauuaauggcugcuuuguuaaacucuguagaccacuuggagcggauuguggagauugcccggcuucgcgcaguacagcggaaggcccgcuuugccaagcucaaagucugugucuucaaggaagagaugcccaucacccccuaugaguguccgcuccucaacucccuucgcuuugagcggagugagagugauggacagcucuuugagcaccacugugaaguggacgugucuuuugggcccugggaggccguggcugauguauacgaccucuugcacugccuggucacugaccucucagcccagggccucacgguggaccaccaguguaucggggugugugacaagcaccuugucaaccauuacuacugcaaacgccccaucuaugaguucaaaaucacgugguggugaguuguccucagaagcaagaguaccacgaaggaggauguucguccucuugggugacucugggagucugauccccacaggggcugcugacugucccagaagccgcugaguugagaggacagagcgcggaggcacagaugcagagagagaggcccaggcgcuugcugcagucucccuggcucguggcucuuggggacucggucugcucucaccugauuuucucuucaaggccuggcagucuucacuggaagccacaagaucuagcaaggaugucgcugggaguccagagagcuuuugauaccuucuugaugcccugcaggaaagcuccugccugucccugacgcagauagcaucacugccucacauuguuugaaccuucccauguguguccggcgggauaaagagugagcuagggguuucgcccaaacaucugcccuguaucccuggccaaagaagaaagccuguaucucuucccagugugcuccuuggucuuccagugacuugcaguaccuugucuuacgauguagaaagauaugucccauguucccagaacaugccugucaccuucucuuggagauuaaccauagcugccaaagccguguaccauguugggccuuagaaaaaccacauuguuuacagcccugccccggggcuuuggcuucucccuucuuugcaggguuacccuuucacagggcuggaauguuaaguucuaaagguucucucugaagaucccccaagucaggcagacaaggagcccggacccucuugauauguaggaucccucucagaugucaagaacacagggccuugcugcggagucuuauguggggagccagugugguaaaccucucuggaaggggugcucucuuucuuugauaguuuuuauucagggugguggggacuugcucugcagucagggacaggauauaaccuguaaccccuaaagagagagcuguuuagcguuccucugagagcauugcauguccaggcugcacuauggcuucuauguagucauggguguccuugaaugauaauuuuuuuaaugaaacuuuuuuuuaaaaaaauguaaggaauuguuaaggacagcauugccaagcucaguccuguaggaucagaguggugcagucugagggauagaaggccuggggcuucuggcucugagcuaaauuccucugggcagcuggagggcagugacucuccugggcucucguggaaacacgcaauuuugaacaugugucucacucugaguguaacagagaggcugaggucuggcagggauggcagggaugaggggcagucauuauccaggacaccugcucucucuguucuccucagcaaacagccacaucaucugaggugcugaugucccugcuugaagcuuaguccagcacuguggcucuggccuuguuucagcaaagauguuccuuauuucaaccgauuuuuuuuuuaauuuuuaauuuuuauuuuucggacagggucuuauguagcccaggcuggccucauguuagccguagugcuaaggguaaccuuauacucuugcccuuccugcucuaccuccgaggcucugggggacacaggcaugucccgccuccccuagcucuuauguucacugucuggagagcuagugaaguacacuguucaggaugaugcccacguggguagaaagcagacaauuaagcccggggcaguuagccuggggcucucgacuuccugcucuagaauauugcaaugcuuggaaaauuagagcccacaaauauaagacagaaaauuguaucagcucaaaaaccgggcccagacugcuugcugaagguugaaagaugcuggguaaagaugccaucuuugugacuugcuggagauacuguuuuucuguuccccuuuuuauucucaggaugauauaguuuguaccauuguggcaagagagagcucuaggcugcuggagcaggcaggggugggauacaagauagccagcucagcaauccccccccuuuuuuuuagauaguugacuugauauuuaugguauuagggaucaaaccauguacugaaucuucuugugugguuuuguuuuuuuuuuuuuuaaauaacaaaacccuuugcauuuuuaagccagcgacuuguccaccgucuugcagcacagaaacuuuucuuuguacuacaaaauauguuuauuauaauucuaauucucccuugacuaguaaaauagaacuaugaaauaaagcaauauauauugggaucugggaugugguuccaugguagaauaucaaccuagugugcacgaggcgcuggguucccucuucagcaccaccaaaaaccaaguauguccaaguguaucuuugcuacuuggacucucuccucacuagccuucucuucccucuuggaacuucucuuaaauggaauaaaagaauucauagccuguuuuggcucucucacgagaagccaaggccaagucugaaaugcacuguugaaugugguggcugggggugacuucugaauaaaagggucauaucugugggaaguaguuuggccuguuugauccuuuuuccgguugcaauugcccaggcccugaucaaaagacuugugaggaaaagcuucuugacucacaggaaauaccuucucacaaguauguguguguccugucaaucaacaccucuugucuggcuugcgcccacaacccuugaguucaccuccucuuuuccuuugggcaucuuuucuccugggagacacguuugcucacuuguuggggaaaagauuuugauagcagcacaugguguaacauuagccacagcagaacgcaaugcaaaguaaaacauagaguggaaacaggaagacagagggcaagagagcuauccuggaagacagcacaucccagggggaggaauucccuguuacugauguaaguaggggaaccaucaccauccauacccuaccucuguguguucaccuggcuguuguauacccaaccaugaaagccagccaugguggaaccucuuguucucuauugcggcuuaggcuguuugggaacugagugcucagucccaggcugaucgaguucugaguugcuucauggaggacuaacagacccucaggagacagagcaagcgcaggagaugggguauggggaguuuauuggugugugaucccagacugaaaugaaccuuaaauaaaaacuccaccagccgggcagugcuggugcacacccuuaauccca

SEQ ID NO: 2702 - RNA, 26687 nt, Mus musculus
uggcaagccaggaaguagcugccggaaugcuaaccgcugaccuguaaucuccaaaccugucuccuacccacccauugccaucagccagggaaugaguguucacacacaugagcccguguugacauguuauacccccaccccauccccaucucuuuuggcgggcaccaaagacuuccuucccucucugcaccuugcugcuacgugacuagaacucuuagagcacuuuuggagcgucuucuagguagguccacuggagagguaccccaauggucacauucacugcccacacugagcuagaaaaagccagaauguucacugccccaacuccauaguagcuguuagcguuaccucuucagaaagggggcagggguauugaaaaugggcuaagauuugacuaggcaacuuagagcaaaaagauccaaaagaagaguaaccaguuucucucuugacuaaaagccagauucucuuggugguggcagccuucccaggggccagagcugccaaaaguguuuggggacucugaucucugauacuguucuucaguguuucuagaggcauguuguaauuccuuccugggaggaaagguaagcucuaccuaccucuaaggucucaaugacaagccacccacggcacaauuccagcaaaguccaguguugccagugaacuucgugggcuuccuuacaggaaagugcgggguuaguuacaggguguggacacuccucccaucaccagccacaccuggaaagccuuauccaguaaggaugggggcucccauaaccacaaagauguagccccaacacaagaccucauguggggaacugacgagagcucugagugacuguguacaaaaguugaugaugggaauuuggcaaagccuucccuuuagugugaauguggacggugugcaaagauguauacuugugaaggaccgguuaggcucauagcaacugcaucuucauucucccagauguuuauggcugaagacuguuugacuauagacaccugagacuagcuaaagccgccuucuguucuguccacgaugaaggugcugagguucugagucguugcuguaguugagaccacuccaucagagugcccacagcucaccugacuccagcuuuuuuuguacaugcaugugccuuagcuuuucuuccuugccuguuuguuccuagccaagccccagcuacauugaaugcugcccgcucuguucuuccccagugugugcauguguguggauuccugcaugugugcaugcgagcgcauucgugugugccuccugacuccagcuuuucuguacuugugccuauccucuguucauucccucaucguuccugguuaaggucaagugucagcugagcugaaugcuacacccucuguucuucccuggugugaguguaugugugugaguguuuguguguguuagggugggguguaaauuuacaagcccaucuggagugcuauuucccaagggcggggcacagcugaguucuuaaacacagcaaguugcuuggcucugaggacagucauaacagguuagcucuuccgaggaggaaacaacauuacaauaguaggugaggcuuguuaagacaaaacuucuggucuagagaacauaaucuccagccuggguggaccuaacauuccagaugggccuggucaauuaccuggccaaggggccaccccgcagaagucaggcuuaccuuaagccaugcuaaagagagguauggagguaugauuucuuugucuuagggcccuuuuccagagauugauuaagcucacucucuuaaaacagucccagucgcuuaccauaauagcaaauucuguuuauaaaacuuggaaagucuguauaugcugaccagguuuaaaguaaaaaaauguauauuggaauugugaggguuuuauuuuaucccuaucaaagguaguuagcucgcugaaggccaguauuccauacaccaucuugcuuuuuggcugguugguuuuguuuuguguuuuugaggcuguggcuguccugaagcucacuccauagugagaccaggcuagccuugaacucacagagaucucugccugccuuggucccuagagugcugggauuaaaggcaugcaaagcaaaaaguaucaggguauccaaggaaauuguacacacagaugaagguaaaaaaugcaugaugggguggggcucgggguggggacauucuuuuggagaugggggaggaagaacuaucagagggcagacugggacggggaugaccggacuguuaaaaaaaaaaaaaauaagugcauggucgcgcuuggguuaugcuggagauuggauaagggugaaacgugcuuccggccugaagugaaugcaaggucuggauccauaguuccacagguguccauggucaccucccacagcuuucagccagcucugauugggugacuguaccaaccugccuguucaugaaaaggaccuaacccaggacaccacccagagagguuaccagggugcagcagacagagcauuugaguucaagagugugaagaacccccccacuaagugggaauuggacugggguuggcuaucacgugcaagaagucccucccucccuuagguuuugccaacagccuugucugaggaagagacacguucuguaucuucagagcacccugacuccuggcacaggacagaaggaaguagccuguacagcaggcuuuccagcucaaggaagaugcaccaugcuaugccuuaaggcuuuucuguuuauauguuauauagccucuucugcgaaggagacucaugucuaagggcacucugacccucuaaggacagccagaagugaucuuuacaacagacgaccuuguagguaagauggcuuuucuguucccaugcgauuuuuuuuuucuuccuguacuuccucaucuuuguuuucccugauaauaaucaauuaaacaucccauuuucucauaagucgauuuccgucaggguuugaugaccacacagugucuuuguaugcaguugccucuaauaacagcucagcauuggacuuacucugaauccccagggauucucccacgagccaccaugcuuggcuuggcuggguccugacgucugcuccuuuggcuccaccgucucuaagccuguuuuucuuugagauagaauauucugccucccucuuaagacuccuuuuauuccaagcuuguuauuuaccccgucuccagauuuccuugcaaccugggaguuagugacagugacauaaacaggcuaccaaaaaugaacaagaugaugucaucccauucugauuuuuuuuuccucucucuuuuaagccauuuuucuguggucuauauuuaucuuaguuacuguucuguugcuguggagagacaccaggaccaggaaaucucuuauaaaagaaggucuuuaauugggggcuugcuuacaguuucagagggucaguucaugaucaccauggagggaagcagacaggcagggugcugaggcaguagcugagagauuuaccucuugaucuauaggcagcaaguagggagagacgagaagauagugggccuggcagggacuuuugaaaccucaaaaucacucccagugacacagcuccuucaacaaggccacaccuccuaaauccuucccaaacaguuccucuaacuagggaccaagcauucaagcauaugggccgaugggguccauuuucauucaguccacuucaauauuugcuagauuauaagcacuaaauaaaaauaacaagaacuguugucagucagcccuuguaaagaguacagaagacacucugucuaaaaaaaccucucagcagcuucuccagccuccuagguuuaaggccuuccuuaucugaguucugcuugaugucauagacaucgauuugaucacguuuuacuguguauuucugccuuucuaccugcuccuugcacuuauucaaaaccaaaagcauagcagugguagcucauugucuggaaugagagcacacacaugcugugcacacacagacauacacaugcagaugucuucuauacgauuucccuggaacuauuuggcuuugagguucuggaggagacaagcaucagaguuccacuuacacauucuaugggaagccaucauccauucugggugaggacuuuccaguguaguugcuuugaggucacucacccugcuggcaguaaccucuugccuaugcucuguaaguaagccagauacauuuacuggcauuccagggggaacuuugguuugucaccgagaccuuaggaaaaggggauaaacaucgcauagucuuuaccuaaggagaaaauucucacaaauguucucaugucucauggcacaccuuuaaucccagcacuuauggaucuuugaguuugagaccagcuugggucacauagugaguuuuaagucagccagggauggauugaaagaccuuaucucuuuuguuuguugguugguuugguuuuuuuuuuuuuuuucaagacaggcuuuguuuagccccagcuuccuggaacucauucugcagaccaggcuggccucaaaugcaaagaucuaucugccucugacucuugaaugcugggaucaaaggacaaccuucccacugcccagcaaccgugucuuuaaagaacaacaaaaaaagucaagaccagacaaauggauaaguguaacugaucuccuggguuuucaauaaucauguacaaaggucaguauuaaugugguuagaggaauuuaaaaaggauaauauuuugcugcuucuaaggucagcuagguccuuggggacugagacauggcuugaaaugaauuguccuguuguccagaaacgcgacagauucccauccaguggauccuagagucccgucuacagagaggagggugguauuagugugcucaaacaccaugacuaagguaguuggcuccucauugggcuccagagagaacaggaagccagcucuugccauccacgagaccccugugucaaaacaaaaaauuccaacaaaaauaaacgaaaaucguguccucuuuacuaucucacgccauacacaccaagaccugcagaagcacuucgggacggaaccgagcaagcucacggcaguucgcgaaugcgagugauaaauuucaggcagcuccguguaugcuuuucccauuugcaaaacgaagacagucugcuucuccuccuaaccccgaccccacccgccgcucgccccggagcaauucugucccuuccgcgccgccgucgcgcgcgggcggggucagaggucacggcggcguuaguggugacgugguuuucugccuucacccggaaagcccggcguucgcagcgcgcggagccggcgucccguuggcgcgcucuggccuggcuucgggucgucgcuucggccccgaggagccgcucgcugucuccggagcggcggagaggauggugcggggcagcccggggcccgccgcgcgccgccgcgagugaacagggccaggccgcgggcguccgcgggcucgagccgccagucugcggggcggugaguaggagacggggucguaaucgcgggcgcaugggccgggaccggggacccugaacccggggcccacggcgugcugggcggaucggugcgcaggcucucccagccaccccagcuccguucacuccucuauuagcugacccgguccuguuccauccucccgaggccugcggaguccugcucccucagucaaggcuuguauaggucggcugaauaaggcugcguggaccuacuagcauccuuugcaaguuuuagaaaaaaaaaugauuguuuuggaaaauuauuuacaugauguguuuguauuaucuugucugcgcacgugagcgcaaauacccaccgacuccagaagagggcguuguguccuuagacccagaguuacacuccauugguagcugccugaugaugggguugcugagaacuuaacucugguccucaggaauagcagguauucuuaaccccguagccaucuuuccaacuucucugugugugugugugugugugugugugugugugugugugugugugugugacagagagagagagagagagagagagagagagagagugagagugagagagugagugugaguguguguguguguucaguuuuagauuugugacuugacuuuggguugucaaaaauguauccaaaagaggguuuaaugcagccuuaacuggcuaggauuucccuauguagacaagacccaccuucaacaccgaucuucccgauucagacuccguaguucagagauauaggcgugggccacacugccaagguuucacaguguaauaacgguauuguuuugguuuuaaucugaauccuggagucuggggucuccugcagccuuagauaguccaaacccacgacucagucgaggcugaccuugauucucuuagacucccuagugcugccguuggcaggugugcacugccaugccgguuaagcccggcuaaaacauaauuuuuuuuuuuuuuuaaagacagguccacuguguaguucaggcuggccuccaacucucuguguagcuugaaguugugauccuccugccucagccucauauugggguguuguuagcugugugguaccaggcccuguucacagaguagugguagccugguggcaaggcuagucaauacugggacaggggggugauuucuuaccugucccauaguuguauaauacaacaaaucacgggaggauuuccacauacuguaagacacacagcuuuaguucugaugcagagaauccagagcugugaguuuaacauaauggaaauaaccugaagccaugucacaguucuggaacucguauuuucccaggcuucugucguugccuugucugaacauucucaggagcccaugguuuuaaagcuucguguuuccuuuugacccuucuucccucucucaucuagugcucuccucuuuacacacgagcauuagagaaaacugggccugauuugggggugggguggaguggucggggauacagagcacagugcaagggugguggaccuacaggaugguuuuugucaguaugggaagucuguagaauucuaauuaugggccagaccuaguggcacacgccugugaucccagauccuugugagcugccacuggagcugccaccagcccaacccaggugcccuggaagauuaacugagccuucuuucuauccccacagaacuuuaguuagacagcuaaaguguuuauugaagacggugucuccgaugauguaguugguguguucgaggcauguggaauugauuggugggaagcccucuugcugggccugguguugugugauagcacagugaguuaaaugagaguccucugccacuuacaugucugcuuguaucauuguacauuaccuaagcuguaugcugacacggagacugauacccaccuaacagugucggagagauuaaaauaccuaccagggugugcuaagcaguuguuaggguguccacuacauggcauauguuaaguaguuauuuucuccuuagccucguauaaucugguucugccacaauccacaauuaacucuugugaaagagaguguuguuuguuuguuuuaaauuuauuuauuuuaugugucuuaguacacuguccuguugcugucuucagacaccccagaagagggcaucggauccccuuacagaugguugugggccaccauguggcugcuaggaauugaacucaggaccucuggaagagcagucagugcucuuaaccccugagccaucucuccagcccugaaagaguuucuuauauugguugguuuuuuuuuuuuuuugguuuuucgagacaggguuucucuguauagcccuggcgaguuucuuauauuguuacugacaucuuuaauuuucuuuucucugaauuuuuggucaugguauuuaguuuguauauguguaugugcauaccaugguaugcauauggaggucaaaggacacguauuugaagucagcucuuuccuccaucugcuuaugggucccagggagcauauuuauaggccacuaggguugcaagucaaacaccuuuaccccugagugaucucaacaacccuuuuuaauuuuuauuuauuuuaacagauuuauuauuauacaugaguacacuguagcugacuucagaugcacuacaagagggugucaggucucauuaugagugguugugagcuaccaugugguugcagggauuugaacucaggaccuuuggaagagcagucaguguucucuuacccacugagccauuucacuagcccuuguuuuuauauuucacuauuuuaaauauuccuaagucaagcaacucaguaguugagccuuuuuuuuuuuuuagccgugguuaggauuuuagaaauggagucgcagaaaagcacaggugugcuuugugugcuuugugacacuguggagugucacaaagcugacccauguccuuucaagugacuguguucuuagaacuugaggauuguuggagcugccuuuuaccuaaguugucugcaguuuggcuugguucugguggcagugaaguagucuagguagcaacuggugaccugcauucgucuuucuucugugcuugaggagucagaguuugacucucuaucuggugucccuccccucaguccuuggacuucucagacgccauuucccagccuucauuucucacuaccugguuggaaugaacuuugggggaaguggccagccacagcaccugcuucucacucccaacggaaugcaaugcuugcuugcuuauuuguuuguuuuuccagacaggguuucucuguguagcccuggcuauccuggaacuugcucuaggccaggcugagcuugaaaucacagagaucggccucugccuccugaguuuugggagguguguaccacuaccauccagcuugcauuuuuauuuaaaaguaaggcuuacuuuuuuuuuucccaagacaagguuucucuguauagcucugacuguucuggaacucacuuuguagaccaggcuggccucgaacucagaaauucaccugccucugccucccaaguugcugggauuaaaggcgugcgccacuaugcccggcaaggcuuacagaaacuuuuuuuuucuuucuuucuuucuuucuuucuuucuuucuuucuuucuuucucucucucucucucucucucucucucucucucucuuucucucuuucuuucuuucuuucucucuuucuuucuuucuuucuuucuuucuuucuuucuuucuuggcaaggcuuacagaaacuucuuucuuucuuucuuucuuuuuucuuuuuuuuuuuuuuuuuaacuuaaaggcaagucuuacuauguagcccuagcugaccugaaacucuuuguagaccaaacuggccucagacucacagagauuggccuaccuuugccuuucuuguaagugcugggacuaaaguguauaccaucaugccugguucagaaaaccuugcaucucuuggcugauauagccucuaauuuccuauuugaaaaugagugugaaugguagaaaagguagaguuuugguaacuauuuagagucuugauaguuuuguucaaaaugcuuuugugccuggcagggaguugcacccuuguagcaccauaugaucccagcgcuugggagguguaggcaggagagucaguucaaggccuaaacuacauacugucuccugccuaacuauaacuauagcuauagcuauaacuauaacuauaacuguaacuauaacuauagcuauaacuccccauccguaccugguucucaucaucccuuugcuauuagauauuuugagccagagacagguaagaguauuucccuacucuugagugauuugcaguuuggaaagaccagaccacuggaaaguuucagaggcgcagcucuugagcugcccuggguucaguccccagcacuauauagguuggguguggugguacauuccugaaaugccagccuguggaggugguggcaggaggaucugaagcccaaaguccuccuuggcuacauagccaguucuagucccaccugaguuacaaaacaacaaaacuacaaauaaagggcuggagcgaugccucagagguucagagugcaugcugcuuucacaggauuugccuucaggucccaguguccaugcgagcaggcugacaaccaccuauaacuccaccuuuaggggauuugaugcccuuuucuauccuccacagacaccugcacacaugugacauacacguacauaaaaauaaaucuuaaaguaauucucugccaugacguuuaaaagccaauguaaaagggauaauuucuuaaaauaccuguuuucucaaauuugacucaccagaaguaaaaaauagacauacaguuuaaaaucguuaaaguagcuaagauagacuccucaaaauagaaaacaaauacuuggcagacucaaauaguuuucuggccaaaguuaaucaaauuucuaagaaguagaagugcauuuuauuccuggucucacaggccuuaaauccaaguacuugggaggcagaggcugguggauuuuugugaaucuagagccagcuugauauacauaggaaguuucaggccaucuuggcuacacagggaaaucuaguuucaagaauuaaaaaaaaaaaaaaaaaaggaaagaaagauaagcuugucuuauuuaugaauacauagaaaagcugggaguaaaggagcagauauaucaucacaguagcuuuaaaggucucgaucaggagcugggggauagucugugcucucgcccccauacaccaaaccaaaacucuucaguucucagucauaccaaaguuacccaaaccaugcagucaguauggaaaagauuaaucagauuauuuauguuaacagaguaaaagacaaaaauuguuuagauauugcagauaaaguauucauugaaauguaguauuuggcugaauucaauagauacauagcaaaccagagagaccuugaacccaagaaccaagagaaaacagccaggugugguagcauaugucucuaaucccaauacagagacagaggugggaagcucaggguucaaggccagcuuggaauacaggagacucugucccaauccuuucuuucccccauaaaaaaagaaauaacauucuagugaaaaucuuuuguaaacuucuaagaaagaguuaaguacuuccucccucucgagaggucuucuguuguaguuaggguuuccgacgcggugaugaaacacuauucacaaaagcaagaaagguuuauuuggcuuccacuuccagaucauugaaggagcucaaacagggcuggaaacuggaggcagcagcuaauguagaggcccuggaggggugcugcuuacuggcuuguuccucauaguuugcuuucuuacagcaccuaggaccaccaacccagggguggcacugcccagggcccucccacaucaaucauuaagcaggaaaaugcaccacaaguuugcucacuggccaauuuaauggggacaguuuuuuuuucuucauuugagucucccucuucuaaaagaacguagcuugugucaaguugacauaaaaugagccagcacagcuucccaccagaagccuguguugagucccagauuuaauggugaagcauugcaaagcauuuuugugaggcaagaauuuuauuacagcuauugcuauugauguuucauugaaguaggaaaaaggaaaaagauacagggaucccaagaaguacugcuaaugcacuuuuucucaaacaguaugauugucuacauagacauccaagagaggccagacagcuugguuagcaucaacagcagugggagggcccuugauuggcaggucaguagauaaaagucuccuaugagcaugaacuaauaauaauaauguacugugugugacaggcuccuguagcccagccugaucaguauguggccaaggagaaacuugaaugcaugaucuuuuugucugucugucugucugucugucuuucacgugcuggccuuacagaugugugccucccugccugucuuacacagugcugguuaugggacccagggcuuugugugugcugggcaagcacuuaccaagugagcuaacagcuccaccccucccuccacuuucuuuuccuuuuuuaaaaauaauuuuguauuuucuuagaaagacugucuuacauaguuuaggcuggcuuugccuguggcuggggaugaccuucgacuccugaucuuuuccuuccugaagucacaggugggcaccuccauuccuggcucuuucuagucuuccaaaugagcucacugcguggacauuuucucucucagauccggccuuugguccacaguccuccuguaugagacuggacugagcgcugcagcuuagugcagccaggccgccggccaaucccucgcugcauguguugcagguugccgcuggugggaagcauguucaguaucaacccccuggagaaccugaagcuguacaucagcagccggccgcccuuggugguuuuuaugaucagugucagcgccauggccaucgccuuccucacccugggcuacuucuucaagaucaaggagauuaaguccccagaaauggcugaggucaguauauuccuggugucugcuugugucugauggaccuuguagaggagugugugugugugugugugugugugggggggggcagcucuuuuuauaugugaggucucacucuguacugcaggcuauuggcugaccuggaaccugacgugaucuuccugucucagccuccugaaugcugggauuaugcguuguguaucaccacaucuggacuguucuuucugagacaaggucuccugaagcccaagcugcccuugaacuccauauccucuuggcucuguuauucaagggcacacagauagauaugucagaaaaagauacauauguauguaguuuccucuuuuuuccugugacuggcuagggaaugccuaguuguuuuaaguaauacuaucaauuuuaugcagacuauuucaguagagaaacaugcaucugggaggguguauuuauaaaucaaacaaacacugcguaugguggugcacuccugugaucccagaacuggggagacagcggcagaaggagugugaguucaaggcuauccugggccauguaguaagaguauguuccaaaagagucugaagagagcauguucagugggcguggagaaggggaacagugagugagagcaguggguaaaugacacgagugagugucgugguacagugacgaacccgcggccuuacgugcuaaccuaaaauacugaguaagagucuuagauccuagagagaaggaaaggacauuuuuauuuccagugcaguucuuucucuuuauuauacuucugacugguuuguuacuuacuuacuuacauagucucccuaugcaucccugauuguucugauauucaacagaucagcugacuucuggcuucuaagugcugggauuaaauguuugcaccaccauuuuuauuuauguauuuauuuauuuaaauauauaugcauguuuugccugcauaugugucuguguacucaugcaugcaguguccucagaggccagaagguguuggauucccuguaacuggaguuacagacaguugugagcuuuaaggcaugcauguggcacacagccauacauguagacauauacccauauauuaagauaaauauauaaaucuuaaaacaaagcaaaaacaagcuauaaaauaaaugaaaauagugauuuuaaugugucaccacuuuuguucaagauccuuugcccccuuuuuucuucaaugcaggguuucucuguguagcccuggcugugcugaauucacucuguaaaccagacaggccuugauccccuguguguguaccgccucugaccgacugauuuuuuuuuuuuuuuuuuuuuuuuuuuuuuugguuuuuggagacaggguuucucuguguagcccuggcuguccuggaacucacucuguagaccaggcuggccucgaacucagaaauccaccugccucugccucccaagugcagggauuaaaggugugcgacaccacugcccggcuuuuuuaaaauuuuuacugucuauguaugaguguuggccugcauguaaguaugugcaccaugugcccgaggagcacaaaaaggaucucggaugcucugacacuggaguuacagaugcuccaaccuugcuuucccuguaauaguagcaaguguucuuaaccaccgagucaucggacagcccucacggccuuuuuguuuugcuuuuauuuacuuuuauguguauggauguuuugcucccauuuaugucugugcacugugugugggaaguggcagagggugucaggucccuuggaacuagaguuacaguuaguguuagcugccauaugggugcuggcaaucucuggaguagcacucucucuaccaagcucucucuccagccccucaagauuccuuuugaguuugaucuugagccaaguugauuuuucucuuaauuacaauaugcugaauucucaggcacugcagugugugcagauuaccagggcuagcauaauuguaucagaugcuacaggugcugaguggugaugcauugugacuugagacagucaaccucaucucauucuucucgucuugugcuguguagcagaguccagggucagggcucuuucugccuuggagaugcugggacuucauaucuucucuguuuuauuuugcugaaggauuggaauacuuuucugcuccgguuuaaugauuuggacuuguguguaucagaaaacgagacacugaagcaucucuccaacgauaccaccacaccagagagcaccaugaccgucgggcaggccagaucgucuacccagccgccccagucccuggaggagucaggccccaucaauauuucaguggccauuaccuugaccuuggacccucucaagcccuuuggaggguacucucgaaauguuacacaccuguacuccaccauccucgggcaucagauuggauugucaggugugugccagcuacuuuccuuucagaguucugaggcagcagcugagcuagguuccauguucuguucuguguuucugcugugucuccucuugagacuuggacuucaugaagccaagaaggacugguuccugugcaucuucacucagucggucuucagguaucacacacacucucuucauaaaagcuuucagaaucaggacugauggggucagagacacagcucauuguuagagcacugggcuugugugugugaggcccuggcuuccucuguagcacugggagacgccaagugggaggagagagaacuuguuagugcagggucuguuucuggucucaguuuauuugaccuuugaccaacauagguuucacuugcucagguccauuuauacuugaacuuuuuucauuauuaaaugcuuucuuuugcuuguauaugaauguuuugcauggguggaugugcacuguguguuccuggugccugccaacaucagaagagggaguuagagccucuggaucuguaguuacagaugauugugggcugccugccaugugagugcuaagagcugaacccugguccucugcgcgagagccucugcucuuaccugcugagccaucucuccagcucucuauuuggacccgagagaaguuagcauaaaaaguguaagaaugcugccuuaggucauugaggcacugaggccagcuuggcagugggacacagugauaaucccagcgugugggagaguaaaacuguaggaucgugaguuucaggcccugccucaaaaacaaaaacaaaaagggcugguggcgcaugccuuuaaucccagcacuccacagacaggggcagggggaucugugcaaguuugaggccaucugguagucuacauagcaaguucuaggacagcuagggcuacauauuaagaccuugucucaaacaaaacacaaaacaaaaaccagagaauucaaaaagaagaauugaugguggucaugagguagaagcaggagggucauaaguucaggguuaucagcauugaauuugaggccagcacauguuacaaauagaaauaaugaagacaucuuagaagccuaacaucccacacugucuuacuguaauagucuuguagucucuuuuugguugcaguggggucacauaggaaguguccacugaaaacaugcugagucucugugagcaguucaccugucuaaugucaguggcacacagcaggaaggagggauuuugcugcugugucuuuuucccuguuuaugauacagggauagauauguguguuaauugacuguugaaguuguuaguaaggcuuccaaucaacaucaagcuaaauuaaauugguuguuaauuuuaagucuggggagucaagacuuacacucaguuuuuugacugugugggagucagcagucuaucauguuguucaagacacaguguauuuacaaacaugucuaugaauggguguacugugcugggguuuguguguggcugcacaagcgguauaccuguccagagauauguuuguaaauguagguaggauccuaggauuagucuuaggucaccugauagguuauuucuccacuggugaacugagccaacucaagcuggauuagaucauauuaaaggcagguuuauugggaaacggcucucgggugaguucaauggccacaaggacugaggccugaggggucaccaugggaggugaggggaagaagaaaaagggagagaaagcuuauauacacugcaagagagagaagaggagagagaccagaauagauuauauagggaagguagggaaugacagguagggaugagggaugcugggaggaccugaaggccagguaaaauauguauaccucaguuccuugugccaaacuucaucaucaggcucauuuccccugcccugcugagcuaucgugcuggcuauuauuuacuguuguuugugaugcuggacuaugaaccagggccucgugcaugugaaaaaguguucucucaggccugaacuuuuuuuuuuaauuuaaaauuaauuaauuauguucuauguauuguguauugccugcuuguauguauggcuaauguaccauuuauaagccuggugccauggaggccagggagcacagaaucuccuugggccuggaguuacagcugugagcugcuguguggugcuuuaaauugauucuaggguccucuuaacuacugagccaucucuccagucccaggucugcacaguuuuaaauguccacaguuuguuuaguggugugcuaacuucuaggaagaacuagaaaaagccucagaccuaaggccuucagccuugaaauuuggggauuacagaagaggugaaaauaacaggaaucaggcuggggguaacucauugggcaagggcuugccgagcauguguaaugcccuggguuuagggcccaguacuaaaaaaggauaagucaaacaccaaccaaaguccauauacugccuaguuuuaugucagcuuuauacaagcuggagucaucuggcaagaguugagaauauacucccaauauagauuggccuguggguaaaguaaguguguguguguguguguguguguguguguguuugaugauugaugugggaggauaccagcuuauugugggugguguuaugccuggacuggagagccuggguauuauaaaugagccauggagagcaagcaaguaagcagcaccccuccaugacuucugcgucagcuccugucuccagguuccugcccuggcugaggucuugcccugacuucccugagcaauguauaugacuugagagauauaaacaaaccaacccuuuccucccccguugcuuuuggucagaguguuuuaucacaguaguggaacccuuauuaagacagcucauuauugcaaggcuuucaggggucccugcuuaugauuuaauaauaaacacagggagacaucuguauaguuuaaggcugcuggccuguuugcuggggcagucccucuaacucaacccaacuucuuugccaucaugucuuucccuguggcuuucucucugcucuaucucugcccugagccuguccugccuccaucccucucugccucucuccugucuucuuuucuuccgccccagcuucaacugccaguucuuuauuucucaaaugccaugcuucuuucugauacaaagaagcuacuaacauaagugggagauuuuuuucuccccacagcagcuugccuuucuuugggggcaggugaggaaaugacaaacauuuacauauccugccagccuggugcuggcacagcaacuaacaauuaauacagggauauaccuucauagccaguccauaccguauguguggggguggguuauccugaaaauucaucaugaauuaacacuuaccagguacuuaaaaugcuaauuagggucuuguuaaauguaucuguuacauuuauauugcuguguuaaagcaccaugagcaaagcaacucaaaguuuaauggggcuaaugguccuagaggcuugaguuuaugauagcugaugguuuggcaaaggcauggcugcagguggcuggagcagcagcuagcugagagcucacaucuuaacccacaacaggaggguugagcucacugggaauggcagaggcugcucccccucccccagugcuucucuguguagccuuagcuguccuggaucuuguucuguagaccaggcuggccucaaguucagaacucccaagauccaucugccucugcuucccaagggcugagauuaaaggcgugcaugcccaccuccaggacguaccuccuccaacaaggccacacaucauaauccuucaugcaucaaacccuugcaccaacuugggacuaguaaccaaacauuugauccuguggggaccauucucauccaaacuacuacaguaaauaauacaaaagguaaaaagcauggauuauggcugugccugcuuguaugugcuaagccugggcacaguaguucagugguguaggaggacaugagaggaagcugggaaaagccgcaaagccuuuguucauucgaagggcuggcuggaccuuggagcgauaaccuuugguucccaaaagccuuuggguagucaagucuuggagaugcugguaggguccugccuguugccucugacuguuaagaguggacauucgggccgggcagugguggugcacgccuuuaaucccagcacucgggagguagaggcaggaggauuucugaguucgaggccagccuggucuacaaagugaguuccaggacagccagggcuauacagagaaacccugucucgaaaaaccgggaaaaaaaaaaaaaagaguggacauucggugcaaaucacuccugugcauuucaagaagcaaacacgcaagaugcacucuauugucccugcccugagucugguggacugcgucucccugugugugugcagagagaugcuugagacacauccgugggcuaacgguugauucugagggaagugucgcugguacagaaaaugacuccacucagguugcccaacucuguuccuuucuggcucuggcagggcuuccuagccccaacugaaaaguaggagccuucuguggacacuugguggcugugcuagucuggugggccucacagaucaggacagaucagaaaucccauagagcagguaggugugcaggccaguuggugccuguuggguuuggcuucagacuucuuugauugucagcaaacagucuauacauuucugccuguguccaccaauaaacugccaauucuucugcaggcagggaagcccacgaggagaucaacaucaccuucacccugccugcugccuggaacgccgaugacugugcccuccauggccacugugagcaggcgguguucacagcaugcaugacccucacagcugcccccggagucuuccccgucacuguguaagugcccuacacauuuggaggccaagacgauuacuggcaggagucauuucucucucugguuuccaggggcugagcucaggguguugggcuugguggcaagggacuuuaccuucugagccaucugagcugguuucagggauuauuuaauuuaauuugaaguucuaacuucuccuccauaaacagaugugccuguuggggguuguagcucagucgguagaguguuugcuuagcguucaugaaguccugggucccauuucaacacagaauaaacgggacaugagaaguacaccuguagucccaguacuggagguggaggugggggaucaggaggucaaggguacauaggagacccuaucucaacaaaacaaaaccaggccaggcggugguggcgcacgccuuuaaucccagcgcuugggaggcagaggcaggcagauuucugaguuccaggccagccuggucuacagagugaguuccaggacagccagggcuauacagagaaacccugucucggaaaacaaaacaaaacaaaacaaaacaaaacacaacaccaaaaaaaacccccccccacccccccccaaaaaaaaagaagccccgcccccaagccaguguuucagugagccagugaugcuguggcuauucuccaguaaccauuccuacuaaagggaucuuguauuuggaaaggaagagccagguccccugccagagugaccuguaauuaaaggugccuaacgauaaagguccuucucuucgucucugugacccagaaauuauauuuuauuuuauauuuuuuaaauacucauuuuuauuacuuuaaauuguauauauuuguaggggauggauacgugaguacgguuauuuuaguuuuggggagauuuguuuuaagauagucucauguagccuaaguuggucuuaaacacuacacaacagagguuggcuuagaauugcucaucauccugccucauucuccggaguucugagauuauagguguccaaucuaugccuggcuccuuaugugugcauuuaaacaaacaaaccaagaacacuauagaaguuugaugugcuggcucauaccugcacuuguaggcauuugucggccagccuguuauguauugagauccugucucaaagcacagguaauaacaaguaacucucaaacagcgcugucugucccagagggcuguggugauuguucuccucauguggcucugcucaguguugcugggggcuguguggagggacuccaaauaaauguuucaggucaccgagcuggucucuuccucuccccugcagucagccaccucacuguauccccgacacauacagcaacgccacgcucugguacaagaucuucacaacugccagagaugccaacacgaaauaugcucaagacuacaauccuuucugguguuauaagggugccauugggaaagucuaccaugcuuuaaaucccaaacucacuguuguuguuccagauguaagugaaauaagucccuuuugcgugucugugacuguguguguguauguguguguguacauacauccuggaacuguggguguaugaauguuacaucuuggguuagcuuagccuuggcuauucuuuuuuuuuuuuuuuuuuuuuuuuuuaagauuuauuauuauauguaagugcacuguagcugucuucagacccaccagaagagggcgucagaucucauuacagaugguugugagccaccauguguuugcugggauuugaacucaggaccuucggaagagcagucagugcucuuaaccacugggccaucucuccagucccagccuuggcuauucuagguuucuacuugguuuggaagacuagauggcagagcuguggauaucuugguaccuuugugguuuagaaaagccuguuccuuaauuuuuuguuuuuuuccagaacaaaacaaaaguuuguuuuuguguuuguaacccguaagggucucuugaggccuuauaugcagaguaucugcuuaaugucaauguuagcaauagcuaguucucuuuagggcccagaaagggugaguaguucauuagaggcaaaucuuuguuucucuucuucuuaaacaguagcucacuauuauagcucaggcaggccugggaauugggauccucuugcuucagccucuugagugcugugauuauaggcuugugccaccaugccuggucuagaaugaguauuugucuugauacuagggccuacauagccuuuaacuucagaggaaagaggcagcugucacugcagcagucaguggguagucugccacacucaugacguuuguucuugcuuccuuccugaguguaucgcacugguuucuuucuauuuuucccuggacuaucccuuuuucaguuucuguucaguuaaggauguuggcagucagggcgcugccagccuagggcagaaggggaggcugcauggacagaggucagauuccagagcuuucccugcccagccaggguucaccugccuccuccagcagggccugaccgccuugccaggcgguuggaaagcacucaugcacucacuggucuggugcuagagagacggcucagcaguugggagcacuugcucugcaggagaccagagcucaccgacaucaggcaguugccagcaccuguaacuccagcucuagaggaccugaugcaccuuuguggcuuccacaggcaccugcacacacacagcacacacauauacguaaaaguaaagaucuuaagaggagacuggucuggccugguguauauauauauauauuccucagauccuggcacuugggagcugaagcaagaugaguuccaggccagucugugcuacauagugaguucuaggucaagcuguacucaagagugagacucuaaaaugggcccugagcacugggucgagaaacauaaugggagguagacaaggucucuuccaagcccccuugacugugguuacauaugagaucucaggaaugaggcuagccugugccccuuucagccagggacauagugaaaaacagaagggaaaaggaugcugucucuggugggaugugccagcuguccaguggaggagugucucagaggugggcagcagaccaguugcuuugugggaucaagaggacaugucaaagcacagcaggacuuuggcagguggcgugcagcuccccuugcaugcaaguuccaugucuuuacauaaugacaacuaguuugguaguuuuggagauacgcagagagacugccuguucaaacuuaagaguuacuauuggggugcuggagauggagcucagugauugucuagugugugugaggccgugggugcaguucugagcaccacaaaggcauggagcugcuguuggaacaucagugauggagugcaugucuggcuuccuuuguucuucaggacgaccgcucauuaauaaaccugcaucucaugcacaccaguuacuuccuuuucgugauggugauaacgauguucugcuaugcagucaucaaaggcagacccagcaaacugcggcagagcaauccugaauuuugcccugagaaggugaguaguggguggguguggcugccucugccaacaggccuuucucaaaaaaaaaagucucaacuucaugauagcuguucugaauaaucucugauggaguucaugucccucgugccucuuuacccccaguccuuccuucaacacagaagucaugcagcagaggaccuaucagggccaacuaacuaguggcuagggauguggcuugguuaguacagugcuugucuuguaagcaggaggcugugggcucagccugcagcacuugguaaaccacacaugguacaugccuggaaucccagcacuugggaggucaaggcaggagcaucaggaguuuaaagucauccucagcuucauagugaguuugucagccuaggcuaccugaauucuugccucaaaaaaccaaauucaaggucagggaugguggcacacaccuuuaauucuaguucucaggaggcagaggcaaaggaaucaauuaguucaaagccagcaagagcuauauagugagacccugucuccagaaugaaugaaugaaugaaugaacgaaugaaugaaugaaugaauaaaagguuugcuuuccaagcauaguguaagugguuuugcagguuggcaacuguuauagacuuaggcuuuuguucauucuucuccgaggugagguaguuuccuuaaagucuuauuaauucccucacuccccaaagguacuagaugcugauagucagcaugaccucgcaguauuguucucggucccaguggcucccuaguugacucaguugucugcuugcucucuucuagguggcucuggcugacgccuaauccuacagcuccccauuuucugagagaccaagaaccaugaucauugccugcugaaucggccagggccuggccacucugugaauacaugaucuugcaauguuggguuauuccagccaaagacauuucaagugccuguaacugauuuguccauauuuauaaacacugaucuggaaauugguccugugaugcacgugcuuugcccuggaugcaccugaacucgucccccucgucgaggggcaggagggcauggacaugggcuucuucacggagagccagggcguguggggaucuugccagagcugagcugagcagcucguguuccagcgccaguggggccgagguuugcugugguucuuguuucagacuggcgugcugagugcuggaagcuguuugcaccuuugucaggacacugcguuucagaagccacuguucccucugguggcuuuuacaugucgguggcuggcauaccauauaguaacagcaguaauucugucucagugugcuugcaaggaaacuuuucuuauaaagagaaaaaaaaguuacaauuuacuacugcccuaguuaggacagacaugcuugucucuccuagguaaaaggucagguccccgagucauuucuguagugaagagcagaguuccgugucuacacuggcaacuaggaacuggggugcucugcucccguuugcuccugggaggggcguucuccuggcuugagaaguagcuguguagugaaggcacaggguugugugggugacuaacuucacacggcagaagagauguugcucuaaugcucacaaacagggcuugcucuuuuuuuuauuuuuagaggaaauacauuuucuuuuuaauuuuuuuuuuuuugcauucauuucuauacaucacacaucuccaggagaaugcacauuauagguauguaauguggaaccgacacuggggagaucugaaggaagaaggcaugaggcacucucugauggcuugcuagucaaaacuggaaggauuuuccuuaggacaggugugaccuucuggucccucugucccauugcccucucguauuccauuuaaaaaagucauucaugauccuuuccacccgcucucuguauuuucaauguuuuucucucagcgccuugccuuaacaauccccagacaguguucucucaagcaguguuccagacuuguugggugugaagauaaaugcauguaagagcagcccuuuggaggcugaggcaggagaaucucaaguucagggccagccugggccacauacugauacccugucucucaaagggagaaaaauuacuuagguaugucagcacuuuuguccuguaacuguagaucugucucaauugaaguuaacucacuauauucggaaacuuacuggccuagagaauuuuaucccaggcauucuuagauggaaaacaauacuuuuguuuuuucuucuaaauugaagcuuguuaaaauaaucacuguaguuaugugguacacuaguauuucuuaaagcagaggugaguugcggauaagguggauaauaugugacuuuagucuagucuucucugagacuuugagacccuuggcuuggcugguauaagugugucauccggaccaccaaacuucagauuaagcuguuacugagugagacacgagaagaaugguguucgcuggucugucggcuguguuccucuuagucauccuuguguuaaugacaggcaguggcugggaucuguagagggugggaaggaggaccaucacaagaccuagggagaggaaguccccaaaaugcuugggacaugacccauccugaggccagauacauacuuuaaaauucagauauucaccguagcagguagacagauggaggauggcuggggaagggaguugugggcugaaguuuaggggacugcagacacaucugggcccaguccucagcuguuccuugcugguauaccucagaaguggaaugucagagugggcuacuagagaccucugaccccagcagcacuggcuugcccucauaugugggguguagucacgucagugacuuccugggaauugcuuguuucagaucauauugaucucuuuccuuuugucucucaccguaugguaugacuugaaucaguuuugauucuauguguaaguucucaucguuuggaaccugguauuucuguuguguucuuggcagugcauaggaacccagccuccuguguuuugacccuccugcaggcacugugggacucgagggcagcagauccaucucccgucccuugcugcaugauggucacuagcugaucugugauggcgucccuucccccauugauuuucuguguuugaaguaugugcauaugugcuuuacagaauaaaacaucuggauuuacuugguuugccguuuuaauuccagccggauugguguucuuuaaacaaaaaguaggcagggagcacuuccagggcuuugcaggcuguuuuuguuuuuuuuuu

SEQ ID NO: 2703 - RNA, 10040 nt, Mus musculus
ugggguccugaccgaauagaggaaaacugagggacugcagauguugaccagcugccuugccauucugccaccacgccuccuuugcugugaaggccugugaccccucacuugcugagcugcgugugguaaagccucaccuuccuugagaugguuuuccaggcauuucgucacagcaaugaguaaaguaccgaauacaaaacuggagcaaaggggaagcugacuagaaaugcaagccagagcuuaguaaaaauaaguuuuauugauuacauagaauuuuaacuauacuaacauauauuauaaaccuuuaagaauuaguauuaaaugacuguauauauuuucccaagaauaaucuaagucaguuuugguagcauguugguugaaaauuagaaagucaaauucucccuagucauuauaaaucuauugggagggacccaggaacucuucucuccaugcucacaccccauaccugcacuucauuauucagaaacaccccaucuucuuuccagcaggcguacccccuuuguuauucagaccccucuccaaugaucugucauggacuaacucuaccuucuuauccaccaaugcugucucugguccccuggaacuagaaaggcagacgcagcagugagcagcuguucuggacucuguauuuuagguuauuuuucauuuuugcuggaaaccccaauugacaacaaaaauacccagguaccuggguaaauguuuaacacaagauggaaaguggcacgucgcgugagcagggcguuuggcaggucacagaacgagcugcugcugugaggaacaagcguccucggucgugcuccaguugaggagccgggcggugucauucaaacuucucaucgccuuccuccacguccuucagacugagcacuuccagagaaccccugccuuucguuuccuuuuuuauuagcucaucaauuucucugaagcagccugggucgaugaggcacaccugcaaugaguaacacagcugguuuccaagggaagaugggcaucggcacagaauaagcccaguuugaaugcucagggcagaucuaugacuguguucuaggugcugcucacauggaggccagggcagcaggcugggccugggguucugucucgauucuaagcaccuacuguuggacuuugggaaaggcacuuaucccguguuacgguuuguauaugcucagcccggggagugacacuauuagaaggugugucccuguggucauaggcuuuaagacccucauccuaacagccucgaagucaguauucugcuagcagccuucagaugaagaugucgaacucucagccccuccuguaucauucccaccuggauacuaccaugcucccaccuugauaauggacugaaccucugaaccuguaagccagacucaacuaaauguuguucuuuauaagacuugcauugguccuggugucuguucacagcaguaaaagccugauuaagacacccuugaagacucaccuggccagugcugcagcucauacugagagugagcacugcuuagcaucaagacccuggguucagaggcuguagagaugcucagcacuggcugcucuuccagagguucugagcucaauucccagcaaccacaaguggcucacaaccaucuguaaugggauccgaugccuucugcugugucugaagacagccacaguauacucauauauaaaauaauaaaauuaaaaaaagacccuggguucaaucccuagcacuucacuccuuucuaagacauccauauucucccucccccgugggguguguguguguguguguguguguguguguguguggcaaaccaugguccucuccaggaugaaauguagcauuagacuuuuacaggucaccacuaguugugagacagcccagaggcauacugagaagccaugguagguugugacaaguucagguguuuccagugugggcaagcuguuucugucuagaguagucagcucugcaucaaauccguucacugugaaugcuaaaccauguucugguaaaaagagcugcuaacugcuagucucaaauuuacuauggagcugaacuccugauucaccugccucugccuccggaguacugggauggcaggcgugcauaccuggcuccacuuuuauuauuaguuagcccauaagagaagauucaguguaaaauauaucugauuucaaagaaaaugaauauggccaacacaauucugcuaugaaugcuuugacaaagaggcaaauaagaaaaccuugugaaugcuuaacugccccauccuguuuacacauggauacguuagccuagcccacacccucuaaauacuguuccaugguuuaaacaggaaauguccucaacaggcucacauguuccaagucuggcuggaggugcuauccugucacaccugggaacuugaguggccgaggucuccauggagggaguggauucuuagggaccugucuauaagcuacgccugcucuccaguuccccuaucugcucuccuuccuguccugcccaaguacaugaggccaagcgucacgggcugaacccucagacugagccaaaaaaaaaaaaaaaccaaccaaccaaccaaaaaagaaccaaacccaacccccuuacuuccuuucaucugcucucucaaguguuuuggucacagccaugcaaaaguaaugaacacagcacuuaugaucaggaacgaggcuauuuggguagaaggaagccaagaauaauaauguguuaaggucauaaucaugggaccuuggcugcgccaccugcuccccgccaccaucaucuuacgaucuccagcugcuggcuguaguccucacucuccaccaccuucaucaguggcuucagcuucuccuucagcuucuucccuucguucacuggcaggaugaagcgcaaucgcaugugggcccgcucuaucuucaucuucucuuucagcugcuuuaucacuuccaaagccuuuaagacagaacaaggggugcucguuacuuaguuuuugugcugcacaaauuuauauguuagacaugaacaaagcaguuuccacauagcugccuuaugccagcaguuucacagccaagguaccagcaauccuagaaauaccuaaaaaaugagcuagugucucauuuugugaaauggaaaaaaaaauaauuuuugcuucggcagaaagcaacguuaaaggcugggacucaguucaguggugaagcaacuacccagcaugcacgaggaccugggcuguccucagcucucuaaaagcaagaaaaugugugcggugggaauuucguacaucucuagaacagacaaaaugucuuuuuguuggccucggagacuucuaagccaacccuguuuuaagccaugaaccuugaggaccugagcccauagcugaguucacaguaauucuaacaguggugagagcagagacaugcuccuugggaaaauggcccagagcuucccaccagccguccagcaaggcccuucccacucuguggacacccgugccugagaagcugucacuggguagaagacucaguggcuucccugaaagucuaauaacagucauccagagugcugggacgccuagugauacacaguaagguccucacaggccuuugccuuggcaccucugccacugacccgcaggcagcgucagucacuggcagcuggauguggaggagacgggggcugagcuugugcaaucugagguuuauggagaggggaacagugcacagguggucgaugugagcucguuagucccuugaugacucuccugugcuuguucccuguacagagaagccccugguuggguuguggaauggacaugaguaguucugagguugcccagaguucuuguguauggagguucuucucuggcuccuuccaguuuuccaccaggccuuuucuggacguacaugaucaggucuaagucaggccacugccuaagcaguaauaacucaggcaggcuguuaguuauaugggucauacuauacuucgugcugugaaacaccauugcucgcuugcuugcuugcuugcuuucuuucuuucuuccuucuuuuuuuuuuuuuuuuuuuuuuuuugguuuuucgagacaggguuucucuguauagcccuggcuguccuggaacucaggcuggccuccaacucagaaauucgccugccucugccucccgagugcugggauuaaaggugugcaccaccacacccgacuuguuauuucuuuugaguaugcauguuauaugaaaaugcaagaacaugcaugcauguaugucuguacaugacccauauggccaugucuucuucuaugcccucuucuguacucucaagacagggucucucacugaauuuggagcugcucugguaaacagcaguucccagaaagccuccugccucuguccccacaacacugggguuacaggcgcagaagcaagggacccaauuuggcuucguauccagguccuggacauccaaauuuaggucugcguuccuguguagcaagugcucucauguccugagccaucuucccaggccuuuauuuuacagaaucugucaugcagcgcaguucaaguuugucucaaauuuguuauguggugaaggaugcaguuuugccuccacaucccucaagaugaagguaccaguauuucuaacuugaaaagguuauaagcucugugaaagcacuacagagcugaauaaucuaaaaccaaaccaaaccaaaaccaaaacaaccggugacuuuauuuucugagccagggugucagucucgcaagugcuuggaauccaggccagcagaauggcuggcgugacagggcugagcuguaggaaauauguuaauaaacacaaacagcaaaagggcucaggugacucaaaguccaagcuuucucuuuaaagguuugagcugggcaggaaauaagaguucuguaugagccaggugugguggcccacgccuuuaaucccagcacuugggaggcagaggcaggcggauuucugaguucgaggccagccugggcuacagagcgaguuccaggacagccagggcaauacagagaaacccugucucgaaagaccaaaaacaaaacuaaaaaaaaaaaaaaaaaacccccaaacaaacaaacaaacaaaaagaguucuguguguauuuguguuccgucacacugaggagcagcagcuaaggguauggcucagccgggagagggucugcucagaaugaugagcaccagcacagccaggcagccuggaagugugugcugcugaccccagcaccagagauagggaggcaggcgcaucaggcacuuccauggccuuaggucccgaggacaacaaggaacccuuaccuguugcuuugugcucuuguuggguuucacggaguaguggauguccuucauggcucucucgaugaggauaacgguguaaggucucuuuguuucuggguucacacacuugucugccacaaugguggcgauaucccuaaacaucugcuccagcugugugugccguucuuuaucugacacuugaacuucuccuuuagucaaaaucuaaagauggcagaacauagagaaagcccucaucaguucuggguaucucucuacugcacagguagguagcggggaggaagggaggcggcguccacugcagcugcucacgcagaaccacgugcugccuuaacccagcagcagcuuacaaggaguuccgcgaucccacuuacugagggccagggagaaagcccauucagagcagcagugcucagccuauguaugggucaugacaccuuuggggguugcauaucagauauugacauuaugauuccuaacaagaacacaauuacaguugugaaguagcagcaacguaauuuuaugguuggggguggaucaccacaacaugacggaccguguuaaagggcggcaacaauaggaagguuggugauagugugcaccuugcaugcuaaaggcccuguguccaauccucagaacccccaccacagaauccucgccuccccgcagaaaaaacccacaggccgcugugguggcaugcaauucuaaucccagguauugggaggcagagccuagaagaucucuaagguugaggcuggccuggucuacauagcaaauuccagacuaaccagagcuauguagucagaucuuacuuuaaagaaaaaaaaaagaaagaaaaagaaaaaaaugucugggguugagggugggaagcacaaucagguuauuuucuaaaguuugauuuaaaaaaaaaugcagaagaaggacauagugucacccuuugucuccaaaaaacaaaagaacgaacaaacaaaaacaaauauaggaguuugucguauuccagcauggcuaucauacucucugguaagauggagaaccagagccaguuggugauggccaggccuuuaagcuuagcacucggcagaggcaggaagaucacuugagucugagaccagccuggucuacagagugaguucuaggaaaaucagggccacacaagagaaacccugucuugaaaaaccaugauggggaaccaggcaaucaugcagcuccuaaggaugggcuaaaagauggguucaaugucaaggccuuagaaaggaaacugcagccaggcagugauggcgcaagccuuuaaucccagcauuugagaggcagaggcaggcggauuucugaguucgaggccagccuagucuauacagagaaacccugucucaaaaaaccaaaaaagggaaaagaaaggaaacugcaaauuucaaugccccaaguugguggaguauuuaaggucccaccagccuuaaccuaaaacuggcagaaaugcucugggaaccaucgacaguuacagaaaagccacugaaggcuaagagaccccucaaacaggacaaccaacucucacucugaagaagacgguggggcagacugcugaggcagagcacugccccugccucugagcauggcgauccagagaaaggucuuucccaucaguccucuacagugaguuucaauccucagcaucccgaacaaggagugaggacuccuuguaccugcaucuccuuugccuuugaagauguccuucccaccauguggaucuaagucacugcagucuccucuccaccuuggauuuucaauugccaccuguuuuuuuuuuuuuuuuuuuuuuuaaauaauacagguauuuaaacuucaucucucuuuauaguuuauguuuguuucaauaaagaugggagugcauagaaaguagacuuauuaauauugugacugguauuuuucggacuuaaagcagcauuaaaaaaagguccaagguuuguauuaacgugacccuggggggaauggagggaaggcaguguggcaaagggagcuugcugcucuuccugaggaccagaguucaauuccccgcacccagaccacugggccaacaaacacuucuuacuccgaguccaggagauccaauuuuuguuuugugguuauuuucuggucucucaggcaacuugccccaauuugcacauguguauacacauuaaaaaaaaaaaauaaaagggggccgggcgugggcgugguggcgcaugccuuuaaucucagcacuugggaggcagaggcaaguggauuucugaguuugaguccagccuggucuacagagugacuuucaggacagccagggcuacacagagaaacccuuucucgaaaaaaaaaaaaaaaaaaaaaaaaaaaaaaaaguugggcauggugguaugcaccuuuaauuacagaacucagaggcagguggaucgcugugaguucaaggccagcuuggucuacacagugaguuuugggccagcccgagcuacauagugauacacuauguguuggcuccccugcccccauaucuguguauuuucccacuucaucuugggguguguguauggggggaacugaaaccaaaaaaacccacgacacuguuuuauguagggagugaaggcuuacauccuagauagccaaagcaaagauacugcauacuuggguaaaaguggagauuccgaggagggugggugaggguguuugugugaccuguaguacucauuuuaguauuuguaggcuuagcuucccaauuauuauuucagaaacaugaccauaguaaguuucuuuucuuugugauaguaucuggaguaguggauuccgguccuaaucacugcaugcuauuauaauggaugugggugagguggcaugucccuggaggaaucagaaguuccaugccagcauggcuauccccugaguuugaugucagcuugggcuacagagugagauucugucucaaaaaaauagcaacagacaaauaccauacagaccuccccaaauugcccaacaauauaaacuggaggugggagggacccaacaaaugcuaaaacaacaaaaacucaucaagaaaaacaguaaacacagugguccagauguugccuaccaucgugagauuuuguuacauugcaccuggcaggaccuaccugcuugcagauuucagucuggucgucugucccaaaugcacugaugaggucuuccuucuuggcaaccugaccuuuggaaacauuuacaaacacugaaugggucugcagaacuucaucaaggucuuuuucccuugaaagggcaggagagaaaguccuaugugaauccacuggauaguagaaaauccacucacauuuaaacacaagauagcaacaagagaaauggcaagugcugcaagcugggugugaugugcacaucuguaacucaccauuuaggaggcagaggcagggaaauugggaguuugaggccagucucaaaaaaaaaaaaaaaaaaaaccaaacaaaacaaaaaaaaacaaaacaaaaacccuaaagaaaaaaaaaaagagaaaucucacacacacacacaccacacucucucucugguggcuaccugcgaaggacaguaucuggauucucccacuucaccacagagggaaaaacuacaucauuguuuuauguaaggaaacucagggugugguggggagugguguuucuucuguccuggaauaucugucccuagauggcaguagcgaagacacuacuacgcacuuugggaaacuggggauucugaggugugacguuuuaauuucaggauuuguagguguaagauuagcuucccgauuguuaucccuggaaaaugaccauaauguuucucuucuuggagauagcauuuggaauguuggauuccugucuuuuuuuguuuugguuugguuuuuuuucgagacaggguuucucuuuguaguccugucuguccuggaacucacucgguagaccaggcuggcccugaacucagaaauccgccugccucugccucccaagugcugggauuaaagaugugcgccaccaccgcccggccggauuuaaacauuuaauccaagaggcuacugcaauuucggguccucuugaccgcagcuuuguuuuauuaguacagggucggucacggucucucucacacacacauacacauacacacacacacacguuccaggcuggccuggaaaucgcagcaauccuccugccucaguuuccugggcgcugggauuacaggccuaaaccaucggucccacccggcucugauggcguuuguaguuggcaguuuuuaugauacuaacaaaaucccaaagcagaacccaauccgaaucggguaaaccaggccugaaagguaccgaugggucgcaggagccgggguuagggaggccaggccgccgaacucugggcacaggauuacucacacgccacuccgccagccgacgaccuuguuuuuauagcaggcgauuucgaagcgcuucccuccccgcuucauccgcaccacggccacauuggucagucggaucugguuggugggggugaagaucgacaugguggcuguucacagaucucgagcucgaggggacgccaagugcucggcugaaacgacccugcggcgcgcgaacccuuaacgcccaaggagugcgcggcucuuccggaaccuaccagggaagaagcuaccgcacgcccgauugcccuacugcacaugcgucaaguggcgcacuagccaggcagccgauaagaaag

SEQ ID NO: 2704 - RNA, 10040 nt, Mus musculus
cuuucuuaucggcugccuggcuagugcgccacuugacgcaugugcaguagggcaaucgggcgugcgguagcuucuucccugguagguuccggaagagccgcgcacuccuugggcguuaaggguucgcgcgccgcagggucguuucagccgagcacuuggcguccccucgagcucgagaucugugaacagccaccaugucgaucuucacccccaccaaccagauccgacugaccaauguggccguggugcggaugaagcggggagggaagcgcuucgaaaucgccugcuauaaaaacaaggucgucggcuggcggaguggcgugugaguaauccugugcccagaguucggcggccuggccucccuaaccccggcuccugcgacccaucgguaccuuucaggccugguuuacccgauucggauuggguucugcuuugggauuuuguuaguaucauaaaaacugccaacuacaaacgccaucagagccgggugggaccgaugguuuaggccuguaaucccagcgcccaggaaacugaggcaggaggauugcugcgauuuccaggccagccuggaacguguguguguguguauguguaugugugugugagagagaccgugaccgacccuguacuaauaaaacaaagcugcggucaagaggacccgaaauugcaguagccucuuggauuaaauguuuaaauccggccgggcggugguggcgcacaucuuuaaucccagcacuugggaggcagaggcaggcggauuucugaguucagggccagccuggucuaccgagugaguuccaggacagacaggacuacaaagagaaacccugucucgaaaaaaaaccaaaccaaaacaaaaaaagacaggaauccaacauuccaaaugcuaucuccaagaagagaaacauuauggucauuuuccagggauaacaaucgggaagcuaaucuuacaccuacaaauccugaaauuaaaacgucacaccucagaauccccaguuucccaaagugcguaguagugucuucgcuacugccaucuagggacagauauuccaggacagaagaaacaccacuccccaccacacccugaguuuccuuacauaaaacaaugauguaguuuuucccucuguggugaagugggagaauccagauacuguccuucgcagguagccaccagagagagaguguggugugugugugugugagauuucucuuuuuuuuuuucuuuaggguuuuuguuuuguuuuuuuuuguuuuguuugguuuuuuuuuuuuuuuuuuuugagacuggccucaaacucccaauuucccugccucugccuccuaaauggugaguuacagaugugcacaucacacccagcuugcagcacuugccauuucucuuguugcuaucuuguguuuaaaugugaguggauuuucuacuauccaguggauucacauaggacuuucucuccugcccuuucaagggaaaaagaccuugaugaaguucugcagacccauucaguguuuguaaauguuuccaaaggucagguugccaagaaggaagaccucaucagugcauuugggacagacgaccagacugaaaucugcaagcagguagguccugccaggugcaauguaacaaaaucucacgaugguaggcaacaucuggaccacuguguuuacuguuuuucuugaugaguuuuuguuguuuuagcauuuguugggucccucccaccuccaguuuauauuguugggcaauuuggggaggucuguaugguauuugucuguugcuauuuuuuugagacagaaucucacucuguagcccaagcugacaucaaacucaggggauagccaugcuggcauggaacuucugauuccuccagggacaugccaccucacccacauccauuauaauagcaugcagugauuaggaccggaauccacuacuccagauacuaucacaaagaaaagaaacuuacuauggucauguuucugaaauaauaauugggaagcuaagccuacaaauacuaaaaugaguacuacaggucacacaaacacccucacccacccuccucggaaucuccacuuuuacccaaguaugcaguaucuuugcuuuggcuaucuaggauguaagccuucacucccuacauaaaacagugucguggguuuuuuugguuucaguuccccccauacacacaccccaagaugaagugggaaaauacacagauaugggggcaggggagccaacacauaguguaucacuauguagcucgggcuggcccaaaacucacuguguagaccaagcuggccuugaacucacagcgauccaccugccucugaguucuguaauuaaaggugcauaccaccaugcccaacuuuuuuuuuuuuuuuuuuuuuuuuuuuuuuuucgagaaaggguuucucuguguagcccuggcuguccugaaagucacucuguagaccaggcuggacucaaacucagaaauccacuugccucugccucccaagugcugagauuaaaggcaugcgccaccacgcccacgcccggcccccuuuuauuuuuuuuuuuuaauguguauacacaugugcaaauuggggcaaguugccugagagaccagaaaauaaccacaaaacaaaaauuggaucuccuggacucggaguaagaaguguuuguuggcccaguggucugggugcggggaauugaacucugguccucaggaagagcagcaagcucccuuugccacacugccuucccuccauuccccccagggucacguuaauacaaaccuuggaccuuuuuuuaaugcugcuuuaaguccgaaaaauaccagucacaauauuaauaagucuacuuucuaugcacucccaucuuuauugaaacaaacauaaacuauaaagagagaugaaguuuaaauaccuguauuauuuaaaaaaaaaaaaaaaaaaaaaaacagguggcaauugaaaauccaagguggagaggagacugcagugacuuagauccacauggugggaaggacaucuucaaaggcaaaggagaugcagguacaaggaguccucacuccuuguucgggaugcugaggauugaaacucacuguagaggacugaugggaaagaccuuucucuggaucgccaugcucagaggcaggggcagugcucugccucagcagucugccccaccgucuucuucagagugagaguugguuguccuguuugaggggucucuuagccuucaguggcuuuucuguaacugucgaugguucccagagcauuucugccaguuuuagguuaaggcuggugggaccuuaaauacuccaccaacuuggggcauugaaauuugcaguuuccuuucuuuucccuuuuuugguuuuuugagacaggguuucucuguauagacuaggcuggccucgaacucagaaauccgccugccucugccucucaaaugcugggauuaaaggcuugcgccaucacugccuggcugcaguuuccuuucuaaggccuugacauugaacccaucuuuuagcccauccuuaggagcugcaugauugccugguuccccaucaugguuuuucaagacaggguuucucuuguguggcccugauuuuccuagaacucacucuguagaccaggcuggucucagacucaagugaucuuccugccucugccgagugcuaagcuuaaaggccuggccaucaccaacuggcucugguucuccaucuuaccagagaguaugauagccaugcuggaauacgacaaacuccuauauuuguuuuuguuuguucguucuuuuguuuuuuggagacaaagggugacacuauguccuucuucugcauuuuuuuuuaaaucaaacuuuagaaaauaaccugauugugcuucccacccucaaccccagacauuuuuuucuuuuucuuucuuuuuuuuuucuuuaaaguaagaucugacuacauagcucugguuagucuggaauuugcuauguagaccaggccagccucaaccuuagagaucuucuaggcucugccucccaauaccugggauuagaauugcaugccaccacagcggccuguggguuuuuucugcggggaggcgaggauucugugguggggguucugaggauuggacacagggccuuuagcaugcaaggugcacacuaucaccaaccuuccuauuguugccgcccuuuaacacgguccgucauguuguggugauccacccccaaccauaaaauuacguugcugcuacuucacaacuguaauuguguucuuguuaggaaucauaaugucaauaucugauaugcaacccccaaaggugucaugacccauacauaggcugagcacugcugcucugaaugggcuuucucccuggcccucaguaagugggaucgcggaacuccuuguaagcugcugcuggguuaaggcagcacgugguucugcgugagcagcugcaguggacgccgccucccuuccuccccgcuaccuaccugugcaguagagagauacccagaacugaugagggcuuucucuauguucugccaucuuuagauuuugacuaaaggagaaguucaagugucagauaaagaacggcacacacagcuggagcagauguuuagggauaucgccaccauuguggcagacaagugugugaacccagaaacaaagagaccuuacaccguuauccucaucgagagagccaugaaggacauccacuacuccgugaaacccaacaagagcacaaagcaacagguaaggguuccuuguuguccucgggaccuaaggccauggaagugccugaugcgccugccucccuaucucuggugcuggggucagcagcacacacuuccaggcugccuggcugugcuggugcucaucauucugagcagacccucucccggcugagccauacccuuagcugcugcuccucagugugacggaacacaaauacacacagaacucuuuuuguuuguuuguuuguuuggggguuuuuuuuuuuuuuuuuuaguuuuguuuuuggucuuucgagacaggguuucucuguauugcccuggcuguccuggaacucgcucuguagcccaggcuggccucgaacucagaaauccgccugccucugccucccaagugcugggauuaaaggcgugggccaccacaccuggcucauacagaacucuuauuuccugcccagcucaaaccuuuaaagagaaagcuuggacuuugagucaccugagcccuuuugcuguuuguguuuauuaacauauuuccuacagcucagcccugucacgccagccauucugcuggccuggauuccaagcacuugcgagacugacacccuggcucagaaaauaaagucaccgguuguuuugguuuugguuugguuugguuuuagauuauucagcucuguagugcuuucacagagcuuauaaccuuuucaaguuagaaauacugguaccuucaucuugagggauguggaggcaaaacugcauccuucaccacauaacaaauuugagacaaacuugaacugcgcugcaugacagauucuguaaaauaaaggccugggaagauggcucaggacaugagagcacuugcuacacaggaacgcagaccuaaauuuggauguccaggaccuggauacgaagccaaauugggucccuugcuucugcgccuguaaccccaguguuguggggacagaggcaggaggcuuucugggaacugcuguuuaccagagcagcuccaaauucagugagagacccugucuugagaguacagaagagggcauagaagaagacauggccauaugggucauguacagacauacaugcaugcauguucuugcauuuucauauaacaugcauacucaaaagaaauaacaagucgggugugguggugcacaccuuuaaucccagcacucgggaggcagaggcaggcgaauuucugaguuggaggccagccugaguuccaggacagccagggcuauacagagaaacccugucucgaaaaaccaaaaaaaaaaaaaaaaaaaaaaaaagaaggaagaaagaaagaaagcaagcaagcaagcaagcgagcaaugguguuucacagcacgaaguauaguaugacccauauaacuaacagccugccugaguuauuacugcuuaggcaguggccugacuuagaccugaucauguacguccagaaaaggccugguggaaaacuggaaggagccagagaagaaccuccauacacaagaacucugggcaaccucagaacuacucauguccauuccacaacccaaccaggggcuucucuguacagggaacaagcacaggagagucaucaagggacuaacgagcucacaucgaccaccugugcacuguuccccucuccauaaaccucagauugcacaagcucagcccccgucuccuccacauccagcugccagugacugacgcugccugcgggucaguggcagaggugccaaggcaaaggccugugaggaccuuacuguguaucacuaggcgucccagcacucuggaugacuguuauuagacuuucagggaagccacugagucuucuacccagugacagcuucucaggcacggguguccacagagugggaagggccuugcuggacggcuggugggaagcucugggccauuuucccaaggagcaugucucugcucucaccacuguuagaauuacugugaacucagcuaugggcucagguccucaagguucauggcuuaaaacaggguuggcuuagaagucuccgaggccaacaaaaagacauuuugucuguucuagagauguacgaaauucccaccgcacacauuuucuugcuuuuagagagcugaggacagcccagguccucgugcaugcuggguaguugcuucaccacugaacugagucccagccuuuaacguugcuuucugccgaagcaaaaauuauuuuuuuuuccauuucacaaaaugagacacuagcucauuuuuuagguauuucuaggauugcugguaccuuggcugugaaacugcuggcauaaggcagcuauguggaaacugcuuuguucaugucuaacauauaaauuugugcagcacaaaaacuaaguaacgagcaccccuuguucugucuuaaaggcuuuggaagugauaaagcagcugaaagagaagaugaagauagagcgggcccacaugcgauugcgcuucauccugccagugaacgaagggaagaagcugaaggagaagcugaagccacugaugaaggugguggagagugaggacuacagccagcagcuggagaucguaagaugaugguggcggggagcagguggcgcagccaaggucccaugauuaugaccuuaacacauuauuauucuuggcuuccuucuacccaaauagccucguuccugaucauaagugcuguguucauuacuuuugcauggcugugaccaaaacacuugagagagcagaugaaaggaaguaaggggguuggguuugguucuuuuuugguugguugguugguuuuuuuuuuuuuuuggcucagucugaggguucagcccgugacgcuuggccucauguacuugggcaggacaggaaggagagcagauaggggaacuggagagcaggcguagcuuauagacaggucccuaagaauccacucccuccauggagaccucggccacucaaguucccaggugugacaggauagcaccuccagccagacuuggaacaugugagccuguugaggacauuuccuguuuaaaccauggaacaguauuuagagggugugggcuaggcuaacguauccauguguaaacaggauggggcaguuaagcauucacaagguuuucuuauuugccucuuugucaaagcauucauagcagaauuguguuggccauauucauuuucuuugaaaucagauauauuuuacacugaaucuucucuuaugggcuaacuaauaauaaaaguggagccagguaugcacgccugccaucccaguacuccggaggcagaggcaggugaaucaggaguucagcuccauaguaaauuugagacuagcaguuagcagcucuuuuuaccagaacaugguuuagcauucacagugaacggauuugaugcagagcugacuacucuagacagaaacagcuugcccacacuggaaacaccugaacuugucacaaccuaccauggcuucucaguaugccucugggcugucucacaacuaguggugaccuguaaaagucuaaugcuacauuucauccuggagaggaccaugguuugccacacacacacacacacacacacacacacacacaccccacgggggagggagaauauggaugucuuagaaaggagugaagugcuagggauugaacccagggucuuuuuuuaauuuuauuauuuuauauaugaguauacuguggcugucuucagacacagcagaaggcaucggaucccauuacagaugguugugagccacuugugguugcugggaauugagcucagaaccucuggaagagcagccagugcugagcaucucuacagccucugaacccagggucuugaugcuaagcagugcucacucucaguaugagcugcagcacuggccaggugagucuucaagggugucuuaaucaggcuuuuacugcugugaacagacaccaggaccaaugcaagucuuauaaagaacaacauuuaguugagucuggcuuacagguucagagguucaguccauuaucaaggugggagcaugguaguauccaggugggaaugauacaggaggggcugagaguucgacaucuucaucugaaggcugcuagcagaauacugacuucgaggcuguuaggaugagggucuuaaagccuaugaccacagggacacaccuucuaauagugucacuccccgggcugagcauauacaaaccguaacacgggauaagugccuuucccaaaguccaacaguaggugcuuagaaucgagacagaaccccaggcccagccugcugcccuggccuccaugugagcagcaccuagaacacagucauagaucugcccugagcauucaaacugggcuuauucugugccgaugcccaucuucccuuggaaaccagcuguguuacucauugcaggugugccucaucgacccaggcugcuucagagaaauugaugagcuaauaaaaaaggaaacgaaaggcagggguucucuggaagugcucagucugaaggacguggaggaaggcgaugagaaguuugaaugacaccgcccggcuccucaacuggagcacgaccgaggacgcuuguuccucacagcagcagcucguucugugaccugccaaacgcccugcucacgcgacgugccacuuuccaucuuguguuaaacauuuacccagguaccuggguauuuuuguugucaauugggguuuccagcaaaaaugaaaaauaaccuaaaauacagaguccagaacagcugcucacugcugcgucugccuuucuaguuccaggggaccagagacagcauugguggauaagaagguagaguuaguccaugacagaucauuggagaggggucugaauaacaaaggggguacgccugcuggaaagaagaugggguguuucugaauaaugaagugcagguauggggugugagcauggagagaagaguuccugggucccucccaauagauuuauaaugacuagggagaauuugacuuucuaauuuucaaccaacaugcuaccaaaacugacuuagauuauucuugggaaaauauauacagucauuuaauacuaauucuuaaagguuuauaauauauguuaguauaguuaaaauucuauguaaucaauaaaacuuauuuuuacuaagcucuggcuugcauuucuagucagcuuccccuuugcuccaguuuuguauucgguacuuuacucauugcugugacgaaaugccuggaaaaccaucucaaggaaggugaggcuuuaccacacgcagcucagcaagugaggggucacaggccuucacagcaaaggaggcgugguggcagaauggcaaggcagcuggucaacaucugcagucccucaguuuuccucuauucggucaggacccca

SEQ ID NO: 2705 - RNA, 419 nt, Mus musculus
aggccagcagggaugguuuggggacaguuaugggaauggaugaagccaauuugguugguggagcagcucaacccccuuuuccuuucccuuccauuuuauuuuauuuauuucuuuuccauuuucagggcuggagagcacagugguuaagaacccaugcccuucugcucagauucggcuuugagcacccauguggggugacucacaaccaucuauaaacccugcucuaggggggaucugacaucuccaacaucuguagaaacuauacugauguguagacauucacaugcaugugcacacacauacacagaaauuuaaaaguaauauaaaucuuauuuuuaaauuuucaugcauaugugguaugcauguauguguagguugguucuguguaauauguuuacauguguguggaggcuucaggu

SEQ ID NO: 2706 - RNA, 3502 nt, Mus musculus
agaaaagggaagaguuuauuucugcuuauaauuccaggucacggucuguuaaugcaggaaggcaagucaggaaacugaagguaggccuucuugcugauucguucagcauugucacugaccaagcaccaaggaacucacuucacagagagaaaguugagcaggagucauggaggaugcuguuuucuggcucacuugccagcguaugauuggugauucaaaaccacuuaacuagucaguggugccacccacagugggaugugcccuuucauaucaaauaccagucaagauaacccccuacaaucaugcccaucugauguagacauuuccuuaauugaagcucuccucucagauccucuaggcugggccaaguugacaauuaaagcuaacgaagacagacauuuuguauaucaagugaaggcaucugaagaauccaugguuguaguuuccugagaauuuacagaaacaaaagcagagaagugagaugucaaggugcaacccugcaccucauaguauguagacuagagagaaccagauaggggaaggaaagggugaaaugucgcuucgggauguuuagcuaugacagugcuagauucagaaccacaaggacuuauagcaguaacaucuuaaagacaguaauugugggguggagagguggcucagagguugggaacaccuguucuguaggaccggaauucaguuuccaacacccaugagggguagcucacaccugccuguaauuccaguuccaaggaaucuacagcccucuucuggucugugcaggcacugcccucacauccacauaguaaaaagaaaaacaaaacaaacaaacaaauaaacaaacaaaacaaacacgugucacagagaaaauggggcguuaaacucucauauguugacugaauugcgauggagaaaagauuuucauaaugccccacuucucccaucuguguaugaaguguugggagucuugaguucccccguagcacucuggguauugacugcaugaauuaaggaagagcgauuuuggugaugggaaggcuucuugucuauaggagguagaagaagacccagcaacgacagaaggaugcaaacggcucugccagaaaguguucagaggcgagacacagccuccauucucauuaaagcauuauacugcuacuuuaggcacugacuacacauuuguuuuauguguggcuauguuguaccuauugaggcuguguuggugcugcugggaccagagugggcguuuuauacaccgugucuucucaagcaagauggaaagggcuuauaaaagcuguuuccaaggaguaaacggauguuuuaaaaauuuaugaaacaaguguccacuuaggauuucauuugaguuuuacaaaacacuccugcuugagucuugccgugucagcacaagauucugggauugaaauaaauaaaaccuggaagaauauaauaaugcuuucuuuuuaagucuuuaaaugaugcaucaaguugccggggaagggagugucaaggccuaagugaucccuuccuacugucuauuaaauggagaaaagaaagguuuaauuauuaagaauucaucuuuugaauaaacagaaggaucugggagguaagggggucugggaggugcauccacaaaagcuaaugaccagcucuucucuuuuaaugaaacggagauugaggaggaggccaacacaagcauuaccagccucccacccccucuucuucugugggaguuucccaccccuauaaaguuggugagaauuaaagauaaauaaauaucugagcuugaauguacugucaagagaugagaaaugggagguuaggcagccccauggacauuauaggggucuucuguuguguuugcuuuggugaagauaaaauaggaugucugcugaggucugucuguguguggaggagagaaaaccuggggugugugugugugugugugugugugugugugugugugugugugugugccugucugugugucugugucugucuguggaggagagaaaaccuggugugugugucugucugucucucuguguaugugucugucugucugugucucuguguguguuuccugucugucugucugucugucugucuaucugugugugugugugugugugugugugugugugugucucugugugucugugugucugugugugucugugucuguagagacauacauguacaucagggugcuuguauguggaugcccaguggucaauguuggguuucuuuuuccaucacucucugccuuuuuuuaaaagacaggaucucucacugaaccugaagcucacuaauucagcuaaucuagcuagccauggggcuccaggaaucuaccugucccucccuucccagggcugaacuuacgaagaccccugugcuuuucauguggauuuuggaaucuaaagugagguauuugugcuugcacagcaaaacacuuuacuggcugagcuaucucccccuacacaguguauauuuuagcuuauauuuacucuuuuuaguuucuuucaaaccccagacucucaacaccugaggaccaaaugaaugaaaugaacuugagggugguuuuggaagcaaguucccagcugacugugaaauguuacacuguggugcccuuacagguccacucuuucagucugaggagaggacuuuuguacacuuaccuuguagagcugguaucugacggggaaagcuagagaaaagugaauaaaugcauuuuuaaaacuuagaucuuacucagcccaucuaccaaauuagcugaaccuggcucauuaagacuugcuuagccaugagucuuaucucuguccaggagcaccuuccucacauauuaaccuuucauccuuuaugucgggagagugaucuguuucucuuuauuguuuuuacuaucuacuuguaaucaagcagaaacucugcccuggguaucuguguucaguugauucaaaucacccauuaaacugccccccagaauccaugacgguagaaaagaauagugucccccauuuauguguggacacaugcacgugucauucauaugcagugaacauuucuacauacaacuauagagaccaaggaucaauuuuggcugucauugcucaagcacuauccagccucguuuuuagacgaguucucucacuugcauggaacucacugaauagccuagacucguggauggcuagggauccuccagcccugcuccaucucucccagcagagagcacacaccacaccugauuuuuuuuuuuuuuauauguggguucuggagaucagacucagguccuugugcuaaugcaccaagcacauuaacuucuuaaccaucuuccuagcucccaaagaacauucuucacucaguacccgcucaagcuuggugucuuuacaauccugucuaaaaggaggaaagguuuuaaaaaccggagagugcuggcacagagaaccaaaauacuugcugugcaaaccugaagacuuuaguucaguugcugaaacccacauaguugaga

SEQ ID NO: 2707 - RNA, 571 nt, Mus musculus
auucuuuuuuuuuuuuuuuuucuccauuuuuuuuuuuuuuuuuuuuuuuuuuuuuuuuuuuuggaggccuaauggaagucaguggacucuuuauugcuucgggcguguggggcucaggagcucuugguggggcggguccguuuccucuucaccaccacaggcuucuggcuucgaaggauggcacuggcccugcggauggccgccauacgcagaucagggcgguacuuguucuuucggaucaugugucugaugcagcugaggguagcccgagcauucuuguugauggugguccucacauaagaaguggcagguuuucgcugaccggaucugcguuucauaacuaccacgaccccuuugccaucggcggccggcuccacuccgacggucuugcggugaauuagcccguuguagcggaaggaguuucgggcuuucagauuauuuggcuccgugcuguacgucugcuuauuccucuugaucaagaaacuggagcaguuccggacgaccauccacugcagaugcgcggacauggcggcggcuccucucccuauggcggccggagacggaaagagcu

SEQ ID NO: 2708 - RNA, 1366 nt, Mus musculus
gacaaacaaaacaaaauacuguuuacucuuccagaggaccagaguucuaauucuagcauucacaugggggugugugggagugggguaucaacuguaacugcaguucuagagaaucuaacacccucuucugaggccuccacagacacuauacacgcaggguacacagauauacaugcagguaaaguacccauaugcaugaaauaaaaccgccuaaaauaaacuaaaucaaccaaucagugcuggguaugguggcacacaccauucaggaggcaggggcagguuugaguuauccuggucuacaggaacaaagcaaguuccaggccaguuagggcuaaauaaugagauucugucacaaacaaacaaacaaacaaaccauauauauuaauagguuuucuuucuucuagggugguuugcaauuugcagcaauauuccugccucagccuaaaguugggguuacaggugugaaccacugugcccagcuaccuuccccaguuuugcuuccaugagauaagcaucuaggauguucccucugucuccuuucaguauuuauacaaaacacuucuuggaauugggagaguagucuguguuaaccuauacccuaaggaugugugaggaccuggguucaauucccagcuccaccuaaguaacuccacaccaaaacuaacacacacacacacacacacacacacacacacacacacacagaauuuaaaaaggggcaguaagaaucauagaacacuucacagacaucuucaaauaauagcuugacacucauuuaaguccccuacucauggauagacggugaagccauagccuucucaagucuuugcuuuccuggaguaguaaucaucugccaauaguaaacaugguugucuuucccuuagcgcgucgccuucagccaguaguaagcauggccguaucuacuuccgccaggcuagaggucaagggugacacaagauggcggcgcccauaagcgguugaggcgugacgcggaggauguuggcggcggcccgggcucugcgggggccgcggccgagguggccgacaccggcucgcgagcacuggacaccggccggccguucgcggagccggcgagaagcggccgaggccgaggcggacguuccgguguuucaguacgugggcgagcgcgcggcucgcgccgaucgcgucuucgucuggggcuucagcuucuccggggcgcucggggugcccagcuucguggugccguccucggggccuggaccgcgcgccggccugcggccccgacgcaggauccagccgguccccuaccgccuggagcuggaucauaaggugggggcaguggcauccucgcuggcaucucuuagggaacuuucuuccccgcgug

SEQ ID NO: 2709 - RNA, 1425 nt, Mus musculus
uaggcgauucuggagguuuuuagcugugggaagagugucccccuccuccuggucuccugcuucuuacucuuucuggauaggauuuguugagaaauuuuugccccacucuugugggugacuugggucacccucccggucucaguuuuuuuucuuucuuucucuuucuuccuuuccuuccuuccuuucuuccuuccucuuucuucuuccuuccuuccuucuuuccuuccuuccuuccuuccucccucccucccccucuuucuuucuuuuuuuucuuuauaucucguucccccguuuguguuguguguggaaauggcgaacucggcaaacacaaacaccgcgccuaaauuguauagaucugugauugaagauguuauuaaugauguucgagacauuuuucuggaugauggaguggaggaacaguuccugauggaacuaaaaucacugugggagaauaaacuaaugcagucuagggcaguagacggauuucauuuggaagaagagcagcuuuuguugcaaguucagcagcagcaucuccaccaccaucagcgagcccagcaucagcaucagcaucgcaucuccaccaccaucagccagcacagcaucagcaagcacggaaccaaaagauucuuauuccugcaucacagcaagcuauggcaccacaaguuaauguuuccgauucuaaguugauacaacauaugaaugcaucaaguauucccagugcuguugcuacaguugcuaccuuggcacuuccugcaggcuuaccuccuguucaacagauacuaaccaauucaggccagcugcuucagguggucagagcagccaauggugcccagucuaucuuucagccucagcagucaguuguucuacaacaaguuauaccacaaaugcagccugguggaguccaaguaccuguuauccagcagguccuagccccacuuccuggagggaugucacuacagaugcgugucaucauucaaacacagcaaaucuuauuuacaggaaauaagacccaggucaguccuaccaacaguggcagcacccgccccggcacaagcuggacagcagcagccacaggcccagccugcccaacagcaagcuccguuggugcugcaaguugauggaacagggcauacaucuccugaggaagaugaagaugaagaagacuaugaugaggaggaggaagaaaauaaagagaaagauggagcugaagaugggcagguggaagaagagccccucaagagugaagaugauguaaaugaugaggaagggcaggaacucuuugacacagacaauguugcugcaugccaguucuauaagauacacagaaguaaaaauaaauggaaauuuccucucaaggauggcauuaugaaucuuaacggaagagauuauauauuuuccaaagccuuggagaugcagaguggugaa

SEQ ID NO: 2710 - RNA, 1425 nt, Mus musculus
uucaccacucugcaucuccaaggcuuuggaaaauauauaaucucuuccguuaagauucauaaugccauccuugagaggaaauuuccauuuauuuuuacuucuguguaucuuauagaacuggcaugcagcaacauugucugugucaaagaguuccugcccuuccucaucauuuacaucaucuucacucuugaggggcucuucuuccaccugcccaucuucagcuccaucuuucucuuuauuuucuuccuccuccucaucauagucuucuucaucuucaucuuccucaggagauguaugcccuguuccaucaacuugcagcaccaacggagcuugcuguugggcaggcugggccuguggcugcugcuguccagcuugugccggggcgggugcugccacuguugguaggacugaccugggucuuauuuccuguaaauaagauuugcuguguuugaaugaugacacgcaucuguagugacaucccuccaggaaguggggcuaggaccugcuggauaacagguacuuggacuccaccaggcugcauuugugguauaacuuguuguagaacaacugacugcugaggcugaaagauagacugggcaccauuggcugcucugaccaccugaagcagcuggccugaauugguuaguaucuguugaacaggagguaagccugcaggaagugccaagguagcaacuguagcaacagcacugggaauacuugaugcauucauauguuguaucaacuuagaaucggaaacauuaacuuguggugccauagcuugcugugaugcaggaauaagaaucuuuugguuccgugcuugcugaugcugugcuggcugauggugguggagaugcgaugcugaugcugaugcugggcucgcugauggugguggagaugcugcugcugaacuugcaacaaaagcugcucuucuuccaaaugaaauccgucuacugcccuagacugcauuaguuuauucucccacagugauuuuaguuccaucaggaacuguuccuccacuccaucauccagaaaaaugucucgaacaucauuaauaacaucuucaaucacagaucuauacaauuuaggcgcgguguuuguguuugccgaguucgccauuuccacacacaacacaaacgggggaacgagauauaaagaaaaaaaagaaagaaagagggggagggagggaggaaggaaggaaggaaggaaagaaggaaggaaggaagaagaaagaggaaggaagaaaggaaggaaggaaaggaagaaagagaaagaaagaaaaaaaacugagaccgggagggugacccaagucacccacaagaguggggcaaaaauuucucaacaaauccuauccagaaagaguaagaagcaggagaccaggaggagggggacacucuucccacagcuaaaaaccuccagaaucgccua

SEQ ID NO: 2711 - RNA, 346 nt, Mus musculus
auauucgcucuccgccagaucgccgccaucauggacacgagucgcgugcagcccuucaagcuggcuaggguaaccaaagugcugggcaggaccgguucgcagggacagugcacgcaggugcuaguggaauuuauggaugacaccagccgcucuaucauccgaaaugucaaaggucccguaagagagggugacgugcucacccuauuggagucagaaagagaagcucgaagguugcguugaucuugcagcuggguucuggauauccacuacuuagcccacggaaugaucugcaacuguuaaauaaagcauuuauauuaauucuugucuaggaaaaaaaaaugaaaua

SEQ ID NO: 2712 - RNA, 17001 nt, Mus musculus
uaccagaggcacuccgugggaugugucugggcaggcagacuacgaaaauaagcaguuugcugagguugcuaacgguagggcgagccugcuuggaaaucaccagccuuaaaccuugaaaaugccaccuuggagaaaaccauuuuuuuuuccucguugauacugguggaacccaggcuucugacccaugcccuauuauuucuuuaagaaucucauguaccccaggcuggcaucugucuuucaagugcugaagcuacagguaugugucaugucagcuuuuuuuguuguaguugcuuuguugagacagagucucccuuuucuagucccagaacucacucuccuccugcccggcuuguuaguaguguaagaauggcaggugugggacuggagagauggcucagugguuaaaagcacugacuacucuuccaaaggucuugaguucaagucccagcaacaacaugguggcucacagccauccauaaugagaucugaugcucucuucugaggugucuaaagacaacuacaguguacucacauaugauuaaaaaaaaaaaaaaaaaaaaaaaaaaaaaagaaugacagguguguguuacuuuaccuggccagaaaguaucuuuaguuuuguuauuguuguauuuuuuuuguuuuuuuguuuaauuuuugugauagcucugaaauuugugauaguacauagcucuggcuggccuugaacuuacaaagauccaugugccucugcucccaaguacuggaauuaaagaccugugccaccaaaccugggccuagaaagcaucucuuuaaaaauacuuauuuagccgggcgugguggcccacgccuuuaaucccaguacuugggaggcagaggcaggcggauuucugaguucgaagccagccuggucuacaaagugaguuccaggacagccagggcuacacagagaaacccugucucgaaaaaccaaaaccaaaacaaaacaaaaaaaaccuuauuuuagccaggcauugguggcacacacaagagauagaggcaggcagaucucugaaaucaagaccagccuggucuacacagugaguuucagagcagucaagggcuacacagagaaacccugucucaaaaaaaauaaaaguccaugaaaguaaaaagaaaugaaaugauuuuauuuuaucuuauuuaaugucacaauuaaauaagauauaauaaaaugucucccccccccccccccccgccucucaaacgccagcuccugagaucacugcggccucuagcggccagggauggcuacgcggugcucucugcgcaggcgcaggaagagauucaccgccucuauaacgcacuuccgcuuuccucucggcguugcccggaaaccaggacccagacuuccgucaaagcggcauggggcggggccucggguggcgggaagagcagccaccggaauggagguucaggagaguggcugugacccauccgagaguggggcgcaggagcccucgccuguccccagcaagaccgccggccacuacgagcugccguggugagccugcagccauaguaacgcgcgcguagacgugagggcgggccgagcuccaggaacccuggguucgaccugggucuaggggacagagaaggugcagauguccccaggagcgcagauuuccccuuuccuucuugaagcuagauauucuguuuuucuuucuuucuuuucuuuucuuuuucuuucuuucuuucuuuuuuuuuuugagaucguguccuguguaacccaagcuggacucgaacucacuacguagcaaaggaugacuuugaacguugauccuggggugacagggcaugcauuacuuccguaaagcagugcuggggauggaacacagagccucgugcacgcuaagcuagcacucuacggacugaggcccauucacagcccugggguucacugugaagcccaagcuggucuugaaguuucugcaguucuccugcuucagcuucccaaauacuggaauggcagguguaagccaccaggcaaagguagagauuuuuauuuauggaaauugaggaauaugugucucgagguucaucuaaaugaugcuuaaacgugacuaauaggcccucaugcagugcaaugcuaauggcuuuuauuuauuuuauguauaugaguauacuguagcugucuucagacacaccagaagagggcaucagaacccaucacggaugguugugagccaccacuaugggaauugagcucaaggccuuuggaagagcgggcagugcucgucaccgcugagccaucucuccagcccuggccucauauuuuuuuauuuguuuaaaaaucucaucuuaaaaaacuauuagcuuuagccaggugguggcacacaccuuugaucccagcacuuggaagucagaggcaagugauucucugaguuggaggccagccagggcuacacauagaaacacuguuuaacaaaacaaaacucuguguguguguguguuucacuuuuguuacgguaggucucaccacccuaagcuagcugcagacuuucuguauagucgagaaugacgaauucugaccccacugugucuucugccuauggacaggggcugcaggugaauuuugagcuuuuaguuuuugcauggaacuugcugccagaccacaugcuagcauggagcuaccccagcacuaguuuuucuuuaucaaaaguaagguuucugacagcagaccacagagagguuccucgguucacugaacuaucucuccagagcaaugguucucaacuucccuaaugcugugacccuuucauacagugccucauguuggggugcccccccaacuauaaaauuuuuauugcuacuucauagcugcaauucugcugcuguuauguuauaugaugucaauaucuaaguuuauugguggccuuaugcauucccugaggaagggucagucaacagccccgggcgggggugggggguccucgacccacagguugagaaugcuggccuaaaguguaaaguauacuagaaaaguaugcaaacuggaaauaucccucaguggcagacccuugccuggcaugcucagggccuaggguuucauccccagcacucaaaaaagaaaaggaaaguaaagaaaagaaaaugcaccauguauauaauuuagcauugucugguagccaucgaaauaaguaaaaagaaaguggguauccccuuggaguagcucacaccuuagcuacacagggagugugaggccaaugguuagagugcuugacaacccaguguaauccuggauccuacacuuuggaaggagagaaccgacucccagaguuguccucugaucuccacgccugugccauggcacauauaaauaauaaacauggacggauauauacuuaaggcuggaggugguggagcucuugaguucaaggccagccugcucucuaucaggaguuccagucuggcaagaacuacguagagaagcccugucuccaaaaauagagagggaaaggagagaaaacagcagaauauaaaaaaagagcaaaggaaacugauggucagaucacaguaaaucuacaacaucuguacgcagagcuggaaaacguccuuuugacuuuuaauguugcuuguucauuuaaaaagcagaacuugguggucaggaggcugagauagacagaucaugaguuccaggccaucaggagaugugguccaguugauagggcgcuugcugucaaauggaaacccacauuuccauugccagcccccguggacugggcacagugauacacacaugccugucauccuagaccuggagaucuagaggcugaaaaauuggaguucaaggucauccuuugcuacauagugaguuccaggcuagccugggcuacaugagacccugucugaacaaauagauucuuuauaggcacggaugucugguuuuuuaaauuuauuuuauaucuguggguguauucagugcccucaaaggugaggagaggaaaucggauccccugaaacugcaggcugcugggaauuuaaccuaaguccucuagaagagcauccgugcucucagguaccggcucucuccaaccccaagggaacggcauuuuaaugaaaugaccaagagucuuuucaaaacugcccacccaggcuucccggucauagucccaaaucacacagugagccagcacuggcuaccugucaccacagacacccugaagauagccauuugguguaacaaguggguacaccuggguccaucacagcccacccgcuagcccugcauuggugugcacuggggcuggcuagacagaaaccacagcuuacucugguuugcuccgcuguguggaguggacacacaaagccaggucauacgaaaaguucucuugguaucucuuuucauuuaaagccucucuuuuugcacuucuuuccuggggaggaggggggcucuugcaccugccaggucagaacgcagucucuaggagucucuucuccccugugggucccagggaucaaacucagguggucaagccugucggcaggcaccguuaccucucacccaucuugcuggcuccuuucuugguuuugaguuuguuguuggucaguugguugauugguugguuuuuguuguuguuuguuuguuuacuugcgguucccuuuaugugugugaguguuuugucugugugucuauaugggacagugugugcaugcagacaugaagaggccaggagagagcauuggauuccuuggaauuagagcucgaggauguugugacccacuauguggaugcuagaagucgaaccugggaguucugcaguagcaagcgcucuuaaccacugagucaucucucuagccauuguuuuuauuguuuuuuaaaauuuauugagugucucauuuagccuagacuggccuuguacuugcuauauacucaaggauagccuugaacuucugaaccuccuguccccgcccccaagaugccacugugucuggcugauugcuuuaauuaauuaauuauuaaauaguuuuauaugcaucggcgguuuuaccugugugugucugugucugugugagggcaucagauucucugaacuugagucacaggcaguugugagcuuccauguaggugcugggaagggauugaacccagguccucugaaagaguagccagugcuuucaaccacugagccaucucuucagaccaugaggauuuacucauuguguggcuggaugugccacauauauaaggcccacaguucguguggaggccaucaguuuucuuccuguugugccaucuugguucugggguuugaggcaaggcugacuagcuuugccaagagugccuuuaugugcacucuugcuggcuuaaggaccaucuugcugcuuucuuacuuuuuugaaguaguuuauguauguagcagaggcuggccuggaacucggaguccuccuggcuuagccucuguguguuggcaucacagcuccaccuugccagaaucugcaggguugccccuucccgcccucucuucuggguucuguaggauaaccaugucaguguuugcuuucuccucaacaggguugaaaaauacagaccauugaagcucaacgaaauagugggcaaugaagacacugugagcaggcuggaggugagggagcccggagccccuuccaacaucacaucagugacccaaugagcuaguggggacgguuccucgugggguugacauagcaauggggaagguaccauccacacugagggugggucuuccuucucuucucuacuuggggccuaaugauggaugauaggacucagcuuguuagccuuugccagagccuuuaucugcuaagccaucgucuuggccucuauuuuuauuuauuuguuuugggguuuuguuuugcuuguuuauucuauuuuuaauuuuauuuuuuauuagguauuuucuuuauuuacauuucaaauguuauccccuuuccaaaaccccccuaucccauauccaccaccaccacacgcgcgcacacucaccaacccauccacuaccgcucucccugucccugcauccccuauacuggggcaucgagccuucacaggacaagggccucuucucccauugaugucccacaaggccauccucugcuacacaugcggcuggagccaugagucccuccaugugugcucuuuggugggugguuuagucccugggagcucugaagguacugacucguucauauugcuguuccuccuaugggacugcaaaccccuucugcuccuuggguccuuucucuagcuccugcauuggggagccuguacucaguccaaugguuggcugagaacauccaccucuguauuuuucaggcacuggcagggccucucaggagacaggggacauuuuccugaacagaacaccaguggcuuaugcucuaagaucaagaauugacaaaugggaccucauaaaauugcaaagcuucuguaaggcaaaggacacugucaauaggacaaaauagcaaccaauagauugggaaaagaucuuuaccaauccuacauccaauagagggcuaacaucuaauauauacaaagaacucaagaaauuagacuccagagaaccaaauaacccuauuaaaaaugggguacagagcuaaacagagacuucucaacugaggaaacuugaauggcugagaaggaccuaaagaaauguucaacauccuuagucaucagggaaaugcaaaucaaaacaacccagagauucuaccucacaccagucagaaugucuaagaucaaaaacaggugacaauagaugcuggcaaggauguggaaaaagaggaacacuccuccauugcugguaggauugcaagcugguacaaccacccuggaaaucaguuuagcaguuccucagaaaauugggcauaguacuaccugaggacccccuaauaccacuccugggcauauauccagaugaugcuccaacauguaauuaaggacacaugcuccacuauguucauagcagccuuauuuauaguaaucagaagcuggaaagaacccagaugucccucaacagaggaauggauacagaaaauguaguacauuugcacaauggaguacuacuuagcuauuaaaaacaaugaauucaugaaauucuuaggcauauguauagaacuagaaaauauuauccugagugagguagcccaaucacaaaaggacacacaugauaugcacucacugauaaauggguauuagcccaaaagcuccgaauacccaagauacaauucacagaccacaugaagcucaagaagauccaaguguggacgcuucgguccuucuuagaagggagaacaaaacacccaugagaggagauacagaagcaaaguguggagcagagacugaaggaaaggccauccagagacuggggagccauuccacauacagucaccaaacccaugcacuauuguggaugccaaaagugcuuguuugggguuuuucuuguuuuuugagacaggauuuugguauguagccuaaacuggccuugacucccugauccucauggcccagccuccagugugcugagaguggagucaggcaccaccacaccuaacuuaaugaaccucuuccccucaggucuuugcaagagaaggcaaugugcccaauaucaucauugcugugaguacucaggacuggcccugugggcaucuugucugccauguccacuuccugccuggggaagccacaggucccuggcuggguugccaacagucgggaguugugggggcagugggaccuauguggggcuccuuuuugaauuaauucacuuuauguguaugguugguuugccugcauuuguguuuguguaccaugugcaugccuggugccgggggagggggguggauccccuggaacugagauuacaguugguuuugggcacuggggauggaaccagguccucuggacaagcagccagugagugacugcucuuuacugcugagcucucucaccggucuuggggccuuccuggcugaaguacugaggagcuccuauccacagggucccccaggaacuggcaagacaaccagcauccucugcuuggcucgagccuugcugggccccgcccugaaggacgcaguccuggaacucaaugccucaaaugacagguagagucggggggggggggggggggggggggggaggaagggagggagggagggcagcaccuccugcuggcuucacacuuaauugaaauagugcccagguaucugaggagcaccugcaggguuccuuguuuugaugaaaauguucaaagauuacucucuuuuuaaggguguauuuuucuugcugcauauuuauugggggaggggcguaugccuguagagcucagagaacagccugcugggaucagguucucuccaccgaguggguccugaggauugcacucauuguggaggucagcggcaagugccuuuacccaugcagucaccucccugacacugaugggggcgcgggggcgggggggggggugcgcgugcaugugugaguguguggggcgggugggcaugcgugccugugugcaggucagcacaaucauguggaaucaguuucuucuaccuuuauucggguucuggggguuggacucagguugucagucuugcauggucugcuggcaggugcauuuacccacagcccugaaaccacuuuuaaguguuagcuucagucaugcucauauguuuguguuauuuugcaacaguuuucugaccuugcaaaacugaaacugcccucgaguucucacuccccauuucccuucugcagcccuggccacagcccaccuucuggucuguguauuugacugcuagcucauguucucagguuaaaauaagccccuguagccacucaaggccaccaggaggauuugcaagccccuugugaacugggaguggugugugggaaaucccagcacuggagaggcugaggcaggucgguucugaguuccaggucuucucagccaccauaugaagauccucucucaaaaaauaaaauacagggcugaagagauugcuuagcaguuaagaacacgcugcucugcugggcagugguggucugugccuuuaaucccagcacucgggaggcagagacaggcagaucucuuaguucaaggcuagccuggccuacagugaguuccaggacagccggggcuacacagagaaacccugucugggggguugggggugggaggacgaaagaaaggacaugaugcucuugcaaagaugcagaauucccuuccugggcccacucaccguauacuagcuccaggcacccccuuccggccucuacaggcaccccacccccugcgcaugcugagcaucuacaaagacauuaaaaaguaaacugggccacugagauugccucaguggaucaacacccucacugcaaaccucagagcccauagaacucagaggggaaggugagaacugagucuugaaaguugucucugaccccuccuccacaggagccccucccucaugauaauaaaacguuccuugguuucugacccugugcauucuucugugucaggggcaucgauguggugaggaauaaaaucaaaauguucgcccagcagaaagucacccuucccaagggccggcacaagaucaucauucuagaugaagcagacagguaugggcuggagaugguuuccccaaguggaccaggcuggccucacucacauuuccaguccuccaucccagaagaggcagggaugauggggccaucaugcccccagaccuggcaccaaccucccucuuacacuugccucagcaugacggacggugcccagcaggcccucaggagaaccauggaaaucuacucgaagacgacccgauucgcuuuggcguguaaugcuucagacaaaaucauaggugagcgggcagccugggcagcugcgcccaccugguacggcucccuuuucuuuuuccucuuuuguuucuuuuuuaauauuuauuauauguaaguacacuguagcugucuucagacacuccagaagaggacaucagauuuuguuacggaugguugugaaccaccaugugguugcugggauuugaacucaggaccuuuggaagaucagucagcacucuuaaccacugagccaucucuccagcccccaacggcucccuuuucauguacuuacuuuucucauuugguuucagguuugauuaugucugucugcugucugaauaugcgugcccuggaauuaggguacaggcaguugugagccacuugauacagguguccuucacucugugaguguguguguguguguguguguaagccugcugcagcguguguaaaggucagaggacaauuuuaagaauucuguucucaagcugggcgugauggcgcacaccuuuaaucccagcacuugggaggcagaggcagguggauuucugaguucgaggccagccuggucuacagaguaaguuccaagacagccagagaaacccuguuucaaaaaaccaaaaaaaaaaaaaaauucuguucucaccuaccaggaauugaacuugggcagugccuugaccuaccuagccauuuugcuggcccuacuuuuaucuuuuaugguacugcagaugcaacccagggauuuuaggcaugugcccuacuaacuguggccugugugcuuuuuuauuuugagacuuggucuuccuaacuugcccaggcugguguugaauuugcccuauaccccaggaaagccuugaaccuacaguccuccuucuucagcauucugaguagucgggaugacgggacugugccacucagcuugucuugaacgugcucuaguuguuuuguaugcugugacccuuggcaucaauggacucugcauugggcuuugccaggccuccaccucaccacaguguuuucccguagugccuuuggccugcagcccagcugcugcccauguacuggccucucugccagacagguauccuggcccgccgugcuguguguuaucucugucucauuccuguccugcugaugcccggcacugggggcuuuucugucgcacuucccccuccgcacccacacacaagcguguuaccacaugcuuuuccugccagcucauggcugcccagauagguggaaggcuuaguuuuacaggagucauccauccugucccaccugcuccccucccccccauguaaaacuuacauuguaugugugugcuagaagucaguuaucaucuaucuauguggaucuuaaaauugaacucacgcugucugucagucuugguggcaagcaucacugagccaucuugcuagcugccugcccccgcccccacccccauccuccuuuuuucuuguugguguugguggugucuguggugauuuuugagucagagucucaagcagcacagguuggccuugaacugacuuuguaccugaggcugaccuugaacucacgauccuucugucucuaccuccaucuguaauugcaagugcuggguuuacaggcuggcaccuuguggagcuucaaagagcuuguuggaguuccauugccuucuagccugaccaacugccaucuuccccaagggcccacccauucuacacugugauuccagccauuccagagguccuaaccguguguguggguguguggguguguaggugucugugugaggcccgcuuacccuccagaaacaggacccgaccugcuucuuuuaagcaguuagaggcaggcauuuauuggggcaugggaacagacacaucagcaugcacaccuagaaaaagacccucugcagagaacagagagcuggaaaugcagccucucugccucuuaucugauagucugacgccuggcucagcugugagcccucacucugccgucucugcccagagcccauccagucccgcugugcggugcuccgcuacaccaagcucacugacgcucagguccucaccaggcucaugaaugucaucgagaaggaaaaggugccauacacagaugacggccuggaagccauuaucuucacagcccagggagacaugcgccagguuggagggugacugcugcuaucugucuuaggcaggguuucuauugcugcagugaaacaccaugaccaaaaagugagcuggggaggaaaggguuuauucagcuugcacuuccacacugcuguucaucaccaaaggaagucaggacuggaacucgagcagggcaggaacuuggaagcaggagcugaugcagaggccauggagagggcugcuuacugccugcuccccuccauugcucagccugcuuucuuauagcacccgggaccuccaccuaggauggcaggacucacagugggcugcccccuacccaucaaucacuaaugaagaaauugcccuauagcuggaucaucuuuugguuugguuugguuugguuuuuaguuuuuugguuuuucaagacagaguuuuuuuguuuuuguuuuuuggguuuguuuuuuuguuuuuuuguuuuuuuuuucgagagacaggguuucucuguguagcccuggcuguccuggaacucacucuguagaccaggcuggccucaaacucagaaauccaccugccucugccucccaagugcugggauuaaaggcgugugccaccagugcccagcuccuauagcuggaucuuauggaggcguuuuccaauugaaguucucuccuuucagauaacucuaguuugugucucaaguugacuugagacuagauacauugcucuuacaaguugaaguuugggaacgaggguuaugccaagucuggcuaaaaugcagauugaggacucaguauccuguggggcugagcggcuggcgggugggggucgggucucugagaggcagggcaggaaaagacuucauagucguccugauguaucgcuugucuccauccaggcacugaacaaccugcaguccaccuucucaggauuuggcuauaucaacagugagaauguauucaagguaccagggcggggagagggcuagccugcagcagaaugaaccugcaccaacguuggguggauguaggacccgggcaugguaguccacaccugugaucccagcaucaccuucagaguaaaaccugucucaggaaggaaggaaggcaaggucugauuuauuagaguccuugccuggguuccagacccagcaccacauaaacuagguaccccacgccugucauacaagcagucgggaggcuaaggcaggggcacugugagacacugucuugugcccaaagaaaggcggccggcacucauggcugggugagaugggcuccuggcagaguugggugcuugcuucguuuguuuuuccaccccagcuuugucccuuguacccaggagaccagugggaggguccugggaaggucccagguggagguaguggaagauagguggguccuggcuagccaguguuuuuccugaucucucacuucccugcagagauggucuuacccuuaccugugcugcaggcugggcucugguggcuugucugaaguugcuugccucccgagccaucucuccaaucuucuuccuuugauucuuuucuuuuugagccugucaguagcccagacucuguccucaggcuggccucgaacuucuguuccuccugccuccaucuuccucaggcugggaucacaaaugugugccaccaucccuggcucauucacuuaucuuagaggcaggucucaauauguggcccaggcuggccuugaauuugagguccuccugugccaacaugcccaacaucaugccucuaaugccacccaagcagagagucuuucugggccguuggcugcuuuguaguucguucauccuggauaugaggacuuuaacuguguugggcgcugucugucauuugggggauguccgugguggagagaaaacuguucccaaaucccaugccagaugcuggagacuuggugaaaacgagucugggccucaagauggugucuccugauuguuugcucaggucugcgacgagccccacccccugcuggugaaggagaugauccagcacugcguggacgccaacauugacgaggccuauaaggugggucuccuccuccugcccucgucgccauggugcccuguaucucuucagccagguggaagggcccacgguggcuccaggacucugugucgcuccccuaacuguaaaaucacugugagcuuuggguagacuggcuuggcuuucucaucacucagccagaaccaggcagaagcagcuccacagaagcuggcuuuauggggaccagcguggcaggaaggccugacaagcucaugguggugggagagcucaugggggggacggaggggcguguggcuuugcuuuuuuuuaaguaugcgugaguauuuugccuucauguagccuguucaccauguguguguauggcacccuuggaauccaaaagaggacaucugguccccaagacuggaguuggaauuaugagcugucaugugggugcuaggaauuaaaccagggccccaaaagagcagccagugcucuuaagcacugagccaucuccccagcccccaugagcugccucacaucuugauggaucaggaauccuauacaugcugccuagcuguagaggcuccacccccuaaaugcccaaccucccagaacagccaccagcagggcacugagugguauuucacacucaauccgugaaacugacuccuagagagaggcugauuccuugccuuaagccacacugcagaaguagaccuggaagucagcauugugaccuccuggaguuacauccucuaccagagauucucagccugagacagaaagagcagccaacaccuccagugaugucacauuguccuggguuggggaacaugucauauccugcucugucuuccugagaaucauguugagggccagccaggaaccuagcaguuaucuguuaacuggaagaggagagaucaggaaggguuuaguguggcugaaggccugguucucugagcagaugccgggggguacggaugacuucagaucucuaggugucagggauaugauuggagacacuguaacugauacagcguuucccacucucagucaacuagggagacugaccagggucagggcaggguuggacuuagugagaaacuggaguaccaggcacugaguacuggaggcugagguuaagccguagacugguuacugaagacagaacacagcuaacccuaaucccugaugcuaacccucuaucccugucuaacccuaacacugcuagaguccaucccaaggugccaaggcucaaagaauugucucuagacacagccccaggcuagggaaaguugacagggagggagaaaaggagggaggcaaagacuaauggaaagugagcuaaauuaccugcugggaucagagugcugggugaaccaaggcagccauggggcccacuuagaugaugaucacuucaggugauccucaaagccucaugggucaccugagccaagcuguuacccucagggugacaggccaggcccaccauaguccccucuguuucccugucugugaagcucacaguguucagggccugcugggucuucuaucuagauucuugcucaccuguggcaccugggcuacucaccagaagaugucaucggcaacauuuuccgagucugcaaaaccuucccgauggcugaauacuugaaacuggaguucaucaaggucagucagagcucaggaguacuuugugccuuuuaacucugcugacuucuugaucugugcugcugguuuuuauaguugaggucucaugguauggccuaagcugggcuuaaggguaugugccagcacgcuggcuugcgcuggcuuccuuacugcagugccuuccagaucugcugugacguguguccgugcucuggcccuuaucacugagcaguauuccaugcggcugucaccaucacuuguucucugggaaggccguugggguuucuguggcuaaggccacuguacacgggcauacaugggccaccacgccucccagccaaggucuuguucuacucggguggguucccaggcacaagaccuccgacucaggcaaguguaugcugaacuuuuuaagaacugaacuggggcuggccuaguugggagagugcaugucuugaaugugcggagcccugggguuggucccagcacugccuaagaagagugcugcuaggcuaggcguggugugcccuugagugcuacauagugaggccuuauuucagaacagcaacagcagaaacaaccuccuggagguggaggcaggagcaucaagagcucaaggcugcccucuaguacauagggaguuugaaagcagucuggacucugagacuaacagacggggccuuagcuccagguuugcuccgcaagcuuggaacgugcuuuuauagcaugagccaaacuugagugaagccaggucccgccugucacccugcauugugagguccucguaucugcuuugaacccgccacuaguuaagcugguuaggaacaacgagucccgcuuacccaccugcugcucuucucggcuugucuuucaggagauuggauacacucacaugaaaguggcggaaggagugaacucccugcugcagauggcugggcuccuggccaggcugugucagaagaccauggcuccaguggccagcugacuugagacggccuccacugauggaacuaggagagucuuuguugugggagaugugccucagcuagaacaugcucacuuuguuuuucuucugugaaaauagucucuuguaccccaggcugaccuugaacucccgauccugccgagugcugggguuggaggugugugucaugugugcuuucugcgguacuacagauggaacccaggacucgugcgugucagacgagcacugccagcugggcuacagugagauacugagcucuggaagugacacaccucugcucuucugugugaauucaagcccuggacauggggcaugcugggaaagcucugaccuccucagucuuguagccgauaaagccuuuggauguucgucuugcuaugcuuaauugcuugcggccuuggggaaa

SEQ ID NO: 2713 - RNA, 2625 nt, Mus musculus
aauaauaaaacagauaagaaaauuuaauaaaccagacauaguggcacacauguuuaaucccaacacuugggaggcagaggcagguagacuuacuacuaggccagccugggcuaccauagugagacccuguuucaaaauauuccccaaaccaaaaacacaauauguucccuggugauaaacagacauggggaaaggguugugacuugggguagaagugacagggcuuugaaauuuaaagacaaagguucucucuucuuccucacuggaagagguuggcgaccagcuagccagagucagcacuggaguuuuuuuuuuuuuaaagauuuauuuauuuauuauauguaaguauacuguagcuucagacacuccagaagagggcaucagaucuuguuacagaugguugugagccaccaugugguugcugggauuugaacucaggacauuuggaagagcagucagugcucuuaaccacugagccaucucuccagccccagcacugggguucuugaaugacaugggaaggaaaugaaucugggucuuguucccuucgguuccuccugccuuccccuguggaauucugggauugcaggugugugucaccucacccgguaagcugucuuuuuuguuguuaagauagguucuauguggccuuggcuggcaugggacuugauaugcagaccacacuggcccugaacucacagugauccuccugccucuaccuauggagugcugggauuauaggcaugucuuuugaggcagggucuagaaguugaucucaggcccucuugcuuauguugccaacugagccaucuccccaacucuccucucuacagaagggcccgaggaugggggaucugagcgggaacugaagccuuuacugccugcugaauaaagccuguucuccagggaugcucaaguuucacacccuggccguggcugcuccacagccugggagacacugggcaucgccagagccccaacccucaagugaugcccuggacuucuuugggggcaaagcaagugcccagaggauauagacugugcugacuggaagcccaagaccugaggcaagauguguccccagucucacaucuaaaaugaggcacaacaguggcauuuguggguuuuguuuuuguuuuggcugcaggaucucacuaaguuacucaggcugaucucaaacuuguaacccucaguccuaguguugggauugcggcauaccaguuuuuuuuuuuccuuucuuuguuuggaccucagauuacuuaugucgacuucuaggacuguugcuaugacucuuuuugugguuaacugaaguugcuggagucguauuuaauauugucaaugucaggggguucccugucucagagcauuauguguacuaacuguagcagaggaauggggugugggguaaccugggaucgcuuugguuucuuagugggcuccaguuuguucugaucuuucauuccugcggggaccuugugcgucggugauagggaaauaaaacugcccccucaccaaacaccaauaaacccugugagugugagagcaggcgcugcacacaugccuuuguuuaaacaccuuccccuguguguucauagggcugaaugucucuguuguugcucuccguuauuuuuuuuaagacagucacacuguguagccccuggcuacccuggaacuugcuuuauaaaccggggugacccugaugagagacccugucugcuucuacuuccuggauacagggcugaaaggcaccacugcaccugaccuuugguuuaaaaccugugucugaguauauuccaugugugggugccugcagaauucuggaggcacugggacacuugaaacugcagacucuugucggcugcccuacaggagugcuaugaaccuaagcuccucuguaagagcagucaagcccaacugcugagcaaucucaucucuccugccuucugaacacgugucuguggcugagcugguaggcuugcugaugggauagaccugcugguccagcgagccccagggauccugucucugaccugccagugcuaggaccacagacaucugucccugugcuuggcuuguuacuuggguucuggggaauccaaacucagguugaggcuguagagcacuuuacuuacuuggaggcagucagaggacagcuguggcgcuggcucuccugcccucaugagggcuccaggcugggaagacaagcaagcgccuuuaccacugagcuaucuugucaguacccucugccauuuagucucacuguaacccaggcagcugguacugaauuuguggcaccccucugccucagcaccccagguguugggauuauaggccugugccaccacaccuggcucugguaaagacccuuccuggaaacgaagagcaaggugguuuuuuuuuuguuuuguuuucugagacaggguuucuguguguagccccuggcuguccuggaacucacucuguagaccaggcuggccuggaacucagagaucugccuaccucugccucucgaguacuaagauuaaagguaugaucaccauugccuggcuuaagaucaagauucuuaguagaaaugacccugagguccagagaggaauggggcuaugcacuucauguccagccccc

SEQ ID NO: 2714 - RNA, 1284 nt, Mus musculus
cagauaggguccugugucaacugcugugcucacacuugcuggagcucgacauuugacuaccuagaucaucauuggugacaguggccucucauacgugcuggcccccgauacuuuaaaauuccauccucggcucuuggaauccugcaucucuacagcuggaccccugacucguccugguccugccauuagcagacucugagccauggucgucagcaaacaagaggccaucagcuucucugugacuucacuggguugggugggugccauugugagcugcgugcugcccguuuggagggugaccuuuccagaugaugagacagacccagaugccaccauuugggagggucuguggcacauaugccagguucgggaaaacagguggauacaguguacacuguaugacacccggauacugguagcacaggacauaaaagugucucgagucuuuauggucaucuguaccauuggaaccuggcugggauugcugcucugugugcuuggggauuggcgcaucaauuguuucaugaauuuuacuauugaagagaaccucuugaaaguagccggugggauguuucuuaguguuggccuucugaugcugguaccccuguccuggguaacacacaacaucauccauggcuucuuuaacccauugcuuggcuucucgaagaaaguacagaugggcucuucacucucccuggccuggaccagcucccugcugcuguugcugggaggcauccugcucugugucaacaucccaguaugcagagacuuuccccguugcauugagaccccuagugcuagaccuucaggagccaacaacgauaccuuagguaagugucucucuucccgccccucccaccuuccaccccagacggaguuugucuguguagaccuggcuguccuggaucucugagauccgcuugccucugucucccaagugcugggauuaagggugugcaccaccacugcccggcaucucucaccuuuugaguugcuuauuuuuagacugaccuccgaucaucuucugauccuauucuacagauguuugauggccagcacacucacgucuggaggggaaaacuuccucaagaggccucucuccagguucuagaaucauugaacuggagggaggaaagacaggucuacggagcugcccacaagcuguguaguggacucuggaugcggcuagcugugucagcaccaugcugaggugggcuucuuggugcugaagcugcccgagucuccuaucuaagggaccccaauaaagucauuguuccccuagac

SEQ ID NO: 2715 - RNA, 1818 nt, Mus musculus
ccuuucuuguugcaggugcaggcaggaaagagcugcaguguucgcgcuugguagcuggugcaucggacucagcuggcuuugugucccugaggcucaccgaaaaaaacuuucucagcccucugacuccagagagagagagagagagguacuuuuuguggucaccgacuuugaccccugcagaggcugagcgauggcgucuaugggacuacagguccugggaaucuccuuggcaguccugggcuggcuggggaucauccugaguugugcgcuccccauguggcgggugaccgccuucaucggcagcaacaucgucacggcacagaccagcugggagggccucuggaugaacugcguggugcagagcacaggucagaugcagugcaagauguacgacucgaugcucgcccugccgcaggaccugcaggccgcccgagcccuuauggucaucagcaucaucgugggugcucuggggaugcuucucucagugguagggggcaagugcaccaacugcauggaggacgagaccgucaaggccaagaucaugaucaccgccggagccguguucaucguggcaagcaugcugauuauggugcccguguccuggaccgcucacaacgucauccgcgacuucuacaacccuaugguggcuuccgggcagaagagggaaaugggggccucgcuuuacgucggcugggcggccuccgggcugcugcuccugggaggaggccuccucugcugcaguugcccaccucguagcaacgacaagcccuacucggccaaguacuccgccgcccgcucuguccccgccagcaacuauguguaaggugggccacucuguccacauugccuuuguuaucuuuuuuucggauugagcucauaacagccuguggccccucacauucuccaggaccugcccugcuaugggccacuaacugcuugcuggggacaggcaaacccggacugugcaaaguuacuagcccguagcucuugggcugcuccacauggcuccuuacggccggcaagaauggauguaaaaauaucuugcugcuuacauccaaauugcugguggauauggggcugaaggcagaagcagcugggaagggcaguagaggcgcaagcuggguccugcuggccgggguagcucagcugugacuuuggacucuggaguggauguccucauguuagcaaacguccacuguccuuucucuaucccccucacucagccuacacguuacuccagcgcuacucuugccauuacgccccguguuuccgagcacagcugguccuaccccaagucauggugugcugagugacugacugaggggccauugagagccggugggcucugccauggaacccuuccguugauuagcaaugacugugcuugacccacccaccuacccuacuaaugaauuucuguagaguggauggacggguuugagggaagaaggguggagguggauuaaacugguuuggggagggcuggggaccuagaagcagcccaguguguccccaccccuuuuccgcacugucuugcuaauguucugaucacugugcgcccccucccucuucagaaggacccugggccucuugaguuggccccucugaguucccucccuuugcccauuucaaggacaccggccagucugcggaaggaagguacggggggggggggggggggugauggcauuguaccagggagucuccuggacuccccugccuucucugugguuucuuguuuuguaauuuaaggucuguucacagcuguaauuauuauuauuuucuacaauaaauggcaccugcauacaggaaagguuu

SEQ ID NO: 2716 - RNA, 3409 nt, Mus musculus
ccgcaagguguggcuaagaagccuacguccgggugccuggcaguggcuacgacgguugagugacggugcgaagaacaagccaguuggugaccccguccagggcguggcaggggcucacagaucuaaaggggauuguauauugucccagaggagggaccagucccacguagcgcuucccugguccuggucgggaacuggucucuaagcggcucacagcgucuguaggaauugcguaguggcgcaagggggcagggcuagcgcuguauggcuacgcccagccuguuaccaagccagcuaguccuacagaccaggcucaaaguggcugcaggaaauguguaacgugcaagggcuggggucgucuagcggcugcguccaagaagcuucugcuuugggagggggcugaacugacuccgggaauacauuagaccacguggccuaaaguggcgccucgauggggggggggcgggggaaaaggcggagcccuaguuggaauagacagggcucugaaaggcggagcgugcgcaggacagcccuaggaagcacacuuugcgggcugugggcaugcuccgcugggcgcgagcguggagggucccccgugggguacucggugccuccucucccaggcguuuggcgguuccugucacguucuguagcagccgcaguaguggccaagaaaacgccgaucugaggucagccaagggcacugggaggguuguucuccacugguccacuucgcacgcggcuuagcuggccccgccucuccuuuggccucgccccuuuuuucuuucacucucuccucccccuuacuccaugguggcccccaccuuccaggccgcugccgcugucuuauaaucuucuagauggagacgcgacacucccagccaucgucuuuuugcaugggcucuucggcagcaaaaccaacuucaacucccucgccaaggcaaugguucagaggacuggccggagggugagcuuccggauggggcggugcaugggugggcgggggcuaagggguaaggcugagggcaguggaccuaguuucaaucacucaggucugggcucuuggugaccugaaaauggaaaguuucagugcccaguaaaccguaaaacaucuaugaagaggccugguccuguaagaugccccacaguuaguccauuuauguuacugagacauaacaggucucuuugucaggucccaaagaaacuugggacaauuuuguggcaccuacuagcaugccaaagcacacucuagccuccuggcuuacucaguacgaguggcagcucucugcucuuguuacccccgaccccuuacuauaaaccuuuccaguccagaggcuucccgucccccagcgucucuuuccuguuaacccagccauuuaagccauuugcucccugacuacucugauccuccuuuggucugcaugcccucucuccuuggcaccugaaguucucauuugaucuccacauguacaccauggcacgugcuugcgaagauauaacuugcgcacaugcauacauguguguauauaauaaagcaacuaaggaaguugcucaauauuaaccucugcacgugcgcaugcgcgcgcgcacacacacacacacacacacacacacacacacauacacacacauacuuaugucuccagacuucucucccuagcugcucuguggacccuaucaggcuuuucguugucuguagucaaaguaacaccauuccuguuucacccccaucgcaggugcugacgguggaugcccggaaccacggugacagcccccacaguccagacgcaagcuaugaggccaugagucaggaccuucagggccuccuuccacagcugggucuggugcccugcguccucguuggccacagcaugggaggaaagacagccaugcuccuggcacugcagaggguaagcuacaccuaucuggguccucuuaaugcacucuaagcccauugauaacgugggacucauccacacuuuggauggccagguccagaaacucugcuggcggcucagaguuugucugggaccugcucuggucugauucugucucccagccagauguuguggaacgauugguuguuguagacauaagcccgguaggaaccacaccuggaucacacauuggagccuucauagcagccaugaaggcuguugagaucccagagaaggugccgcacucccaagcccgaaaacuggcggauaagcagcuuaguucgguugucaaggugacgcacgcccccccccccuuuccccauggugugugucagaggaaaaguggugggugggccucacagggagccccuucacagcugccaggucuccccacaggaagcgggcauucggcaguuccugcucacuaaccugguagaggugggugggcgauucuccuggagacugaacuuggauacguuagcucagcacuuggacaagauaaugaccuuuccucagcaacgugaacccuacucggggccaacucucuuccugcuugguggaaauucuacauauguacaguaagccggugugggaccauaggaaggggcaugcuuugcccaccaccagcuaugggagccugcgugggcuaggggaggcgggguaucugggagccuggcaauaccacugcgcaugaaggcucaugcacaucucucucuccuguucucucucucucccuuucucccucuccccacaccucuccauugucuucccucuccauuggcuucacuauggcggccagacccagccaccacucagagauuaggcgacucuucccucaagcccagauucagaccgugccuaacgcuggccacuggguccacagcgacaaaccccaagacuucauggaugcugucaccagcuucuuggcuuaagaaguagcuccuuggaagagcagccaggggacucuaggcuugggaucugugccaucuugcuucugcacagaaaaacucaggggcacggagaggguccaggaguacagaaguggcccaacacuuuuaaugaauaaagacaguuccccuuuaagcccuggauccguuuucaccaccgucgcccccacugaccccgggagaguugaauccaggaacuucugcccgggcuuguguucucguguguucccagggugccucugggcucucccugcagcugacuccgcacccgcucucgaaccauaugcugcaugucuuccugggcacgggagagagagcagguccgaggcaaucccuggggacggaggggcggaggggcgucuuccaagacucccgacucagaggcuccacccuaccucccaggccuccaccuccuguuucagcuucaguuucuccugcaggaccuccagcagcugagccuccacugugcgcagccuggcucgacaggaguccagcuccucuuccaccgcgcgcuuccuacaggca

SEQ ID NO: 2717 - RNA, 3409 nt, Mus musculus
ugccuguaggaagcgcgcgguggaagaggagcuggacuccugucgagccaggcugcgcacaguggaggcucagcugcuggagguccugcaggagaaacugaagcugaaacaggagguggaggccugggagguaggguggagccucugagucgggagucuuggaagacgccccuccgccccuccguccccagggauugccucggaccugcucucucucccgugcccaggaagacaugcagcauaugguucgagagcgggugcggagucagcugcagggagagcccagaggcacccugggaacacacgagaacacaagcccgggcagaaguuccuggauucaacucucccggggucagugggggcgacgguggugaaaacggauccagggcuuaaaggggaacugucuuuauucauuaaaaguguugggccacuucuguacuccuggacccucuccgugccccugaguuuuucugugcagaagcaagauggcacagaucccaagccuagaguccccuggcugcucuuccaaggagcuacuucuuaagccaagaagcuggugacagcauccaugaagucuugggguuugucgcuguggacccaguggccagcguuaggcacggucugaaucugggcuugagggaagagucgccuaaucucugagugguggcugggucuggccgccauagugaagccaauggagagggaagacaauggagagguguggggagagggagaaagggagagagagagaacaggagagagagaugugcaugagccuucaugcgcagugguauugccaggcucccagauaccccgccuccccuagcccacgcaggcucccauagcugguggugggcaaagcaugccccuuccuauggucccacaccggcuuacuguacauauguagaauuuccaccaagcaggaagagaguuggccccgaguaggguucacguugcugaggaaaggucauuaucuuguccaagugcugagcuaacguauccaaguucagucuccaggagaaucgcccacccaccucuaccagguuagugagcaggaacugccgaaugcccgcuuccuguggggagaccuggcagcugugaaggggcucccugugaggcccacccaccacuuuuccucugacacacaccauggggaaagggggggggggcgugcgucaccuugacaaccgaacuaagcugcuuauccgccaguuuucgggcuugggagugcggcaccuucucugggaucucaacagccuucauggcugcuaugaaggcuccaaugugugauccaggugugguuccuaccgggcuuaugucuacaacaaccaaucguuccacaacaucuggcugggagacagaaucagaccagagcaggucccagacaaacucugagccgccagcagaguuucuggaccuggccauccaaaguguggaugagucccacguuaucaaugggcuuagagugcauuaagaggacccagauagguguagcuuacccucugcagugccaggagcauggcugucuuuccucccaugcuguggccaacgaggacgcagggcaccagacccagcuguggaaggaggcccugaagguccugacucauggccucauagcuugcgucuggacugugggggcugucaccgugguuccgggcauccaccgucagcaccugcgaugggggugaaacaggaaugguguuacuuugacuacagacaacgaaaagccugauaggguccacagagcagcuagggagagaagucuggagacauaaguauguguguguaugugugugugugugugugugugugugugugugugcgcgcgcgcaugcgcacgugcagagguuaauauugagcaacuuccuuaguugcuuuauuauauacacacauguaugcaugugcgcaaguuauaucuucgcaagcacgugccaugguguacauguggagaucaaaugagaacuucaggugccaaggagagagggcaugcagaccaaaggaggaucagaguagucagggagcaaauggcuuaaauggcuggguuaacaggaaagagacgcugggggacgggaagccucuggacuggaaagguuuauaguaaggggucggggguaacaagagcagagagcugccacucguacugaguaagccaggaggcuagagugugcuuuggcaugcuaguaggugccacaaaauugucccaaguuucuuugggaccugacaaagagaccuguuaugucucaguaacauaaauggacuaacuguggggcaucuuacaggaccaggccucuucauagauguuuuacgguuuacugggcacugaaacuuuccauuuucaggucaccaagagcccagaccugagugauugaaacuagguccacugcccucagccuuaccccuuagcccccgcccacccaugcaccgccccauccggaagcucacccuccggccaguccucugaaccauugccuuggcgagggaguugaaguugguuuugcugccgaagagcccaugcaaaaagacgauggcugggagugucgcgucuccaucuagaagauuauaagacagcggcagcggccuggaaggugggggccaccauggaguaagggggaggagagagugaaagaaaaaaggggcgaggccaaaggagaggcggggccagcuaagccgcgugcgaaguggaccaguggagaacaacccucccagugcccuuggcugaccucagaucggcguuuucuuggccacuacugcggcugcuacagaacgugacaggaaccgccaaacgccugggagaggaggcaccgaguaccccacgggggacccuccacgcucgcgcccagcggagcaugcccacagcccgcaaagugugcuuccuagggcuguccugcgcacgcuccgccuuucagagcccugucuauuccaacuagggcuccgccuuuucccccgccccccccccaucgaggcgccacuuuaggccacguggucuaauguauucccggagucaguucagcccccucccaaagcagaagcuucuuggacgcagccgcuagacgaccccagcccuugcacguuacacauuuccugcagccacuuugagccuggucuguaggacuagcuggcuugguaacaggcugggcguagccauacagcgcuagcccugcccccuugcgccacuacgcaauuccuacagacgcugugagccgcuuagagaccaguucccgaccaggaccagggaagcgcuacgugggacuggucccuccucugggacaauauacaauccccuuuagaucugugagccccugccacgcccuggacggggucaccaacuggcuuguucuucgcaccgucacucaaccgucguagccacugccaggcacccggacguaggcuucuuagccacaccuugcgg

SEQ ID NO: 2718 - RNA, 1134 nt, Mus musculus
guacagaaguggcccaacacuuuuaaugaauaaagacaguuccccuuuaagcccuggauccguuuucaccaccgucgcccccacugaccccgggagaguugaauccaggaacuucugcccgggcuuguguucucguguguucccagggugccucugggcucucccugcagcugacuccgcacccgcucucgaaccauaugcugcaugucuuccugggcacgggagagagagcagguccgaggcaaucccuggggacggaggggcggaggggcgucuuccaagacucccgacucagaggcuccacccuaccucccaggccuccaccuccuguuucagcuucaguuucuccugcaggaccuccagcagcugagccuccacugugcgcagccuggcucgacaggaguccagcuccucuuccaccgcgcgcuuccuacaggcagugggggauggggguggggguguuccaguggcugucuucuggaaauaucuggagcccccuuccucuccucuaguaggagugaguccccacuucccccuccuccaccccacccccacccccagaguuucucucacuuagcaauggcuucaucccucuccugcaguacuugcuccagggaagguuccgcccgggugucccccagugcuccugccgcuugggauucuggguucuguuggggagugauggaugaggaggcagugaccuggggcuugucagaaggagaagccucacccuggguccuucugcccugccucugcccugccucaugcuauuuccacucaguuuuaccacccuuugccuccagggggugcugcgccggcaucuuguaaaggagacccuuagucuggcuagccgggaaguagacuaugggacuuugcagaauggacaguguuugaagcuccugaggagaaaggaguucccacacagcccuacagaaaugcuacugagugcucuggagucgcuuaccuuucuaugagcuuagagagucaaggccuggugacugagacuugucaguugguagaggcuagaagacagagcccuuugcccuuccaggcaaggcacucccuagcagacuccaccuacaggaggacagccuggggcaaggagcaagugcaccucccucuuaacaccuugga

SEQ ID NO: 2719 - RNA, 1134 nt, Mus musculus
uccaagguguuaagagggaggugcacuugcuccuugccccaggcuguccuccuguagguggagucugcuagggagugccuugccuggaagggcaaagggcucugucuucuagccucuaccaacugacaagucucagucaccaggccuugacucucuaagcucauagaaagguaagcgacuccagagcacucaguagcauuucuguagggcugugugggaacuccuuucuccucaggagcuucaaacacuguccauucugcaaagucccauagucuacuucccggcuagccagacuaagggucuccuuuacaagaugccggcgcagcacccccuggaggcaaagggugguaaaacugaguggaaauagcaugaggcagggcagaggcagggcagaaggacccagggugaggcuucuccuucugacaagccccaggucacugccuccucauccaucacuccccaacagaacccagaaucccaagcggcaggagcacugggggacacccgggcggaaccuucccuggagcaaguacugcaggagagggaugaagccauugcuaagugagagaaacucugggggugggggugggguggaggagggggaaguggggacucacuccuacuagaggagaggaagggggcuccagauauuuccagaagacagccacuggaacacccccacccccaucccccacugccuguaggaagcgcgcgguggaagaggagcuggacuccugucgagccaggcugcgcacaguggaggcucagcugcuggagguccugcaggagaaacugaagcugaaacaggagguggaggccugggagguaggguggagccucugagucgggagucuuggaagacgccccuccgccccuccguccccagggauugccucggaccugcucucucucccgugcccaggaagacaugcagcauaugguucgagagcgggugcggagucagcugcagggagagcccagaggcacccugggaacacacgagaacacaagcccgggcagaaguuccuggauucaacucucccggggucagugggggcgacgguggugaaaacggauccagggcuuaaaggggaacugucuuuauucauuaaaaguguugggccacuucuguac

SEQ ID NO: 2720 - RNA, 5369 nt, Mus musculus
cggagccggggcggagcggggccgaucgggccgagccagcagccgagcugggggcgcgggcgggcgguauguaccgggcccgggcggcgcgggcggggccggagcccggcagcccggggcgcuuugggauccucagcaccgggcagcuccgggaucugcuucaagaugagcccaagcuggaccggaucgugcggcucagcaggaagguaacgcggggggcgcgggcaggaggaggguguggggggauggagaggucgggcugcggccugcggggacccggagacccagccagcggaggccaccccccuggagcugccaggccucgggaucaugggagccuggcacguccgagugggccccgcggagccgcccccgggggauggggggcgccccgauccagccuggggcgaguggugcggaaggggggcgcccggggaugcacccgugcaccccgggauggccgcgaggcgugcccucccgaggaugcuccggggagguguguucuggggggcgggagguggagggugagcuguguuguggggggcccuggcucagcacacccacguucuguagggccagaaaggggaggcgccuuguuuggggggggagaacugaaggccugcuugacaccugggguggggaggauagcugggaaaaugggggggggguaguaaugcauuagauggggagggggcuuugugucugccauuggguaugggucuuugaauacagaggcuuguauucuguaggccaccauaagagaaaguuguauauuucacgggagacauaggcccgggcugguugucugucgggagggggguacagaaagagaaaguguguguuacaaggagccagacgaggaggggcuugugcauggaucaggggacagauggagggagcgcauucuccaggggcggggagcuaggcuuggcccuccuagaaacaggcucaaacagccgucuucagggccccagugcugccuucugcuaggugagcagcuagcaggggcaggggaccacagaagcaaaggggguguguguuguguucgcgggggcgugugggguuccacuagagggccaacaaggggguagaagagaugagagggugaccugaguggggguugcugggaagguucggggugaaaacaucacucccccaagagucagaacaggggguggggaugcuuuccacacaaacaccugaggaggaagcgagacaaaggccugguaugagaggcaagcuguccaagcggagaaaaugggacagaggagggaggggggagcccuccgggaccuaagcagacauauuaauugaaaaauuaaaaauuaacuaacauuuguagaggccuucauaguuugguucacuuaagucucacaacagcucggugagcuaggcggguuuuuuguuuuguuuuguuuuguuuauguuuuguuuuguuuuuaauuguaguagaaacuggggcccaaagaaaagaugcaaggcaaagccuggucccuccaccuguugguccugucacccuugcagguugggggcuccggggugccuuuggccaggccugugguggguguugugcaaggguggacuucaggugacccugggcagucugagcccaggccucuuagcucucguccaccgcaguuccagggucugcagcuggaacgggaugccugcuuggccucuaacuacgcgcuggccaaggagaaccuggccuugcggccccgccuggagaugggucggacagcccuggccaucaaguaccaagagcuucgagagguggcugagaacugcgcagacaaacugcagagacugggugaggggcggcccaggagaccugcuuggggcgggguuggccuuaauucgugccaaguucuuaagggugggacugggacacaccuacuccuggacaaagugugaagggaguugguuuuggccuccuggaagagugagguguugaccuguggaggaagcaggcauggagaacugggcugggucccccauuguguguaaucccaggauuugggaggcagaggcaggaggaucacaaaacuucaagaccagcccuagguuauguaggaggucuugaucagacugcucugugucuugaggggagacucugcaucaaaacaaaaacaaacgguuguguugaagagacccugggcaguagaagaaaggagacccaagccaggcauggugacauaugcauauagucccaccacuugggaggcagacaccggaggaucaguaguucaaggccagccuuggcuagagugaguuugaggccagccugggcuacccaagacccuaucucaaaaacaaaaacaaaaacgaaaaacaaaccaaaagccaacaacaaaaucucaucaaggcugaggaugguucacuaaguaaugacacuagguggcaagcuugaguuugcuucccaggaccuacaagguggaaggggaaaagaccagcgccuagaaauugaccucugaccucuacaacucuugagugguaugugugugcccacccacauacacacaagaacacaaaguaaaaauguuauuuaaaacaguuuaaaaaaaaccuaacaucaaaaggcuggagagauggcuccgcauuugaaggcacugacugccuccagaggaccuggguucaaacccccagacccacagaacagcucacagcugucuguaaugccaggcucugacaccugcacauagacacacaugcagacaacaccaaugcaaauaaaauguaaauacacacauuuaaauaaguaaaaacccaaccucaaacagaaaacaagaaauggggcuggagagauggcucaaaagcuaaaagcacuugcuacuacuccagaggaccuggguucgaaucccagcaccuccauacauggcagcucacaacugccuauaauuccaguuccaugaaauccaauaauaucucugauguccauggguacgcauacauauaugcaggcaaaacacacauauacaugaaauaaaaauuaaaaaaaaaauggaagaaacucaaagcuuggauucccuaguggucaaaaccucccagugcuuuauuuuauauucuaggauguaggaccaccucaugucugaccuaacugauggguuggguagugguagccucaauguggaagugaggaggccaucuguccacagacacucaguagugcccguguuauugaacauacugagccagguauggugguacauguuuguaaucccagcacucaggaggcugaggcaaaaauaaccacauuuggcaagcuagccugagcuacauaguaagaccugaugaugaugaugauggcgaugauggcagugacuguggcagcuggagagauggcuuagcuguuggaaaggauaggaguuugguuuccaacacccaugcugggcaggucaaagacuccagcuucaugcuggaucugacaaccacuggccucuucagaaaucugcauucaaguucucacgcccauacacagacacauccauauaauuaaaacuaaauucuuuuuuuuaaaagaaaaagaaacaacgguauagcaaacaaacagaaauaagcugaacuugucugcgcaugccuccaaucucagcacuuugaggucuagauccuggaggaucaggaguucaaggauagccugggcuacacaguccaaguuagaggcuaugugaggcccugccucaaaagaaaacaaagccaggugaggauuuggaggccacagagaugggaacuguagagucaccugcagucaaugggagagucagagucccugucugucccccugugguccccagagaagagcaugcaucgcuggagcccccaaugugcgcugggcuggcugcaggcugagcuggaagaggcugagcaggaggcugaggugagggguagagguggcuggggccaggucaacagggagggaaaccagucucauuggggucuucucugagaaacccuccgugauugcuuccagaacuuucuggacuccgcucaggacggcagaguuugcuguccuagggacgucuacagacacuggagggcagggucggcugaguaguaaggcccauuucucagggcuggguugggagcagguccuuaaguguguugaaggguacgggacagcccucuuuguggaaauaagguggacaccuguccagucuggguaacccagaggcugggccauguuggaagcuccgggccucugcuggcuggucaccguggggaagaaggagucaggcucugaucagauugccuccccaacucucccuuucccuccuggacgcuacccagguccagauggagcagcugcugcugggggaacagagccuggaggccuuccugccagccuuccagaggggccgugcccuggcccaccugaggcggacacaggccgagaaacuacaggaggugcugaggcgucgagagcgcucugcccagccggcccccacaacugcugcugcugcugccgccgccgccaccgccauggauccccccaaacccuucccugcugcugccguccugcccacuggggccgcccggggaccaccuccagcaguaccccggagccugccccccuuggacucccgcccagugcccccagugaagggcucucccgggugcccuuuuggcccagccccuuugcugagcccucgacccucucagccugaacccccucaucgguaggagccagggugaggccucccagcggggguccagacaaacuugauucauggcuccuccuccucccccacugccuggguggggggaggggcaggccccucccccuagccucaggcaggcccagggcccuggaggcugagcuggggaagaggggcuccccgaagaggcccgaagagggcuggggguggggugggcagggugcuggacuccggucaccaaggaaacucugccuuuuuauuuuauuuuuucgucuccccggcuggggccuccagggugccaagccagguccucaaaugaaaaagaacuuuaugggguccugcuucuuccagaggggucuugcuugggggccugucgcacccugccacacuacugggcucgaacaacugccaaggcuuacuggauuguucucauauccugagcuaacccuuccugcaguuugggggcccuccgccuaggagccgggcccagggacacccccaauggccuugcagcuggcccuggggcaagguaggacagaggcuucugaccugcacaggugagagccugccacccccaggaaagaccauucuguauuuuucugucccugucuccuuagaauggaaccuuuuugagggcagguccuugucuuuguauguucuguccccagccccgccuccuaggggcugucaauaaaugugcugauggaugacggugau

SEQ ID NO: 2721 - RNA, 16106 nt, Mus musculus
caacuguccucccccgcccccucgugcgccgagacgugaggacgccggcgucguaggcugagguggcagcugucccgcagucauggagcugccgcagaugccggagcugaugggguugucccuccuggugggucugcuggccuugguggccacggcggcuguggcgcggggcuggcugcgggccgaggagaagcccagccagcccgucuguaaguauaccgggucggguggcggugacucuggggacuuugcucccggccgccgcgugguacgaggagcguggagagucacggaccucaguuucccugguugugagaugaacuuucccguguagguuucggguugcaggugcaccccagggacaagauucuuuggaaccugggagcugcgcugcuacguggucggugacuuuuccugggacaccucccaccaccaccaccaccuauguccccggagcugcuacgaaagcucagucagaccccagguuugcuauguguucguguucuuagaaaaugggggucauuugaaaauacucuucagccaacucugaccggcaggaacguuuucugaacuccuguuaccuauaccuagcuucgaggucuuuuuaauacguucaguaaccgagaagcuuguaaaaguguggucuacacuguagaucuaaauuguaagcaucugaaaaggcaagcgaaauagacauuguauuaaauuucacaaaggaguuaauacuauaaaaggaucgagaguaugaauggucuugcugcuuuuauuuauuuauuuuuuagggaauaaaaguuggggauuccgggaacucuucagagaggguagggaacccauugugaguuucugagacaugguuucacaauguuguccaaacuggccuugagcucugguuauuacugccucagucucgggagcauuggaguauacaagugugugugugcuccccauaccuagccuugugaggugcuggguaggugaaacccagaggcucaagcaagugcuguuccacggaucuacacccccaaaucugugaugugaguuguucagggaugccaguguaggauuuugccugggaggccaaggaagaaagaagguucuuuuguuuguuuuguuuuuucgggacaggguuuuuuuuuuuuguuguuguuguuguuguuggguuuuuuuguuuguuuguuuuuguuuugguuuugguuuuuugguuuuucgagacaggguuucucuguguagcccuggcuguccugaaacucacuuuguagaccaggcuggccucgaacucagaaauccaccugccucugccucccaagugcugggauuaaaggcgugcgccaccaucgcccugcaagaaagacaguucuaucagcagcaaaacucaagaagacaagggauuccagaaacacuuggaggcugcuuggacauggugcggccauagaccgccugccuaggauuccccuagugaggggucaggaacagagcucaggguuagaacucuugccugugauaccggaggcacugcauuuuaucccagugcugaaagaauagcaguccagcaucugguuuaacgcugaaggucaccaugagcaaguucaauaauaaguuuuaauuccuguaagaauuagggagcaucuacugcuaccuaacacgugucagcuugguguguaaaccuaguucuccaagauaugcuuucauuuuaauuaacuauuuuuuuuuuuuuugagacagguuuucuauauauagcccuggcugucaaagacccacccacuucccaagugcuaggguuaaaggcauaugccaccacugcucugcuuucucucuuuuaaaaauuuuuuuuccugcauaugaguucacuguagcugucuucagacacaccagaagagggcaucagaucccauuacagauaguuuugagccaccaugugguugcugggauuugaacucaagaccucuggaagaacagucagugcucuuaaccacugagccaucucuccagcccccgccccccuuucucucuuuugugcaugugugagagagagagagauccagguggggccuugaacucacuauguagucaagccugacucugaacaaccuccucucccagucuuccugucuccaccugcugagugcuagaauuauuuauaggcagcauacaucaccaagccuggucucaauaucucuuugaggaaucaagauuuaaagcaguuaaauaacuuacccaagaccagaucuucagauccccuugugcauaucauuccccuacuuggggaugccugacuagaauucacacuacacaggcuaagccaugaacccacccagcugucucaguucagagagaugcuauacacacucagaaaauagccucuguaagaccacacucaugagggcuggggauguagaacauguguucuuccuuagcaugcaccaagcuacagucucaaccuucagaauggcuuuaaaaauagaagaaaagaauacacacugauaaagacugaauucaaagucaagucugauuucuaagccuuuuuuaaaaauuauguguauagauaauuuagauuugucuauagauuuguccauuuuuguggagauguucuugagggccaugggugccauagucucuagaacuagaguuuuaguugguuaugagccaccugauuugagugcugggagccaaacucugauucucugaauauaugcuuuuaaccaccgcgccaucucuccaggccuaguuuuguuuguuuuucagugcagcuggagauugaacuugaggcuuuguacaggcuaagcaagcccucuaccacuaagcuauaucccuagccccucccccuuuacaugaacauguauggguggaugcacauacaucucgugcacauggauuucagggaacaaccuuauauauuguuaggaacgcaaguugcuuccauugagauggagucucauauugacugggagggagcucaugagcuaggucaggcugguuaggcagagagcccuagagacuuuccugacuccaccuccucagugcugagaugacagcggauguguaaucucucagguguaaaccacacgcaccucauauuuacagagcaaguacuuugccuaugaacuaucucccccccuucucccaccucccuggccuguuuuugcacaugucacuuuuucaaggacaaaggcucuaucugggccguguugugguacccuacacagagccugagaaauccuaggcacucacucgaugcuucugagugcgugcaugggucaaugacacggcccuuccuuguaggucagaaagaaaacgaacccaagaagucaggauccaagaagcagaagcagaaucagcggguucguaaggagaagccucagcagcacagcuucacgcacccccuucuggcugcagcacugaagguacuugguacuccuggguacugaacacaugcaguauguacaugaagagugcucacgccuacaccuuguccuugguaaucugggcagauuacauacaccuaacucucagcagcagaguaggcauaccccuucuggcccuucuggcuggugguuguuucccuuguacugaggauugaauccagggccuuguauauucuaccuucaguucuuauuaagguuuggucucuugcuacguauuguaaucuuuaguacuggcuccacgaucugguugccucgggauguacaccaagugaugcuauguaacccugcuccuuaaguuaaaacuauugguugaauaaaaaugccuguagccuguagcugggcagaagagagguagcuggggcuucgcagagaccaugaggaggcaaacugaggggugaggagaggagacaaugucauggaguagaugaaugaugagaacauggcccugagggcuggucagcuggagacaaguuauaucauagaguuacugacagggaagaagacaaaaaucauagagggccgauaucugcccagcucuaguacuguuaauguuaauuauaaauauaaggggucugugucuuuuauuugggaacuaaaugaucaaagguggaguagaaacccccauugaguuauuacuauaucaaguucuuuuuuuuuuuaaagauuuauuuauuuuauuuuauuauacgugaguacacuguagcugucuucagacacuccagaagagggcgucagaucuuguuacggaugguugugagccaucaugugguugcugggauuugaacucaugaccuucagaagaacaguuggugcucuuaaccacugagccaucucaccagcccccgguaucaaguucuugauuggcagauuucuacaaaagggccccgcagcugagcaccuuccuuggggauucgaggcaggcauucugccaauaaacuacagcccuaguccauucucuuuaucuuuucuacuguuauuuuugaggucguuucacuaaauugcuuaggcuagcuucagacuuuacucuguagcucaggcaggccucgaacuuggcauccuaugcugagcucccaaggagcugggauuauagaccugugcuagaagagcuagcuuaccuuguuccaucucugaccuguccaucauccaagccccugagccagaguggcuccccuagguucagccuccucauccacuugagagguuucucauugguccuuccugcauucuuuucccuagagccacagugggaauauaucuugcauggacuucagcagcaacggcaaguaucuggccaccugugcggaugaccgcacuguccguaucuggagcacuaaagauuuccuucagcgggagcaccgcagcaugagagccaacguggagcuggaccaugccaccuugguacgcuucagcccugacugcaggugagacaggacagagccucaggcuugucugcaaaagcccagcuuauggcuguggccuucacauauccaguuggggcuuagugaggagggaucaggagucuaccuuguugugacguaaaaaggucauucagacaguauggagccuccuggggccucucggaggcuccgcucuauagaaggaagcagagacagaacauuccuacccuggauguuccaaacuccaaccugccaugaguuuuggaagcucuuagaacuuuuuuuuuuuuuuuuuuuuugagacaggguuucucuguguagcccuggcuguccuggaacucacucuguagaccaggcuggccucaaacucagaaauccgccugccucugccucccaagugcugggauuaaaggcgugcaccaccacugcccagccucuuaaaacuuccuaagcuccagaaauggaaggaaccaaagcucugaggcccguuuucucuuuguacuguagggacugaacucaguaucacacacaccaccaagcuacaccuucagccguucuugcuucuuggguuuuuguuuuuugauuguuuugagacaggacacggggccuugcuauguugaucucacuagguaaugcagcuuggccuugaacuugugaucucucugcccagucuccccugugcugggauucaauguggccuuguguacuuuuguucguggaaauauaagcaaaagucuguuuacucuagguagggcauaaccacagaccagagaauaauugcucuguguagcacuuggugagccauuggguuuaguuggguuacuuacaggauuauggguaagaggaugcuuaaaagaacauggacagcucuuugggagucacaucauagaaggcccauguuagcaugaaugacgaugacuugcguauugggcuucaaggcagcuccaucagacaguccucucuucccagcaaugguuucuaucucuguagccuuggggagggaggggccuuaugaguauugagacucucuuagcuuccugcuccuuaagucucaaagccucucucaucuugggaggauauguuuuuuuauguuuagugcuaaugaucaaacccauagccuaccacugagauacauuuaugucuucgaauuguuuuguuuuggaggguguguguguguguguuugugucugugugugugugugugugugugugugugccagagaacaacagaaguugagguuuuuuuccuucugcguggguuccugaguauugaacucguuagccuugccaagcaagugcuuuuuuaccugcugagccauuugcaagacuuuucggggacuagagugauggaucagggcuuaagaauacuggcugcccuuauacaggucccaaguucaauucccagcacccauaugacagcucaugaucgucuguaacuccagacucaggaaccaaugucuucaucuggccucuaagggcacuaagugugugugugugguacacaaacauacacacacacaaagaaaucagauacacaaacauuuaaaaaaaacuuuuaaguuaaaaaagguuuugaggggcuggagagauagcucagugguuaagagcacugacuguucuucugaagguccugaguucaauucccagcaaccacauaguggcucacaaccaucugugaugagaucugaugcccucuuuuugugugucugaaggcagcaaguguacucacauauauaaaauaaauaaauaaauaaauaaauauuuaaaaaaaagauuuugaaccaagggaucuauuguaagacuggacaaggggcaaucuugguuuucucuagaaucuaggacacauaggccucugcccaggugaggaaguagcucugguuugcuugucucuagagccuucauuguuuggcuggccaauggggacacccuccguguuuuuaagaugaccaagcgggaagaugggggcuuuacuuucacggccacaccagaggauuucccuaaaaaacacaaagcgcccaucaucaacaucggcauugcugacacagguaagggaagucuccuggguggcauuuacucgagcccugaaagugugccugagucauaacuuguucuuuguuucauuugaaaaguuuauuuucacuuuauguauauggauguuuuauuugaauguaugucuauguacuaccugcgugcagugcucacagaggccagaagagggcauggggucuccugggaucauaguuaagaccaauugugagcugccaugugggugcucagaaucaaguccugguccucuggaagagcagccagcgcucucaacuguugagccaccucuccaggccucccuccaccuuguuuugcauuuauuuuguguguuuaucauagcacacauguagaugucagcccaguaggucaugaggccugguggcaaggaccuccaccaacugagccagcuugcuaguaucugaguuguauuugguuuuuguuuguuuguuauuuuaaagauuuauuauuuuauguaugugagugcacuguaguuguacagaugguugugagccuucaugugguuguugggaguuaaauuauuuuuuaggaccucuccucacucuggccaaccccucucgcuccggucagccuugcucgcucagucccugcuagcucuggcccagauuuaugauuauacauaaauacacuguagcugacuucagacgcaccagaagagggcgucagaucucauuacaggugguugugagccaccaagugguugcugggauuugaacucagcagucagugcucuuacccgcugagccaucucaccagcccugaauuguauuugucgaaugaguuguuacugccugaguuuugcuuggugucccugugaucgaggaguccaugagagccaaacagugagagcccacccuuauugacacagaauuaccuguggugaccuuuggccugggaaaggagcauggauacuucuuagagcagugauccauuauuuuguugggaggugacaaucuggucaugaccuugggcuuacaacugucuucucaucagggaaguucaucaugacggccuccagugacacaacuguccucauauggaaucugaaaggucaggugcuuuccacgaucaacacuaaccagaugaacaacagucacgcaguuaucuccccauguagcaggugaggaagaagaggaugaggguagguacgggguagguacagagcagggaggcagcuucuaggagggguguagggacacuggaguagaaguccuagcucuccaaacgggaagggauuucacacaagccccugaaguccuuagugucuguuucuuuuuuuuuuuuuuuuaaagauuuauuuauuauuauauguaaguacacuguagcugucuucagacacaccagaagagggagucagaucuuguuacagaugguugugagccaccaugugguugcugggauuugaacucuggaccuuuggaagagcagucgggugcucuuacccacugagccaucucaccagcccagugucuguuucuucaccucuccucuuuuuauuuuugcagugcugaggguggaaaccacuguuaggacauguuaggcaaaugcucagccaccucucaacaugcguagcccucaccugaggguuugagucaggauuucacuguguaucccuggcuggccuagaacucauuauguauaucagauggccugacacucacugagaucugccugccucugccuacugaggccuuggcuuaaagaugugugcugccaugccagacccuuuuaauuuucuauuuuuuucugagacaggguuucucuauacagacuuggcuauccuagaacuccuauauagaccaggcuagccuuaaacucaccgauccaccuucaucugccuuuaauuaaguauggaaauuaaagguguccaccaccgggcgugguggcacaugcccuuaaucccagcacuggggaggcaggggcagguagauuucugaguuugaggccagccuggucuacagagugaguuccaggaccucugccucccgagugcugggauuaaagaugugcgccaccacgcccggcuaacauuugaguuuuaagaguuacaugaauuacaugacagguuuguggguucguguggcuucaccccagaugugaaggucugggaggucuguuucgggaagaaaggagaguuccaggaggugcugcgagccuuugaacugaagggucacucugcaucuguccacucuuucgcuuucuccaaugacucucgaaggugagugcuucgggacaucuucccuuguucuuucccuuguucggucuuauuuaguauagauaaccaaugcuggcccuggaguccuaacauaccugccucucucccucauaagaacugagguacaggugugaauaccuugccugguaauuguuuuguuuugcucuguucauguuuuucagacagagucucacuugguagagcaggcugcccuugaacuuacagugacccucuugucuugccucagccccccaaugcugggguuauagguguguaccagcaagcugggcugagcagugagucugggguacuucugccugucugggcugcaguucugaaaaggguggaagacuugagucucggcaggauguaaccuuggguuccuagcugcuggcucccacagguugaucuaguguuucccgagcuggggaugcugaggcucuagcugugauuucccacauugcaggauggccuccgucuccaaggaugggacauggaagcuaugggacacagauguggaguacaagaagcagcaggaccccuacuugcuacggacaggccgcuuugaagaggcgagcaccaugccuugccgccuggcacucuccccugauacccauguccuggccuuggccacuggcaccaauauucaucucuucaacacacgccgcggggagaaggaggaguacuuugaguguguccauggggaguguauugcugacuugacuuuugacaucacuggccgcuuccuggccuccuguggggaccgugcagugcggcucuuccacaauaccccuggccaccgggcugugguggaggagaugcagagccuccugaagcgggcauccagcgaaaguacccgccagaggcugcagcaacagcuaacccaggcccaagaggcccucaagagccugggugcccugaagaagugacucuggcuccagaugggucuggcugucuggcccagcagcuccugcuccccaggggccccugggauggagaccuggaggaaacucccaguuuucuuccuggugcccccuacuuuuuccuauugaaacuauucuugcauacucagauaucucucucucuguuucucccuucuuguuugacucuucccagacugaaagauacuguuuucucacaggcccuagggguagaaucugucuucaucuagcacggagaaggggaguagacagaagacagacagagcaaaaccuuugaugguuuggcaaaagacccugacauccaaagaauuuugucaguguagagggaaaacccuagggucaccagggacaaauugcuguuuuauaagaguucagaacguguuuuauaaugcugcguggugagccuccaucuggaccaggcuccugauagcagcaagaaguaauuaaggacuggucuuuguuggcauuggucuguaauaucagcacuauacaggcaaaggugagaggaucagggguucaaggccagcuuggacuacauagugaauucuaaguccuccugggcuccauucauauggagagaaaccuuggcgagauuguuuuucccugggcuucaguuuucuuauuuguaaaauggggaacgaugcucucuguggccuuccugcaaagaugcugugaggcuaggaguguuauaaugcucccacacauggagcauaacaggucuguccagugucauuaccuaccagguaaacacaggaugcagacgguguucugcaagcaaacuaggaaaaaaccacagcccuugugaagccaaguuuccuagggcucugcuugcucauucaucuuggauaaacauggugguuugguucccgugccuugagaaguaaugccaucgcaaaaggguguuccucucucagggacuucuugaacccaucacuucagggccugcuucaugggaccagcuagugaugcuggcuaacacagacagacaagacuaggccugcugccaaggguaaaagcuggugggaggaccuagaggcuggugucugugaugugcuuuuuguucauuuacagcugcaggggagguuguggacaggaggcuugaccguagucaauccaggacaauaauggggaaagaauggaauccacccacuaagagacugggucucagccauguacauuugaagacugcuuggacuggucuuuguuggugaggaagauggcaggcaucuaggaaggcuugaaucuagcaaaagguucccaucccaguuaguuuuuaucucucuuaaaaguagggccucuuccugccacccucaaugcuacaggauguuuauaacaaggcacaacccugaaguugaccuugauggcucccuugucacccucuccuucuaccacugcugcuacaugcagauggccugcagcaucugcagcucucccacucuucuguuaccaucccggucuuagccacugucccguaguauauggauaguaccucuguuuccaaccacauuacuucaagucaguuuucuacauaguuuagccugcuuugggaaaacaaaaaugguauuuuggaucaugccauuuccaaaaggcuuccuucucucuacacuuggaauuaaaccacaaacucucuuuguggccugcguaguguugugaaauuuagccacuccugugaucuuucuuugcaaugguccaaucccauucuuccuauucuuugcuaacccaggcauuuggcaggcucugggugugggcuggucccucuugugcugcaagcauuuuuccuuucuguuggcagacuugucagugcgauucaguccuuguaaguuucacuggaaaacaguugccaccucaccaacucccuccgaaguagccauuuccaccaauccugucccuccuggugcccugccgcuuuuccuuuuguaugaauuggugcuuucugaagccaucuugucuggcuauguguuuacugcagugucagagaagggcagugaguggggguuaagagugggaauuaggcccgucaccugguugugcuauggaaggaaacgguagagacugcacugggcugguggccguguguccugggugcacagugggagggagccgcuacugacugauaagccgcagaaguugccaguugcagagaaguuagaugcuggcacuguacuuugcaaggaggcauccuuguggacugcaccaaacccugacgggggagggcgcagcucaucagucucauuggugcugaaggauucuuccuuacuuuuccuuuugcaguccugggaauggaagccagggucagguagacaaauagcucugcuggugagccaugccucaaccccucacugggagaugcuagacgaagacucuccucagccacagcccuagcccucacuggacaaaugcuuugccuccaagccucuuugcagcaguuugugaaauugcugaagaaugcguuggaacagaacccuuguuggucugcuuugcucugggucccgagucaacuagccaggacaaaguaagcucucaauaaaugggacucugacuagaaguaaugaccaagcuuuugauauacuuuguuuucugcacuccgcucucuauuguggauucagguuucugauaagaucagccauauugaagaccauguggccacacacggauuugggcuucugacuacacagcugugccucaggcuugugugugcgugugggggucuggugggcaucugcucugguugucggaaagcaucugaaaaugcguucucuugcuucugcacucgugucuugagaaguaacuggugccguggcugcacagggaaggcagugaacccuagcaagaaugcugagcugcugaagucagaagucuguucccaaacuggccaauucacuggccuguggccuggaguccuguaaucacagaggcugccagaguucgucuccccacuuguggaaugggaauaaauguuguucuguuaccgcgcauggugauucuuugcuuguguacaugcuuauggguuacacuggggguuagauaugugcucuugccccaaacccauuuuuuuuuguguguguauuugagaaaaagacucacuuuguugucuuggcuggccuggaauuuauagaaauccaccugucuuggcuuccugagugcuugguuuuaaggcaugugccaccauacacagguccuuucgccuguguuuugagcuaauguuucacuaaguugcuuuugaucuugagauucucuagcgugucaggccuacaucugcaugccugggagcugugaguucugaaugaguugggagcacuacaaaaggucauugcacagacugcccagggguaggcuagagcuguucguguugcccuaggaaaggugucuggcuaguacuacaggcugccaagcuuuucugauccucgagaguagaggcggcauugaucugcugauucuacacaaggugugguagugcaugcaugcagcccaagggcuuggcagguugaagaaccacgagucagcacugcauagacugucuaaaacacaguucaugaauguauucauuuuaguuuuuugagaaaggguuucucuguguagcacugguuguccuggaacuuacucuguacaccaggcucgccucaaacuuuacagagauccaccugccucugccucugccucccaagggcugcgauuaaaggcaugugccaccaccauucagaucuaaaacacaaaauuuaauacuaauuuugaagcuucuuaauuuuuaaaauaaagguaugggugagcuaaagguggugcaaaggucaaccaacuccaauuucaggaggaaaaccgcaaaguccacuugagcaaacaucugauggcaauagccccccauccuccaccccucuuaacaacagccaguuagucuacagcagcauggucaagguacauauaaacuaagacaucuggcagaaaaaagauaacccagccauccuauuugucaggugguuuugccccuguguuugguuccugcaaauuacagcagaaaugcaguuuuaaaaauauuaauuugcugaccuguauggaauuccccaagcuugcuguaaccaccauaaauacccugcaccccuagacucgaggcucucacuucugaccacugcaccggugauggagugcucuugagcuccuaauaaaagcccauauguguuuacaucagaauugacucccugguggucuuugggguccuugcgauuugggcauaagagugguacuuacuuccacucgggaagcugagauagguuuagcaaguuugagauuagcugggcuauaguaauauccugucuuaaauaaaauggaugucagacgguucaguugcuaaaggaucuugcucuacaagccugucaaccuguuuaauccccaggucccacauguggauagaaagacaucagugacugcucuuuggccacacauauccugcacacucaaaauacuuuaaaaaaugcaaagaggcuggagagguggcucaaugguuaaaagcacuggcuguucuaaagggcccaguucauuucacccacaauggugguugacaauuguaacuccagccagugugacccagucagcaagcuccagaccagugaaaaauccugacacgccugaagagauggcccagcgguuaagagcacugacugcucuuccaaagguccugaguucaauucccagcaaccacaugguggcucacaaccaucuguaaugggaucugaugcccucuucuggugugucugaggacagugacagugaacuuauauacauuaaauaaauaaauaaauaaauaaauaaauaaauaaauaaauaaauaaaagagaaaagagaaaacccccugacacaaaacacaagaugauggacgcccgaagaaugacggaagaaauuuacuucuagcuucuacacacacaaaaaacaaauaggcauacacauguguucacaaguacauacaaaaugucuuucguuauuuuuauguuauugucacacugagcagcagugguaguggugguagugaccugggguacacaccuuuuaucacagcacucaggagguaggggcagguuugaggccacacuggucuacagagcuaguuauagaauagcagggccacacagaaacccugucuugacaaaacaacgccccaaaauuuuauauauguguguguguauacauauauguguguguguauguauacacacaccaauacaagauuauuguagcuggccaggcagugguggcacaugacuuuaaucccagcacucgggagguagaggcagguggauuucugaguucaaggccagccuagucuacagagugaguuccacaccaccugggcuacacagaaaaacccugccuacaaaaauuguagccauauguaguggugcaugccugcagucuaggcucuagagugacugaagugggucauaugaguccaggaguucaccggcagcuugaucaacacaaaccccaucucuuuagagacagaagaaagaaguauacuguguuaugacuggagaguaacuuucacuuugcuaggucaacucaguacucuccccaacuugucucuacaaacaaucuggacucaggucuucuguagcuuguguucagggcacgacuuuugagauccauguucauggaacagaacauaaucuucugaaguugcaagaauaugugacuuaucacaaccaugugccuggucugucuuaugaugauggccccaauuccaacaucugguuucacagaguucagaagaguuuagcuuggggaaaaaaaugguuuugguuuuuguuuuuuauuuuuaaugauuuauuucaugugcauuggugucuugcuuguaugucugugugagggugccagaugcccuggaacuggaguuccaaacaguugcaagcugccauguaggugcugagaauugaacacagguccuuuggaagagcagccagugcucccaaccauuaagccaucucucaagcccuauagcuauggucucugcuuucccuuuggcauacaaauugcugcuugcaguuguugugauuuuauuuaagcacaaauaaaccaugcaugu

SEQ ID NO: 2722 - RNA, 6855 nt, Mus musculus
cagugucguagagcgcuugaggcggggagagcauggggcuguacgcggccgccgcggcggugcuggccggcguggaaagccgccagggcucccucaagggguugguguauuccagcaacuuccagguagugaggccgggggcuggcaagccgggcuggggagcggggcuuguccgggcgggagggcgaggcgaggcgaggcccgcguggggugcagcggguguccccugugucgcacagaaccugaagcaguuguacgcucuggugugcgagacgcagcgcuacucggccgugcuggacgcugucaucgccagugcugggcuccuucgcgccgagaagaagcugagaccgcaccuugccaaggugagcggcggccagaggcuguuacccgugcguggcucucacacuucuuucuggggucccaguugagcugggucagaugugacuccccuuggagcauugcaggaagggcuaaguaggacgaaggugcaaacuaguaguggcugaggcuaccuaccggacagggugaugauggcaaggucggucgggguccagagcucugcuggcgaccuggggggugggguaggguggggagggggagcuucaggcauggggcaggacacgggguuugcagauggcauuugcucucgucucuuuacccgccugccuggaugccugucuuuuuguaaugcugggagauugaacccagagucuccaacaagccauagaagaguucucccacugagucacacccacaacaccucauuggacagcaucacuagacagaugcucuauuuuugagcaguacccccagccccucacugggggauucuaggcaggugcuuauugcugagcugcaaucccuauuucuucucugguggauacuaagcaagcuuccuacccuacugcugagccaccgccuccguugccuccucuuccuucucccccuuucguccucuucggucuuuagagacaggcuuucucugugucacccaggcuguucuggaacucacucuguagaucaggcugaccucgaacuuacagagaaccgcuugucucugccucuugagugcugggauuaaaggcaccauuacccaguuagcuuguaguuuucuugcuuaugcaucugauguugcuggcauuauggacauuugcccuaacaucaugccauuaauuucuuuugugaucuugggcaagagaacucuauugacaugaccaucuggacagguaccuacuucucccacuggaggguuuuaugguguuaauaguuuuguguuuuuuccuguccaggugcuaguguaugaauuauugcuggggaagggguuucgaggggguggaggccgauggaaggcucugcugggccggcaccaggcaaggcucaaggcugagcuggcccgacucaagguucaucggggugugagccgaaaugaggaccuguugcaagagagcuccagaccuggccaaggugacuuggaggcugaggggcgggaggggagugacccucagaaggcucaccucccuccccacuugaccacugugacuucuagccuaccagguaccacgguucgugcgugugaacacgcucaagacccgcccugaggaugcaaucgauuauuucaagagacaagguuucuccuaccagggucgggcuuccagguaagagcugaacaucgugcccgggugccuucauuuuccucuguguccagguucucaaggaaguaggagucuguuagaggggagacuagguguguguaugugggauaaucacugcuuucucuggauguuuuuccuacuuucccaacagaauuuucuuuguuuuuaagaaagauguugcuuuuaaguggugcacaugucugugcaugggugagggcaugugccugaggaggacauuggacugcuggacacggugcuaggaacugcacguagguccucugcgagagcagugugucuuccuaacugcugagccacgucucuggcccuggcagcaguucucugcagucucuucugagaccuguuuuuuuuuuuccccugaacccugguguucuugcgguucuuguucugcauucugugacccccuguuugcucuccagucuaacugcccucccgccccugccaccuuuccgcucuccugucuauaucacagccucuucagcucuaagccaacacaccacaggacacaccuuuaacauuugagagacagaggcacgagguccaggguccaggccagccuggccuacagagugaguugccagaguuacacagaacccugauuugaaaaaccaacccaaccaaacaaacccauaacaaugugcagucuguaaucuuagggagcagugaaggguuucugaaggcucagugaccaaaauuaauucagaauuaaacauguacuggagccaggguguucuuagcaacauguauugauguugcacggugugaggucauauagccuggacucugaacacacagugcaugcacuugguacugcguguccccgcacagcccacagacacuucgagaagcaccuuggcacagcuuugagacuacugcguaguagggacugcaauguucuacugcaugcacagucuaaauacagaaaauaaagacuaacauuacccugcugucaaacugccguucuuuuuuuuuuuuuuuuuuuaaagauuuauuuauuuauuauauguaaguacacuguagcugucuucagacacaccagaagagggcgucagaucuuguuacggauuguugugagccaccaugugguugcugggacuugaacacuggaccuuuggaagagcaggcggguacucuuacccauugagccaucucaccagccccaaacugccguucuuagucaucaaaauagucuuuggauugcauugcauuagagugucuaguuuguuuguuuguuuguuuauuguuuaaauugguguuuagcuggacagugguggugcacgccuuuaguuccagaacuuggaaggcaggggcaggagaucuaugaguugaacgcagacuggucuauagaguaaguucuagaacagccaaggcuuauacagagagacccugucucaaaaaacaaaaccaaaaacuaaauuaaaaauuaguauuugaucuguugacuugaguuuuacaaaaaaauuauuggauagauuuuggcuuuagaucaggacaaaacucucaacaauuuucaaauggcucccaacacacuucugucauuuugugucacauauuuauguaaagugcuguucucuaccuuuuauaaaaucaauauaccaaccuaauuuaaacucuuuuaauucucauuaguguauguuaugugaggccaugccuaugccacgugccuguggucagcaaacagacuuucaggaaugggucuucucugccccucugcugguucaaggcauugccucagguccucagacuuguguaguaagugcuuuuaccuggugagccacccacugacccuugcagcuuccacuccuuuuccuuagaggcaggggacaagguuauauaccugucaucccagcacugggagcugagauaggauugaguuccagauccugugucaauaaaacaaaccagaccuagagcuagaaaugcagcccaacagcuaaagggcacacauugcucuugcagaggaccugaguucaguuccuggcacccguguuguguggcuuguaacuccuccuucauggugcacugaugccucucggugucugcucucacuugaacauaccuacacauagaugcauaauuuaaaacaacaacaaaucuuuuuuaaaaaugaaaagcaggagaguuaagggcacagacugcuuuucuggaggaccagaguuugguuccuagcagccacaugguagucacaacuaucuguaacuccaguccuagggacuccgacucccucuucuggcccuuuacaggcacugcaugcauaguggugcacaaagcacuucaacacagaaaaucaaaagguuaaaauccaaaccuaacuggugguuuuccccgccagccuggaagacuugcgagcucucaaggggcagcauuuucuuuuggaucccuugcugccugagcuucuuguauuuccugcacagacagaucugcacgagcauccacucuaccgugcuggccaucucauccugcaggacaagguagggagaugggaggagagagaggaaguauggggaagugacugcagggcucuguguucgcccagcuuccuaccaucuuguguccugcuaggccagcugccucccagccaugcugcugucccccccgccaggcucccaugucauugaugccugugcugccccugguaacaagaccagcuacauugcagcccuucuaaagaaccaggggugagugcuggcuaugagcuuugaggcugagggaggguggggucaaaucuugccuuuuguaggggaaagucucacuaagugccucuggcagcucauagccuagucccaagccaggcuauugguuugagacaaaacucccucagcuuuugggguugucuguggcagugaccccuauggaugacuuaaauagguuguccuagcuuuuuggguucaugugauaguguauuggggauugaauccccuaagcaugcucgggaagcacgcucccacugagccacacacacaaccccucacuggggguggggugggggggggcuucuagguaagcccucuauugcugagccacgccccagaccuguguccuggcuuagcacacauuacaauuugaugauaucuaaccgugggccucuguguuccauaaauguucaguucaggggcuggcaaaauggcucagugagcccuugcugcucuacuagcacccaugucaggugacucacaaccuguucuaucuccaguuccauggcuuccaacagcguuuucuggccuccacagacgcccgcacacauguggcagacagacacacagaagggaauucucaguucacucugccucugcucuucucccuaggaagaucuuugcuuucgaccaggacgcuaagcggcuggcagccauggcgacguugguggcucgggcuggggucucuugcugcgaguuagcagagaaggacuuccugacagucucucccucugaccagcguuacagccagguccaguacaucuugcuggauccuucuuguaguggcucuggugagaaggggacaguguggcucuggucguaggccuguagcagcuuggauacuggagaugcccaguuagucuugguguugcuuuggacuuguaacuacaaaugcucucaucuuuaaaauggggguuuggguguggaaauggcuucauaauugcagcucuuuuuccacaggcaugcugagccggcagcuggaggaacauggggaaggcacaccuagcaaggagcgcuugcaggccuuggccggguuccagcagcgggcucugugccaugcacuuagguuccccucucugcagcgccuagucuacuccacguguucccuuugccaagaagagaaugaagacgugguccaggaggcucuacagcacaacucggggacauucagguagugguccccaggucugaggucacaaguugcuucucaccagggucugagucuuccccuucuccacagguuggcuccuguccuacccacauggccucaccgaggucugaguaccuuuccagggucugaacacugccuccgggcuuccccugagaccacgcucacugguggcuucuucauugcuguguuugaacgugcagaggugguaccaacgugagugaggagcucaggcuuuuguuauuguuugaggcaguaucuguguaacccugguugaccuagaacuuacuaucuagguagaccaggcuggccccaaccuuuuuagauccgccucugccuccugagcuaaggugugugcuagcacaucugcuaaccucuggccucuucuuccagcccagccccacagaccgaugcaauggauccagaaccucucagccaagucccaaagagaaagagaagacgcaaagcagcaguuggugccagcaugcagccaagcacauaggcacugagugccccacagccagcagaaccaugcuuacugugggaacccugcucuucugggaagggaagaugauguccuggcacucugugucccucacugggcccaguccuaccagucacgaguucuucgcuucacaaauaaagggcaaacucacaucuaugacagaucacaguuuuauuuuuaaugacauaagcaagaacaaucucacauucauacuaaaaaucucagcuacacucacaggaacucagucuguggugggaagccccagccucccugucccuguccagcgugagcacggacaaaugugcucacacaccgaggcuacuccaggaugccuccgcaggggcccuggauacaggccugcuguggagcugagguaauuagcucagacugaauugcagggaggccccuuccuuaccugaggcacagguagaggcuucguguucagacccccacccauccccauccucacaggcauuugggaccugaggucaagcucuucuccagcuccacacaacccagccuaaccccugccauaaaacauucaaucccagucacaaagggaaggggaccagggacagcuacaucacacuguuuauaaaagaagaaucacacuuauacgacaugucuagaaggagcucugcccccuuaggggagcugcuggggacagcugugagccccuccuucacacaggcauaacuauacagcuaauucuacuauucaauagcauuuauacuuaaccaccucagugaaccaagcuugaaggaauuuuaaaggcaauuuagcuuaaauacaaaaauaaauuuuauuuuguuaaaaaau

SEQ ID NO: 2723 - RNA, 6855 nt, Mus musculus
auuuuuuaacaaaauaaaauuuauuuuuguauuuaagcuaaauugccuuuaaaauuccuucaagcuugguucacugaggugguuaaguauaaaugcuauugaauaguagaauuagcuguauaguuaugccugugugaaggaggggcucacagcuguccccagcagcuccccuaagggggcagagcuccuucuagacaugucguauaagugugauucuucuuuuauaaacagugugauguagcugucccugguccccuucccuuugugacugggauugaauguuuuauggcagggguuaggcuggguuguguggagcuggagaagagcuugaccucaggucccaaaugccugugaggauggggaugggugggggucugaacacgaagccucuaccugugccucagguaaggaaggggccucccugcaauucagucugagcuaauuaccucagcuccacagcaggccuguauccagggccccugcggaggcauccuggaguagccucggugugugagcacauuuguccgugcucacgcuggacagggacagggaggcuggggcuucccaccacagacugaguuccugugaguguagcugagauuuuuaguaugaaugugagauuguucuugcuuaugucauuaaaaauaaaacugugaucugucauagaugugaguuugcccuuuauuugugaagcgaagaacucgugacugguaggacugggcccagugagggacacagagugccaggacaucaucuucccuucccagaagagcaggguucccacaguaagcaugguucugcuggcuguggggcacucagugccuaugugcuuggcugcaugcuggcaccaacugcugcuuugcgucuucucuuucucuuugggacuuggcugagagguucuggauccauugcaucggucuguggggcugggcuggaagaagaggccagagguuagcagaugugcuagcacacaccuuagcucaggaggcagaggcggaucuaaaaagguuggggccagccuggucuaccuagauaguaaguucuaggucaaccaggguuacacagauacugccucaaacaauaacaaaagccugagcuccucacucacguugguaccaccucugcacguucaaacacagcaaugaagaagccaccagugagcguggucucaggggaagcccggaggcaguguucagacccuggaaagguacucagaccucggugaggccauguggguaggacaggagccaaccuguggagaaggggaagacucagacccuggugagaagcaacuugugaccucagaccuggggaccacuaccugaauguccccgaguugugcuguagagccuccuggaccacgucuucauucucuucuuggcaaagggaacacguggaguagacuaggcgcugcagagaggggaaccuaagugcauggcacagagcccgcugcuggaacccggccaaggccugcaagcgcuccuugcuaggugugccuuccccauguuccuccagcugccggcucagcaugccuguggaaaaagagcugcaauuaugaagccauuuccacacccaaacccccauuuuaaagaugagagcauuuguaguuacaaguccaaagcaacaccaagacuaacugggcaucuccaguauccaagcugcuacaggccuacgaccagagccacacuguccccuucucaccagagccacuacaagaaggauccagcaagauguacuggaccuggcuguaacgcuggucagagggagagacugucaggaaguccuucucugcuaacucgcagcaagagaccccagcccgagccaccaacgucgccauggcugccagccgcuuagcguccuggucgaaagcaaagaucuuccuagggagaagagcagaggcagagugaacugagaauucccuucugugugucugucugccacaugugugcgggcgucuguggaggccagaaaacgcuguuggaagccauggaacuggagauagaacagguugugagucaccugacaugggugcuaguagagcagcaagggcucacugagccauuuugccagccccugaacugaacauuuauggaacacagaggcccacgguuagauaucaucaaauuguaaugugugcuaagccaggacacaggucuggggcguggcucagcaauagagggcuuaccuagaagcccccccccaccccacccccagugagggguuguguguguggcucagugggagcgugcuucccgagcaugcuuaggggauucaauccccaauacacuaucacaugaacccaaaaagcuaggacaaccuauuuaagucauccauaggggucacugccacagacaaccccaaaagcugagggaguuuugucucaaaccaauagccuggcuugggacuaggcuaugagcugccagaggcacuuagugagacuuuccccuacaaaaggcaagauuugaccccacccucccucagccucaaagcucauagccagcacucaccccugguucuuuagaagggcugcaauguagcuggucuuguuaccaggggcagcacaggcaucaaugacaugggagccuggcgggggggacagcagcauggcugggaggcagcuggccuagcaggacacaagaugguaggaagcugggcgaacacagagcccugcagucacuuccccauacuuccucucucuccucccaucucccuaccuuguccugcaggaugagauggccagcacgguagaguggaugcucgugcagaucugucugugcaggaaauacaagaagcucaggcagcaagggauccaaaagaaaaugcugccccuugagagcucgcaagucuuccaggcuggcggggaaaaccaccaguuagguuuggauuuuaaccuuuugauuuucuguguugaagugcuuugugcaccacuaugcaugcagugccuguaaagggccagaagagggagucggagucccuaggacuggaguuacagauaguugugacuaccauguggcugcuaggaaccaaacucugguccuccagaaaagcagucugugcccuuaacucuccugcuuuucauuuuuaaaaaagauuuguuguuguuuuaaauuaugcaucuauguguagguauguucaagugagagcagacaccgagaggcaucagugcaccaugaaggaggaguuacaagccacacaacacgggugccaggaacugaacucagguccucugcaagagcaaugugugcccuuuagcuguugggcugcauuucuagcucuaggucugguuuguuuuauugacacaggaucuggaacucaauccuaucucagcucccagugcugggaugacagguauauaaccuuguccccugccucuaaggaaaaggaguggaagcugcaagggucaguggguggcucaccagguaaaagcacuuacuacacaagucugaggaccugaggcaaugccuugaaccagcagaggggcagagaagacccauuccugaaagucuguuugcugaccacaggcacguggcauaggcauggccucacauaacauacacuaaugagaauuaaaagaguuuaaauuagguugguauauugauuuuauaaaagguagagaacagcacuuuacauaaauaugugacacaaaaugacagaaguguguugggagccauuugaaaauuguugagaguuuuguccugaucuaaagccaaaaucuauccaauaauuuuuuuguaaaacucaagucaacagaucaaauacuaauuuuuaauuuaguuuuugguuuuguuuuuugagacagggucucucuguauaagccuuggcuguucuagaacuuacucuauagaccagucugcguucaacucauagaucuccugccccugccuuccaaguucuggaacuaaaggcgugcaccaccacuguccagcuaaacaccaauuuaaacaauaaacaaacaaacaaacaaacuagacacucuaaugcaaugcaauccaaagacuauuuugaugacuaagaacggcaguuuggggcuggugagauggcucaauggguaagaguacccgccugcucuuccaaagguccaguguucaagucccagcaaccacaugguggcucacaacaauccguaacaagaucugacgcccucuucuggugugucugaagacagcuacaguguacuuacauauaauaaauaaauaaaucuuuaaaaaaaaaaaaaaaaaaagaacggcaguuugacagcaggguaauguuagucuuuauuuucuguauuuagacugugcaugcaguagaacauugcagucccuacuacgcaguagucucaaagcugugccaaggugcuucucgaagugucugugggcugugcggggacacgcaguaccaagugcaugcacuguguguucagaguccaggcuauaugaccucacaccgugcaacaucaauacauguugcuaagaacacccuggcuccaguacauguuuaauucugaauuaauuuuggucacugagccuucagaaacccuucacugcucccuaagauuacagacugcacauuguuauggguuuguuugguuggguugguuuuucaaaucaggguucuguguaacucuggcaacucacucuguaggccaggcuggccuggacccuggaccucgugccucugucucucaaauguuaaagguguguccugugguguguuggcuuagagcugaagaggcugugauauagacaggagagcggaaagguggcaggggcgggagggcaguuagacuggagagcaaacagggggucacagaaugcagaacaagaaccgcaagaacaccaggguucaggggaaaaaaaaaaacaggucucagaagagacugcagagaacugcugccagggccagagacguggcucagcaguuaggaagacacacugcucucgcagaggaccuacgugcaguuccuagcaccguguccagcaguccaauguccuccucaggcacaugcccucacccaugcacagacaugugcaccacuuaaaagcaacaucuuucuuaaaaacaaagaaaauucuguugggaaaguaggaaaaacauccagagaaagcagugauuaucccacauacacacaccuagucuccccucuaacagacuccuacuuccuugagaaccuggacacagaggaaaaugaaggcacccgggcacgauguucagcucuuaccuggaagcccgacccugguaggagaaaccuugucucuugaaauaaucgauugcauccucagggcgggucuugagcguguucacacgcacgaaccgugguaccugguaggcuagaagucacaguggucaaguggggagggaggugagccuucugagggucacuccccucccgccccucagccuccaagucaccuuggccaggucuggagcucucuugcaacagguccucauuucggcucacaccccgaugaaccuugagucgggccagcucagccuugagccuugccuggugccggcccagcagagccuuccaucggccuccacccccucgaaaccccuuccccagcaauaauucauacacuagcaccuggacaggaaaaaacacaaaacuauuaacaccauaaaacccuccagugggagaaguagguaccuguccagauggucaugucaauagaguucucuugcccaagaucacaaaagaaauuaauggcaugauguuagggcaaauguccauaaugccagcaacaucagaugcauaagcaagaaaacuacaagcuaacuggguaauggugccuuuaaucccagcacucaagaggcagagacaagcgguucucuguaaguucgaggucagccugaucuacagagugaguuccagaacagccugggugacacagagaaagccugucucuaaagaccgaagaggacgaaagggggagaaggaagaggaggcaacggaggcgguggcucagcaguaggguaggaagcuugcuuaguauccaccagagaagaaauagggauugcagcucagcaauaagcaccugccuagaaucccccagugaggggcuggggguacugcucaaaaauagagcaucugucuagugaugcuguccaaugagguguugugggugugacucagugggagaacucuucuauggcuuguuggagacucuggguucaaucucccagcauuacaaaaagacaggcauccaggcaggcggguaaagagacgagagcaaaugccaucugcaaaccccguguccugccccaugccugaagcucccccuccccacccuaccccaccccccaggucgccagcagagcucuggaccccgaccgaccuugccaucaucacccuguccgguagguagccucagccacuacuaguuugcaccuucguccuacuuagcccuuccugcaaugcuccaaggggagucacaucugacccagcucaacugggaccccagaaagaagugugagagccacgcacggguaacagccucuggccgccgcucaccuuggcaaggugcggucucagcuucuucucggcgcgaaggagcccagcacuggcgaugacagcguccagcacggccgaguagcgcugcgucucgcacaccagagcguacaacugcuucagguucugugcgacacaggggacacccgcugcaccccacgcgggccucgccucgccucgcccucccgcccggacaagccccgcuccccagcccggcuugccagcccccggccucacuaccuggaaguugcuggaauacaccaaccccuugagggagcccuggcggcuuuccacgccggccagcaccgccgcggcggccgcguacagccccaugcucuccccgccucaagcgcucuacgacacug

SEQ ID NO: 2724 - RNA, 18902 nt, Mus musculus
cucacugguggcuucuucauugcuguguuugaacgugcagaggugguaccaacgugagugaggagcucaggcuuuuguuauuguuugaggcaguaucuguguaacccugguugaccuagaacuuacuaucuagguagaccaggcuggccccaaccuuuuuagauccgccucugccuccugagcuaaggugugugcuagcacaucugcuaaccucuggccucuucuuccagcccagccccacagaccgaugcaauggauccagaaccucucagccaagucccaaagagaaagagaagacgcaaagcagcaguuggugccagcaugcagccaagcacauaggcacugagugccccacagccagcagaaccaugcuuacugugggaacccugcucuucugggaagggaagaugauguccuggcacucugugucccucacugggcccaguccuaccagucacgaguucuucgcuucacaaauaaagggcaaacucacaucuaugacagaucacaguuuuauuuuuaaugacauaagcaagaacaaucucacauucauacuaaaaaucucagcuacacucacaggaacucagucuguggugggaagccccagccucccugucccuguccagcgugagcacggacaaaugugcucacacaccgaggcuacuccaggaugccuccgcaggggcccuggauacaggccugcuguggagcugagguaauuagcucagacugaauugcagggaggccccuuccuuaccugaggcacagguagaggcuucguguucagacccccacccauccccauccucacaggcauuugggaccugaggucaagcucuucuccagcuccacacaacccagccuaaccccugccauaaaacauucaaucccagucacaaagggaaggggaccagggacagcuacaucacacuguuuauaaaagaagaaucacacuuauacgacaugucuagaaggagcucugcccccuuaggggagcugcuggggacagcugugagccccuccuucacacaggcauaacuauacagcuaauucuacuauucaauagcauuuauacuuaaccaccucagugaaccaagcuugaaggaauuuuaaaggcaauuuagcuuaaauacaaaaauaaauuuuauuuuguuaaaaaauguuuaaauauuuuuuucuuuuaauuuagacacacgcauucauacuucucccaaagaggauggacauggcagccaggcucuggggcugaaggguaugguaugguuuuggaaagaaagacaggcuagguaggaaccuuuugagaauacaacuaaggacuauauuaaguguaguucauuaauguagaacuccaaacacaggcagaagcugcccuggccuggguggguuacguggggaggaucaacagagggaagucuuugcucccaacaggcuccauccccugggcugccagcccuuaagucaaaacacuauugagaauucaggagucagcacuguggcugucacgcggugccacuuucagcauucaauuagcuaggcccaggagggcccaggugacauuaaguccggcauuaccaacaugccgccacacauacaauucaauucuuccuccaaacucgauucaaggagcaacacacauuaacaucagaccaacauaguacaaggcuuggaaaauacaaucccgaagaggcaaacuggcccgggggguagugggcaggugaagaggcagcgagaagcaguggugggcggucuggucuaccugccccaggucuuccuggagcaaacgucucccuccccuggcucugccaggcuaacagucuugagccaccaacccuuucgaggcuauaucagcagagggcuggagauaaacagacugggcagaagaggcggaaccgugcccacuggggucuccaaggcaaagcaagauucacugccauuuaaaaggaaugaaucucacagaggaccggugaaggacaaagcagcaagaaauagggagagacccugaaggaaucagaggaagagaaccacuucuuauggccaaaccaagcaggcaaagcuuagggacauuccguuucccccaaccccaccucauguguauuagggauccaaguaggugccagcagagauggugccaaggaaagggggaggcugccuagguuacacacuaaacaagcgcuggggcagcaagaggacaauauguacagauguuuuuucaguucuccagccuaaccagugugacuguucaaguaaaguacugggcuucugccccuccguggggcacuggcuuccucuggaacagaaaugaccaggcugccacuuccacccuggcgacaggcuggguuugcuauggaauuugaagggucagaggcucuuccuagcaggugcugagguccagauucaggcaagggaugggggaguggagacaagaggcaggcuacuucuugcgggugugcugccuucgggccugaagucgcugucgagccccuggggucuuggaucccgcaccaauggaaaacgaaggagcugcugauccuggaaagaauuaacaagaccuuaucagggcagcugcuaccacagaaaaugugcuggugccuucaucuggggagucagucaauagcaaaaccuaaguguuccauuagggcuucugaaaccauugggagcccucacagcucuuggcuggagagauggcucaguuaacagcacugacugcuucuuccagaggagcgaaguucaauucucagcaccagcauagauagcagcucacaacuccccuguucuagggcaucugacaccuucacauagaugaacaugcgggaaaacaccaauacacauagaaauaaacaacaccggcacuuggcuugaguuuccugagaagauuuaacuuuugcuguccaacuucccuggacccugaggaacagcaaccugcuauauuccuaaucacuccucacucaagggacaaggacaccauguuggcagcagacugguggcuuaccaaaagguccaacuccaacaaagccuugggcagguguugaagaggccccaaaugagaggcugcucccuguggugccuacgccgggggcaggggcacucugcccgaaaguagguguagaugugccuaaaagggagacagaaaaaaguuagaaacuagaccauuaucaggccuauccccagcacccagagcugaugaagccagccucugccaccucuccauuaugcaacugcagugagaugggggagagggugaggcgugcugucagguuaaucccucccugguucccugccccuucuuucucauucaucuguagggucccccuccuucccaggaugcucugcucuguauaaugucucagggcugucugucucugaugcugcuuccagaccacuucucuccccuccuaccucaaacacucaauuccauuguuaugcuguuuuugagacugggucuucugcuuagcccagguuggccuucaacucuccaaccuccugcccaaaccuaagugcugggauggcaggcaugccauaccacacccaggccaauucccgagguuugggucccagacucuuauuaacaguucugguccuuuggagggucaucuaucagucaaucaccucccccaccuaggauccugaaucaucacccuccccaucaccauucuuaagugacuucacaagacucaggaccuuuuagugcuaaucacacacacacagagccugaguauuaucugguguguuuguguguguguuugcaccagaguaguacucaucuaugggagaguacagaagccagagguugacacugggugucucuggagcucucccugagcuggagcugccuauuuugggucuccugcccaugcgcucugccuaccuccacacccagcauugagauuacagguugccacugccucaucaagcuucuuagcacaggagacugaaucagauccccacccuucaagcaucaggcacuggcuacugagcugucuccccagccccauccaccuacuuauuccagacgcugcaagccuuccacugucucucauuacauccccuuucucauguucccagcaacucccucaacagaucugcauccugcccuuggccaucuucuccaauucacaagagauucucuccuauuuaccaaagaagucagcggcucuuagggccaaaauuuacccugcacgcagcagaugagacccuuaagcuuaaaauucuauugugacuucccuggacauuuaaaauccagacaaugaaccuagcuaugaccaaccuuguacucugccagcagcauugcaaucuccagccaaucgugccuuauucucugcucaugaaccuaccuucugcuucugccucuaugcccugacaguacccuucccugcagccugcgguggguauacgucuaucacuguagcauuugggaagaugaaguaugaagaucuugaauuugagggcagccugggcuacacuagaaaacaguaucaaacacacacauagacaacacaaacaaggagcgagugagcuggcucugcgugaagacgacaagcacucgcagcacaagccuggccaccugagguauagccucagaauuaagaaguaaggggaaagcagaaaaccaacuccauaaaguuauauccagaucccuaucuguaaaccaugguaacaugcauguacacauagacacgcaugguggacacacacacacuauaaauuacaacagcugagaagauggccuggugaguuaaaaguccuuccugugcagcaugagcaaccauaugaaauaaagcuaaggaugaccguauacaccaaacaucuuuuccuuucauuaauaaaccuagauucaauuucuagcacccacacagcagcucacaggucccagggaucuaacacccucuucuagcugcugugggcaccagcacacaugugguauacagacauacgcacagccaaaagacacauacacauaauaucuaucuuuuaaaguuuuuuuuuuuaaaguaugugugugcauacaaaaugcagugcccauggaggcagaugaaggcaucagacacuugaagccgcagcuauaggcagugacagccaccugaugugugugcuaggacuaaauuuggguucccuuuaagaucaggaagucuuacccgcugagccaucucuccaacccuccaggaaccuuuccugacuacacaggauuccucccaugcuaguuuggauugccaguuggcuuuuaacauugcaggcagacuauugugcacucacccuuaacaggcuugccaaacuuaccuccaaacacaggcuugcuuucagguguacugcccacacugaaggcaaagggugagcccuggcugggugcgcccaggguguucugacucagacuuccaaaggaggugguggugcccggggucccacucuguccagauccaaagcugaaaguuccagagguggagcuggugccugggguagcacuaaggccaaagccuccacugccagcaggagcugcugagccaccgaaugugaauggggauggagcagagcugccaaacagagagcugcugcucccacuguugguggucuguguggugguagcagcgguggcagcagcaccaaagccagaugugguagcugacccaaaggagaacacagacguggugcuaccaaaagcuggcugagugcuggcaggggcgccgaagguggaggcugcggcuuucaacccuccgaaagcuggcugugcagcacugccaaagguggcuggugcuggggcugccgauggggcugaggccacagaguugccgaaagugaacgagcugccaaaacuuggggcaagugcuggcuugguggccccaucgguggcuccaaaugugggcugugaguuggcuccaggguagguugggagcgcaggcuuggcacuggagcuaaagggaauguugaaggugggggugacaguguugcugaaggucagcgugggcugacuggugguggcaggggccgagguggagguggugagggugcugccaaaaccacugaagccacuauugcuggcagcagucuggguagagcuggcaaggggcuggcuaaaggaggugccugcugcagaugcugcuggggcaagaggcuugccaaacuggaagauggaggccagagcuggggcagagcuagaaguaguaacagggggggcucccccgaacagaacugacugggaaguggaagucaugguacugcuggcaguacucgcugcaguggucacuccaaagccaaagacaggcuuugaggcagaagcugcggugccagaggccaccguggaaguggcagugcccaggccaguaaagagaggagcugauguggcuguagugguggcuguagcaguugucugcuucagggagaagggaguugacaggggcauggcugugaauggcuccaucuugucaaaaaugggcuugaacguggguguggugcuggcugcugugggaggggcggugcuggaugaagcuguaguggcggcugaggagcuacuugguaaggggcuaucacucucacuuuuagguguggcuggaaaaaugggcuuaaacaugggagaagcacaagccggagcuggaguggcaagggaggaagagcuggcagguggacucagcaucccaaacagcaugcugggcuuuggggucggggaggaggcuguggaggcuggggugcugacagacugcucagccugagagacuccagaggacuugcugucagugagugggguuauagacgaagcagaagccagccccaggaagguggcugcagguuuggagucugaggaggugcuggcuaggggcccugccaguggugagacaagaggggccaagaggcugggugucuucggaggugaaggggcugcaacuguugcugccucagcagguucugagaagaaaaggaagugaggugagucuugagggugucugagggcggcacucagcacgccugcccccuccagcagccaccacaccaggacucccagauuccaggaaaggcggaagggaagaguagggagccugacuggagcugcacauguggccaugaaggagaacgcuacuccugcaacugucugcacugccuuacacacacaggugccugcucaucucaaagagccaccauguucaccacccuagcaaaacggugccugccuggccccgagcugcaucagcacgccugcacuccagugugagaagucagcuacacagugugugcaugugcaguagcacgaaggcacuagcuggcaagguucaccagccuuacccaacaccuucaauuuaucaaugacacagauucggggcagcugccuuugaaucacaguauuacagcugucccuguguauuuccagaccagggcagucugaagccucucacugccaucaugucaaaagccuguaacccuagggcacacugcucugcuuacccgaggaugauggggcuggagacuccugcaucuucuucaagcucuccaacaguggguuagagcugggagccgggagggaggcuggcgaggcagcaggccccacagcgggcagggugaaugugaagggagggcugguggaaggggggccaucaguggcugaggcggaagcaucaucuggaggagagacaagccucuuacaugggagcuccuuccuuccuaaccucacugcuggcucccggccugcgcuccagcacucgggacacaguaacauuauugucacaaacaacaaaacuuccaugucccaugggaaaaguauuagugacaguuccuguuaauaagagcccugguggaaucaggggggacaaacaucuaagagcugguuguaauggugcacauuugcaacccugcacuuuggaggcugaagcaggaggaggauuaugacccugaagacagccuuggauaaugaauggaaaaaucaaguauucuacaacugcucuuccaaggaaagcuaaaaggaauacagagacacugcggagcacacugcgcccagccugaccuggcuuguccuccaagaccuuguuaaaccauugcagugaggcuuuccucuccauguccaggucuucagcagugauggaauagccaagcucuggggguggaggcugcccaagagaauggaggcagguuaggccaagcccaagaugcuggagacgacccugccccucagacuccuggagacuaaaagagccgagaaggauagacaagacauaccaaggugagcugguccccucgccgggagggcagcagcuggaucuugcguuugcguugcccggagcugccagguguggguggggaaguccaugagcucugcugcuucccagugguuguaucuguaacuacagacagaaacacaggcuugcugaccucccuacucaaggacaagacgaucuucccugccccacccagaguaacacggugaacuucacuggagaugcuccucucgggcccauggcuucucuaccuacccuuuucuccuggggacuccuugucugucaccaagggaggugaagaacuggacugcugacauggcuccuccucucuguggggauugugaaagcuagauguuauuugggaaggccuggagacggcacagcaccucacacacacacuugcacacucccauggcucuagugucagcauaucaccauguggcaguucuuguagaaacgaaggcaggcaguuguuauaggccaugagcaaccagccuuuaaucaaauauagaccagggaucugcaaagcuucccucagagccugccaaguccaggccccagacugcaucuucaggcucuaacagcagauuagugcuaggagcgaggagugaagcuggugagaaagcaggcccgugacaggcagacagauagggaaaauaaaaaagacuggguggcaggugaggccagacacagacagaccugauccccgagggagccgagcuccagugaagggugagcuggggccagggacucaggcucccugcugacccgguccacucugcacuccacucccaguggccucugcaccacucccacuggaguaugagacagagaagggaccccaaccaucaguugcucacacuguaggacaaggacacaacucuagcaggcacuuugcugcucuuguaugguuugacucugauuugcugagucagauaaagcagcccaacagcuaauccuuguuaaacccgcugccccuguccacacaaagugaccagaagggaccggucaucaccuugucuucuuggcuggccucucuggugucugggagcgggaggaagcuggacuggagaagggagaagaugugggaccacuccucuuccacagcugcaagucaagcagagagacaaucugaaacuacuacugacaauauggcuauguaggcagauauucugaccuggccaggcaggaaggcacacaccuuuaaucccagcacuaaggaggcagagguggauagauuucugugaguucaaggccagccugcucuacauagugagcuccagaacagccaggguuacugagagacugucucaaaaaacuaaaagaaaaaaaaaaaucaagaaacacagcaaaacuaaaccuuucugagagacuggagagauggcucagugguuaagaaacacuugcugcucuugaagaagacccauguuugguucccagcauccacaccagacugcucacaaauacuguaacccuguuccuaggaugauggaugcuuucuggccucacacaggcucaaauaaauaaaaauaucuuucuuuucuuuuuuuaagaccauaucuuacugcauagcccuggcugcaauuuacuauguaggccaggcuggucuuguuagaguauuccaccacauacugcaaaauaauaaaucuuaaaaaaagaaauaaaaggacuggagagauggcucagcaguuaagagcacuggcugcucuuccagagguccugaguucaauucccagcaaccacaugguggcucacaaccaucuauaaugggaucagaugcccuuuucuggggugucugacagcugcaguguacucauauacauaaaaauaauaaauaucuuaaaaaagaaauaaagagguaauucuuguauucauuacauauucuaacaaaaaucaucuauaguaaaaaguacagccucuauuuuuacagauucugauauuccaugaauaugaguauuagauacaaacugggcaugguggugcaagcugaacaccuagugcuuggaggcugaggcaggaggaucacuacuaguuaaaacccagccugagcugcaugcacaauagccagggauacaugagaccuugucucaaaaggcaaaagcaaacaccaagggcgacugaucuaccugcaggagccugugcaccuccuagugucaauaccaauacuggagcccaagugugccugacaguggagcugccuggcuuccccaccuaugggcucuaacgaacucuaaacaagaaugacaucuacuucaugaaucaaagcuuacacuaaauccuacuugccuauaaaucuccuuuauacaccauugcauacacuagcaagcguuugcugaaaggacccugauauagcugucucuugugagucuaggccggggccuagcaaacacauaaguggaugcucacagucagcuauuggauggaucacagggcccccaauggaggagcuagagaaaguacccaaggagcuaaagagaucugcaacccugcaggugcaacaacauuaugaacuaaccaguaccccggagcucuugucucuagcuacauauauaucaaaagauggccuaguuggucauuacuggaaagagaggcccauuggacacgcaaacuuuauaugccccaguacagaggaacgccagggccaaaaagugggauuggguggguaggggaggggggggggaaugggggacuuuugggcuagcauuggaaauguaauugaggaaaauacguaauaaaaaaaaaaaaagaaaguuuaaaauaaagaaauaaaucuccuuuacauuccaaagggaacaaaaccuuucuaaaucaguaccauuuacugcacugguccaucugcagguugcuccaucuggaccagguuugcuuucuguucagucccacugaucucguuaauuugcuuuguauuccaguuagccuagagacagguucagugcaaagcaacagagggugagcugcauccucugcucccggcccugagacauaccugugagaugccacggguggagcuguaggagcuggugauggcauugcggcuagaacuggggaugccuccugugcacgcacuagccagggagcucacagaggaggugcgagaccguuuguucaaguggucaucugagcucugggaagccagacuucucuucagggagccaggccuaagagaaaggaagaaguguacaugcgcuacugcaggcguauucugcuauuuccaccauggugccucaccuuucugaauaaaccugaaagaccaccacaauguuccucaaggccacugucagcagaugacauggcugccuaugucugacaaagugacuggguaaaagcacagcacgggaaacacaacaggaaggguuacaccuugacuguggugucauggggacaaaaacguaaugucugucaaugaucccucaauaaagcugcuaagagaaaaaucauuaagccucuaacugaaagagaaaucucccauaauccuuucugucaauguguguuaccuagcccuacuacaguaugguccucuuaccauuucccaggcaagugcaucaaccacaaaccaguucgcugacaacugcagcagaggcagccaauguuccccuccuuccacuagcacaccaucaucuuggcucgcucccagaugccugugccuccucuaggcuggagccuccaaagccagccccugucaggcuuuccuaccucagcaguccacacuguguaugcaugucucccacggugcaacacagugagcugagugcaaggcuugacagagccuuuuuaccacacuggaacuuaugcaccuucuaugcaaacuuccucucauacacuccauaucaacacuuccugcccugcagaagccugugguccauuugugaagggucaacugcaccauguuagugaagcagagugagacagagcaagcacgagacacuggcugacugcuuuaguuagugguuuacuuaaagcacugcuuacggcccauaucuaagcaucacuucacuuacuacuuggaacagaauaccuggaaaauuaccaguuuguugcucuuaacaaccugaccacaagagcuuacaccugucaucuauaauacaccuuuaaaacaagcugacugcucauacgcaucuguaaaaucgcacuugcuuauucgucccaccucauaguuuagaugaauagaagaugagaauaugaacgggcccaggaccaaucaagaucuuuuuaggagcuauccuggcuucagucaacuaaugaaucucucuucucucacagcuaucagagaacuuacuccaaaaagauuaccgcaacacuagcacaauauauaaacagucauuguauauacacaacauuagcacaacauauauuuaucuaaaaugucauuaaacauggaaaaaccuggaaagaaacuggaaaggaaauaucuagucauggcaauuaguuagaauguuccuccagaugugaaguggacagugcagacaguagagagaggugacagggcagccacugucagaaacacuuuucccaaccagcaguaucccgucaccgaggaucucacuaagcaguagcaucccaucacugaggaccacuaagcugcagcaucccaucacugaggaucacuaagcugcagcaucccaucacugaggaccacuaagcugcagcaucccgucaccgaggaucucacuaagcugcagcaucccaucacugaggaccucuaagcugcagcaucccaucacugaggaucacuaagcugcagcaucccaucacugaggaucacuaagcugcagcaucccaucacugaggcucucacuuacuuaggcacaaaugcagcagggacuccguuggccacaaggggcucgaaugcugaauguccgcucccaccgcuaucauggcgccugugauaaauuuaaaaaauccuucaugaaacagcgugcccguacucccagcccccuuuauucucuggaccuuacacaguggaaugagagaacugacccucccucacaagcugugcucugaccaccauggccaugagcgaaccaacucacaacaaacagguaagaaaacugaaagcauuucuucauacuccuggggccuaguauacauuucaugcuaaauaagaaaagguuguuucgccaggcagugguggcgcacgccuuuaaucccagcacucaagaggcagaggcaggcggauuucugaguucgaggcuggccuggucuacagagugaguuccaggacagccaagacuauacaaagaaacccugucuuaaaaaaccaaaaaggaaaaaaaaaaagaagguuguuucaaaccacucaguucugugaagugcaucacucuaagacugaccugguaaguaagggacaggaagaaucuccaaaugccccaacugcucagguguaccacacgaaggaaaaacaguuuuguuuuuuuuuuugguuuuucgagacaggguuucucuguauagcccuggcuguccuggaacucacucuguagaccaggcuggccucgaacucaagauccaccugccucugccucccaagugcugggauuaaaggugcgccaccacgcccggcuaggaaaaacauuuuuaaucaaguucuuguuauucuguccaaacuauaccagaacauauuccauagccucaggcugccuuuaaacuuccaaugcuucuggcucagucuccacgugcugggauuacaggggccagguacacacauggugccugugaucacugcuacauuccaaccacagggaaaauaccaacuccucagcuacagaugcaccaaggccaagacacuuuccuggaccaaccaguuaucauuuccucccuggccaucggcucaguccuguuuagcuaugggacaucagcacaacugcuuacucgccauuccugcaacuccucugauagccuuuaguccauaaaugcaggggccauuucuuaagauuuccuuaacuagugugaggcacagcaaugcacauauauaaucccagcagcacuugggaggcuauggcagaacaauuaagaaugccagucuagccugggcuacacaguggccugggcuauaaacauugucucaaaaggaagucaagagcagaaucuccuucacguccuuuugucuuccaggacuggaaauggucagcugaaaaccugccagcuguaagugguccagacaaaggggaugacagcuauucuucccaggugcguggugcaccgcauccuaagagagcacuuccucauuacaccaagagaccuccucauuucuaacacucuacuuccugcucucauaaacuuaugaucuguuguuaccuuguuaacuaaccauuuaacuaaguagccuugcagggugugcuggcacauggagaggagacggccugccuagguagcaagugggaggccagggcuacccagcaaaccgucucaaauacaccaucccacuguggggguuggagagcuggcucagugugagcagggugauugucaccaagccugagccugaugacuuccuggcccacauggcagaaggggagaaucaauuccuccaaguuguuuucuggcuuccacauaucuucugugacaacuguguacgccuucuugaccgcccccccccccaggcaauuaagugaauacaauguaauuuuaaaauuucagaaguugaaaaaaagcugggaaaaaaaccccagcucaguaguuuagagcacuggauguuucugcaggggacccagggucaaucaauucccaguaccuacacugaggcucauauuuacccauaacuccaguuucaggagcucugaacuucugaacuuucugaacucaaugggcaccaagcauauaaauaauaacaacccaaaccccacacauaccccuauguauaucuuuaaguauguacgugaacauagaaaaccuuguuaccuugaaagucccauaacaagaaacaaaaacaaauaaaaaaaaaacaaauuaaaaaaaaaaagaaaagucccauaacuaagaggaguaagggccuagcacacaguaggugcuugauaagcauuuguugaacuacaaaaaaaagguagagggcugggucuauggucagcaguacagccgcugaggaaccaggggguauggcuuggcagugaacacuugcauagcaugcagcaggcccuaagucucuucccgaggaccacaaaacaaccaccauaaaaacaaagguccuguaucucuugaugacccucuccaaccuucccucugcacaccccggaagcugcuuucucuauucucacuaaguucccauauacuaaaaagaaaacugguucugcucaucacugacaguccuacuaugccuuucauucaacaacacuacugcuauuuaacuaaaacaacaacaacaaaaccaaaccaaacaaacagacccauacaauuggaggggaaaucucugagcauuuacuuuugggaauaaaauuucacagaguagcauccaaggcagagagcuggucacacaggcuaaggaucccacuuuucgagguagaagggcccagaguucaaggcuagcucggguuguagaauagaaccugcuucagaacacuaggaggggagggcgagccaaaugccaaugcagguuuacgugcacgaggacugaaacuuacccagcccgugcuuuaagagguaaacaguauuaaagccuuguuaccacgcugcuccaaggcucagacuggagcagccucuacaccugccugguaaucaccaccacuugaauucucuggagcccccaccccacccccgggaaggcaguguaacaccauacugagacugcucguuaccuucucuuguuuuccuggccaucaaggugcagcuggucuuccuccgccacuguucuuuucuucuucuccuugagggcguucaggacagucuccuuugcacaaggaucuggggcauuacuugauggugaagacaguguuguaucgaguaucugcucugaccuauaaugaaagacaagauucuggagacaggauauuuuaacucccaugcacauacagaacagaacggaaacuagaagcuaagcaagaccuuggcucaucuauguguagaaacuaccaugacuacaggucaggcaugguggcgugagccuuuaaucccaacagugagaagcaggaggaucauccugaguuuccagacagcuugagcuacucaggcaauuuuaggccagccuggucuaugaaugugugcaugccugcacgcuugcacacuggagaaauggcucuggcauccugcauaccccuagagacacagcuccaagggaaaaaggccagcuggggcuucaacagcuagacccaaacaugauccccagggucagcgagacucuggccugaaaggaaaaaaagcgagagcaauagaguccugaggccuucuucuggugguguccacacagguacagaagguuacuugcacacacaaguuuguauacacaaacacacacacacacacacacacacacacacagguacucacauugaugagcggaauagcuugcugucuggaggggcaauccucacugucacugggcugcacaccauccuggaguuccguggagacagcacagccuucuuauggccaccauuccagcagacgguuggaagugccccaagcaaggaauacugggcuugcugaaugggauaucgucuucgggguguuauaacaaaccgacuggacaaaggcccacaaucucuguggagaacaggagacagacacuugauggaaccacaguuuuuguuuuuguuuuuuuuuaauuuauuuuauuuauaugaguacacuguagcugucuucagacacaccagaagagggcaucggaucccauuacagaugguuaugagccaccaagugguugcugggaauugaacucaggaccucuggaagagcaagcagccagugcuaguaaccacugugucaucucuccagucuggaaccacagucuuaaaagaacaccaaauucaacugacugcagaaacaagaggcauuaacacuucuuucaaccucuuauuuuucuguuagacagugcugguagcagaaacuaggggugugugcaugcuggacaaagcacucuaugacacuaacagcucagacuuuaaauuucucuaagcagcagagaacguagcauuuuuuggcacauuucucccauuucauccaaaggcagaaaauaucaguugcuuaauggcugucucuaccacagacuucaucaaauuaagagggaaacuggaaaccuugcccacauggguacuucagaagaaaagcacaugcaguugggauguguaggaauaguuuuuuuuuuuuuccuuucccccaacuaaccaccaauacacagcaaaaaccaaacauuaacagguauucaccaccucaacuaagcagacuuaucaaggccagugaaacgucuugugaaggagcuugcugccaagcuggagacccaagaucaaccucaaauucacguggaaagagaaaaaggacuccagcaagcuauccucucaucucccugugaauaugcaauuuaaaaagaaaaaaaugcuuuuauccagaauccggguugaguguaguggagcacaccgguaaucccagcauuuaguaggugaaggcaggagggucagcaauccaaagucacccucaugaguucaagggacagcucagauacaugagauccugucuccggggggggggggggggggaacaaaaacccaaaggcuggggaauagguagagggcaagcuugccugcuaugacugaagcuguggguucuaucccagcacagcauacaaccuggugcaaaccuguaauccuaucagugaacucgcucagaagacgaggcaggaggaugaguucaaggacaggcucagccaaagaacgggguugagauuagacagccuaugccaucaaauacccucucuuaaaaaaaaaaaaaaagaaaaagaaaaaaaauaaagagaaaagagaguaaugggaaaagggagggaagggcguagagauaaaaagaaagggaaaaggcaaagaaaagaaaaaggggaggugaguuaaauccgauuuacagguugagcccuacgucaaauccgcggccgcagagaccccacccugggaagaucgccggggcuuaccgguggggcggccuccgggagggucgcaaaagcgggguggggagcgcgggguagacgugguggacucgcuggaccgccgaggccggaggcggggagcgugcgggugggcggcgccccggccucucccuuggguccugccggagggcaggcucgggcgggccgggcuugcccagguagcugcccaugaguaagagcucagccgggucggggccucccagcgggcugcgggguucgcagaggcuaccguugacuggugacuuggccggaggcggugaagcggugagagcuggccgcgggugacggcgcgcgucgcgcacgaaggacgacagggcccucgggccgcgggguucucggcucaggccccaccaggccgcgcucgcccccacggccagccaggccagcgcggccgccgcgggcaccagguagagcgcgaggccgagcagcgcuaggccgagggccgcagcacccgccgguccuccguagccgcgggcccggcuccggccuucccguccgcccaacgggggccgccgccgcucgccuccgucagccgccgcagccgccggagacaucgcggcuccgcgccgcggagcggacuuaaauaucccagggua

SEQ ID NO: 2725 - RNA, 3235 nt, Mus musculus
ucgggguguccucauaucuccaggaucucuuuucugcaccccagcuuugaacucugagcugugccugaccuccagaacauggcgggcucugcuacgaucguugccggccuccuucuccugguagccugcgcguguugcaucuuccccauaggugagacuucugggccaguguggggcugcugguagcaaaagcuucuaaggccauggcugguuuggcacagugaagggugagggaaccaagaagucuggagcuggggcugagggaggcacuaaguggcugggguaugacaggcucugugucugcaguugagccuacggcaggcuggauacugaccugauucuucucuuuccuuucagauucugugaccauccccucaucuugcugcacguccuuuauuuccaagaaaauuccagaaaaccgagugguuagcuaccaguuggccaacggcagcaucugucccaaggcaggggucaugugaguaucuaacuccagggucccgaacuccaggguucuccuccucccgaggagguccagcccugggcaucucugaagaaggcacuagacuucaugaacuucagcuuccucacccaggaaacuagggggagagcagggcagggagguaggucaguucguaguaugcuugcuuaggauacaugaagcccugcgugguuccaucccuaauaucacauaacaaccaggacaugguauaggccaguaauuccaacacucaggaggcuaagaacauccacaaaguaccaaaugugggcaagguauugugcacggagggaaauacaugauaugccaucagucuaacuagucuucucaacaauuucauaagacaaugccagaaccccugccuagaaucccccagggaggggcuggggacguggcucaucaauagucuacuuuccuaacuuguagaaaacucuggguuucauucccagcauggcaaaaccaaaaacaaucucacagagaacauaggacuuuuuccauuuuaaugaagguaguugaggcucaguaagaccucaggcucaaggcugcaugaccacccaggucucuagauuucacauagcuucagagccaccuuuucaccugggguaacaagcaugaccucgugucuuaagcuaugcuguacagggggaaugacauguuaauauucccccagcugacaucagagcgucccugagagcuggcaccaaagggggcauccagggcucaccucucagcuauagcaggcccaggagccauguuuccaugccuagugugaucugaugauguuuaccuuuaaaaaauggguauguguguagaugagcugggcaugaguguccacgucaugugugugcaugucuguggagaccagaggcuaauuuugggugucaccaaguauacugagcaccuccuucaaaauagaagucucucucucuuuuuuuaauuaaguuuugugugugugugugugugugugugugugcaugcacacaugcaugcacucugcagaacauguauagggguucucuuauucuacccugugggucccagaaauagaacucaggcuuggcgacaagcacuuucccugcugaaccgucucuggcuuccucaccggccuggagcucaccaaguaguuuaggcuagcuggcugucaagcuguggggaaucccccuagcucugccuccucagugcugagauuacaagcucaugccaccaugcuuggaguccugacaauugaacguguauccucacaguuguaaggcauacauuuuccccagcuaagcugaccucucagaucuguucuccugcuauagaucugacacagaccauaucuguaucaccauauccagcaccauacuucaaaggcagagccuccuuugucucacagggacgccacagaaugagcguauccgcacacuccaccauccugucccccagugguaaaacacagaauucgcagagaagucucaugucaggggcuuccuagcgccaagggcaggcgggcagcugagacucgcuugcgcucacuuccucauaaagggaagguuagucuccacaccuggcaggacgucaaacuaaacccugcccuucuuuccuacagcuucaucaccaagaagggccauaagaucuguacugaccccaagcugcuguggguucagaggcacauacaaaaacuggaugccaagaaaaaccagccuucuaaaggggccaaggcagugagaaccaaguuugcuguccagagacgccguggcaauagcaccgagguuuagccgccucuccucugucccugaacuuggacauagguauugacgcuuuaccaggcugcuuugggguuugacagaccagcugggaugaggucuaaguucauuuccccauucucagcauuucuuuuaggggauguguuuauucugugagaaccugagugagcugcaagcaugccagaguucuggugucuccugugcugagugaaaagauuccagaagaauaucaguuguccuguguuaucucuuguguggcucaaaggcuucaucagagcccaggugcaugagccccgagucucugcaggcggaccuugcuugcagcuggcuuccauaggguucuugucuuaggguggggccugagggcugucugucuguccaucucugggugaagaucugucaacagcaguaacucccaaacaugcugauggguauaccaggcuggucccauccccagaacuuggaacagauaaaaaaaguuggcagaaacggaggauuucaacagcagcauuuuuaaacccaucagucuuuguaaagccggagguguaacucagaugguggugugcuugccuggcaugcauggggcauuggguuucaaccacagcaccgcaaaaacuaggcaugauggugcaugccuaagaagaucagaauuucaagcuuagccagacaucccagaaggcagaggcaagaggaucucugugaguucaaugccacccuggucuacauagcgagcuccaggacagccagggcuacauagagagaccauuucucaaacacccuucccuaaaaauaaguucaaggcuacauagccacacagaaaauuugaggccagccuggcccagggucugccuccucuugcugccaggauguagaacucucagcuaccgcuccagcaccaugucugccuggauggcaacaagcuuccucccaugaugauaauggacugaaucucugaagcuauaagccagccccaacuaaauguuuuccuuua

SEQ ID NO: 2726 - RNA, 15420 nt, Mus musculus
guuuuuuuuuuuuuuagagugagguggggcagggggcuuguuaaucuuguuuuugaccguuaaaacuauguguauauauauauauauauauauauauauauauauauauauuuuuuuuuuuuuuuuuugguuuuuucgagacaggguuucucuguguagcucuggcuguccuggagcucacuuuauagaccaggcuggccucgaacucagaaauccgccugccucugccucccgagugcugggacuaaaggcaugcgccaccacgcccggcuuucuauauuuguuuagucaggcagcuuuuuaucuggcucuguacuuagccuacuaguacaguuuggaaaguccuuuugaagggggaagguauaggguaguuuugaauuuauuuuggauauuacaucucaugcuuuuguuuguuugagacagaauuucuguguagcccuggcuguccuggaacucacucuguagaccaggcuguccuugaacucagaaaucugcuugccucugccucccaagugcugggauuaaaggugugugccaccacuggccggccugagucucacacuuuuuaugacuggaaaucucucaccgauucugagaacacucuuuggucucuucacuuuggcuaggcugacaauccugcccaucuguguguguaguggguaccuguagacaggaaggaggccuggccucccuaugagaauauccagaccuugagcucugucaccaucuugugugaccagucaccauggucuaggcucgggcucccucuccggcuugccuaauuucauugccugagccuggggcuaguccacuucccuuccauccccuccuugccuaucugucuccaugcuuguauuacuggcucuggguacuggcuuggcuccugcuuaccuuugcccagccuuuaccugguuaucccuaccuggagaucuucccucuggcuggccuguucaccagcagcucuagaguagggcaugcccugggaggagaggcugagggcagggcaucuuugcggcccccaguuuguaagccgcacaaacugaugccuucuggcugguuggucccgcguugacuggggaugaggcaugacucgagggcacagagacuucagugcagagaacagcauucccuuaggcugaauaaacagaagucaaaguuuuuccuuuccuggaacgguuagacuauguauccccaagucccugguucucgaaauccuccugccucaccuuccccacgguugggauuaaagaguccaccacuguaccaggugaagggaauacuuuuuccuucuucagugcugggaugaacuuaccuuuccagacacaucauauagcacugagcgacauucucagucccguggcaauucucuuguaccugugguauauggguaugucugugcacuugcgggugcgcucaccaaugugggcacuugaggccagaagccaauauagggaugucuccaauugaucuucacaaacagggcugcucacugaacuuggaacuuacgguucuggcuaaucagcuagcuccaggaauccaacuccuggccccggguugcagagacacaaggccaugccuuuuuuuuuuucaguggagguguggggaauccgaagucagaucuucaugcuugagcggcaagcacuuuauucacugagccaucuucccagcucccagcaccuuuauuuauuuauccacucccucacuauucugagcagccagggcagggccaucuagacuuugacaaauauuuauugcguggcacaccuguacccguguccccaguacauauuucauggcaugucucugaccccagccuggggacaggcacagacucagucaugacuugcagacaugggacacaugauuuggcaaacgagggaaggcugggaucgcccaggugucuugugaaacacaugugucuggagguuaucuccacagagacaaaaucauagcucaguccaaucugcaaacuccucucuccagggaaggucauuuucugggccuagaagaggggaaagauuccauccacugagguaucaccucagagcccuagggagguugaucugcagcgaaaccuacuaggcaaaggcugcuucugaaggcaaggaaagcaggcgcugagaaacagaugguuccacucuaguguagcuucaggcugccugugcacugguuccagaucacacaaaggcccagggaauggagaucuaggggcaguccaucaguguggggcaguaggaagcuggaauccagcucugcauugucuguuagcaauuccucugcauccuuggagcccaucaguaaaggcagcaacuaggucacacaggaggaccugacaauucucacagcccagucgccaggaaaccuggguguuuggcauucacagcucuagccagugagccacccuauguaggaagaaaccaagaacacacaagccuaucuacagaguggaaggaccuugccuaagagcccacaucuggcuguauucaggaagugccacugaaaugccaggcguggcugcaguccaaagcuccgggucccaccaguuuccagccguguccuuacugaggccuagaugcaccuguuuccuuggcuaucgacucaagucucuaaugcagugccaaucuuacucaugucauacuggcuugcuugccaguggguuucaaagaccauuuggcugugcccaucuucagacuacccucucuggaggagugggcuuggggucaggaaucaccuguauuggaauacuuagggcccuguaguggcuauuccugguugucaacuugacuauauuuggaaugaacuacaauccagaauuggaaggcuuaccagugacccuauccuggaggcugggagauagaaguuucugaucuggaucuugguauggagaucuugaagcauaguggcuauggauuccagauuaagacagggagaucucgaguucaaggucaucuggaauuaaaggugugguggcacacaccuuuaaccugggcuacaccuucugcuagagaccauauaaggacauuggaagaagggagucucauucuugcuccuucgccugcuugcugugugagacugaguaacugcuagaugcuuggacuuccauucacagcuacuacugaaccauuguugggaauugggcugccgacuguaagucaucaauaaauuccuuuacuauauagagacuaucuauaaauucugugacucuagagaacccuaauacaggcccucagaggcagcccagagcaucccauagagcuccuggacaugaaggccauacaccguaucuaaaauaccuugugaugccauggcuuugcuuuuaaguacuagagaugaaacccagggccacuugcaugcuuagcagguacucaucacuaagccaccucccauccccaccccuggaacugguccaggcugacuuuagagaucuaccuaagugcccugccucccaagugaugggauuaaaggcaugugccaccaugcucagcuuauuuuuacuaaaaagaaaauucuuuuacuauuuccauaccuggcuuuauuuuuagagacaggguaucacuuuguagccuuggauauccuggaacucaguacauagaccaggcuggcuucaaacucagauccauugucucugccuccuacaugauaagauuaaaggcaugugccaccaugcucagcuuauuuuuacuaaaaagaaaauucuuuuaugagacagucucucauucacuugcuguacccaucucuggguuuaucaacucuugacuucgcuguccccacccaccccaucagguccucacugcagaccacugagcacagacuggaugugauucuggcuccucacagcuuuuuggugucacgcuugcccgggacugaacacaguaugccacacaccacuggcagguuggaggcugguuuuuauacagaggugacucacagggcggaucaccagccugcugcugcaggucaccagucaggcagaagucccaucagccauggcugcggggaagacgauguuacaaggacuaccugguacagucacaccagacacaaguaaggacccaugggcacugagcagggcaggauggguaggacggcaagagucccuggcagccgauaaccgcaccuucuugacacuggauuaggaaccaagaagcccaggagccucaagaccccaugauauaccugcccggggggcuagccuaaaacccgcucuguagcuggggcugaccuugaucauagcugagauuacaggccugucuuaccauccaguuucuacuuucuagagcugccuugaggugaaacaacacagauacagggacauuuaucaaaguacucuucagagcuggcacacagagguaucuaauuaguaauucuuuuuuguuuuguggagcugaggacucagggccuuaauuaugcuaaguaagcauucuaccacagagccccagucauuguuauucauucugagacaggguuuuguuaauacauauccuaggcuugccuuggacguacucuggagcccagacagaccuugaccuuuuaccuauuggccuuaacccccaagcagcuggaaugacaggccggcaugcccuggcuucaauaaauaauuccuacauucucagaaccuuccucuguccaacaagguggaagccgccucugcagacugguuagggcauggcuaccuuggaagacuccuuggagccuguagccccugggguacccagggccccugaauacacagugccaggacagcugauaggggagggaggcuguacccccugggaggucccugcagaagcuggguacacacuggaggcauugggguuaggaccaaagugguucugcacauagcacaggccggacgcaggcugguauggagguaggcugggcauguggccaggaggccaggaggccaguuucuggccacuggcaugcugcaucugggugacaggauaacuuggagucagaugaggguggcaacucugugugggguaggagccaggugcaggguucagccuggaaaggaauaagagaagacagugacucucugcaagguacacggcgccaaguccugagguaacagcaggggugggaccauagccagcacuagguuucaauucaaggaagaagaaagauugacuuugggaguugggggacaggguuuccuguggcuuaggcaucguugaauugccaguguagauaagaaugaccuggaacuguggcuccuacccguauccucagaacauuuagauuacaggcaugguggggcauaacaggcacggcuggcugugcagugcucaggaugaaauucagaaauucaugcauacuggacuguacuggcugguuuuguaucaacuugacacagcuggaguuaucacagagaaaggagcuucaguugaggaaaugccuccaugagauccaacuguaaagcauuuucucaauuagugaucaagggggagggccccuuguggguggugccaucucugggcugguagucuuggguucuauaaaagagcaggcugagcaaggcaguaaagaacaucccgggcuggugagauggcucaguggguaagagcaccugacugcucuuccgaagguccagaguucaaaucccagcaaccacaugguggcucacaaccauccguaacgagaucugacuccuucuucuggagugucugaagacagcuacaauguacuuacauauaauaaauaaauaaaucuuaaaaaaaaaaaaaaagaacaucccuccauggacucugcaucagcuccugcuuccugaccugcuugaguuccaguccugacuuccuuggugaugaacagcaguauggaagugcaagccgaauaaacccuuuccuccccaacuugcuucuuggucaugauguuugugcaggaauagaaacccugacuaagacauggacacuauuccaagcugcucugugaggauucucagcacuugugagaaagcucuaagaaaacagcauugagagucuugugaccuuaguuucuucaaaacagaauugcuccuggaauguguuuccauguuccucccguguagcagacagaagugagcucacuucagucuuagucaugugcuguacguaacguuuuuaccacguaaggcuugcccuugugauuugacaccugacucacguggcucuucucagcacucagaguauaaauggucugaugccuugaauaaaaguggcuguuacaugagacuaguccuucucauuucuaggugccacucccccagguucacagcaccaacuagagaugcaaacagccacacaaacaaaaauuaagaauauaaaaacaggaggcuggagagauagcucagcuuaacaccaacugcucuucugaagguccugaguucaaaucccagcaaccacacgguggcucacaaccaucuguaaagagaugggaugcccucuucuggugucugaagacaauaacaguguacuuacauauaaauaaaucuuuaaaauauauauauuaaaaaaaugauuuuccugccaggcagugauggcccaugccuuuaaucccagcacuugggaggcagaggcagguagauuucugaguucaaggccagccuggucuacaaagugaguucuaggacagccaaggcuacacagaaaaacccugucuggaaaaaaaccaaaaaccaaccaaccaaacaaccaaaacccaaaacccaaccaaacaaagaacauuuccccuuggggcuggagaauggcucaguaguggagcacuugcuuaguaugagccaagccccagcuucuaucccagcccacaggccaacuucugcuucugggagcgcuucucucucucuuccucccucucucccuugcucuugugagacagggucucacuauacugucuugcuugguguacaacucucuauguagacuaggcugcccucaaacucacagagaucugccugcaucugucucccuaguguugggaauaaaagaugugcauuacaaugguacccacccagccuucuuaaaauuauuuucccuguuugugugugugugugugugugugugugugugugugugugugugugugagagagagagagagagagagagagagagagagagagagagauguugcagagaacuuccagagguccucuuuccuucuacuguguggguuccagggacauaccucaggcucucagacuugguggcagauguccuuauccaugaagccaucuuguggguaucuuuucucuauuuuuaauaaacugucucuagcuuuuauuauagcaacaaaccacucaaacucuaagccagaccaaccuugugaacaagagcaauuguaaacaaaacaacccacagggcggcuuacuaaaauaaauacguguucugucaggauguucuuggugacuguuaggacaccugaaacaucauguucuguucugauaccugcagccaaucuuggcaaccagccaccauuauccacacgaggaccagaaagaacccagagcgcuccccagcacacgugucugggcucagacccggcacaggugacaaagcugcucaggggcaaguguaacucagaguagaacugcuuccugggucuccaggacagcuccuucaccagaagagugcgagcuggggcuucugcccuacuccauggcugcucagcacugggaggggagggaaacacaucccacagagagcugggagagguggauaagacagagccggcucuuccuuccucagcaaggcccuucucugggaggcagcacagacaggaagugguagacuguagaaucucugaggggacacaagcuggaaauaacaaaguggcugaggcaguaugggaaagggacuuguaggcuggagacccuaggucacaccagacucuuuccuggacucugugcuaccugggaacacagguccucucuggccuccucuauaaaggaagugugaaaccccguaaguucugguggcuugccuaucaguuuuuaagagcaaacaagcucagacaggaaaaaacgucagccuuaccugcuuucauaugggagccacgaaacucuccucucaagucuccugcccuaucaccuacugagcacugucuaaacauggccaacugccauagcccagugcuacccacagugcuugcugacuaagcagugugaagacgauuaccuauccauagaucacucagaauuacaugcaagugucuuuggccacucaggcuuguuuccccuccuccgcccccccccccccaacucccccagauagggcagcagccaguguucagaagauauuugugcacagguuuucuuuccuuauuugcagugcuggaacccaaagguucaugugaauuaggcaggggccccaccacugagccacgcccccagccccucacucagggauucuaggcaggggcucuaccacugagccacgcccccagcccuucccugggggacucuaggcuagggaauuuaugcugaacuagaacuacaacccuuaguugcacuuaguugagaaccuguuccucgccucuauccuccaaggugaaccagccacaccuucauuggcucugcaguugcucuuagaaggagagugacagcugauggugggauucuauuuacagccugguaucagagauguacagacaggaguccaaagacaacccuggcuaucuaugacacugacuuacaaaaccaaaggcaaaggugggugguuguacaucaguagagcaccugacacauguacaaaaggccuuggguccugcccccaucacugaaacugaccacgcaacuaaaaaggugagggcauuuaucacuuaccuacggcucugggcugcucuucuuucggcagaagaaccugagauguacuugaacaagggaauccuccucaugaggcugaaggggaacuucugaucaagcuucagggcuacucgcucagagaggucgagggaguagcaguaggugaggccaucugagguaguguauuaaguaaaacugaaggcagcgggagggagggaggcacaggugugugucagucucugcaaagagcugaacaucccauccauguaccucacagggaacaacgccauguugauguguguuagaauuccuuccaaccacagccguuagucacaagacagucuuaauauaaugcagagacuggugcaguccuagacuuuugcuccaaaucaaaggugcccugcucauauggccuucuguggagggagauguguagcccagucuggccucaaaccccugagcacugagauuuugaggcaugcaccaccaccaccaaguuucaauguggcuucuccuuuguauguauguacguacauauauauggguaugagugugccacagugugugugugugugugugugugugugugugugugugugaggagguaugaagaacaacuuuaugaaacuggaaucaacucuccuuccaccaugaaggucccagcauugaacucagguugucaggcuuggcugcaauauuaagcaucuguuuuaugccugcacagguugaguccuccuuaucuaaaacaaucugggugaaauagcucagagcuuacaggguuauuugaaaaucuacagguuucacccguaccucagcagccugaguuacagacuuggggggcauccacugacuuccauuuacagagacagcuaagguacagaguguucgugucagguuaacacucaaggcggugcagacuuugaagcaccugggucucagaauuccuaauuagggaggcucaaucuuucauaaaugccagacaaggcagugcuagcgaugccacuuaguaggcaaugaccaggcugaugcacuggagggucaaaguuggauccccagcccugccuaaaaaugaucaaggcuauagucccagcuacuccagaggaugcuagagauuagggcuuuacuccucugccucaggcagcuccagccccaaguaggcuaccuuacucagaacuauaagagcaagcugggugugguguguauaccuacaacguuaaucccagcacugaggaggagguaggaagauugacaggaguuugggagcagucuggcuuguacagugaguuccaggucauccagggcuacauagugagaucccaucucaaaaacaaguuaccuuuagaggacaggggaucuaaagauagcucuguaguuaagagugcaaauugcuauucuagaggacccaaguucaguucccaccaugcacacggagcucaccaccaccuguaacuccuguuccaggggaaccugucacccuuuucugaccuccucaaguaccagcacgcaggugcacguauccauagacuuacucauaaauaaauguuaaaaaaaaagaaaaagaaaagaaaaggaaaguacacaccaagaaguuuguaacugggguguggcaccaagugugguggugagccagcagucuuagcgcucaggagacggagguggguccuaagcuugagaccagccucagcuuuacagcgacucuccucugagauaaagaaaaucaagggcgcucucgaaccaggcggcuucagccgugaacaaugcugaaauggccaaguuuaaggcucgggaccugcgcggcaagaagaaggaggagcuguugaaacaacuggacaaucugaagguggaauugucccagcuucgggucgucaaagugacaggcggcgcugcguccaaguucuccaagauacgaauuguucgcaaauccaucgcccgaguccucacuguuauuaaacagacucaaaaagaaaaccucaggaaauucuacagaggcaagaaauacaagucccuggaccugcgacccaagaagacuagagccaugcgccaucagcucaccaagcacgaggagaagcugaagaccaagaagcagcagcuguauccucugcaaguaugcagucaaggcuugagaugacaaugacaauaaagugcaagacugacugccaaaaaaaaaaaaaaaaaaagaaaagaaaaucaagggcggagaucuagcucagugguccuaccugucaaucacacacaauguacaaugucuuuagcuugauacucuucucccugcaaacacagaccaaaguaucaacgaguccaagucuguuucuugacccucccacuaacaucaaggugauggguaugucagauugguccaaccaacacugcuguggaggccagaggcccaccuuaguguuaggguuucucacuggaucuggaacgcacugaacuaggcuagucuggugggccggugagcacuagggacucaccuaucucuaccuccucagugcagggauuagaguuuaagguccagggcuauggcuuguguccucaaguucucacgagugcgugccuaacugaggcagccaucuuccuagcccucuuccagugaaaccuuacacuaagguuaguuucauagauuacaccucaguuaacaagaaaaaaaaaaagucacacugcugcaauuaagcccaaacuguuaaagagcugagcugagcuggccugggcaagcagccguauuugcauuuuccagaugagcucugguccagagaggggaggagagcugcccaaggcucucagguuccgagcccaggcugcuugucuaagagccuaaggcuguguaccugacaccccacagcccccucccaggaaggauacaggacaggccaaucaaaaggccagagacguuacugaggaaggaggucugagggaugagccaggaggcacacagcagcaaccacggcacaaggacggaaggcaccaccacaccgaacaccagggcccgccucaugcgagagcggaccgaggugacucccagcauggcgaaagcuacuggggugaacccucuggcauccuccaccucccccagcuuagacagugaggacacagacucaaaugacagguagaugauggcggagaagaccguaaagaucaaggugaagaagcaauggcggacggugcccacgguccucucgaaguugccagcaaagcgccagaugaugauggcgccacagagcagggagacuggguucucauagacgaagauguaggucaccagccuguaaacuaaagauggguucggguuagugguccagggcugagcguuccaaccaggggcaaccgggucccaggccagcuaggaagggagaacugaagccgggcacaaagcccuggggcccaccccuagcacuguagacugcucacauaggaauggugccagcacucaggagguagacaggaagaucacucucggcucacuccaggucacucucggcuacacugggaauuuagagccagcuuggacuacaugggaucgugucucaaaaaccacaacaggaagcaaaaacacaacaacagaacaggaaagugcccaugauucaagauauaaaguauauaauauaguuucuguuccuuccuggcccuagagcccugguuaucaaaaccaauccccaugauucaaagcaugagcauauaaugucgucuccauccuuucccggccccgaggcagagguuauugagaccaauuucuaggugugaaaaagauaccuuuugaaaacuggaaugguuucugaacaugacaaaugcuuuacaacccuguuuuagguuuucuuuuaaagauguguuuuuacuguuguguaugcuacuuguauguggguaccuguggaggccagaagaggagguuggaucccccuggagcuggagucacaggcaguugugagcugugccauguggaguccugggaaccaaacuuggguccucugaaagcagccagcucucuucuuaaccacuaagccaucucuccaacccuccucuguuuagauuuuaauacugaccuaccucacuaggcagucugaggguuaauuaauugugacagcuucaggguaggcugagggucccacuuaacacucuguguggcagucuccuuagcuguaauucuggccucuccuuccauagaggcuguucgggggaagaaaaaaggaaccaugaauuauaacgaccauaaaauuauaaaauugucacuaauaauuacauagauuaaguaagggucuucuuaaagagugcuuucggaguuuuacaggggcagccaagauuuauauaccauaaaauagcaaggaaaguccuuuucucucucucucugcagugagacaaggucucccuaugcagcccuaucugguguauacauugcuguguagacuaggcugguuccugggggcugggauuauagguguaagacaccacaucgagccucuuuuggggauacaagguuuugauauguagcccagaccagcugcgaacucacaaucuuccugccucagccuuuugagugcugggacuacaagugucugccauauuugguuuauacucuuccccccaauacaaguaauggcuaacauacauacuuuacauuuuuauaugucuuuauuuguggguauaugggaguacaugaucagagaaaaaccuucagaaguucuaccacguagguccccaguucucacgauugguagcaagguacuuacagggcucuaauuucuuuucuuucuuucuuucuuucuuuuuuuuuuuuuuuugagacagagucuuauuauauagcccugguuguccuggaacucccuauggagaccaagcugggcucacucucagagacccgccugccuccgccugccuagugcuggcauuaaagguacuguuucucugccuguucauggagcccaugcucagacaaauaugguuaagugagcauggugaugggugauguaugucuguguucuaguacucagaagggugaggcaggaggaucauggcucugaggcuacccuggacuacauaaugaagccuggccauacugguguaaauaaauagcaagccccuuuguuucaaaguaaacaaaacgaaaacaaaaaaacaaaaccaacaaaaacaaacaaaacaacaaaaacaaaaaacaaaaacccagaaagaaaaagagugcgugccugucuacacuggcauuuagcugacuguaagugcuacauguauccaaaaaagggggaaaagaaaauuucagcuuuaagcaggaaaccauuacauccuaucagaauaucuccagaaguuugguuauuugcuggauaugucccaaauugaaauuuuacugguaaauaugaaaaaauucuacauacaacucucuaagauuuagguagcugacgagauggcucaacaggcugagguagguccugccaaucccaaagacccgaguuugauucccaggacccacaugggggaagaagagaaagacuccggucagguuguccucugacuuucacaagagugcacacaagcauauaaauaaugugucacauauguauaccucuaucuaaagauguggagauuauauacccaaagcccuaguuuuaaaucaccauacuaaaaacaaagugcggggcuccuaucucaauauuaugauguguuagcucugcgaaucucuguauucaaccucaauuucugguaaacaggcaauuuaauauggccugucaugaaaucacagcgaggauuacaugaaaugaacgcgcaggccucuguuaacguuagaagcaacagggauuucccaggaaagaaugaggaagaaacaaagacuaagaauccugucuuuuacaaagggaugauuaccagacuuaauuaguuugagaaauuucucuccucugagaaaacaaacacuuuaccagcuccuucugugagcugggauuaggagucaggauuaagguaaagacgcagcagaaaauucuagagucaagaggaaaagccauccauuggguugacaguagacaauugucacgauaaaggugagaaacguuugguuuguuccuguggggcucgggccgucagcagaugggguuuguguuuauaaaacgugaauggcuuaggaaguguguucacccucgagaucaaagaaugaauggaucugggguaacauggaagggggcgauuguggguagagaaggaguuggcggaaaugauccggcuuuggacaagacaugcuggagcuccaaguggggagaaugguggugggcacggaggucugggguuggcuggcagugaggcuggagaucagggaccggggagucugcgggcugaggaagcgcgccauccccgccccgccucuucucaccuugccaguugcgcagggccucggagcgcagagacagccccgagggcgccagaggcggcugcagcaggaacaggcgggggcccgacaccagcagcgagagcagggcggugaagaauguggcggagggcaccucgggacacgagcaccagaagcgacucgcggggcccggggccgccauggccgcgagcccuuccagcgugcggccucgguacuccccgccucccuccucaauuuccgccuccuugcggcggucuccccuggcaacagcggaagacuggccucuccucaagcaccgccccaug

SEQ ID NO: 2727 - RNA, 12877 nt, Mus musculus
gccauauagacuugccugcaggcacauuuaaucuggguaacuuagagggagguguugauauccaaauugguucuugauuguaacaauaaaggaggcagaagucaauugcugggugaagggaaaaaggugggacuuuugggucccaggaggaggagaagggacagggaggaugaaacaaccauguaagaucuuggggggcuggaaauggcagucucugcccuggcgguuggcuagaauagguuagcugacaagaaucaacuaucuagcuaguuuuaaaauauuuacugucuaguguuuuccaucugcagagcauagugggcaggaggagaagggacagcagggagaacagcagcccagggucaaaugagcuagugcuuuuuaaaauuacacaaaacagggcaaucccucaauuggaaaacuccccuuucaugugacucuaggcugugucaaauugaugguuaaaagcaugacagaucuuaagagacaugcuaggaagcacucuauuccagccaugccacuaaucauagguuacugcucuauagcugggcucuacccugcugcucuaauguucugagacagucucccucccucagcggccuggaacugcucuuaacucugcagugcaggcaggccuuggccuuuagacccuccugccucacccuccacagaguagcuggggugacaggcaugcaccgcuaagcuggccuuagacuucucugacucuucaggggccucugccuaacgugggaauagccgcuaguucuuguugauguuauuauuuugagauaaggucucccuauguaguuucagcuggcuuguaguucaguauauacaccagucuggacuugaaaucagagaucaucuuguguccugagugcugggauucaaggugugagccaccacacccaaccauagacucuauuccugauuagugagcugauggaaaaggaaaucuacagagaccuugaaaaagaaaaucagagccugcuuuacugucauuaucaacagaccagacauaauuuggaagagaugcugaugcugacucaacacccuccaucaacgcaaacuagauucucaagugguuccaaagacaugaugcugaauaaguuaggaugcugcugcugcugcugcucgaggcucacaccucucacuucauguucuugacaaaguccucgccuuucuugauggaggcuuucagcucagggauagccucggcaaucauuuuuuccucaaaaggagugaucuugccaaugcccagguucuucuccaggcccuuuuucugaaugagaagggaaacggugacaugugaaaccacauucuagcuuggcagcgcagagcucuaccaggucacacggccagucccucacuggaggguucuaagcagaaggacugcaccuuagcugcacaccagcccaaaagcccuuuucuuucaacuguggccuggccuugacagccguucacagcugccacauuccccaagcuauacuugcacagcucugcucuaagugacauuguuccuccuccccuaaagccaagcagguccccaggcagugaugugggcucgcccuggauacgcacccccaagagcaagggcguagagaaguaagugcauuccgucucuuuggacugaacaaaagaacacucaacgacuccuuccuucccguucauggcguccacgagggagaagacaaagcgggcuccagcauaagccauggacagaguggcagaaccugggagagaacagugggucagcacugccagcaccagacgccagauaccaauagugcugccgggaaagcaccugcaccccacacucauugggggggggguauucugggcugcacuuccgcacuucacugucuccaaaucuacagucaccuucacccuacagaaaacugagcugccuucuagaaccuucucuucaggcaaaggcagaugcaccauggagagaagcacccauucgguacccagggacaaccagccuuucucugucacccaaaaaguccuggcccucagugucgguguuacuaccccuagggaugccugggacucuaccugcuccagccuuggccuucacgacuucugugccagccuccuggauccucccggugaguguggccagcuggucuuggggaaagucaaccuucgggguacacugcagggcaagccaaggacuaugugagcauuuucuggugcgagccccuccacacaccccaggccuggcccaauccccccgcuacaguguguuccaucccagcaccacugcaaaaagaaaccaggcuucauuucuucuuggggauguaacuuagggccuccuucaugccaaacagagguccugccacucaaccacaaagacuccaaaguccuuucuuagacaaaggcaaaaaucacuuuuuuuuuuguuugagacaggguuucucuguauagcccuggcuguccuggaacucacucuguagaccaggcuggccucgaacucagaaauccaccugccucugccuuccgaguguugggauuaaaggcgugcaccaccacgcccggcuaaaaaucacuuuguuguuguugagacagaucuuaugcagcccaggcuggccuuguuuucaagaguuagccaagaauaccugacccuccugcuuccaccucccuguguagccgccaugcacagccacccuaauuacuugugugugcacacauauauacauugcggggccugagguugaugucagcugucuucaaccacuguccagcuuauguguguuuugagacagggucucucacugaacucagagcuccgacuaggcuaggcugacugcccagagauccucucaucuccucccgggcacuagcaugauagccuugccucuggcucauuuucacauggucgcuggggacucagguccucguguuuggauggcaggcacuucacugacugaaccaucuucccaccacuuacucugccagagguuuuacacaccgagcagcagagcccucgacuccgcguagucuguccacccaaggauccccucaccuuugguccgcacccagguuucucccaucucuucucuuucgccccauuugcaaccagcucucccuuuugugacuugcagccacaauugagcuugaagaaaacuuuguuuuagauuuauauccacugacccaucucuccaggccuggccuugcagagucuuaauacucaggguggacgccaaguuuccucuugguucauuuauacaguaugcuacguaccacagauaugauccuuaguacaucauauucaggggcuacagagcuuuuauagagcucauuaaaugacacuaacucuuaucaccauucaauucaaaucaacugcuggauuuuuuguuuacuauagggcuugauguagcccaggauggcaacaaauccaucccacagccgguggauggcaagagugaacuccuaauccucuugccaccaccuccccaaagugggaauuuauagcuguccccucucacaccaggccuucuauagugccugcuuugaucucaugggcuguuucccagugugcuagagccugcugcuucugacaacauccagccccaaagcggauaaacaggaaaaccccagacaguuggguuccagccgcagcagaaauccuuccacaauccagaggccaguuccccuuguccagacuguucugagggcuucaaggcagccuuaagaaggcgucugucuuuuaagagagagcucuugcagucacgcaccugagagaucagggggaugaucgucuucccggcguggccgccaaugacaggcacguugacucgagcuggauccaaacccuacucagcaaagcaggaagcuugauuaacuguuaaccaguucccugagccacagucacccaaagcacacagacuggaaacccagaaugcucagaaagaaccaggaggacucagagucuggcccugucacaucaucagucacugugagcagaugcagggagggacgguguggugguuugaauaugcuuggcccaggagauguggccuuguuggaggaugugugcagaugagccuucagacccuuaaccuagcugccuggaagacagucuucuucuggcagccuuuggaucaagauguacaauucucagcuccucgcugccucagcacccugucuaccuagaugcugccaugcuccugccaugguaacaguggacugaaccccugaaacuguaagucagcccaauuaaaugcuguccuuauaagaguuuccuuagucaugguguugcuuuauagcaauggaaacccuaagacagucaguuugugaaggggccaccacaggcuccucugucacaggccaaacuguacuguccaccuugcuagacaccugaugacauccucagguagccagaggacagcaacacuccuaugcuaaggucacuaugaaaaaccccaacaaguguccuucccacccugucccagauagaguucuuuccccaaaacuuaagagaaucuacaccuguuccccacacuguggcuggacagcaaaagcacaggcucaaggcagcagggcugcuagugagauguacacagucaagcggaaugcccgccaagcagggugugaaaggcguccgucagcagacacuggcugauuaagagugucucagugguuaagagugcuugcuguucuggaacuuuccugauccuuaucaccauguguaaggacuagcagauaaaucuaguuuuuccagggcauggcauaugagacaggugguuaccauccaaggguagauuagagucugaaugcugaugcagagggaagaggucaagggcagagagcacacuaagccaggcaguagcuggccagucugagccugugggguccacugccuaaccgccuacaaaaaacacugacacuggcugcaaagacggaacucucggggccauguuuccugccauguucugugcccucccaugugcaguucagacaacagguacugagucacccacaggguccucccucaccuuuagcucugccacaaacguguucgcucugacgaugucaaggguugucacaccgaagaucuuguuaggguuguacacaccgugcuucuugaaaacuucugcugugauggggaugguggaguucaccuaaaaaaucaugagacagacgucagcuuacagcagagcccagcaacaggcccugccaauagcaguaagccaccugcaaggacaggcaaggcagccacagcauaugaacaaagccacaccccugcacagacgccugcucucuggcacccuccagccaucccaugcacucaaagagcccugccccugguacucacuggguuggcaaugaugcaaaccauggcuucaggacagugcugggcacaggcagccgucaggguggccacaaugguagcguugguguugaacaggucaucccgugucauuccugggaugauccagggugagagagccacauacaacauuaugaaauuucaaaaacaauuacauguuuauuuuuuccucugugugcaaacaugucauggugaguguaaguaugugugugagagagucaaaggacaacuugugggaguuggcccccaccuuccacuuuugggaggucuuguacucacauauaagcacuaagaaaaccaggaaucaugcaggagugucuccucaaugaaggagauagaaaucaaauaccugcauuucaucuguggcgcugagaguggauuuuucuaauggccuggugaccuuucggcuaucuagaggcagaccucacccaaauuaccaagaaugacugucccaggcucuucccucccucgaccuuuacccauccugaggggagaggucacauguacuuuccggcugcugaccucugugcucaguuagagaccagccuuucaguuauagaauccacccucacaaucaaauguaauuuguaagagucuccauguagucaaacuuuauugugcccuggaacuggacucccaguugccuggaaacuuuccccaaacuguaccuuuuuuaaaguuuuuauuuuauuacuuauuuuauuaacuuacuuacuucuuugcuuacuucuuugagacaagcucucucucuguguaacaguccugagcgguucugguacucacuaugcagaccaggauggccucaaagucagagcucugccugccucugccuccccaaugcugggauuaaaggcgugcgccaccacacccagcuuguccuguguuuuaagcauucggacagugaagcgccuggcuuaggcucccugcaggcugauccaggcugaugaagccaaucugcacuggguuuucauucucaucucuucaagugccccacuucccucucugacaccugcaggaaccccucaacuggugcccagccugggguacaagacccucagagaagguaagaaaaguuuuaauuuuuuccuagaaauuagagguuagggcaacucacuaaaaugaccuuaaugugcgagaauggagcuauaggcucuucucaguccuauagacaaacuguuuuauacaauuagugaaauauuuguuaagaucccaaaagcccaaaauguucagagcaauagcgcugcacugcuauaugcauaggagcuaaaguagagagcccaugaaaaugacgauaauaaagucccugucaauguggguaccagggacugaauuugaggugucaggcuugguggcaaccaucucuaaccacgaagucauccugaaggcccaucaaggguagcaggaguccuaagauggagcuggcugacaccagguggacauguggucuuuccccuggacagagaggaggccuuuggagacggagagggguaaagccacagcgucagcaggacgcgcgcgcuucucaacugugugaggccacuucaggccaggcuuuagaauauucauuaauaaaaacauuguauuuguaugugguggccugcagagaugcagguggguguuggcucccugggagcugcagucacaggcauuugugagcggcccacuguggaagcugggaucuccaucaggugcucucgcacugcaggaagugcccguaacagcugagccucuguccaccccacacccacccacacaccugguuuccugggcacuccggcugggaugaccaccacaucacaaccuuugaggcaaucuggcaacugcuccgguccaagguagccuggaagaauaccccauuagggcagugucaccuuuccgagcccagggaagccacaugugaggggagagcacacaauugcugggucccaucugugaggugccaggcccugucuaaggggaagagcccccucuggacagacuaguucuacagaaacuagcuaggauccuccugucuccaccuccugagugguggaaauugaacccagggauucaugcaugcuaagcucuacccccacccugagucuuuuugacaaggucucaaauauauagcccagggugaccuugaacccaugauccuucugccuuaacccugccaagugcuggggugacagguagccugcuucaaacuucuacaacaaaguauuuauuauuauggggguggguguguaugugcaaucacagcacaugugugggcugacaacucuuuggaacuggcucucuccuuccaccuucauguggguucuggggaaugaaccugagccaccaggcuuacccagcaaggacccacccacaaguugcuuuucuaaaaaacaccacagcuuagguauuuguagacccaagucuaaaacaaugcagucaucugggcauuugugcaaugucacucuaaaaugagccugcagcccucagguucaccuaugauccuguuuucaacccagacccuggcuacuacagggaacaugguggagucuccaaggcagccacgcccaguaccuuucacauuugcucuggucucaaugugacucagaucugcugccacaccaggugugugagcgauaucguagagggucaggcggcucacuagggggcuguucuucagcaggagugaaagggguugcccaaugcccccagaagcucccaggacagccacuuuagcauuguucuagaaaaaagcagagagaugcacacuuuagacagaaccagcagggcacuccaaaaaccauggcacggggcucuaagaugacgaaaugcccaagcaagacucagcagccauaucaaccaguuuugcuguggaagagcucuggaccuccauuccaaaguccaaauucaaguggagagaacacaagccuagagauagcaggaugccaaaugucuuuucuacaagauaacaaggcagcuccaccugggcagccagcuggacccaugacagcagccuuaccuuugaucugcgguuuaagaacuacacauuacuggagagcagcagccucuuacugcacuaagagugagguaggaaagcuggaagagaacuauuccugucaccacgaggacuuguuccaggauccccacucacccacagaaagcgguagcacuguguaccacugacugacacacauccuccugucugcucuccaauccccucuccugcucccucccuccccacaggcacuuuugaggugcuggaauugaaccaagagcucugcucugguuaggcaagugcucugcuacugaacuccauccucagccccgugcaccuguacucuaaaccaucucaagaugacuuguggacuggcaguauaaccuagcaaguagaggugcuugcuggaaaggagaggaccugauuuccauccuuaggacccacacguggagcaagaaaccaacuccaggaaccuguuuucugaccuucauacauagccacauguaauaaaaguuaaaaauaaaaagauugcuuauaacacuuaauacaauauaaauaugcagaggccugugaaaacagaauuaaggaauaacaacaagaaaaguuugcacauguucacuaugcaaguaauauauuuugaaagacuucuacauuccuacuuauguauguuacguauguaucugcaggaacgcaugucauccaugcaugugcguguccagaccacagagggcaucagagcaguugugagacacccagugugggugcugggaacuaaacucagguccucuggaagagcagcaacugcucuuaaccuuugagcugucucuucaguuccuauuuuuuucuuuuuugaauguuuucaguccaaggcuggcuggcccuguggguggaggccacagggcuacacagcaggaaauguaauuagacaguaauuaaugcuguaauaaguaauaauggguuucaguuaucaaaacccaaagcccaagguugggguggggcucagugauagagugcuugccaagcacguaggagaccuggguuccauucugagagcuggaagaagaaaaggggauacacaccuauagucccggcaggaggcagaggcaggagaguucugaguuagagaacagccugugcugugcagagaggcccugucuccaaaacccuaaaaaggaaccaguguaugaagaaccuggccuccaaccugccugucuccuugucucccaacuccuuuacccugagucacugucaccccagugggauuucuccaaggcacuaguguggugguuccuuccaacuccacugaccuuugcugagagcccagagucacugucaacugcccacugccuagcaacuauacugaggauggacagaaccguaacacaauucauucacaacuucugcuuucaacaucuaagucuguucaaaacuucuagguuuguuucuacuaaaacuucuagguuuguguuucuacuacacgaacgcacauacagauuagaaauaaacacauggggugggggagagucacucugaagcccuugacuacauuuuuccauugagacagcacagcccaaacacccuuagugcccguugucuuuggauuuacuccacuguuuucucaagagcuacugguauuuucuuuuuguguuucuaaaucuacugaaagccaagccacugaauuuuuuaaaauacccucgauugcuuuuucuccaaagucuuuacacuguaccaccaagccacaucccccagacccucacuggggauucuaggcaggggcuuuccuacugagccacaccaccagccccucccuagaugacuccagacaggcaugccgccacugagugcuaccucuagcaagcucuuccagaacucuuccucaucucaguaaauaccaaacccuaccaccacccacgacuccacuuucccuuauccgaucagcaaauuccgugagcuccaccgauuuucaccauaccuacagagucacaucacagugaccccuuaccugucuccccuaccuaccaaguacuugcucuguucaaaaugguaccucacuuuuaagguuuuacaaggcuugcuggguucucuccauuccuccuuuuauuauuccacaucucccugccccauaugcuggacagucuccauccaccugccugcaauucuuucuacagauaaucuaugcuuucuucugguugucacugaaaugucacauuccugaugcugguccugugauugugggauggcuaggcaaguaaaaucacuugcuucaaaagcucaaggacaugaguucaaucucgaaucuuucccacacgaugaaaaaacagacuccagcaaguuguccucugcaugcuacugugcugugaugugcacacgcacagacccacacggcccuucccccaacuaaaaagaucucaacuuccuuccucaguggcacaauauucgcuuagcaugaguauggcccgaguuccauccuccacacacacccccccccacccccacacggcacuuaaccacacuauuauucaccaucucugcugagcuaacccuacucuacuguucagguuaacucgucugugacccaccccagacuucccauucaucuuuguaucugagcacccagagcuuugugcaugccucacauguguuuaccacugaacuauguauacccuagugcuaguuucuuuucagaguccuccuaagucaccggggcggguuucaaacuuuuaaucuuccugucuggaacuccugaguggcugggguuacaagcaugcaucaccacacccaggguguaauauguuagcuggauuauuuuuugguguguguguuuaugugcagguacccacggagggcagaagaaggcuucagacccucuggugguuggagucaccugccuuggguccugggaaccaaacucuagucucugcaaaaucagcaagcacuuuuaacugugagcaccucuccagccccuugcaucuuuauuuuucaaugaauggacugaaugggaaacaggaagaccugaccuagaugguaagaaauguagacuucccuggaaugaucaguucuccuccggagcaugguaauuguuucucaagccuugguuguaucaauuuugcuagagauuuguaaaaaauacugacccugcccucuugacacgauccugggucuccuuuacugauuccgacaugcacuaguuaaagaggcccuggcccaggagaagauugacuauaaauagcuuagcuguaacuguccuaggccaagucuacccaaagcaaggaugauccuccaagaauaauucaaaagagauccaguggaggagaugguucaguggguaagugcauaaggaccugaguucaaagcccgguuccccugccuggcagguucaucaaaggccuucucacucucauaaauaaauaaauaaauaaauaaauaaagucuacaacagggguucuuaagcuuccuaaugcugcaacccuuuaauacaguuccucauguugaggugaacccuucaaccauaaaauuacuuuuaaaaauaaaauugcuacuucguaacugaaauucuguuacgguuaugagucguaauguaaacauuugcuacgggaccccugugaaagggucauucgaucccaagguugagaaccgcucgcuggucuagugugugauggccaagacaccgauguccuucucuggccucuguacaaucaugugcacaugacaccacacacacucugaaaaacgaugcuugaugcacaucuuuaaugccgguacugaggcagagacuggacuccgugaguucgaggccagccugguccacauaaacggacauaaagcaagcaaucccugggcgggaaggccacugacugugcuaauuucaaucgaaucucccaaacuacugugacccugauccguucuccacccucggagcccccggcacuacgaaguuaacguccgcguuauuucucuccuggugccucacauccauggaggcuucaaggagaaaaucaguuaagucgaagcaaugcaaaguugcauauaaugcaacucgcauccggaccgcgagccucggcuucugcaccuacguggagcgcagacuauggaggaaaccuggacugacucugucccccuuccauguuggucgggaugugagccgggcggcccagacguccagagugagccuuggaugguuaagaaacgccgagcuccggggacgcgugugccgcccccggaguuccuuccuaggcaggcagccccuuguaccugggccgaagugcugaagcugcggcggagagcggcgccggcaggacgggcgagagcggacagcauggcuagggcgggcgggacacggagcuacuggcaggagcuacaagaagacgagugacuccaacgaccuccacucugcgcaguggccgcccgguccagagccaccugaucucgcgagagaagcgcaagaagcuugagccaaaucucgcgagacaggcucggccgugugguuccuugucuagcacgcccuagacccggcgagcgaggccugacgucacgauucucuccggcuccaaagaagucaucucugggcuccggcc

SEQ ID NO: 2728 - RNA, 1647 nt, Mus musculus
cgguggugagcaguagcuugcaacuuuuauuugagaaaaacagcagguaaauguauguaucaaaagagcgcacagauugacagagagggguggccagcaauggcuaugggagauaggcagcaggcugauggcuucuacuuggcuccagacuguucagacuucccagcuucugggcccccaauuugggcgcgggccucgaaaguaaccggaauggugaucuccgcugacugcgugacugcuuugggcaacggagccuccacgguaagugugcccucaggggauagggaagaggacacuagggugggguccacaccuggagggagccuggacacacagaaaaucagggcaaggguuacacaucccuccugacccggggcucuucgcccuccgcccuggguccgcucccccucccccccaccuccccgcccuccaugcaaggaaucagaacucacguguauuuccgggugaagcaccgagagauguagccauguucguccugccuuucuucgugcuugccuguggguggggacagaaggucagaagcagcccucugcuguccuagcuaaggaguggcugggaccccccagggaggcaaacaaacccgagugcggcggggugccugacugucuggaaucuuaaaacuuuccagaaacuucccuucugagauuugggaugcgaagggcuuggcucugacccagacuuggauaccaggguagguauacucaaagccucugcggcugggucuagggacccugauccugccgcuugcuuauuugggaaugaggucuuccagaagguguguugggucuuccuucauuuuguuucugugcugcggguggaacgcaaagccucaaggccucccggcaggccaggcgaagcucuacccugagcuacauccccagcuguugguccauaucaucgaagaugacagagcuuuuaagagcaaccugcaccccgcguuccggggcaagagaagcaggcaaaggagaaugaugcgggcuccgggucccuagguucauuucuaacuucucaggguucuauuccucaggguuucagcccccacccucagccccccagccaccacucucgccucggcagcuucguccccucugggcacaagggaaacucaccagugaucuccaccacgccuuccuuggucuucacugugagcuccuccggagcgaagugguugacguccagggacacgcgccagcgaucagccgucugucggaucuccgagaccccgcugcugagcugucgguugagcgcucggcugaaggcuggugcggccagggucaccgccgcggggcccucggcggucgcggcgggcagcgggcgcacguauccgggccacccagcggcgcugaaccacugcgaccacucaucgggcaaccggggcaccccgaaagcuugaucgaagaggcggcugugugcaggguaccagucccggaaugguucccagcucgggcuccgcagcagcgagaagggcacgcggcgcucggucauguucuuggcuggucaaggcugaggaucuagaagcacugggcugaggauccgagaagugccggacuggagccccagcgugcuuuuaugugugcccagccggguauuuuuagcaggcggugcuucaggucucuauuaauggca

SEQ ID NO: 2729 - RNA, 1831 nt, Mus musculus
accugcgagagcggcaugcagaugcccgcaccagccgcacgcugcuucugcuggccaaggugugggcgggccugcagaguggaacgggaaggccaguuagguugcaagggacccuggcaggcucuguagugucgcaacaauuggcacuaggaaggucacugauccgauauggcacugcacuucacaguuuaaaauaaugcucgugaucacuucuugagagccccauccacacauaaggagacacagaaagcccaaagcccaaaucuucccaguucuaaucuuauucccagacaugcagaagucugauaguaggaugaaacuuucagggccagcaagagggcuuaguagguaagggugcuugcugccaacccuggugacccgaguuccauccuuggagcccacaugauggaaggagggaaccagcucccacaaucggcauccaagucccacaugugcccaggcaagccccaacacacacgcaaugauaauauaauuaaacacauuugcagagaaaagccgaaauguugaucccaaaguaccagguguccaaagacucaaaaugccaugaucccugguuccccugugggacuucguaaggccucagcuugaaguaggcagccauggaugagcuguugucuccccaaagcucuaucguucuugcugucaucccuaggcgguccagaacauaggcaauauggacacaccggucucuagggccaaagagucguggauggaaccacuccagccuaccgugcgccagggcguggcgcagcugaaggacuucauuaugaagcuuguggacauagaagaaaaggaaggcaaggacuuuaccacacaucauggcgaaggccugugugcaaguuuacuacuugaccccgcauaccgaccgccccgcccaccgagacuaagccuauccgggcuuucuguuguuuuguuuuagacagggucucauucaacccagggcuggcugcaaacucacugccaagaaugaucuuaaauucaaguggauccucuggccuccacuccccgagggcugagauuauagcaugugccaccaagccuguguuucuguggugcugugacucuaacucagggucugcccaugcuaggcaccaacuuaacuucauccccagcccuuuucccccacgacccuacccacuguaggucuuagcaccuccccuaaucuccccgacccuucgauuucccacccauuuucuuuccugcuuucagagcuggaccugcagcgggcuuugaacucacaggcaccaccugugaaggagggaccauuguucauccacaggaccaaaggcaaaggcccucuugcauccuccucguucaagaaacucuacuucucccuuaccacugaagcccucagcuucgccaagacguccagcuccaaggugagcgagcaggaaggcuuucugggaugguguuuguuuguaggcccagcaauugggagguggaagcaggaggcccaagacuucaaguccagccucaacgacauagauagcucaaagccagagugagacccugucucaaaacaaaauggcaaacaggacuauaacuuauuggacagaguacuuacagggucggguacuuuagcacacuggcuguucugcaaaccuuccuggaugcaaacccuaaaagcagguuuagccucaacaccuggcgucuuagcuguaagucugaugcuuaggaacccgcccaauccagcgcguuaggcgcuccccucccaggggccuguucuugacucuggcugagaucccuucacagagcaggccacuaggaacaagaggggaguuguucaggucccucacuguaaguccuaaug

SEQ ID NO: 2730 - RNA, 5661 nt, Mus musculus
ucgcgccugcgcucuuaacugaucggaggacgcgauggcggcggcggcugaaguuucucuuuugcaggagugcggcuguaagggcauccggaccugucuuaucugcgagagacaacgccacagggacccgcccuggcagaucugccuucagguacggacuaggaaaagagucauagccagaaaaucuauucaucuuaaugggaaacuaaggcccagcuugccuguaaaacagccaaggaccaaagccucgcgguaggugaguuguuuggagcgcuuauaucuucaauauucacaaaacccaaaagguggaccaagugccaucggcugauuaauggaagggcggggaaaugcuggugcacgccgagaucucugcauuugaaaggcagagaggcuggagaacggaccucagccgcccagcagguuuuaggaguuaccuuggcaguagggaagcggcugucacacaucaucucugugacuuuggggggugagggguggggguggggggcagugguaaauaacuuggacugaacgggucugguuuugagugagcuuccggagcacaagggagacugcauggaaaugguagggagugcugaacacuaggccgccuguauuagacagggaaugagcgacuuaagacagcacaggcagccgggcagugguggcgcaugccuuuaaucccagcacucgggagacaagaggcagguggaauuccgaguucgaggccagccuggucuacagagugaguuccaggacagccaggacuacacuacagagaaaccugucuccaaaacaggcuuugauuugggggaaauuuuuuugggaaaacaaaccuguaugaaucagcuuuacagccgggcagugguggugcaugccauuagacuuagcacuugggaugcagaggcaggcagaucucugugagucccaggcuagccugaucuacauagggaguuccaggaaagcccaucuugaaaaacaaaaacaaaucugucuuacaagauacuaauaggaucaggagucagguaggccaggaagaauguuaaaauguuucccuucuagcucucuguugaccaggcuaacaccuuccaucaaaaugggcaauggauggaugaaugaaugaaugaaugaaugaaaaauaacuucagagcauuuguauggcccuggcagugcuguagcaaguugcugggaugcauagccaggggaaugcuugaguagaggccugagauaggagcuguggguggcugaggcgacagacacuuaaagagaucaaaggggccugagccaaguuuuuuguuuuaguuauuuucuuuaguuagaggccccagggcgcccccuccauaagcuaagauugcaagcauaugucacuaugucuggaucauggcagcauucagagugaccaaacacccaaguguuuauuauaucaacuggugaacugaagagugggcaguguuggugcuggcuugagggaggucaaagauaucuacauagcaaguuucaaaccagacuaaauaaaagccugucucgacaggaaagaaagaggcaaaccauaaacuaauaagagauuuuuaaaaaucucggauauccaugcaguagauauaaccuuagaaaggaaggaaauucugacgcgaguuccauauggauucaccuugaagaugugcugcuaaaagaaggaagccagucucuagcuggaggcguggucuggagauagugcaccugccuagcaccgcccaggcuggagagauggcucuacacuuaagaacacugacugcuucgggcgugcuggcgcaggccuuuaaucccagcacucgggaggcagaggcaggcggauuucugaguucgaggccagccuggucuacagagugaguuccaggacagccagggcuacacagaaaaacccugucucagaaaaaaaaaaccaaagaccuaaguuugccucccaacacccaagucacuggcgcccucuucuggccuuggagggcacaugugcaugccacacacagauucaaacauagaaagaaagaacugcccuagugaggggcuugggauggaccucugugguagagugcuuaccuaacaugcuaaggccuggcucauguagcccaggcuggccuuauucacuauauagugaaagaugaccaugaacucuuaaugguccugaagaccaggauuacagaccucugccgccacacagguuuuuuugcagugcuggggaaggaacccauggcuucaugcaugucgggcaggccuauaccaucugagcuacagccacagauuuaugaugcccuacauuuuauguacauugguguuuugccugcaugugugucugugugaggguguuggaucuccuggaacugaaguuaauggacagucgugagcucucccgguugguugucuggaagagcggccagugccuuuauucgccgagccuucucuccagcccuaagauggcguuucuacuacugcaucucuuagucucagaggaggcaggagcagggcugaggaagacacacaucuguggcuuccaauaagcauuggccagccccuggccacccagaccacagccuuacgguuagcccugcuucucagacuccuggugcaggcuccuguccuuuaucuuuuugcuccugaggggucggugauagucacagugccaaaggaauagugcccacaucccccagccucaggccagguccucagagaagaaaaacacaaaugagagaaugagaaucccaugcccugaggccugaggccagguucaggcugcaucgccccugcgacuccaggcuccucuccaaguugcuuuaguuccaagaagagcaucggaaucccagaggcuccuggugggucccgggcacauguggcuauugugggucuuugcugguuccagggcacuucuguuugggguguaugcguguacagguguauguguauacagguagagggcagaggauaacccaggugcccaccuugguguuuugagagagucucacuggccuggaauuuucuaagaggccaggcuagcuugcccuuggucugaccuuugccucccuccccagcucuaggauacaggcauccaugaccacacccagcuuauuacauuuggguuuuaggggauggagcucagaucucugugcuucuugcagguuaagcacgucagcagcucacccacucugccccaucucugucuuuuacagaaaaaaugcuguuuccucuacugcccagacacaggcugggccgcaggggccgagggcucugacuuggaggguugggcauuccccuucccaggagugacacugauacaggacuuugugaccccagaggaagaagcugagauggugcgucugauggacugcgaccccuggaagcucucacagucugggaggaagaagcagguacgguggccugagcugagccgagguauggucccuuugccaguggccccggcuaccuccuguagccacacccuagggaucuuuggucacaguggguguggacuuccucaucaagcguggcugccgcgucucugugcggcugucucugcggcugucucguuggugaggggaugccaagcucuagguuggauuucuauccugugugcugcuagaggcugccgggcaucacccguuucuauugugacucucacuccucaccuguaugucucaccuucuaucuuuucccuuccucguuaucucucccuugccacaauguagucagugccuuaguagcuucaaaggugccccucacccuuugcuccuggcaccauagugcuggguuagaguucuggcgacaucagccaguugggggucccuucaagcuucguccugugcugggacagccccagccacccacucugccccugaccucugaacagauggagcaguccuccuaccuaggcuuucuggguccugggauuucaugcacacaccagccaugcccaguuugugguugccauggcuuaagcugggccacuucuccuuccugucuccacuguaggacuauggcccuaacugcuucuccuuccugucuccacugcaggacuauggcccuaaaguuaauuuucggaagcagaagcugaagauggcaggcuuccagggucucccuggcuuuagccagaagguaguccagagaaugggccuuuacccggggcuggaggacuuccagccuguggaacagugcaaucuggacuacagcccugagcggggcuccgccaucgacccccacuuggacgacgccuggcuguggggcgagcggcuggugagccucaaccuccugucagccacagugguguccaugucuccagaggccccuggcagccugcuucucugcucagcccccuccgucagaccugaugcuuuugaggacagccuuguggcuccuagcaggucuguccccugccaggagguggagguggccaucacaguaccccgccgcuccuugcuggugcuuacaggggccgcgaggcaccaguggacacacgccauccaccgcagacacaucaaggcccgccgugugugcgccaccuucagggagcuguccagugaguuccugccuggagggaagcagcaagaacugggccaagaacugcugcaggcugcacucucguuccaggggagaccggugugaugcuucccagggcccaggagcugucacuggccuggccaaaagcuuggcuccagcacaaccaucggaggagcuaacacugaggucuccccacagcaguagauucgugggguuuuuuugagacaaggucucauguagcccaggcuagccuccaauuaauuguguagcuaaggaugaccuuggacucuugccuuuucuaccuccucuucccaagcucuggcuugauuauuuuguuuuguuucucuuuuugggacagggucuccggccuagacuggccucagacucuguuuccagccaaggaugacuuugaacuccggauccuccugccucuaccucuugaaugcugggauugccagcgugcaccaucauaugcaauuuuugucugugcugggauggcagcaagcguucugccagcugagcuaccccaccccccuagccuguuggggguuuuugagacaaggccucacaugggcuagacuggccuggaacuccccauccuccugccucagccucccagucgcugaggugacaguguacuggugagguuuuaggaggagccaucugacccuugacgucaugagcaucguauguccugcccggagcugguucugcugggccugggcugcggccauuccucagcucacugagugucauauguggagggauugagucuuuuagaacuucaguacuugggacgaguaagguggcucaguagcuaaaggugcugccaccaagccugauguucagucucugcaauccacgugguaaaaggaguguccccugaucuccacacgcacaucacccauuuugauaaaauucauaauaaaagaaaaaccuuggucucaugugaaaugaauuucuccuuuucccaucccugugugaaguaguuguaguuauuuuguuuuguuuuaaaacagggucucacuuuguagccuuggcugucuuggaacucgcuuuauagaccaggcuggcccuuaacucauaaagaucucuaccucugccgcugaguaagugccgggauuaaagauaugcaccaaucca

SEQ ID NO: 2731 - RNA, 3578 nt, Mus musculus
uggucucgcucggccccgccucccuuuggacagcuccugcugcgcagacucugcucuucccaauggagcagcuccgguccuccagagcaccgagccgacuuccuagagacguccccaaggaggcaccacccggaaguucaggcuucccagagggacccuagcgugcuuucuguaacgccugccguuacuccuucuaccccgaggcuguccuaagagggcucuccuuugucagaaaagaugaaugaagcauaguagcuguagcaugaaggguuacaguguugcguguuaagggaugaacccccaaagugccuguagaaaacagcucugggccuaauguccuggcugcggugcaggaugaaagacuccgguugauagaccgcuacggagaaaaaccaaagaaggcugucaugagaacauccucgggugcagggguccauggaugcccagagacgaagcugcaaggguaaguggggucgauccucaggguugcaguuuucaaacacuaucuuguguagcuuugauuuuuuuuuuuuuuuuuuuuuuuuuuuuuuuuuuuuuuuuuugagacaagaucuugccuuguagcguaggccagccuggaacucacgagucccccugccucagguucccaagugcuagggucauagccaugcaucaccacuacucuguuuuuacugaaaacaucagcgcucugauuguggccaugaaacggagcuggugccagacuggguuggguuggacuguguugaugggcuggaagcaggaacuggcugauuauguaauauguauucauuagcaguucaggcucuuucacaacgguauacccuccgugagaacaagaguucuguucuaucuagcaccgagaagaauucuugguguguuauagcugcuuaauagggugugagaggaacaucuuuuuauuuuuuauuuuauuuuauuuuauuuuuauuuuucgagauaugguuucucuguagcccuggcuguccuggaacucacuuuguagaccaggcuggccucgaacucagagauccgccugccucugccucccaagugcauuaaaggccuucgccaccacgccgggcuuugauagaacaucuuaacuccccgccuagccagggcaacugagaaguagaggggaggugacugaagguuggaaaccaccaaaaauggaguccuggucaggaggauuugcagagcacuccugcgagcuaaccacugacuucaggcugcgugggcucaagggaggggcucggggcccagaccagcuaaguuuaguuucacggcccaucaccauccacaugcauccuggagcugggaaguguuuucuuuugccuugaauagucccaucuacaggcccaaaccaauaugcauagcgugauuaauaaaaccauucccgcuggcuucccucucagaugaugcaaaagugaauaucuucaugccuuucuuuuccuuuucuuccccuuucauugaccauuuccucaaagaguuuauuacuuagccaaacuguacugugacuuccucuguauuauauuagaacuuuccagaaaguugauaaugaagcugggcgugcuaauccauucccauaaauccaaaguugggaagucgaggcaguagaaacaggaacuuuuuaaagcugaccugggccguugggacccugccacccauacauggggaaaugugucccuucauaaagacuccugacauaaagucaagcguggcaaucuaagcuuagauccccagccagcacucaccuaaaagccagguucgacugugcccaucuguaauccacgugcaggagggaggagaagagaggccugucauuggaugucauuuucuggacuccacaugcacaugcagauacacacacauacacacaaacacuaauagugauaguuuuuaaaaaguuaauaaugggauggagaguuggcucauaagcuaagcgcacuuguugcucuugcagaaaacccaaguuagauucccagcaacaacacgcuaguucacaaccaucuauaauucuacuuccaagggauccagaacucccuucuggccuccgaggauaccacacguauggcacauauauauguuugcaggcaaaacacucauacacuggaaaugaaaaauaauuguuuuuaaaguuaguaauaacaaucuaguaacaauucaaguaguuaggacuugaaugucuacuacucuuaggcacugaucugggcucagaaagagguccugcccucacagaccucccagucuaagucaggaggccaggaguaaccccaucguuguuuaacacaaguggcacacugaaaaccagcacagagcaaacagugccccuaaugugaggaugacaucagauuuauagcucccauagggcuggagauaauggcguguggagugacuuuacuacugaauuaccuuaaagaguagucccuggggacugcauugccuuuugggguuuagaguuaaccugcaguguuccuuccccuccccuacugaucaaggugaaguuaguggaagugaagaaguaauuacaaacuuaaggacuggcaagauggcucagccagccgugugcugguuagcucuuugacaucuugacacaagcaagccagggucaucuguuaacggggaacuugaagugagaggauggcuccaucagauuggccugccagcaagucuggaggacauuuuccugauuuguuugaugugggaggcccugcccacugugggcggugccagcaagcagguugagcaagcccggaggagcaagccaguaagcaacauuucccauagcuucuguuuucagguccugccuccagguuccuucccugguuucccuugguuauagacaauguugccaaaagacucuuuccucccuaaauugcuaacuaagauaacuagggugaagguacuugccaccaagccugaugacuugaguuugaccaccacauggugggaggagaggaccugcucaucucggagcagccagaucuugggguacagaauuuagcauugaguacagagcagcaccagaccaacccacuacauuccccacuuucuaucuaaauaaaaaggcucuuucucuuauaauaauaaacauacagaaggaacaaucaugaaacaauuaugaaaacuauuaaaugagaguuacauucaaaaaguccagucuuuuaguauuuggcaguguuuagauaaaauauuuuauuguguacccuaucuugauaaguucagauuucucuaucuaaaucauuuuuucauuaccaucuuaagcauuuuaaguucucuaauuucauaacuuagaguuagcaaccuuaagacauccauuuauaauuuccccuaaucuucauaauuuguguguaucacauccugaaaaacaucuccuuagaucuuaaaacgcuuucgagauccuuucuaguuuaacugugagacuauagcuaucuaguguucaauuccaucagagcccugagaagggauaaacauuaccugagcaugcaggaaaugcagagcagcagcuuccaagaguacagcaauggcggacagccgacucaggcuccgagccacguaacccucuugucucuucaugucug

SEQ ID NO: 2732 - RNA, 3578 nt, Mus musculus
cagacaugaagagacaagaggguuacguggcucggagccugagucggcuguccgccauugcuguacucuuggaagcugcugcucugcauuuccugcaugcucagguaauguuuaucccuucucagggcucugauggaauugaacacuagauagcuauagucucacaguuaaacuagaaaggaucucgaaagcguuuuaagaucuaaggagauguuuuucaggaugugauacacacaaauuaugaagauuaggggaaauuauaaauggaugucuuaagguugcuaacucuaaguuaugaaauuagagaacuuaaaaugcuuaagaugguaaugaaaaaaugauuuagauagagaaaucugaacuuaucaagauaggguacacaauaaaauauuuuaucuaaacacugccaaauacuaaaagacuggacuuuuugaauguaacucucauuuaauaguuuucauaauuguuucaugauuguuccuucuguauguuuauuauuauaagagaaagagccuuuuuauuuagauagaaaguggggaauguaguggguuggucuggugcugcucuguacucaaugcuaaauucuguaccccaagaucuggcugcuccgagaugagcagguccucuccucccaccaugugguggucaaacucaagucaucaggcuugguggcaaguaccuucacccuaguuaucuuaguuagcaauuuagggaggaaagagucuuuuggcaacauugucuauaaccaagggaaaccagggaaggaaccuggaggcaggaccugaaaacagaagcuaugggaaauguugcuuacuggcuugcuccuccgggcuugcucaaccugcuugcuggcaccgcccacagugggcagggccucccacaucaaacaaaucaggaaaauguccuccagacuugcuggcaggccaaucugauggagccauccucucacuucaaguuccccguuaacagaugacccuggcuugcuugugucaagaugucaaagagcuaaccagcacacggcuggcugagccaucuugccaguccuuaaguuuguaauuacuucuucacuuccacuaacuucaccuugaucaguaggggaggggaaggaacacugcagguuaacucuaaaccccaaaaggcaaugcaguccccagggacuacucuuuaagguaauucaguaguaaagucacuccacacgccauuaucuccagcccuaugggagcuauaaaucugaugucauccucacauuaggggcacuguuugcucugugcugguuuucagugugccacuuguguuaaacaacgaugggguuacuccuggccuccugacuuagacugggaggucugugagggcaggaccucuuucugagcccagaucagugccuaagaguaguagacauucaaguccuaacuacuugaauuguuacuagauuguuauuacuaacuuuaaaaacaauuauuuuucauuuccaguguaugaguguuuugccugcaaacauauauaugugccauacgugugguauccucggaggccagaagggaguucuggaucccuuggaaguagaauuauagaugguugugaacuagcguguuguugcugggaaucuaacuuggguuuucugcaagagcaacaagugcgcuuagcuuaugagccaacucuccaucccauuauuaacuuuuuaaaaacuaucacuauuaguguuuguguguauguguguguaucugcaugugcauguggaguccagaaaaugacauccaaugacaggccucucuucuccucccuccugcacguggauuacagaugggcacagucgaaccuggcuuuuaggugagugcuggcuggggaucuaagcuuagauugccacgcuugacuuuaugucaggagucuuuaugaagggacacauuuccccauguauggguggcagggucccaacggcccaggucagcuuuaaaaaguuccuguuucuacugccucgacuucccaacuuuggauuuaugggaauggauuagcacgcccagcuucauuaucaacuuucuggaaaguucuaauauaauacagaggaagucacaguacaguuuggcuaaguaauaaacucuuugaggaaauggucaaugaaaggggaagaaaaggaaaagaaaggcaugaagauauucacuuuugcaucaucugagagggaagccagcgggaaugguuuuauuaaucacgcuaugcauauugguuugggccuguagaugggacuauucaaggcaaaagaaaacacuucccagcuccaggaugcauguggauggugaugggccgugaaacuaaacuuagcuggucugggccccgagccccucccuugagcccacgcagccugaagucagugguuagcucgcaggagugcucugcaaauccuccugaccaggacuccauuuuuggugguuuccaaccuucagucaccuccccucuacuucucaguugcccuggcuaggcggggaguuaagauguucuaucaaagcccggcgugguggcgaaggccuuuaaugcacuugggaggcagaggcaggcggaucucugaguucgaggccagccuggucuacaaagugaguuccaggacagccagggcuacagagaaaccauaucucgaaaaauaaaaauaaaauaaaauaaaauaaaaaauaaaaagauguuccucucacacccuauuaagcagcuauaacacaccaagaauucuucucggugcuagauagaacagaacucuuguucucacggaggguauaccguugugaaagagccugaacugcuaaugaauacauauuacauaaucagccaguuccugcuuccagcccaucaacacaguccaacccaacccagucuggcaccagcuccguuucauggccacaaucagagcgcugauguuuucaguaaaaacagaguaguggugaugcauggcuaugacccuagcacuugggaaccugaggcagggggacucgugaguuccaggcuggccuacgcuacaaggcaagaucuugucucaaaaaaaaaaaaaaaaaaaaaaaaaaaaaaaaaaaaaaaaaaucaaagcuacacaagauaguguuugaaaacugcaacccugaggaucgaccccacuuacccuugcagcuucgucucugggcauccauggaccccugcacccgaggauguucucaugacagccuucuuugguuuuucuccguagcggucuaucaaccggagucuuucauccugcaccgcagccaggacauuaggcccagagcuguuuucuacaggcacuuuggggguucaucccuuaacacgcaacacuguaacccuucaugcuacagcuacuaugcuucauucaucuuuucugacaaaggagagcccucuuaggacagccucgggguagaaggaguaacggcaggcguuacagaaagcacgcuagggucccucugggaagccugaacuuccggguggugccuccuuggggacgucucuaggaagucggcucggugcucuggaggaccggagcugcuccauugggaagagcagagucugcgcagcaggagcuguccaaagggaggcggggccgagcgagacca

SEQ ID NO: 2733 - RNA, 12979 nt, Mus musculus
gcuucccgagccacggcccaauuuuauuuacacucauugcaaagcaugacaggguuaaacgacaggugcaggggcuaagaggcugggggucauggagacuguagagguagacuacaggggugcaggagaaaagggaaggcgauggugaggauggacaggccccucuuccagugucccccaggcuccuaggcgucccggggcagagagcaggugaggcugccuucaggauuuggacuuggagacagccaguccaaugaguccagccaggccugccacgcccagggccaugccaccaacgauggccaugccuaccaguccaucuggaaaaggaagagggaggugugagcagaccagucccgccccaggcuccugaccacacuccccuccacagaagcggggcaccuguacccagagucugcggguuggaacucuggggcuacagagaccuuggaggguaggucugaugagggacucuguguguguguguguguguguguguguguguguguguguucccaagggccccgcuggggaggaggaagaacagccaacaagaggccugucaccuuucuucauggccuuaucaaucaggcguuccagcuccuuggccugguuguucuggggcucagucugcaacagcccucgcacauacuuuagagccuuuucauauuccugcaaucagaggaaaggcacaccucacacgacacguuccucgggaugcgucccccugagcccccccacccagggguguccuucccuggcccagcucauccuuccuccuccuccacccguugcagccccaccccacagaguagaguucacaaacagcccagcugugggggggugauaagcuagcagagauaacagcuccaggcacggggcugcaccccaaccugacgucagugugguccccacaccccgauacucucucaccuucccucucagagucuaacccacacaguccccaucaccccagccugcugcccuuugcuggcuuucugagggccaggacucuccaccugggcacucaggaggaacgugggucagaaagggcuccgcagccuuaccuugagccgguaguugcccacggccagguagaagacauagucccgcuguuccucuuugcucccuuugggcaacagcucuggagggggaagggagaagagaaagauggagucuccuucuaacacuguguuccauggguccugcuacgcugacuugcucuaggauccugggagggucaugguccuggaccuccauuaccaguuucuaucaccugcagcuucccaguuacagccccgagacagccguaagccugucaaacaccugugguggagaccaggagccagccccgcagucuguauggaugggugcauucccacuggcagccauggguccuacugcaaggucaccucccgccugacacucaucuugcugagaaugcccgaacuugugcuccuccugccaccuccugaauggucugggauacggcuggcuuauuaugcagugcugggaauggaauugaagcagggcuucauacacagcaaacaugcacuccguagacugagcuuuuguuuuguuuuugaaacaggguuucucuguguagcccuggcuguccuacaacccacucuauagaccaggcuggccucaaacucagagauccuccuacuucugcuacuccuccuacuacugggauuaaaggugugaaucaccacucuaggcccacaaccugccccccuuuccuauaacucaucuucccugagugacccuugucugacuuguuuuucauuucauucuguguguguguauccccguaggacgguauuaagauaggcacucacuaugccgcccgggcuuguuucaaacuccccaucaggcugccccagccucucuagcgcuggaguuccguggugcggcagccaccacuucggcacuaaauagcugugcagugcuacagucuccucagggucugcacugugucuccaaacaggacucaaaugcugacaccacucccacugcugugcucuacuguaaaagaaaccuaaaaguccaaacugaucaaaguagggggacaguauuugcuuuuagagaccccagagcuggcggcaccccugaacucgcagcacugagguagcugaagcaggacgcacagguuagagguccugugucaaagucaacugacuaaugauacagcagucuucuguucccagcgucgucccuugacagccucugggacuaugccaacacagcccccagacuucaaagugcacagacggcaggcccgucuauaaaauuaaacgguguuugcauagaaugcaccuauaguccccaaagaugcaguguucuuugagucagggagcucauguagcccaggcugaccucaaauuuggucaggaugugcugacucuggccuugaacuucugaccuuccugccucuaucuccacagucaauguucgacuacugaacuauguuccugugucuucaccuuuguagugcuggggucacacagccuugauaccacuagccccucagauauucuaaaucucuagaauuuuccaaaugacuguuauccaauacaacguaaacacuauauuaacggcaauuaguaacuauaccagaaguguuuuguguacacugugugugugcacauggaagcauggaggucagaggacggccagugcuuucacacuccacagcauccccuaaagaaagggucuccaacugaaccugggcuaagauggcaacaagccaucucuagcugauuccagcuuacucucuauacagacucggauggccacacucagcugcugcugugggugcuggggauuugaacccaggucuucaugccuggacaggaugcacugagucuccccagccugagagcauuuuuuccuacagcauuuuccaucugaaugacuguucagaugcuggggacguagagaaucaaucuagcccuuucuccaagugaaguuacuggugguuacugaaugacaaaugugcuguaaggugaggguucuguguuggaaaggguccuggaggggugaggucaagcacaguagaggucaggcuggcuggcggcuggaaaguggggcccagcgccuuacccuccagcagcacgaugccucugcggauguccucauuguauuugcuucgaaccaggcaccaggcauauucaaauugcgugcucuuggacacagaaccagcugccugcucagacugaaauuuccuuucaaaauucugucauuagagagaagagugaccauuuagcaacaaagagcagcaaucauucuccagcuaacuugaugucugaaucccaguuagaucauauuuuccucccugccgccuuucccuuguagaucuugguaccccgaagcuucugucaucuccaccccugggucccaugcuguguccuccccuucggaagguccgugaacccagccccuagugguaccaagaggagaugccaccugguggcagcuggaggcacugcucccaaaccagcugaccccaagugucugaagaguaaacauacugucccagagcuaaacgaccuccuacauggccuuucccuugaggccgcuggucccgucccacccuacucuuuugggccuggaucugccuuacuuuaauucuaggagaggaaagaaaacacagcuacaaggaugcggugaaaauagcaccgugaggaacuaaacacuagcgaaaauuuacaccagugacuauacuacuccaucccugcacacgaguaccccaaauucccagcucugcaucacacuaagaccccaggccuaggucugaguugcugaaacccgggaagcuacaauucccgucaggccuagggacacgaagccgauucccacaagaagcaggaugccgcagaggcugcugggagccguaguucagcuugccaagaaagacgaaaccggcacugguuagccucagucagcucuccucaggaacugcccuuuccaauucugcccuucuccuuccuccgucccagaccuuaccuucagauccuccacagacaccagcucguucagcacggccuccauggccgccgccccugaaagccucacacuaaggucucuacugggccacagucuccaugguccaguagcaggggcggagaggcacuuccggcaucgaccuguggaggccccgccccuuccuccuuugccuuggggcgggcgggggcacuagugccuacgcugggauacuuugcucucuuuggacuccccugauguccuagauccucccugcaucacauuauccuaggaaccaguguaagaaccccucacucuaggacccuggauuaucuucaauguuugcaauaaaauccuaaugaguaccaggggccggagggucucaguguagucucucacaaagagaugcucagucucucauaaagcaagaggaauugguagcuauacccucuccaugcuccacgcacucccccaccuccccccuccgaaaacuugggucacaugaccauaguggacagccauucuuaauaggauucugaagaaaacccaggaaacacaguccaggguuaaaggcccauggauggcucucauguucuguugccagaccccacauagcucacaacugccuggguuccagcuauaaggggaaaacuugggucacaugauccgccugccucugccuccugauugcugggauuaaaggcacacaccaccacccagcucagccugcucucuuauagaacccaggaccauuagcccagggaugguaccacccacaauggacuggguccucccccaguuauguaaaugccuuggagccagaucucauggaggcauuuuucucaauugaggggcccuccuuugagagagcucuaguuugggugucaagcugacagaggacuagccagcacacucgcugucccuugcccuaugauucugaaaccuccaguaaucacaggcacucugcaugugccugccgucuuugcuauucagaacaucuaucuucuagcccugccguugcuuauugguugauucauucauuuuugauugagcauuuccuaagugucggucacuauuuaaguacagggauuggcacugagaaaaagaaaacuccuauccuuaugcaucuaauguggggagggggaauggucaugcaggcuuucauccuagcgcuugggagguggaggcaggaagaggaggaaguuuaagaucauccuuggcuuagcaaguuggaguccagccugggguaggaacucuucuugggagccagacaauccaaggcuuucucagaggccugggugaaagggcaaaaggaaugucagcucugugucacuguccacaggcagacuuggcaaggucugaggcuggggccugggccucacaggagugaggguugcaguuugucgggauccuacucucuuccuggccuauggcuauucguccuuagauagacguguaugucugagguauccuguguucucguugccaacguugucuaauuuagcuacuuugggccauucucccccuacaaauagcacauaagaugcuguauuuugggcuggagagauggcucagcgguuaagagcauugacugcucuuacagggguccugaguucaauucccagcaaccacaugguggcucacaaccaucuguaaugggauccgaugcccucuucuggugagucugaagacagugacaguauacuuauacuuacaugcauaaaauaaauaaacaaaucuuuaaaaauaaauaaacaaacaaaugaaccaacaaaaacccugaucccuuaagaugauacaccuuagaccucagaagagcguguuggauccccccaccccaccccacccccgcccuggagcuggaguuacagguagucaugagcuaccugacaugguguuuuaggguuucuauuaccacggagagacaucaugauccuggcaacucuuugcuuguuuguuuguuugcccuuccagaagcccugggcucaguucccaguucugucaggugguucaccaccucccagaacuccaguguuggggaucgggugccuuuggccucugugggcaccugacauguacacagaagcacauacauuuguacauacaaaguagaucuuuuuaaaaaugaaaagcaaacaaaaccgcaaacauuguggcaaagugacagauauauaaaauuuggccucugacccacgguccccaggaucccuguuuuuuuuuuuuuuaauuuuuaauuuauuuauuauauguaaguacacuguacgugucuucagacacuccagaagagggagucagaucucguuacagaugguugugagccaccaugugguugcugggauuugaacuccagaccuucggaagagcaauugggugcucuuacccgcugagccaucucaccagcccgguuuugguuuuuuuaacacgggguuuucacuauguagcccuggcugaaauggccucuguggcucagaauaacuuuaaacucauacaaaucaacugcuucugccuccaaaugcuggaauuaaaggugugagcuaccacacccaguuaggaucccugacggaggucgcaggggcgcuguaguucugaaugccuugcaucuuccugaggaaugggagcgacuuaauucucacuaacugggcccugggugguuuucaggauggaggcuggucacaggagaauccaguccagaugaaaagcuuggaacuuugugucuaacccaccccuccuucacuagggaagggagagggcuggagagagucaauaauuaaucaagugaagccucccauaaacggcucucaacuguggaauucagagcugcugugccagcagucacguggaagaaucaugaaaaccgugcaugaauuacucuguccccauacagcccaugcaccuggucuuuuccuaagaaaccaggggugacgagugcuuccuugaaugcccagcuguuauagcucuuucuccauccagaagcucucaaugugaacccagccacccagaaguaccaggggcaaccugggcuugugagggcagucugaagcaggcucucuaacuuguggguucagaugccagcucacgugagugucagcacugaacuggaggacagacaccucccuccacccacaaaacaggguucacagaguggagcaucaccugggagcuagagaacucagguguggguagauguuuggggagaaguaauuuucucauuuagaugaugggggcuggggcugggacucagagggcagagugcugucuaguaagcauguguccuggguuuguuuggucacuagcacagaaagauggcucagucaguacagaugcuugcugucaaaccugaugaccugaguuugguccccaggacccauaugguggaaagagacaacuuuccccaugcuguccucgcaucucugcacucagacuguugcaugucaacccuccacaacagaccaacaaaugugcaugcaggggauggggcccacugcaaaggaaaacgaaacccaugacauaaucuggagaguugagagcacacgaaacguaacaaggaagggacugaggacaaggaagaugugcagggacucagugacgcucucacagagagcagaguccugccacagaaggaaggggcagcacagguaaacggcagaggacugcaggcagacaggggcccgggcgcacuggcugugcuguucaagggccccaaauccugcuauucaggagcagggaagaggaucgccaguucaaggcacacccccaguuaaugagggaauucaaggccaagagagcuugaaugagcucacaccucaaaauauagaauaaaaggugugcgugucuggggagggagagggagagggagagggagagggagagggagagggagagggagagggagagggagagggagagggagagggaggagggaggagggaggagggaggagggaggagggagagggagagggagagggagagggagagggagagggagagggagagggagagggagagggagagggagagggagagggagagggagagggagagggagagggagagggagagggaggagggagaugguucaaugguuaagagaacuuaauucucuugcagaagacuuaaauuuuguuccaggggauaugacauacucuucuggucuccaagggcaccugcacucaugagcacacagauacauacagacacgcaugcauacauguaagaaaaauaaaauaacucgcuuuauuuuacacguauguuuuaugugcauguauauaugugcagcauguacaugccugagugccuucaaaacucagaagaggggaucagauccccugaggcuggaguuacagaugguuacaagccaccucgugggugacgugaacuaaacccagacccuuuguaagagcaacaaguguuccuaaccguggagccauuucuccugcuuucuaaauaaaauauuuaaaaaacaaaacaaaacuaaagcuggguguauguacaugucuuuaauuucugcacucaagaggcagaggcaggaggacaagcucaaggguagccuggucuacacagugaguucuaggccagcuagaauuacauggaaagaccuuaccucaaaaacaaacaaacaaacaaauaaacaaaaggcugaggauaaaacuugguuauagagccccugccagaaucccccugggaggggcuggggguguggcuccugauagaucacuugccuagcauauguugaguuccacccacagcacugaacaaaaucaaacaaggacuucaggaaaugugaccagcagagagcuggugaaauugugugagaggagaccagguugacaaacagguuuuuugccuugggacgcaaugagcaccuaccuauucaaugccucuuugguguagacaggccuuuugagccacaaagaaacagguucuagacaguucugucaccuguccaaugucacagagaauuuugcuuuuauuuuuaauauuauuggguuuaacaguuugugaugguuaucauuuuaaaacccagcccauuaucauccauuuugguuaaauuacuauucucacaugugugucuaacguguaugucaaggcuacaagacaaggauggaagccagaggacaauucugcgagguugguucucuccuccagguuuacaguggcgauggagggacauaucacacucagacaccagaccuggucaguaagcucuuuuccugcugggcaucuuuccaacccuagagcugggguuuuuacuccaagaagguucuuuuucucuuccuuuucccccucccuccucuuccuucccagucucuagcucaggcuggccuugaguuccugaucuaccugccucugccucucggguacuaggacugcaggugugguagcaucauuccugcuuuccguggugcugaggagugaacucaggauuucacacaugccaagugaaugcucuaccgacgagcuacacgcccagcagccuacaccuccuuuucuauuggcuuugaaccacagccgccuucacuucuacaccaggcucuuacuguuacuucagacaugaagagacaagaggguuacguggcucggagccugagucggcuguccgccauugcuguacucuuggaagcugcugcucugcauuuccugcaugcucagguaauguuuaucccuucucagggcucugauggaauugaacacuagauagcuauagucucacaguuaaacuagaaaggaucucgaaagcguuuuaagaucuaaggagauguuuuucaggaugugauacacacaaauuaugaagauuaggggaaauuauaaauggaugucuuaagguugcuaacucuaaguuaugaaauuagagaacuuaaaaugcuuaagaugguaaugaaaaaaugauuuagauagagaaaucugaacuuaucaagauaggguacacaauaaaauauuuuaucuaaacacugccaaauacuaaaagacuggacuuuuugaauguaacucucauuuaauaguuuucauaauuguuucaugauuguuccuucuguauguuuauuauuauaagagaaagagccuuuuuauuuagauagaaaguggggaauguaguggguuggucuggugcugcucuguacucaaugcuaaauucuguaccccaagaucuggcugcuccgagaugagcagguccucuccucccaccaugugguggucaaacucaagucaucaggcuugguggcaaguaccuucacccuaguuaucuuaguuagcaauuuagggaggaaagagucuuuuggcaacauugucuauaaccaagggaaaccagggaaggaaccuggaggcaggaccugaaaacagaagcuaugggaaauguugcuuacuggcuugcuccuccgggcuugcucaaccugcuugcuggcaccgcccacagugggcagggccucccacaucaaacaaaucaggaaaauguccuccagacuugcuggcaggccaaucugauggagccauccucucacuucaaguuccccguuaacagaugacccuggcuugcuugugucaagaugucaaagagcuaaccagcacacggcuggcugagccaucuugccaguccuuaaguuuguaauuacuucuucacuuccacuaacuucaccuugaucaguaggggaggggaaggaacacugcagguuaacucuaaaccccaaaaggcaaugcaguccccagggacuacucuuuaagguaauucaguaguaaagucacuccacacgccauuaucuccagcccuaugggagcuauaaaucugaugucauccucacauuaggggcacuguuugcucugugcugguuuucagugugccacuuguguuaaacaacgaugggguuacuccuggccuccugacuuagacugggaggucugugagggcaggaccucuuucugagcccagaucagugccuaagaguaguagacauucaaguccuaacuacuugaauuguuacuagauuguuauuacuaacuuuaaaaacaauuauuuuucauuuccaguguaugaguguuuugccugcaaacauauauaugugccauacgugugguauccucggaggccagaagggaguucuggaucccuuggaaguagaauuauagaugguugugaacuagcguguuguugcugggaaucuaacuuggguuuucugcaagagcaacaagugcgcuuagcuuaugagccaacucuccaucccauuauuaacuuuuuaaaaacuaucacuauuaguguuuguguguauguguguguaucugcaugugcauguggaguccagaaaaugacauccaaugacaggccucucuucuccucccuccugcacguggauuacagaugggcacagucgaaccuggcuuuuaggugagugcuggcuggggaucuaagcuuagauugccacgcuugacuuuaugucaggagucuuuaugaagggacacauuuccccauguauggguggcagggucccaacggcccaggucagcuuuaaaaaguuccuguuucuacugccucgacuucccaacuuuggauuuaugggaauggauuagcacgcccagcuucauuaucaacuuucuggaaaguucuaauauaauacagaggaagucacaguacaguuuggcuaaguaauaaacucuuugaggaaauggucaaugaaaggggaagaaaaggaaaagaaaggcaugaagauauucacuuuugcaucaucugagagggaagccagcgggaaugguuuuauuaaucacgcuaugcauauugguuugggccuguagaugggacuauucaaggcaaaagaaaacacuucccagcuccaggaugcauguggauggugaugggccgugaaacuaaacuuagcuggucugggccccgagccccucccuugagcccacgcagccugaagucagugguuagcucgcaggagugcucugcaaauccuccugaccaggacuccauuuuuggugguuuccaaccuucagucaccuccccucuacuucucaguugcccuggcuaggcggggaguuaagauguucuaucaaagcccggcgugguggcgaaggccuuuaaugcacuugggaggcagaggcaggcggaucucugaguucgaggccagccuggucuacaaagugaguuccaggacagccagggcuacagagaaaccauaucucgaaaaauaaaaauaaaauaaaauaaaauaaaaaauaaaaagauguuccucucacacccuauuaagcagcuauaacacaccaagaauucuucucggugcuagauagaacagaacucuuguucucacggaggguauaccguugugaaagagccugaacugcuaaugaauacauauuacauaaucagccaguuccugcuuccagcccaucaacacaguccaacccaacccagucuggcaccagcuccguuucauggccacaaucagagcgcugauguuuucaguaaaaacagaguaguggugaugcauggcuaugacccuagcacuugggaaccugaggcagggggacucgugaguuccaggcuggccuacgcuacaaggcaagaucuugucucaaaaaaaaaaaaaaaaaaaaaaaaaaaaaaaaaaaaaaaaaaucaaagcuacacaagauaguguuugaaaacugcaacccugaggaucgaccccacuuacccuugcagcuucgucucugggcauccauggaccccugcacccgaggauguucucaugacagccuucuuugguuuuucuccguagcggucuaucaaccggagucuuucauccugcaccgcagccaggacauuaggcccagagcuguuuucuacaggcacuuuggggguucaucccuuaacacgcaacacuguaacccuucaugcuacagcuacuaugcuucauucaucuuuucugacaaaggagagcccucuuaggacagccucgggguagaaggaguaacggcaggcguuacagaaagcacgcuagggucccucugggaagccugaacuuccg

SEQ ID NO: 2734 - RNA, 5905 nt, Mus musculus
uguuuaucccucuguaucacccccgacacacacacacacacacacaccuccauauuacuucacuaaaguucuuucagcacauuugaucuccagaagagucgggugagaguaacauacacgaaugggggcugggguguuccugucugucuggggagccuggaaccccaaguucugcaugagaggcuaaugcacugggaaggcuggacacucccuuccaggcuggcggacgugucgacccugcccacuggccgcccggguucucaccuggguugacagcauuggcgccccggggucgaucggaggcagaaguuacggggggcagcggcggcagcagcagcaggagcaggagcaaaagccgggguuccgggccugccgcagccauggcuagcagcacgcuuaggcuacacccaggcccgcaccggcgcugagcugagcgccuggauuccgacgccccgggaagauucugggaaaaggggaaaccgagcccgcugagaggaggagcugugcucgggacuccgcccuggaaaaaaggcguaacccgaggccaccgaaaacccgagaugcagacggcgagacaaggcaaggauugucccgcgggcgcgggcuggaggguggggaggagccgaggguccgguccugggcacugccugacucacaccggagcaaccgaauccccccgggaggggaagugaccuuuugaggaggguccaggcgacgcgggggcgggucuugaccacaagucugacccggaggaacacaggacagcaaggccugggguggcgcgcggcgggggcgacgggcccggaggggccgggaagccggaggcgggaucgcgcggacauccucgugggucuggguucaacaaagccaccgaaccugccuauccugucccgcagcgcggggacacgcaccggggaugcaaagggcacagggacaagagcgcuccccuaaagaccacccacgccaguuuuuaaaaagugaccauuugcaggcggcucucagauuuuuuuuuuuggguaaccacaaugcgaccggaauuagguuugccccuaucaaagauggcggaaagcgaaagcuugcugaucuccaagggaacaucacguaaugacuucaagcgggaggggaaagacugcgcacgcguaugugugcacgccaccggaaggggugugcucagagcaagggucggugguuaguacgcgugcgcaguaggcucuucugucaacuguguugcgccaaugguggagaagaaacccgccgguaugugagccuugagugguucgcccuuuugugcuucccaaguucaaauucagccuaacaucuccccgccuagcuuuucacgucaauuaccuucgcucaguguuggggcagucucggaaccauuaauucguguuuugugacugcuugcuucagcagacguuggggauggagaggauguguugucucuccaaagcccgggugcuaugagcagugguacucaccucggcuucuggauuguuuugcuuuuguuuuuuuuuuguuuuuuguuuuuuucuucgagacagggugcguacccuuggcuguccuggaacuagcucuguagauuaggcuggcuuggaacucacagagaucugccugccucugccucuacacugcugggauuaaaggcgugcgccaccaucgccccacuuuccuccagcuucuggauguuggauggagggaacagagaaacuuaggaaaucaaagggcuuggcuuuggguacuacacaaacacgugcacacacacacacgaacauacacacuucauuccuuccuuucucucuuuuuuuaauguagccuaggcugccuauguaaauuaggcuggaccucagccucuugguguccuguaguccugaagucugugguuugggggaguucugguuugagacuggcauguuaugggaaacccagcaccaggaaugggcaggugagauggugcaugcaguagguaaaguugcuugcugccaagccugacuacuugaguucaguccccaggauccacaugauaggagaaaaggcuuccauacaguguccucugaucucugcacguguacugcaacaccuacaugugcacagaaacacucagaauaaaugcacuuuuugaagaaagauagaaauacaagaaaaagaggucagagaugagccccugcugauaggguguuguccagcaugcccaaaacucuugcuccauccccagcaucacauaagccugguguggcugugcacaggaggucaucccaggccagccugggcuuccugagauccuauugaagguugugggggugagaaagggacaggccaaagagcgcuaucaauuaaagaaaaaggacaggcagaagcagccucgagagcaagagaggagacaaaaugucgggauaggaaauauauccaacaagauagggggacaucugggagccacacuggggagacuuuuaguccaaggaagguagucggugcagucacagggcacaggcaugcgucucaggcugaaggaacauucuagaaauguacacuggauuuugcccuacugaaucacaggucuugagaauauggaggccagaagucaauacugugucaauucucaaaggcgcucuuuauuuuaauuuguguaugugugcugcucugugcaggugaguguagguauccaugaaggacaaaagaggcaguuggaauuacagaaaguugugagccacccucauggcugcugguccuggguccuggaaacagcuguagcacucugcaagagcagggagcgcuguuaaccacugagcccucucuccagcugcaauuuauugugucuccaguuauugcugggacugggaggacuuagaggcagcauaaagggccgaaacaagcuugccaagcuggaagaaagcagggugaagaucugggaauuccucacagcauaaugaaggggccgaggcgaggagacuggggcucuaggcaacggcagugcaacuuuccuccugucuugaccccgguaacucucuuugccccaucuaguucgcucccaggacccuggacagcggcgggugcuggacagggcagccaggcagcggcggaucaaccgacagcuggaggcauuggagaaugacaacuuccaggaugacccccaugccggccucccccagcugggcaagaggcuaccucaguuugaugaugaugcagacacaggugagauggggguuagggaggaggagcgagacagugccgugaagcuccuugucacccguaacugcagaugaugccaaugagcgcagaugggaauugcaucuuuauuguguuuuuaauuuccucauuuugugugcaugcauaugugugucuguucauuccugcacacgcuugccuguggagaucagaaauuaacuuacaggaguucguuuucuccuuccagaguugaaauucugguuacucagguugcugaguucagcagcagguucccuuaagcaccaagccaucuuagcagccccuguuucuuuaaaacugcaacuuauucagagagcaggcaaucugagaaauuuauugauauuaauuaauaucaacuuauugauauucuaaagauccaucuucuagccugggggagccauugcucacaugugcacguguguuuacaaauacacacacucacacacacacacauacacacaugacacaaugacacauaccuuuaagcccagcacuagggacacagaggcagguggauuucugugggucagccuggucuucaauuggaguuccagaacagcuagaguuacacagaaaaacccuuucucaaacaaacaaacaaacaaaccauguucagucagcagguuauagacagagacaaaaggcugucaaucaucuggauugguugccauuuccccuucccucugugucaggugucagccacaucucugagacuagcgauggccgugaccuuuguuaucauccuguguacuuguuccuuacucugcucaugucugggcugggcuccggcacuucuugaaccacugagucaaauuagugucugcuggugucaucuuuguacuccaaggccaucugacagggagggggugguuagcucagcaaaccaaccaggaacagcuguauacgcuaagcuagaaacaccauguaugugccuguugucuggucuguuuauaguagggaggguuuuguuucuugagagagggucucucuauguagaccaggcuguucuggaacucacagagauccgccugccucuaccucccaggugcugggaucagcggugugcgccacgcccggcaagauguuuuuaaacuuuaaauaaucucucuuguuucauguguggcauggaggucagaggacaauguuugggaguagcuuuucuccuuguacugagggccagggacugaacucaggauggcagccuuggcagccagcgccuuuucccgccaucuugccggcucaagugugucauuuauacaaauguaggcagagagggacagaccacauaaaauaucccugcccuugggcuggaggaaagggaaggcgucgggacugugggagggaaggcuggcaguagggcggugacuugggaauuacuucuggcuuugccagugccuggcuccuguguugggagcaucugccuuuccugucugugucucugugccucaguuucuucauaugugugggauaaaaaagauggagcaaucagguauagcgacccagcacacagaaaguuugaagccagagaacugccaagaauuuaaggucagccuggucuauauagugaguuugaagugggcuugggguagguagugagaccuuguaucaaagcaacaacaacaagacuguguaaucugagcaccugagaggugggaacagggagaucgaucaaagaucaccguuuaucuacacagugaguucauggccaaccugggcuucaucagcuccuguccccaaaauaaaaagauggaguagguuggacuuuuaaguagcugacggucgaccaggauugcagauaucagucagcguuagugcagauguaggcagggagggacagaccccgauugugguguggauaggccucuccaacaggacugucacagccacuguccagcaacucaguguccuucaucccccaggaaagaaaaagaagaaaacucgaggugaccacuuuaaacuucgcuuccggaaaaacuuccaggcuuugcuggaggagcaggugagagaaggcucagucugagguugggacccuagagagcacgggggggggggggggguggggggggggguggggggggggggguggugagcaagguccugcucuucagcgccccuuguggacaucagcugcauggcggacuggagaauuccggaugccugacccuucauguccuugcagaaccugagugcaucugagggccccaacuacuugacagccugugccggccccccaucucggccccagcgucccuucugugcuguguguggcuucccauccccguauaccugugugagcuguggugcccgguacugcaccgugcgcugccuggguacccaucaggagaccaggugagcccgagccugacccagccaugccuacagucuuauuccauguagcaucccaggaccucccuccuucuccaaugggcuucucucucucuuucugcaggugucugaaguggaccguguaaaccuggcaucagggagagaaaguacccccacccuucccaacccaccccagcucauucacaaaggacagagagagggagaaacuacccauucacccagcaaagcugugcccugccgaccaaggaaggccacagggacccaggacuguugugggggugguccauccacagagugcugugauaauaaacggccuggugaaaggaagccugccugcucauucugggguauuuggagg

SEQ ID NO: 2735 - RNA, 9632 nt, Mus musculus
auuuugcagauuuuaaaaaaaaauuuuaaucauguguauuugugcauggugggaggccagcaugggacacaugagacccugucuuuauauuggacucacggacucaaugguuacaaacauccuuuuauugaaagugaggcugaggaagcuuaauaauuuaucaggcaggggacccucagaaguccacuuucccugaguccauggggucagugggcaaguggaagacuccagggaccuccugaggacuguugggaccagcacauuccaucccaggcacacagacacucucgggagaugagacgggcagcguccccucucucugagaauggcgacccagguuguccaacaaggcacaguggcagagaagguuuggcagacugguugagugucaggggucaacaaaggacaccaugauguaucgaguaccccggguggugggcagccccucaugguagugugugaggcggccagggugcaggagggcccagccuuuccucggagaggagauucugcagucguaacgcaggaagcggcagccgccucccuggggagaugagaucacgaaaauaaaacuaagguuaguucacagggugaugagggugcaggggggcaacaggcauggugggagaggugccaaucaaauggacaagggaggcuaugugguuguugaucuggacugccaacuugguggaguuuagaaucaucauagaaacaaaccucuggagauaccugagugggaguuucuaaaauggguuagaggagggcagggagagccacccugaaucagggugagccaacccaccggcuggcaucuaggacugaauaaaaaggacaaagugagcugggcaccaggacucucucugcuuccugauuguggacacgcuccugcuguugcugugccuucccugugagggaccguccccuuggacuuagacccucccucuuuuccuuccacuaucuugucagggaguguguggcaggaacagggacgucaccaguggaguccuggggagcaggaggaaggaggagagcagcugugcuaguugggauuuugucaacuugacacaagcugggauugucaggaccucgggaaccucaacugaggaaacaccucugucagauuggccugugggugagccuguggggggcaguucuugacagaugaaugaugugggagggcgcaguccacgguggguggggccaucccugggcuggugguccuggagugucuaagaaaauagcuaagcaagccaugaggagcaaggcagcaagcagcaucauggcuucugcaucagcuccugccuccagguuccugcccugcuucaguuccugcccuggcuucccuccacgauggacugugacggagacgcuuaagcgguguaacuuuccuccuuaaguuucuuccgugcgguguuuuguuacagcagcggaaagcuaauuaauaugguggcugagccaagacacgacaggaaaccacugagaaacucaagaaggcccagccggaggcuaggggguaacagagacaagaccguaaaaugaaggguguggaggagccccccgggccccaagacagaaaggacccuacauucaccucauaaucuacacccuugugguugagggcgacauugagagugaagguggacgagucaugguguggccgaagcgagggcugcucaucuggccgguagcggaccacgaaguucaucacugcccgugucuguggggacacaagguggaagucaugggaagggcagggcacgccaaggcuagcccuuuacuuguuuuguacaugagguggaagacaugggaacaagcacuuuauagaccaagccaucuccccagucccguuccuccccauuuuuugagacaagguauuuuuuguagcccaggcuggccucaaacuauguagcucgagacgacccugaauuucugaucccccugcucuaccgucugagugcugggaucacaggcugugcuccuacccccaggcuaugcagugcuggggauggaagccagggcuuugugcgugcugggugagcgcacuggcugacccacaucuccagccucucucuccuguuuugagacaggcgcucacugcacagcccaugcucuccucaaacucgaccuuccugccucaguuucccaaaugcugagguuacaggugucaacacgcccugccagugacucuccuaauagcacaguggcccgaguaggaggcuuaacuuccuuccgaguccaucuuuauccugggccccaaguccguggcgccucaguugcuaaagggcugagggcgggguccacauagagccuuccgagacugggguacaagaagagguacagcagcgguugggauggcccaccuuggugugguagccagggaacagguacuccgucaugggccccacauauguccgcagcagcugaagccacugguccucguaucccaccuguuucauguggauaucaacggugggaacauucucguauccuccagccaaccuggaauccugugagcaacagacacucagccacccacaucccugggcuagcccauucuccuucagggacaauaccagcuucuucuuguugguucccagguuuuuuguuuugguucccuggaacuugaucuacagaucaggcugggcuugaacuuagagauucaccugccucugucgagagugcugggauuaaaggugugcagaugacugcccagccggagucucuuucugucugugacaucuagaagcaguuuucucuucuauugucaaggcagacucacugcugccgggcccuuuagucucugcuguccuuagcucugcugugaauccacgccaccuucccaugcuaucuaacauccguagccccaagcaaccucuguguuauagcuaaccuugacugucaacuugaugggaccuagguucaccuagaagacaagccucugggcaugcuggggagggacugucuagcuuagguuaacggagaugggaagaccugaccacugugggugacaccauccccugggcuaagguccuggccugaaagugagcugagcaacagaacucaucucucugcuuuccgacuacagugcaauaugaccacgugaccagcucucucacgcuccugcugccaugccuuccugccaugaugggcuugugcccgcagacugugagccacaagaaacccuuucuucaaguugcuuuggacauauacuuucuccuggccacaaguaacuagcauacucuuuaugagccccgcccuuggggauccccucuaucccccaaguccccugucccucuucaggcccacccuguccccuugggagcccucuguccucaccucgugccggccuccagaccacuggccauaguguuccauuuccuccaccagcucaucacacaucugcucggucagcagugggaaccaguacacaucugggcauggcuagggacagagcagggcagcaagggacaaggcaaggugaagcucacagaagagaggugggacaggcaacaaggacaggggaggggagacacacaggagaggaucuauggagggcugacccaagcucucuagguggagagaggaaggguguuuuagcagaggagggcaggaauagggggccuggagccccaacaucuagaacaaugaucuuguccugucuuuuuuccuccuuuuugagacagggucuuuuguagcccaggcuguccucaaacucacuagguagcugaggcuggcacugaucguccuacuugcacuuccugaaugccgagaucacaggcgugcaacuucaugcucggguuauacugugcugggaacugaaccuagggcucugugaauacugggggagcucucuacugcacgagccccagcuccagcccaucuacuuacuuauuuuuagacaaggucuuacuauguaauccaggauggccuuuuuuuuuuuuuaagaguuauuuauuuuauguaugugaauacacuguagcuaucuucagacacuccagaagagggagucagaucucauuacagaugguugugagccaccaucugguugcugggauuugaacucaggaccuucgcaagagcagucggugcucuuaacugcugagccaucucuccaguccccaggcuggccuugaacuggcuacgugucugaugcugcccugcaacuccaaaucccuguuaucuuccucgaccugggcucuggcauuauuggcauguaccacaccucuguuuguuuuuaugugcgugugcgcacggcugugugggggugugcaugugcgggugggcacggcuauguugggggugugcgugugcacauuugugcauucgaaggucugagguugacaccaggaacugcuccauuguucuuucaccuuauccaccgagcaugaucuccuaauugaacccagagcuuacggaugcagccagucuugcgaaucaaccugcugcggguccucagucuggaacugcaggugggcucuggagaccuguacuaggucgccaugcuuauguccuaagcacuugaccacugaguucucucucagcccaucuuuuuucuucuuuugagacuuggucuugccaucugaccauggcuggucugguaccuauuauguagcccagguuagccugaaacucuccauccuucugcaccaccuuccagaccucuaagauuacaggcccuuaacacuuaguguggccguuagccuuccucucgcccgaauaggaaacccucaguccccgggugcucagcuuagaacccaccaaugccagcaguggguacuucacacgggccaagguccuggggcagcuuaccuguuccacuagcccuuccccauccagggcccggcuguaauucucgugaauguacuguucucuccaguccuguaggaaggguuagggcgcucgagcggagccuucuucacgccugcccucccaugaucagcaaugguggugggggcuaugggcuggaagcagggagcaaagguccccucuuaccacaggguugucaaagaucugccagaggucuggguguagguggucugugucauagcgagaaguagccagcagccggccaaacucgugcugguugcugagguggaggaagaugcccuggagcgggguaaagggugggcaugcgugaggaggacaucaggaggcugugggcacagcgucgaguccccaugggcaacccaugccaaccaccccacucaccuugucccggacgcucuugcagaaagccauaucugggucugugucgcugcuggagaauaccuccuuuuggggcaguucaguccucagggucuccccgcggaucacauaugccugagauauguaggguacauuccacacgccccugcaggcaccggguaugaucagcuaggugggcaaccccacagacuacgcuuugcucacugcagaagcuccuccucggugucccccagaaucccaagccugaggccaucauaucacccuuuccauagcgggggccuaguguguauguaggaggcugcggagggggaccgagggaagggccugccuggcacugcacgguacgugggugggacucacacucgcuuccgcugcaccaguuccacguagucuucggagcgggcguaguacucauuggggcucagggcaccccagaaguuggaccagagcuugccauggcgggaaagcaugggagcuauuaccuuccuauggagaagacguaggugagggauggacgagaugggauaggacuaugucccaccaggggagggggugaagcucuucuggggcuccaugcauggguggugcuggucaccuguuuuguucaaucaagacacgcaaggucuccggguucguaaggacggcaucagcauccaggcuaaaguagaacucacacucaggguucugccgacagcugucccuggaggagaagagccacagauagagaggugagcccaaaugggggcauggaggcagggcaguggggauggagggaugagcggggcucuccugguucugacaugaggucaagggucagugucuccuuccccaggggcuccacugucugugucagaggaugagggaggggagcguagugugaccacagcccaggcagacucacucacauggccaugucccuggccuccccugcgcucagggccuccucuggccccaccagcuuuacagcugaaaaaugguccuggagcuguggccaggcaucugcaauaugaggcucgugguacaccuccugaagaugggcggagagagggauacacugacggucugggcagagagguggguacaugggggaugcagucagggaggacagacggaaggaggugucggugcggugggaugggggauaagggguaugcucuccauaucucacgcuguugugaaggaagagagagauccuguccgggggguaauccaggagcaguaggcgcugcaggaaccgaggcaggaagggaguaggcugcuccacaaacacggccagaagcacccgggggggaggcugggggacaccacaggacaaggcucacacaagcccagaccucucucugcccacagcagucacccacugcccacucggccagguccaggugcacaggagcucagccccaggccgcccagcuggcccucugcugacauccgugcuguccucaccugcccccccgggaguguccucagggucugguugcagaauccacagccucccuggggaguccagccauuggggacauaguuccccagguaguugagcuggagcuguugggacaggguugaguggcuaaaguggaggugucuggggacagauggcaaggacauugggcucaggaaaaagucagcagggugaggcagccauccuggcacccuuuucugcuggaaauggagaaaaccagggggaggggguccaggaggguugggguagcagggggggggcguggagggcugagggcaugggggcaccuuagugggaccauuuccauggaccacaacaggaagugugucguaggccacauuccggaugcgcacacgauucuggucaaacuuuaagaucacuucaucugggggcaaaaaggggaagguuuucaagagcuccuucauuuuggaaccacgaggcaacaggcucuuuaaggugugaagcgauaggaucccaacuccucuggugcacaaaggucuuugcaagugcucgguagaucgagcuccaaacaccaguuuuuccuuuuguuuuuguguggugcuaagaauugaaccuagggguuucuguaugcuagacacacucucuaccacagaguuacacccccagccuuucauugggggauucuaggcaggugcucuaccacugagccacacauccaucgcuaacacacaugcucaggaguugguuaaguuagcauacuggugaguuguagaucaacccaguucuggcaggaacccaucccucauuacccaccucuaaccaccguccucaccuaaggcuccauugagguucugaaagauccgggauuuaugguccagacucaguuugaguuucuccuagauggcauaagauggagcagugaacggaggggggacaggugacacuauaucucucuuucuccaacucccuuuaugccuccccuccuauucaacuggagaggggguuccugucccugagucucccuacccgcagcccuggguccagguacaguugaguguagaacaauugaucaucaucgucgucuuuguaguuccacuggcggacaaucugauggauggugggagcaaagccgaugaauccuggggggguggcaagcagaagugaguuagaccucccgagacugccaggguccccgacucaagcacccagagcaugcaaugcccgcuccacugggggagggagagauagagaggggacaagucugucuugggaacucggccacucaccaccagaguugaggaagcgcuuccccaugcccaccucaggguacugcucugccagcccccacucaggccagcagaagcucucagcagagaacagcagaugacugccacucugaacaaacuucuucagcagcucugucgggcugcuugccagaaucacgucguagcugggcaagaaaaggggaagacgagagccaggaggaaccucagucucuuuuucucucuccauaaccaguuucccacucuuuccaccccagcccuccuuaccuguccacaaacaugaugaucaugucuuucugaucugcauauuucuccauuuccuucuugagccaccugaccuucuggccuccaccaacuguucgagccacaucacccccucgccacuccugucccaggcccagggucugcaggaaagaucccacccccacgcagcggaagagguucagcuggccaagaugaggaaacaggaccaacccccacgaccccugcccucucccgcuggaauuucucccauggguccccccacucacccguacaguguaguuaaagaacuccgcagacugcagaaaacgccgguaccccucugucucugccguagccacagugaucaccagcaauuugucugucauagccagagaacuggcacuuaagacacggcuuagugucccacguguuuaucccucuguaucacccccgacacacacacacacacacacaccuccauauuacuucacuaaaguucuuucagcacauuugaucuccagaagagucgggugagaguaacauacacgaaugggggcugggguguuccugucugucuggggagccuggaaccccaaguucugcaugagaggcuaaugcacugggaaggcuggacacucccuuccaggcuggcggacgugucgacccugcccacuggccgcccggguucucaccuggguugacagcauuggcgccccggggucgaucggaggcagaaguuacggggggcagcggcggcagcagcagcaggagcaggagcaaaagccgggguuccgggccugccgcagccauggcuagcagcacgcuuaggcuacacccaggcccgcaccggcgcugagcugagcgccuggauuccgacgccccgggaagauucugggaaaaggggaaaccgagcccgcugagaggaggagcugugcucgggacuccgcccuggaaaaaaggcguaacccgaggccaccgaaaacccgagaugcagacggcgagacaaggcaaggauugucccgcgggcgcgggcuggaggguggggaggagccgaggguccgguccugggcacugccugacucacaccggagcaaccgaauccccccgggaggggaagugaccuuuugaggaggguccaggcgacgcgggggcgggucuugaccacaagucugacccggaggaacacaggacagcaaggccugggguggcgcgcggcgggggcgacgggcccggaggggccgggaagccggaggcgggaucgcgcggacauccucgugggucuggguucaacaaagccaccgaaccugccuauccugucccgcagcgcggggacacgcaccggggaugcaaagggcacagggacaagagcgcuccccuaaagaccacccacgccaguuuuuaaaaagugaccauuugcaggcggcucucagauuuuuuuuuuuggguaaccacaaugcgaccggaauuagguuugcccc

SEQ ID NO: 2736 - RNA, 10772 nt, Mus musculus
auuuuguuugcauauucucuauauuuaguauuuuuuaaaaaacauauuuaccuguuuauauaucaaaagugaagacaaacaacaacaaaaaggcauauguaaccaacaaaauucaagaccaugugaccccacauuuggggcccuauggguacacgguguguggcuguccagugcauaaugaaaagagaggaaaaaaaaaucagagagaaagagggagagagagaaaagcaaaaacaccaacaugauuauuuuuuuuccgguggagacauaacagaugcagaguggccugcuaggaaauuacauucacgguaccuucuugugcaguuuuucaguaaauugguuuucugaucauaccuccagcuaggaagcuuucaaaaaagauuaucuaacuaaggugguugaccaggagcugcugucucuuucaucccccccccgcccccccacguguccacugcucacauacagcagccggaaaugacacauugaagugagucaccagugcagcucugacucacccaguaauuggagaaaguucuguccuguuaggucacacagccccuuuucccucucugcuucugaaugccuuggaaaaauuugaaaccacuuugcccucucucaaaucucucucucuuccaucuaaucuuuuuuccccccuuccuuuaacguggguugccaagcaucaccuuggcaaggucccuaaggaaaagagccacgggggggggggggggggggggggagggagggagggaccggguaaggguguguucggcugccacuaggcggcagugugagccccaucacgaggcuacccagaggggcagguuuguggagugaugcaccccugacauacagggaugcagaccccaaaugggaugccguaugccacgguuuaaauaagaagcauuuuccuuaaaagugcuucuucuccccaacaaacauacaagagcaagagauaaauauucaaucacaccccuggaaucuccccagggcccccccacugggagacuggggacgaagagccaggcacacacacguccgacuuuucuuacacccuuuccaaaugaaaaaaguuugugggucgaaaaaagcuguguaaacaagucaccuacacucugaaauaacauaagcaagcugugucaagggagggagcagggagaaggcucgcuauugggccaccauuugaucugucuauccguugccccuuggaggugggcaagguggacauuuccacaguggaccuugagauaggacagugcuuuuuccuuuggcccauggccacccuccacagcaauggcaggcgaugcaagaggugcccacagugugacuggaacacaaacgauuuugcugaaugaaaguguugugcccuccacucugcuggggccucggugggaacuggguccaaagggcaugcugggcagauccagguacugugaguucuaugguccaugagaccuuugugggguaggaaucccuagggaggagggaguuagacucuuuucccuucaagaguccgaggucugggaugcugguuggaaagauuaccagugugggggguaaggaggaguugccuucucuuucuccccauagaguccuuuaaauaauccuuuucuucagaguuucugcuuauaacaucuccaguuucgucccaaaugaaggcgucucuucccacugucaaggcuccaucacuuggcccaugaagaggauugucucugcgggcagaacaaucgugccaguugagaauggggaucuaaggaggugagugagcuaccaggagucacagcugcccagggacuaaguuaggacugggguccuggcacugcgugggcugugacagagugcuagggaaggaauggaacugagugccagaauuuuugcagagucccuaggggcucaagaaaacgucuacguggugggcagguacauaaugauuuuugaaaaacagugugaggacaggaggauguuauaggggucugcucaccugucggguugugccgaaccacaaagagaaaggaucggucuauaaccaucuccgugggggccaugcgggcugagaugacaaaggcugaaagaaaagggacaauauguuagguuugggggauguuaucauuggagugauucccaagagaucuagugacaccagucuaucugauaucagcacuggggaaugauuuuuagguggcuuaaaagaaacuaguaaugggguauggaacccagaaccuccugcaugccagagcaagagugcuauggcugagccaccagccccucacugggggauucuaggcaggggcucuaccacugagccacgccccccagccccucacugggggauucuaagcaggggcucuaccacugagccacgccccccagccccucacugggggauuuuagauaaagguucuaccaucaagcuacauuucccaguccuugguuuuucaggacagggccucgcuuuuuugaaccugcauccuucugccucagccuccugaggcaugugccacuauguuuggcuuccuuucuuuguacucugaauauuggcccuaaaguuuccaaacuuccucugagccccaggauccuauuagucacaaacauauuuagggcucauggcacauccuuuaaguucacucccacugugauuacaccucaggcuuguuuggggggguccuugucacacacuggcccuucaggagccagaugaggcagcagggucccaggggaagugaauccguuuuuuucacacugaggaacggguucgggaaaggaugacuacugggcucacacuagcuuuccuguggggugauugccaucccaggaggugggcgaacacaggcagagagccacacucaccuguggaggaagacgccacugugccgcucucguuuaccucgauccugaccuuuugcagugccugugcuacagagagcugcucuuggucuguaacagagcaggacccaaaagacagauuagccuccacucuauccuccguggggaaacuccgacccacggaagcaagaaaacgagggugaucguuucucaccggaaagacuugugagcaggacccaaaagacagauuagccuccacucuauccuccguggggaaacucugacccacggaagcaagaaaacgagggugaucguuucucaccggaaagacuugugagcaggacccaaaagacagauuagccuccacucuauccuccguggggaaacucugacccacggaagcaagaaaacgagggugaucguuucucaccggaaagacuugugagcaggacccaaaagacagauuagccuccacucuauccuucguggggaaacucugacccaaagaagcaagaaaacgagggugaucguuucucaccggaaagacuugugaagucggccaggguugcacuaaacaugucaggcaugcccaacuucuccaggggcccucugagguccacuucagucuccagagagaaccugugggcaggaacaggcacaaguguuaguuugguucccacaugcuguucuuccaggaccuuuaggauaucuucuaggacagugggacaggguagacacugacacgagcauggaggaaagagucuggcuuuuuguuuugucuugaaauuggaucucauguagcccaggcuggccccaaacucauuauguauccaaagcugauccugaacgccugauucuccugccucuaccuccugagugcuagaauuuagaggugugcgccaccacgcaugguuuauguagcgcugggguuaaaacccagagcuuugaacaagucgggcaagcauuccaccagcgcaacuauauccccagcccugaccuugagcuucugaucccccugccuccaucaucuaguacggcaguagaagucuuugaaacuucauuuggcuagaaggucuggccuauuuuuccuccuugccagaaacuucuaauauuaaugaacauuguucaaucuuuccacccccucaaauccgugacuaauggcuuuccucaaauaagacaguaguuuuaacauaauuguauucgguuugacggcaggagggggacagguucacauucucccucgauaggguguuggagcuaacuguggucugcaggcuguuuuugagcgcacauagaaugagacuuugggcucccccucugcuucccaccagggcaugacucauuaucuccaucuugaugagggagaaagacagcagcagaaggucggcaucuaaagcaaccugaucccccucugucuccaagccuggcaucuuagcaucugggaguuuaggggggaaaccugggcugggagcuucccuguaauucuggaauuacccaaccacagcccucucuaccccuuuugauucugcagaaggauuaggggaaaagaaaaaaaaagaaaaugaaaucuguguuuggaagucuccucugccucugggaaucgaugccuuucauuguuuguggaugagggaagaugggggggugagaugggaggcuuuuacaaauggguguggaacgauucgggccugacacccacuucuuucucuagcucuucuuuggucucaucuuuuuuguuuauuuaaagauggggucuugugugauccaggagaacaaggaagaccuugaacucccgauccgcccccuagggaugggaucggggauuguagcugugcaccaccauuucugaggugcuggagauucaguuuagcucucugugcacgugaaguaauaacccugccaacuggacuauaucuccaccacuuucccugacggcccccuccccuuaugagauagggucuugcuguauauagcccagguuggccuugaacucauuauccuuugugcuagccuuucaaguguuaggauugcaaguuuguaccaccacgcauuggucuauguagcaguggguuugaaccuggggcuucaugcaugcuagccgagcacucuacaaaguaagccagcaaucuugcccccauagccaaagcuggucuugaacucacuauucugucucagccugucuaacacuaggguuacaggcuugugccacuaugauucacuuugguugacucuuacugagcauucugugcauggucuauauggggacguauuuuauuaaaaaaaaaaaaaaaaaacccucucuccucuccagcaguagaaacaggcagaaagaugauggacucagaagccauaaucaaauccagacuaggagguuucccaucagccacccacacaugucccuucccugugggcauuacccaucugggaaacuccgcaaggggacaguggcuuuaggaggaggggugguggaugucgggauuggggcauuggugaaugggauggcuuacuuaggcaggaugaggaggcggggcagccuggucauguugcccuuccauugucugaugaguucagcauccaagauguuggugagggcggagaggugcacaucuuucucaaagggugcagcgaugaacaugcugagggugucgcccugguagggcaguuccacaacgucauacucgagcccaucggggguggugaacucagcugggaagaucaagauggagccuuggaaaaggcuccaacgcccacagguuccuuuccugcuucucuccccuuuucuccuuccagaaggccaugcucuccacuggaguuuuggagguccuucacccauuccacaucccauucaaaugucuuccucuccucuuuuuuaaacuaugucacugaaggugaccuugaacucacccuccaccauaccugguuuacgagcugagcauggaccccaaggcuuuacuaaugcugggugaguauugucccuaagccacacccccacccuuccugccuauuuucucccucuccaucuuuguuauuuucugacuccagccacuaucucauucccaugcucacccaacucccacacagccuucccccuagcugggcuccuuggccccagguaaccacacuauagaagaucuucagagaagagaugggcucaaggguccaucgggcagaugugggccugggagauuaucuaaauuucagcuucaucuagcaugagagaaacugauuccuccccgaccccugacuugaaugaucucaguaucucccaauacuacuugguaagucuuuguaauaacuuggguguguccaccuccucugccaccauccucccucugagagggacacugugaauguugcccagggucaguaguuaugagacauggaaccuggggauauuuggacucacuguaguugaacuuguugcucugagccaucaugggcacagagacggugcugccaucagacuuguggaagaggcgcuggugggugcuggccucuaagaaaggagucuuccauuggccacugaaguagagggcauucaccagcaccaggcgugucagcucgucuacagcccccuuggccaguaagucacugaucauaccuaaggggaggcaaggagaccaagaagugaaauggacuguaagcaucuuagaugucucccuucuguucccaguucucaaauggaugauguugaagggacacaaagagcuguggcaguuaaguggaacaauuaggucuaagacucuaaggaugucuuucaguucacuauucuuccucccucucuuccucccucccucccccucuccuuuccucucuuucauucccuaucccccuccuucccacccuucuuucuucccccacccccucuuuauaguccagccuaguccaaagcucacuuugcagccuaggcugaccuugaauucaugguaauccuccugccucagcuucccaagagcugggaagacaggcaugagccaccacccuggcuucaccaugguuuucuuggcucugggauccauuuuaguaucagaguuaaaaagcuccaucuuugcucauuugaccucuucucuugcccccuaagcuauagucuuggaggcccguguacaccuguguuacagcuccuguuguucuuacugacagugguacccuuucauggugauuuugguuuuguuuauuuauuuuaaaaguuauuacuauugugggggucgggagguaugagguaugugggcagcuuauguugaauugauucucuccuuccacauuuuucuggcuuccaggaaucaaauccaggucacggggcuccacaggaagagccaauacccaaggagccaccuugcugggauuugguuaggcuuuauuuuguuuuguuuguuuugugggguagcuauugugcaguaauuggcuugaauugguuaguuuuuugucucuguagucuuuuuuuuuuuuuccuuugcuggugugcggaggcaggaucuugcuauguaguucaggcuaaccucaaacucaugaucuuccuacagauaugagccauuauacccagcucugugugguuuuaguucaguggcagaguaugugccuagaauggggagcugggggcgugguucagugguagagccccugccuagaauacccaggggaggggcugggggcguggcuagaugguagaacucuugccuagaaucccccagggaggggcugggggcguggcucagugguagagccccugcuuagaaucccccagugaggggcuggggguguggcucagugggagaguggauuacccagcauucaugaguuccuggcuccaguccucagcaccacaacaggaaggaaaagcacaaacaucagcuauuuugcuuugcuucuugaagcauuugccuuuuauccccaaagacaaagcugaaagggagagcuggggaugugugaauuugacaccgaauuccccuucucugcuccuuucccuugggacuggcuugcuuucccaggggcuuaccuuugguaugccuuuccacccagucauugaugauaaaucuggcucuuuccacuucugagaaguccaccuguuucaccauagucuggaagagcuugaagaaguggggcaugaagcccuggaccagcucuaggucccgcuggacaaagauggcauccgcaguacugaucucauucuuguuccacggccccaugagcuccuuggagagcuggcggagggcaugagcugugcccuucucugcagagguaccaggacaggauccauuaggcucauguugagccaagggcuuucagcugggccagguuucccaaggauggcccuaccccuguccaggcagaugaggcucuuccaauccuucaggagucaguggagggaggucuuuuuccaaacuaaccucucucucucccuccccuucucccucucuuucucccuuucccucuuccuuccccuucucuccaucucuuccucuucccuuaccuccaugcucuccccccauccccauuuuuugaaacugggucucaccaugcaccucuggguggccugacacuauguagcccaggcuggccuugaacucacagagaucugccugcgucugccuccugggugcugggacuaaaggugugcacuaccgugcccaacugucucccucucccauucuuuccucuccucuucccuaccuucuucuccucuccccaccccucccugaggagggucucacaugacuuggaagcucacggacauucuccugccuauagcaucuccagugcugggauuaggggcauggauuacuacagucagcccucaaaucauaacauuuuugugcuuccuuucccaaagucucaguucccaaucuuuucuuuucuuuguguaagaauauucuguucuuaaauuauacaccuuccucccugcaccccccuuuacccuugcaacaacuccucuaacagccuuggaaaugcugggaaucccggcacaagccacccugccuggcuuccucuucuguucgguuuugugacagggucuugcucuauaucccagccuggaauggaguuuacuguguagcauagguuguccucgaauucacaauuguccuucucccucagccucccaagugcuguaauuacagacaccaugccuagcuagguuguucuuauauuaauggcauuauugaagaauucauguucguaauccuauuacauauuuacucaacucugugugggagacauucuuuaguuguucccuauuucauagauaauaaaaccaagguuuacaagaguuaaggucccauguuuuguuuugcucuuguguuuaaaggucucauguaauccaggcuguugcugaacucgauacuuagccagcuaugaguuugaacuccugauccuucugccuccacuucccaaguaacauggccacaguucuacaccaucaucuucaguuuccuuagauuuggggauggagcccagggcuuuguguaugcuggggaagcuauaucgcagcaccagagucacacaguuccugugugcugauuccacuggcuaguauaagacaaggucaacugacccaauagugggagagaaaacggguggucucugggcugcggcuggacgugacuagacucagugaugcugcagucagccuucccugccuucuccguuuguucuggaccuggucugugagcuccucccgaccuuuuccuccagcucccacuccgccccaagacucucaccauugacuuugaaucccauagcaucuuggaucugccgccggguuuuccccgcuguggucaucugcagcauagccagcaccgaggacacgccauagggagagaagaccacauuccggucuuuggaggccuggaccaccugcugaaacacuuuuacuccgaagucgguggccugaugggcugugugggauucucggagggguaaagugaacccuuucccagagaccagaaccaggcccaggaugaggcaagcaagggcugaagacaucugcauccuaggaagaauagaagggaaucugauaaagacaugugccgggaagacugcccgggggggggggguguugccuccucagagugcucgccucuagccuguaagccaucagugcgguaaguuccauucauuaagaccccacaaugcaauuggaugaugagaucccacaaugcaauuggauaaccagcucauccccugcugccuccaauucuuuucauccccccccccccccagaaucuugcuugcuauguaaccuaggcuggacuugaacucaggacacuccugcuucacuucucccaagugcugugauuacaggcacgaauagaugcuacuugauguuuuaacauaggcuguccucacuuuuuuuuuuaaccuaggugaaucuuagaaaaacagccccugugcaucucugaucccuucuguggggcuaagagaccuuuagacgaugauagcuuuuggcuuaaagugagagcugauuccugaaaguugaucccugauuuccacucuugaacacaugaguacgcacacaugcauacagauauaaaugcaucuuuccuuuuaaaaguaaagucccuuugcuaaacugagaaaggagagguuugcuggggaaggacccaaagacuaugugcuggcuucugggauacaggguuggaagugcgguuugaccaucuuuccugaccaccugugguccuggcugggcuaggguggacuaaaggcugcagaguuccagaaaagaguggaagggaaaggagggaaaacggagggugagagauggagacgggacguuuuucuuccuuaggugagaguguaagcuugccuuucuccuaccugaguauucaaaggugccuugugauuggcucuuguuggcugucgcucagcugugguuggcugugugcugccggaggcgggugugcggcgguccuccuucacaaagcucucggggcucugcugcagccugauccagcugugcuccg

SEQ ID NO: 2737 - RNA, 3808 nt, Mus musculus
guuuagccagggggcuauggagaaaugaggcugaagagacauuuaagguagggauuauuaugacacagugugugugugagacacaggggccuuuggaauaaaguccagauggaaguuuaaggauagagaagggacaucuuuuucuggacagaauucccuguuuguagaaaccaauguagggaaucaccaauguccagauuugauuacauauaaaauuuaaaagcuagauauggaggugcaagccugguauaauccccaggacucaguuggugagagcagaauugugaguucaaggccagccuaggcuccauagugagccccuucaaguggggcucuggcucucaguugguagagugcuugccuggcauaaccgaccccuggguucgauccccagcacugaauaaaaacagguauagcacauaccuacaguccuggcagucagucggaaugggagacucacaaguccaugguuauccuuggcuaaccuagcaaauuccaaaccagccaaggcuacgugagaccuuggcuaaaacaaaaccaacaaaacugcucuuaaaaaagcaaaugaacaacaacaacaaaaaugaaugaauaaauaaauaaauaaauaaauaaauaagcuaacauaaaaauauauacacagcaaagcauaagggaagacaugagggccaguaagauuacaaacaacagagaauuuugauuugaugaggaaaagcugaaauaccaguuaaaaaaaaggacaccuaucuggacaaagaagaaaauaguuuagauacccaggggaaguaucuaugagcaaggacuuauaaaaugaaaaagaauucaucaaauaaaaccacuggcauacgccaaagauaaaaguuacagauguguucugaagaaacauguagauuccuggcacuaugaaauaaugccucccagagagucauuuagcaauauuugccacaggaggauuuuuuuauuuauuuauuuuuuuuuugggaugauuguaaaacuauguuaaucucagccugccuagaauuccccagugaguggcucacugguagagugcuuacuugauauuuguuccgucucuagcacuggggcgggggcagggggcgaggaugucaucccccuuuggggaaugcauucugggaagauaauucaguagcagaaaaacauuugcagagagaccuuuacagcugcuucauuaacuggaaaccccuccguggugaggcagcggcugaauagauugugguuugauagaaugaacgucuguggaucacaacuaugaaaaguauuuggaagaaaaguaugugauguagucauaagagagagcacagggcuggggagacagcucaguggcuaagaacgcuugcuauccagucucgaggaccugaguucaaauccccaacacccauauaaaaagccagguguggccacguguaccagagcuauaaggguagggggcagagucugagaucuguuuacugccaggcuuacagguucaucgagagacccugacuccaaguaauaggagaguaacagcauggacccuugguguccuguggaccuugugcaggugcgcacacgugcacucaugcaugcacgcacaaggaaagacugaccgggcagauucugauugcguaaugugagccacuggugggacuguguccaaauaguugccaggcagacaauggauucccaaucuguaaauagucaaugauuuguuucggagguuacaucuuuuugaguuauuuugggcugguacucacaucuguacauuuccauuucaguuaguauuauaugcuugaagacuucuauaaauaauauuuaagaauaacuaacuaguuggccagaugugauagugcacacugguaacucuagcacauagagugaggcaggaggauugcuauuuugggaccggguggucuccacagaugaugggauggcuaugaaguucugagcauucucgaaagucuugaaucuccugaccaauccagaccaaguaguagggauaaagaaccaaaugggaucagagcaguuguauaaaggggcagacaguguguguguguugucauucucugucugcacaggcaagugcucauuaaacgucugugaagugacuuaauguguagagagggcucugacacucaguaugccacaaccuuaagccagccaaacugcagaaaucuugacuugugggaagucuccagcagggggcacuauugugccucucaagauagacuucaaaagcagagagagagagaugauugagguguccgccuuccuuuugggaaaggaggcguaagagacaagacuguaggggcuucuugccgguauuuuguguagcagcaaagaugcagagguucucgggaaccuguauugggagugcacgugugguguguguguguguuugugugugugugugugugugugugugugguauuucagugagagaucuucagaaaugaagccaggcaugguaguguaggcugcagucccagcaaaguugggagacugaggcaggacgauagcagauucaagucuucccucaacaacuuaggaagacaauauuuuuuaaaaaaauaaaaagaggguuugagcuggucgggcacagagggcuugcuuagguuuccccagugaggggcuggaguaugacucagcgguagagguuuugccaacagaaagagggaggaaucuccugauucugaaagcgaaucccccaaaugcuaaagagacagagaaccaagcgcuucuuggggacccuugcaagaugaagggagaugcuaaacucauagcuuauaugcucaauauuuguauuacuuuccagaaguuacacaaacaagucacucagcaaaacauacaagugaccacagaagcacagggaaccaauggccccauggcuaagagccagggacauucucacagccagcugggaaucagcugcucugaccgaggaccaauuacccugacauuucaggaaaguuuguuguuguuguuguuguuguuguuguuuuaaaaccauggcaagaguggccauauuuaucuuuggauaguuuauagaaaauaggauuugggggagguggggcaagcguaugcucuuucacugguaaaucuauuauuuaaugcuaucauuuccuuaaucccuaugggcacaauucugaauguacauauggccaggagaaguuugauuuuuuuuuuuaaugugcuaaaggaaauggguaauauuggcgagcugagcuagauggaauuugauugacggguggcaggggccaaggugccuggccaucucucuuuggcagggaaguugaagguggaagcaguccucuaagugggaauugaagagaggaggugcagaccugagaaguagggagaaaacucccuuaccuuagcugguggcaaacugccagagaaagcaguuggaagugagcgcgcucucuucccaguggaagaugcuagaucuucaggaacuugggauccaccugggauugguggagcagagacgucaguggcaucagauauuccucuccucacauauugggcgaaguaucuuggugaccaaguagaagagggugggcauauacagggaagaagaccagaagaagguggaacuuugggaagacaacacaaggugucuccagaggacguuguagccaguuaucuuagggaccaggagagaguggguugaggagagauccugagggucagcccugcccacuucucaguugucaugggaccaagugccuaugcugugaagccuuauaguucuauacauuguaccuccuguuucuaauaaaguucucuggaaccauuucugaaucaauua

SEQ ID NO: 2738 - RNA, 8150 nt, Mus musculus
aguaagcugaauuacgccaauuuauuauuuuucagaacaguaucucuaauuccagcuuggccuugcuguguagaccaaguuggcuuugaacucagauucaccugcccguaucauugugccaggcccaaacuugaucgcggugggggccugugcgaaguaaauagguggcuguguuuagucucaguucugggaucuacccaacggugcagguagggcguggugauucagagauuucuggugaagcacaaguuguagaaggaauuggaaucaaagacgcuuuuuaccuuuugccagcccacccauccagcagcuuguaguucacaacgguuuuuuggagugccccaguaguguggguccaguaucaagacauagacuucugaaccuggccccucacagauccccagcagggccuuggacugggcaucugcaucuccuccuaccauuacugggcccccacccguuguaaagugugaauaaagccgcuccucuucuccccuaagcccuacuccgcggggcaaguggcauaggcgcccuugagguccuccgaaguguucuaggcagagacuggccucuacacagccgauccaguuacgggagccccggaauccggggggcuugucgcccauggccucuagggcucccugcaaggcuggcaguccaggcacgcccgaggacuggcccccuggccaggagcacagcgucugcagggugcgguagccgcauccccagccacggucauccaguccaucgcaaccauagugauaguaaagguaguggccugagaggagggccagucgggcgggaucauggcagggcacaggcaggcccaggugcacguccuucagcagcuccagggugcucgguagagcagcugucaucgaggcagggccaauuccggguuccugguguuuucugggacuagcuacgggcagugugggcacguagaaccggagaacucucagcaagcaggcuagcggcaggagagaugauuccacaggcagacgaauuaaggagccuucuaaaaggcgccggcaaaccagccuggcugcgcagucgcaggcuccgccccuaggggcgggcccagcgcuugcuuccgccggaugcugcgggcagggugccucagugcucaccaaucccgaggcuucuguucccagcgucucugaccucauccccgccccaacuucccgcguguugcacagacucugguggcuguaacaguuuauuggcggcccagaggggcgaaggcaccgcggggaggggagcuuagcccaagacaugcagaagauggggagccccuagugggaggaagucggggaggaguggacagggccugggggcucggucguauuauaucccagcccuuaaauaaauaguguauauacagcuaggggcucgggcagggcggcaggaccuggggucccccaaggggucacaggucugagcagcgcuccugcuugcuauaguggucgaacugguucuuccagugcaccauguaggagcuccagcgguggaacucggccuuccacuggcgcuccgccucguccagaguaucugcggccagggcaccccgcaagagugggagaaacggaacaggucggguaguggagaccggucgugagugcgccggcacacacgcauugucggaggccgagcggggugguggaaagagaacaguggaugauccggagaaugaagggagagguggaacaggaaggagaggaagagauaaaaaucaccggaagacggaggggagggacaggaucagagugggagaaggguucauggguuaguggggaaaagagagaagauacagaaauaguuggcgauuauaaggcccuuuggcugacgccaacuagccccggauccuucuccccucaacaccaggcucaagcuccaaaggauaauuuuuuacauuaaaaaaaaaaaaauccuguuuuuugaauuuuuguuuaacaaagaucccugagucuguccauuuugucucggcuugagaauggagugggguucuguaucccugagaggggccccuucucagcuacacacuagaguaagugugcuuugagaccagaaggggaaaggauugcaguuagagccacggaagcccggaguggaggaggaaaaggaagaagaggagggacagggcuaaguccggcccgggccucggggccgccuccccaugggcggggcuugggcaggugcaaggagccuccguggcuggggagguggagaagagagggauuacacccuguguuuugcaccccaucucucuccccuccuuccaacccuugccgccuugugcauucccugcuccccccacuccaugcgccuaccgguggcgcugagcaauuuggggagaaagcgauuccagaaggcgcaggucugggcgcgcaguccccgccgcaccucuaagggcuucagguucaggcucacauauugcugcgcggcagugguguacgguggccacuguggagauuuggagucucgagggucauuggggucccugaggaaggaaagggaaaucucagccugcccagaggaauaaggaaugaagacguggauccuuuuccugacucuggacccucuucaacucuuaacacccaacucucuucucccuacuccagccagccccccacccccgcccucgccccgugugagugugugugugugugugugugugugugugugugugugugagagagagagagagagagagagagaaaugagugcugccaaugcuucugccucaguuucccagaguacggauuuacagacauggauagguucccuucucauuuuaaguaccuucuaccauuccaccaccuagggaaguuuucuuuccacuggacaucucugucucuuucuccauuucccuuuguuuucaaagucuuucuagcugggugcgguacuacaggcuuuaaucccagcacccgggaagcagaggcaggcuaauuuuucugaguuugaagccagccugaucaacauggagauuuccagaccagccagugcuacauagcgagacccuauuuuaaaauaaaaauucuaggauugugcuuuuagcuguguagguaggugcaguccugucucuacaauuauuacuuuuacuuugggaaacgaaaaucagaugcacccaaggguuugugcaugcuagguagguaaguacuaacugagcuacacccccaaaccucuacugccuuucucugucgucaucaucaucaucaucuguguggguuugugugugagugagagagauuugaaggucagggguagcuuuguggagagccacuucucuguguuucagggauucaacugagauaggcuugcagggcaaucucuuuuaucuguugaauaccaguuaccucgcugucuuuuagagugcugggguggccucauauacauuugcuuuucagccgucuaccauggagcuguucccagcccuuaugggggcucucacucugucgugucccagcuagucuggaacuguauacauuagacugucuucucccuccugugcugggauucaagguucccagcugguuuugucuuuuaaggacucccuguucugccugccuuguucuccggcaucaccugagacuuucucuucaccccuuaacuuugugaagguuucuucuucuuuuucacugccauccauggguaccccucuccccuggacccccagacgccauccccacuccaauaccacugacccugugcgggcaaaauugguccaguauuucauaagucgcugagcaaagauccucuccuccgugguguaguucagcgagggauccagggggagcccaaagaugaacucgauuucauagccauggggcacccccauccagaggggccaagucaguguggaggcacgguguucaaagauguaggcauagacccgggccccuugggcagccagucgcccagccagcugggccacagggcacacaacguuguggucgccuaccacugcacucauggcaucucucaggugaguaggguccucagggugcagccagucuguguaaugcaggaccacagccucggcugccaggucacuugcuugggguacaccgauccgcaccccagccaggaacugggcccggcugaugagagauucauugucuuugcugaagccugggaccccguaaaccagaaaguaggagcccucguccuucaccacacccaccagcaccugaggauaguuggagaugggggaaaggauggagagaugauagagaggcacacagagacagaugagcaaccuaauagccagagagacgaaccauuacaaagccagaacuguguagaacagagagcggggugggggugggggugggguggagagacaaggcguggaggaagaaaaaaauauacccauaguuucuuuuucgcccggcaaccacuuugggaucugaaccacucggcagggaaggacugauuuugggacccacaaacuuggaccucuaacaguggaucuguaguaagcccucaugccugggucccugggaaagggggaaggacggaugaaacccagaagaaucuggucugccccuaucagccauuagucaccugcaggucuugaaaaucuccaguauugaugagagccuccggugugucacugaggaaguccccgucuaccacaggcacgaaggaaaaucggaagauacuuucuugaggcaggacgugccacucgugguccaccagguccugagcgggccuuguccucaagcaggcuaucagcucggugucauugccaccagcgccaccugggggacagcccacaaggcgggccagcaguguggcccugcgccuggccucuccagcacucacaguggcccagggcccauugggugugccacucuggaggacagcccuguggaagaggcuccugcugggcagggacaguaugugcaugcccacggaggcugcacccgcacucuccccaaacagagucacugacaucgggucgcccccaaaggcugcaauauuuucuugcacccauugcaaggcaagccguugauccagcagaccuacauugccaggggcuucucugcuuccugguagggccaagaagccaaagguucccacucgguaguucauagauaccaacacagcucccucaaccugggccaggaaacggccgucauacacauccaaggaggccgcuccgcuguagaaaccacccccauagauccagaugaggacaggugugggagaagcaggucugggguaugguguccacacauuaagauacaggcagucuucacucaacucucgguugggguuccacaucucaguacccucaaacccaggguacaggguguccacguacugguagcagacauuuuggaaggugguagcauccaacacuccugaccagggccgcuugggcucugguggcauaaaucuacgugagcccacagguggcucugcaaaggggaugcccagaaaagcugagacugggccuccaggggccuucaggcggaugccccucagcuggcccccucgaacccucaccagcagcugcgggucuucccggcccucagcccuugccccuccucccaggagggagaggaggaggaagaggaguggaaaagccagggaagguguaugcaggggauaccagggaggccucaugacugccaggacaggcuggugucugcugggagaaagaaaggcaaagggugaagacagcagcucagugggagauuaagaaacagucuugcccagggcuuaucaaggaguugcagaggagguguggcagauugguaaggggaggggagaaauggagucaagcuaggagacgcgacacaggcagacaaacacaagaucagacauacacacacccauaccgcaacaaaugcagccaacugagauaagccuggcuaauacauagucucccuugcccagcaaguuccaagggccuccauaccucuuuccccugcagcuugagcuaagaccccuaguauacagcacaggguuggaaaggcuuuguauaggccccaggacaggugcaggggacccucauggacggacggguguggccccuucgggagcuugcaaguuauaagaaagcacagcccaagccucuccuggguuagccaaagccuucuggggaguggguugggcauucaagguaucgggagucccagguucugaaggcaucuuggaaucuuguccagucgacaccuugccccacccugcuccgccucucuucuuucugguacggccgguugguacccguuugcuuuacaucaaccgcaccccucucgccugacuccagccaacugucucacucgccccuuguggggcucaccagaacucaagccccuauugcauccccauauugcaaugcccuccacugccaaccgggagcaguagagaccaagaagaggccagagcuccccgcccgagccuugguguggggguaucuggagaaucgugagcaucgcagaggggguugaagggcgagccaggacgucuguguuccgggagcuccggagauccccguagcaaaggcaggggcgcuauuuugggggcaacagcugcuguaguuccggcgucuccagccaagagaucaaaauuccccgggucggaacuacccccuccggguguucacccaucacccagccaguucuggucgccuggaucuggggauaguggcguuguuggagauuaaccaggaaacccgaguggggcuaauuauaacucggggcuuccgcugagccuccuuuuagagggagggugggagggugagagggagggagggagggagggagggaaagagagagacagagacacauagagagagacagagucagagagagagagagagagagagagagagagagagagagagagagagagcgcaggagggguccuggagcuggcaaggggcucagcuggguagggacguuggggucgcggcccucgggaugggggguggugcauucgggaugucaguaaccugcgcaguuugggcuccgccccaaacagggggcgucuuccaguguccccagacuuugaagagaguggggaaggggccuucagggggucccugcaggaagggagcgcagaggcagcggccggcccagcgagcaucaucaguaaguaugcagcggcuagcgggaguuucagaggagugcgaggcaguggaggggccccucuaggcaggccccacggggcaggaggugcaguaggagcucuguuggggggcuucgaucguuccaggaucgcacguuucccccgggaugcggauuggucccgacucgguggaggguccuggguggguugggagacucaccugaggcggccaagccgggccgggucgggccgcgccgggagcuggaggcggccaauguuccccggcgcaggcugagccgacagugacagccgccuccggccccccgcacacaccccuccgggccgcacggcgcccccgcccgcccacugucuccgcccccgccccuccccgcucccccgggcugccaccuccccuccucccucccuucaagccccgagaccccggggagcgggagcccagacacacuccagugguagauucagacagaccgacagacccgcagacccgcagcggcggggcagacacccacgugacagacggaccgcagccugcggagacaccagacaccguucacgcaggcgacagucuccugcggugacaagucacagacagaccggucgccuuucacggacggaaggacacacugacagcucuaauccagaaagaucagaggccuaauauuuggcaucuguaaccaggacaaagcuuggggcaggguaauaagagaagagacacgagaaagccugacugaggacccccuucagcugacacugguagaaaagaugacgugggacaucucuguggagacgaaagaacaccuguaggaacaaauaacagaaacacaggcucucccuuauaggaaaagaccccugugggcaagaagaggugacacggggacagcugagaagccagaccacauaguggcaagcagaaggcuguggggagaugcuacaaugcacucugcugcagcucuggaaacuuccggaacccccgagggugggcuugagcuaauuccccugaccggugaccuccggcugucaucacaaggguccggcugguccaugacauc

SEQ ID NO: 2739 - RNA, 1324 nt, Mus musculus
ugucggcuuacaguggaguggaagaaucaagagaauuucuacaacugcagucuaaagauaugucugucugucuaucuaucuaucuaucuaucuaucuaucuaucuaucuaucuaucuaucuaucuaucuaucuaucuaucuauuugagacagguauggcuacguaguccaggcuguccuugaacuugggguccacccgccucuguuuugucagugcugagaugagccagcuaccaugcccaguuugaggccggugguuguccuaauucugaaaggggaaacgagagacuaaauaacuaauuaauucuguguuguggcgccuuggacaaagcguuucucuuuuuaaaauucuuuacgcguuugagcguuuugccugcauguaugugccccaugugcacgcaccccaaagaguucaggagaaggcaucagguucccuagacuggaaucacggaugcuugugagccaccauguggguccugggaacgcaccguaaaagcaaggagugcucuuaacugcugagcuaucucuccagccccuggcaaaauaguucucaacugaccuaagucuguauacaaaguggaacagaauuugacccaaagguuaaggcagcaaaggguacaaaugcaaggacagggacagcugcucugacagcuaaucuucauugucaguucgacaggaucuagugucaccaacgaagcaaaccucuggguagguuugugagggauuuucuagauagcucaguugagguggggaggcaaccccucacugucgccuggcgucuuacuguaggauggggacugaaugaaaagaacugaacugagggccagcguuccucucucucugcuuccugacuggauccagugugagccagcugccucuugcuccagccgggagccaggauaaucgcuuccuugcguggcugguggcugucguuacauuaaagugaaaagaaaugaauacagagaucaagacuccucauccagucccagccacccugaggacaccugcuagcucaagagaaucagagucuucuucguggguaacaaaagcagucacugaacagccagccaccccccuggcuguuaucauaaccuguugagguguuaucuuuaaagcuacugggagacuaaucagaccuugacccaaagguuaaggcagcaaagcauacagaugcagcacacgggacuuugguucccaggacccacaggguggcucacaaacaucugugacuccagugcuagggaaccugauaccuucuccugaacucacggggcacauacauguaguuguguggcuuccggaggaggcucugaugguuaaugaaa

SEQ ID NO: 2740 - RNA, 28563 nt, Mus musculus
cagucucgacucggcccagcccuggcccagccuguuucccucccuccugcucgguucccacuuugguuuccaccuuccuugaccgcgaccggcgcacuaaccccggcggcgcgacauccaccaaccacuccagggagcgagagagaccgcgagcaaucggcccaccccagccagccagggcgggacccccgaagccccgaagggaccccuaacucucagccacgucccgaucuccgcccgcccagcgacggccacugccaggacguccccccucaaggcuggccuccccgcgcgcgcgcgcugcggcggggacgugggggccgcaccugagcgcgggugccuggcgcgcccgcaugggccaucguugagaggcccucgacggaaagucccagcagcagagucggugugcacccgcccaggggagggucagaccugggggggccagggccccccaaacucggaucgcauucagccaaagugaggcggcgccauggagcuccgagcgcugcugugcugggcuucccucgccacugcuuuagaaggugaguuuucuuggggugcccccuguucuuggggucccccaaaguugugccucagagugcaaaagcuggucucucccuaucccaacuccgguaccccuuaaacacuucggaccaauagcacuagaacgggagggggcggggaggaggcggccuggcggggagugggguuuuucuuuuguuugggaaagagauggagucgagagcucagacccgggaccuucccuuacccagccuucuaaauucucaguccugaugccaaaggcccaugacagccuuccuuuuccuguccacccuaauguucaaaacuaucccccaaaguuuuuauccucucuccaccucuggcuaaacuccaggggaaaguuccugaaggggcacuugcaggcgaggcagaccccagcuaggccguaaagcgacccccaccucugguucccuagcguucauucacaccuggacuccacaccccagucaggauggccccaucugcagccccacucuccaacucccaaauggcuggccaggcuacugaccucgugcagacucuuuucuuguuuuucucaaggcuguaccccaaccuuuuacaugccauuuagaccucaacuuuucccaaggcugaggcuuucuuccagccaugcaagcccgcagaaacugccuaacaccggccugugucgcccuaauucaccccagcuggccgccuccuagcccgccucagauuucugguuuuuuuuuuuuuuuuccuucuguauuccucuccaaaugccucuucagaucugugagccccuaacuccacagucccucuuggggcugcacaggacucauaacccccuuuccugccucccuaaucucuuuucaaugaauuuggcucccccacaaccucccuugcugcuuagaaucaaaggagaaucuggggagugggacacaagagugggggagaucucucccugaagcgauggaaucaaaggagcucccucuaggcugggcagugcuguucugggcugaucaaagugugggaauggggugaggacagacuuugggcuccuggagaggaggaagucaaaugggcagagcacccaugaagugugucuggagggaaagacgggccaauaggaaaugccccuucucgccugcgcuaccugaaugauucucaagccccugccuucaccugugccaacugcgauuauuuuacuguuauuuugcccagcaaaaaaggagaguucuuguuuccuuaacaggugacaaacuaaagcuuuagaaauguuaauuaguuuauccaaggccucaggcccuaaaggagguguaaacugggagaugugguggugggggggggaggggacgacgaccuagaaauggagcccuggagggaaggaggugagaggugggucugggaacugggggacugaagugagcuggaggcaaacuggcguguuguggaugcagggaaagugagucugggcucagcucaacaggcugaagagcagccuguugcacagacaguguguaaauuggagacaggaaaacgcuauccaggcuggaacaauggaggguggggacggcggccucuauccacccccuucccagaaccgugggcauccuguccccaacguguucugcugucuccugccacccauuagaggggccgguaggcuuugccucuggcugcucagguuccugccugcccccuacacccugagacagcaccgcaacuuugaggugaugccucccucauccacccuaacuccaggcacuccucucucucaaagccaaaggggagggcgggaccuggucccagguguuccgcugacuccccuggaggcccacucucaacgcaugugguucccagacuccugcccccucccagguugccuacccucaccaggggauuccccaacccucccuuccucccucccgguuguguugccagugaagucugcacaucuccuaaucccuuccugggucagcaucaugucugcuccccucaaaugaucccagagccccuccagguguguucacacacaacuccccaccccuaaacucuccuccuuucuuucuccuaaccaaguccagaugugguggggccucugcuggagcugagcgaggcagggaacccaagaguccaggcuuccagaacuuauuucucuggugguagcaaaugggggaggugcacugccucaggcgagggcaucaccuugaaggacugggugucuggugugaaaagggggcggggaccgggauggaagccaauuuuggcacuuaggaaagggagggaguguggagccuaagacaggccucuaggaaaccuuagccuggaccagcaguucucagccccaggaggcaaggccaggacuggguuuuguccuguuuuuuguuuguuuguuuguuuguuuccagacaagaucucaugcaauucagacugggcacaaacucacuagcuggucuugaacucuugaucuuucugucucuaccucccaagugcuggcauuacaggaaugugcuaccaggcccagaacuuucuuuucuuuucuuuucuuuucuuuucuuuucuuuucuuuucuuuucuuuucucuucucuucucuucucuucucuucucuucucuucucuucucuucucuucuuuucuuuucuuuucucuucuuucuuuucuuuucuuuuuuuuuuuucuuuugcaauucugggggugaagccuggagccugacuacacgaagcaagcacuccagcugugccauaccugccuucccugagagcaaaugcugagaaucagcccaagagcgccugcugcugcugcuucuucuccuucuucuucuucuucuccuucuccuucuccuucuccuucuccuucuucuucuucuucuucuccuuccuuccuuccuuccuuccuuccuuccuuccuuccuuccuuccuuccuuccuuccuuccugaguugugugcacauuuaacuuccagcaugaguuucccucauuuuucuggguacagccccuccggggaaaucuagaagcuauccagugcccaccagcugcugaugggagaguuggcacugggaacagggguuacaaaucuaagggcauugggcuggugagggcguucaucagggaaugcuaccugcgagccugccgaccugcuuuaaauuaucaacaugcgcuuuaugugagguuggggacaaagaggaagacaaagacuucucuugugccuaguacuugugucacacucagaggacaacuugugaggcucucuccuuccaccaugugggucccaaggaugaaacucaggucugcaggguugguggcuagggucuuauuuccuucguccaagagaauaaauuuugcuaccuccuggaacuagaaagacaacccacucgcccucauucccguuuguucccagcaagcuguuggcccuaccucucacacauaccuccccaguggggcugacuuugucucucugucuuagagacccuguugaacacaaaacuggaaacggcggaucugaaaugggugacuuacccucaggcagagggccagguaagagcuggaggggaacugaagcaggagguugcacagaaacacuccgagauacuuguuuccuguagccacucugacccuagcuagacguccugacugacagcuuucgucucugcacagugggaggagcuaagcggccuggaugaggaacagcacagcguccgcaccuaugaggugugcgacaugaagcguccagggggccaggcucacuggcugcgcacuggcugggucccaaggcgaggugcuguccacguguaugccacgauacgcuucaccaugauggaaugccugucccugccgagggccagucgcuccugcaaggagacauucacugucuucuauuacgagagcgaagcugauacggccacggcccauacgcccgccuggauggagaaccccuacaucaagguaccaacagucugggggaucgaugccacuacaagcaguuaaguccagggagggaagagguggagguguguguguguguguguguguguguguguguguggauaaaagggaagaacgaguacugccucuccuguguggggagguccaacuugaagcugcuuucacgacaucucugcagaccuaccugcugaccugcuugcucacugcugggcccuacuguacucuuugcgucucugucaauaucggguccucucacaucccuaccugguuccucuacaccaagcucucaccuguccuuuuauuuguuugcuuucuugagacagggucuuguguagcccaggcuaaccucaaacucacuacacagcuaaggcuggccuugaacuccugauccuuuuguuuccuccuccugagugcugggcuuauaagggggugccauuguaauccuggcuguguuuuuaauuuauuucuuuguugcauuuugagacaacgucuaccuauguaacccuggcuguccugaaacucacucuguagaucaggcuggcuuugaacuuagagagauucaccagccucuaacucucaagcacugggauuaaaggugugcacuaucgugucuuucuuauuuauuuuauguguaugaguguuuuguuccaguguauauuuguguagcauagucacccuggaauuggaauuacugguaguuguaagaacugccacauaguuucugggaaucgaacccauguccucuguaacaucaagugcucuuaacuacugagccaucgcucuagcccugucucuuaaauucuaguuaccagcaccagccacaccuugccucccuauuuuugagcuauugcugugcugcccagaccagcuuugaaacuacuggacucaaaguuauccuugaguucagcuccuccacuuuguuagcccagaaaaggcuaaccaaagcccaggcuagcuugaaacaccugauccucuugccuccacguguguguguguguguguguguguguguguguguguguguguguguguguguauuguguagcaggaguugguucucuccucucacuuggguuccagggauagaacucagauccuuacucccaguggcaaccuuuaccucccccgccaucuuaccagcccugguuuuguuguuguugcaguuuuuaaaaaaaauuuuauuaggcuuauuaauuauuuuauauguguggauguuuugucugcaaugcguuuuaugugcgccccaugugcaggcuuggugccuaaggacgacagaagaggguguuggguugccuggaacuggaguuaaagaugguugugagccacauuguggguccucuguaagaggaacaugugcucuugacugcugaacuaugucuccaaccuucucgguuuuucuuucucuuucuuucuuucauuccuuguuuccuuccuuucuuccgguagucucucuacuaugcagaucaagcuagcuuugaccucagggaucucucugcaugccucuugagugcuggguuuacaggcaugugccacaaugcccagguuuuauuucugguuuuguucauauguacaucuuaaaacuuauuugcuuuuauuuucugugucugaauguuugccugcaugugugugucugugugccaugugcaugccuggcacccacagaggccagaagaggacaucagagcuccuggaacuggaguuacaguugugaacuaccaugugggugcugggaauugaacccugggccucuugcaagagcagcaauugccuuaaacugcugagccaucucucuaggccauguuugguuuuugagacaagaucucacauauagcucaggcugacuucagauuuucuuauggagccaagggugaccauaaacuccuacuccuccugcccccacauccccagugcugggauuacagguguguauuagagauugagcccagagccuccugcaugagcuaacuuaucuauguccccgcaccuaaaagguguauuuuuacaaaucuucacccaaaacuaguuauugauuucccauggcaugucagcaucugggguaagaaucuuagucucuagagcagguggcuacccucgccuuggcuccugcccuacagggccaucugucugucuaugauucuccauccuuucuccuuggcucugaggucauggcgcagguaucuaugaauauuccuagaacaaaugacucauugggaaaccaaggcaggacaaaguuagacgaagugcagcucagcaagcauuagaggacggcaggcgagucccucaguugugagugcuggcuuagcagucacaaagccccggacuggauggagcaagcauggccgugccugccuguccucccagcacuugagagguggaggcaggaggaucucuccaaguucaaggcuagccuggacuauagaguguguuccaggacagccaagacuacagagagaaacccuguuuuggaaaaaccuuggcuacauagcaaguuugagaccagcuuggacuacaggagaccuuauauuuauguguguguguuuaacuauauguacacacacgugcgcacacacacacacacacacacacacacacacacauuacauaugaauauuauauuuguguguauguauauguguauguguguaacuauauacauacauguguauauauauauacauauacauuuauguaugugaaauacauaugaauauauguuguauguuuauacauaauguguauauauacacacauauguaaguguauguauauuuuauauauucuauauauacauuuucuuucuauauucucucucuacacacauaccccauacacacauauaaaacacguaucauggaaaguagauagaagguucuccacagaagcuaaaaugguuggagguaucugugaagaagguagcccaccagagaucccagaggaccugggacagugguggugaaccuggguucuccugcagguggacacaguggccgcagaacaucugacucggaagcgcccuggagcugaagccacagggaaaguuaauaucaagacgcugcgccuggguccucucagcaaagcuggcuucuaccuggcuuuccaggaccaaggagccugcauggcucugcucucccugcaucucuuuuacaagaagugcuccuggcugaucacgaacuugaccuacuuccccgagacggugccucgggagcucguggugccgguggcagguagcugcguggccaacgcggucccuaccgccaaccccagccccagccucuacugccgggaagauggucaaugggcugagcagcaggucacgggcugcagcugcgcgccaggguacgaggcugcggaaagcaacaaaguaugcagaggugagaacgcgaguacccgggaaagguggggccagcuuuuccuccugcucucaucccuuaggauucggggcuucuuuccccucggauuuuauucuuagaauaguagaaaauaguauucagaauucuguuaauuccgcugauugguaguagaucccagcgacgagacucaugggcaccucuguccagccuuuaagcuucccuacguuaagugauugucacugaacagcucggauaccuuguugggugguggaaaaggacuuuacgaucgaucuccauuauuuucuguuauuuguucugaauucccucccauuugcugauaugacuuugcuucucugacccuggaauucagcuugcuuuugcuuuccuuuuccuuuuucuuuucuuuguugucagcacugaggauuugagccaaacucuguacgagcugcguuauauccuccacccuuuaguuguuucuuuuagccgggugguuugguuuggguuuuguuguucuauauucauuauuaucuuuuaaaugcaggugccagcgauucaaacucaggucuucggauuuguauuuucauuuguuuguuuuguuuagagauuugcuuaguuugugugugcuugcuaggggccguggccugugcugucgaggcccccuuguggucagaggucagaggucagcuugcaggcaccagucaagucauuagacuugguggugagcacuuuugccucuugaaccagcuugccguccuguaaaugacuccauuuccacaaauguccaccuaaaauuagccaguccuuacuuuuggaauguuggcaaccucggugccuuuggauugggaucugaggguuuacauaccauccuaaacacagggcuucacaaagcccacucugggugccgcaucaagcuaaaacaacaucuuugcucaugacuucgguguucuggagguccuaaggccaucugcggcaucucuggguauuuuguuugggguuuuuguuuuuguacugggauuaggucuugauuuauagugcacgcugcucuccagcucaugaacugucccaccuuagccuccuggguguauugcugugacuggcuugucucuucuuuggguuuuuguuguuauuggcuucuuccuucccuccuuccuuccucccuccuucucccucccucccucccucccucucucucucucuuucuuacuuucuuucaacaagauuauuuaucuuauguauguaauaaguacacagucucuguccucagagacgccagaagaaggcaucagaucccaucacagauggcugugagccaccaugugguugcugggaauugaacucaggaccucuggaagaauagucagucagugcucuuaacugaugagccaucucuccagcccagcuuguuucuguuuuuauaauuuuaaaauguucauauuucaaauuaguuguacaugugagguuauguguacauaaggcauuguaucuccccaggggcuggaauuacaggugcugcugugagccacccacuauaggugcugggaacugaguucugauccucacacgagcagugugugcucuuaaccuccgagccaucucuccagcccuuauuuuuguuucugagaaauggagucucacuauauagcucagguuguccuugaacuugccucuggcuuccaagugcugucuguuauuacaggcugggaaaaaaaaugccugauuucuaccguucauccgugcuuucuuaaugcuucacgcaucacauguuagcuaucuugcauuuuuuuuaauaguucuauauuuuuggcaguguguguucacaauuauucugauggcugggaacaugguagagggcuugcuggugugcacagaacccugaacuccguccucuccaccuugcaaacuggauguggugcugcacaccuguaaccuccauacuucagagguggagauagcgaaaucaguucaagguuaucccuagcuauauauggaguuugaggucaggauauauaagaugcugucuauaagucaauuaauuaguaaaauaucaugagaugguuucaccagacugccacaguuaggguuaggcagagugagggaugacacccccccccuuuuccucuaacuggccagucucucauuuauuccuaagcucugucugcaugcagguuuuguuuuuguuuuggagucagaagauuccuuuuaaagauuuuuuuuaacuuauguguguguguaugugugcaguugccugcauguguguauauaugucugugugcuguguuugugccugaggucauaaaggggcacuggauccccuggaaugaugcuuguaaggcacccuguggguccugggaacugaacccagguccucuggaagagcagccagugcucguaaccucucuggucuucaguuuuguuuucuugauagacaucuuuguucucucccucagccuguggccagggaaccuucaagccccaaauaggagacgaguccugccugccaugcccagccaacagccacucgaauaacauugggucuccugucugccugugucgaauuggguauuaccgggcccgcucagacccccggaguucaccuugcacuaguaaguuuccaggagugaaaaacaucugaugucccaugugugguucauugggggagaguguguggacuccccauaugguuccugauacaguuuucuguugcugucguaaaauaccaugauaaggaaccauuaagagaggaaggaauuuauuuuagcuuaacuccagguuguaguccauuggcaugggaaagucaaggcaggaacagccagucauaccacauccagagucaagaccagagagaaaugaauguacccauauuugcucgacugcuugcuugcuugcuugugcucagcuugauuucucuguucucacauaacucaggacccacuucauagggaguggugccacccacaguaggcugaguccuccuguaucacuuaacuuaauccagaaaauccuguacauacacauccauaggccagcauaacagucucaucaagacuuuuuccaagugauuuuagguuauaucaaguugcugaagauagcccaccacagcccacaugcuucccagcuuuggccucaccucuaauacuugagaagauuagugugacugacugucuguccuuuaggcuaguccauuccuacccucuaccugauucucuuuucccacagccccacccucugcuccaagaagcgugguucaccauuugaaugguuccacccugcgccuggaauggagugcuccccuugaguccggaggccgagaggaccucacuuaugcuguacgcugccgagagugccguccuggggguuccugcuugcccugugggggcgacaugaccuucgaccccgguccucgagaccugguugagcccuggguggcaauccgagggcugcguccugaugucaccuauaccuuugagguugcugcuuugaauggugugucuaccuuagccacuggaccaccuccuuuugagccugucaaugucaccacugaccgugaggguaagacaaggggacagaaaauaaugauuuuuaaaaguaauagaggggaugaugugaccaaagaauauuauguguucauaugggaaugucauaauaaagccuucugugaagguacuaugcucugguaaauuuuaaaagaaggagaaaaggaaagaaagaaaaaaaagcaacauuuaucaucauaaucucaguauuugggagucagagacagaaagaucagaaguucaaggccagccugagacucugccucacaaagagaaaguagaucuuaguuaccgacucugccuccugcgcucugggauuacaagugacugagaugucugugcagcuucuaccugggugcugggcauccaaauucuugugccccaggcaguuugcuuacugggccaucaucccagacccagauuaguccucccccccccuuuuuuuuugagauagcugcuuguauguagcugaggcuagcuucaaacucagcauucucuugucucugcuuccagagugcucaaaggaaaaaaauuuuuuuucaaaaauguauuaauuuauacaugugugccugcauucauuuguguaaaccauauguguggaggugcccaaggaggccaacagaggguauuggaugcccuggacuugcaguuacaggcagcggugagcuacuggaugugggagcugggaaccagacauggguccccugcaagagcaucaugcagguauuagaagagguugcuagguauaaccuccggaggaaaaauuaggaagcaaaaccccuaggguuugugguccggcucagagguagagcauuugucuagugcauguagggcccugaccgcauccccagcacugugggggugcgggucgggcaagaauuggaaacugcuaauugcuagacuuugcagcagggcgcauuggguuucuuucuccugcagugccuccugcagugucugacauccgagugacucggucgucacccagcagcuugauccugucaugggcuauccccagagcacccaguggggccgugcuggacuacgaggucaaguaucaugagaagguaaggcuaggcucugucccagguaaggggacuggugggcauugaaccagagcugggagcauugcaauucagguugacuguuuauuaacucuacgacuacaggcuagcccuugggccucucuacgcuucaguuauuguuaucuguaaaauaguuauaauauaaauauaauauaaauaaauaauguaguaaauauauaaauaaauaauacaaauaaauaaaugaaauagaaaauaaauaaauaaauaaauguauaaauauaaaauuuuauuuuaaauaaagaaaaaaauauauauauaaauuaauagucaguuaguuauauaccaggacaaccacuguaaaggguugucaggauggcucagugguagagccccugccuagaaucccccagggaggggcugggggcguggcucagugguagagcccugccuagaaugcuucugugaggggcuaggcggauggcucuaguggagugcuugcuuggccugugagauguuuagguuugaguuccagcaucccaaagagaaaaaacuaaagcugcaaggauaaaugaugcuauacgauagaacaaagugggagugacgggggaaggaaagcagcagagacgggggaaucuuacggcccauuccuuucuccuccugcacagggcgcagagggccccagcaguguucguuuccugaagacaucagaaaaccgagcugagcuccgggggcugaagcggggagccagcuaucugguccagguacgcgcacgguccgaggcuggcuacggucccuucggccaggagcaucacagucagacucaacuggauggugagucugggguuuccgguggaggcugggaagguugccccaccaggcacggcgggcuucaguaucggcagucaucugccuuguucuuauccuucaaugauaagcccuggccaaaaccuagaauagagaaacuaaauccgugcugugacgccugcuggcucuucacucuagcugcauguugacccacaagcuccuccuguuuccuccuccaguaagaugagcaaagccuuccacccugaugagaguccugagguaaagugagguagcacgugcuuuuuuguuuuuguuugauuuuuugguuuuucgagacaggguuucucuguguagcccuggcuguccuggaacucacucuguagaccaggcuggccucgaacucagaaauccgccugccucugccucccaagugcugggauuaaaggcguggaccaccucgccuggcuuuguuugguuuuuugagaaagaguuucgcuguguagcccucgcuguucuggaacuugcucuguagaucaggcuggcccggaaaucacagagaucuacggaccuucugccucucaagugcugggauuaaaggcgugcccaacuuaacuccguacauuuuugaacagcuccauguuuuuugagacagggccuugcuauguagccacggagauguuuuugaacuugcaaggcuggacuuaaaguugcagcaauccuucugccucugucucccaagauuacaggagucccccacuuggggggacuuggcuccuuccuuccuuccuuccuuccuuccuuccuuccuuccuuccuuccuuccucucucucuccccucucuuucuuucuuucuuucucuuucuuucuuucuuucuuucuuucuuucuuucuuucuuucuuucuuucaucuucucuuccaucacuuuucuuuuucucauuuuuaugcuuuuuaaggauuuuauuuuauuuuauuuuaugcauaugaguguuuuuccugcauguaugucugugcacuguguagauggaggccagaagucgauccuggaacgggaguauuugagcuucccccauguggacacuggggagugaacccaggucuccuggaagagcugcuaguguucuuagcugaugagcuagagauagagucucauugugugacacaggagggacuuuaacuugacaauccuccugccucagucucuuaaaugcugggguuacagacauagaccaucacuuuugucuuacuuuucucaguacugagggaccuugagcauacuagcccagcacucuaccacugagcuguauccuggccuuuauuuuuauuuugagaugggguuuuacgaaguugucuaugcugaagcagaaccuacuauuguagcccaggcuagugucaaacccucuauccuccugccucagccuccugaaugggauuacaggugugugcuaucaccuucggacucucacccaaagaagauuuucuuuguuaaacuuggacacuuaauccauuguccucaguaugagcucagcaguugcuuagcucguacugggcugagaugggagucagcuuaggagaucucagaucauugcuugaugguggaguuacggggaaucaggaacucucaucuuuaccugaccucuucucccccccagagagcgagagcuggcgggagcagcuggcccugauugcaggcacugcgguugugggugugguccugguccugguggucgucaucauugcaguucucugccucagguaaagacuggccaccugcucacacaccccagggcagugguaucaaccugccgaaugaugcaaucccuuaauacaguucuuccuguugugaugacacccccccccccaaccauuaaauuauuuacauugcuucugcauaacuguaguuuugcuagguaugaaucaugguguaaauaucugauaugcagaguaucugauguguggccccugugaaagggucguuugaccccguuucagguuucaacccacagguugaaaaccgccaucguagagcaagccuuccugucuuucccacccaucaguucucaguggagauuuuucuagaccccaacuccuucacucucugugggcccagagauguaugacucaguuugccuuuugcuucuuuucucacugcuacaggaagcagagcaaugggagggaaguugaguacucggauaagcaugggcaguaucucaucgggcacgguaugugggucacagacaaggggaagaaagcagcuuugaguuaaugggacaucuuggcccagaggaauuuacuuccugguuaaugggcuccugugugacuccuuagguaccaaggucuacauugauccuuuuacuuacgaagacccuaaugaggcagugagggaauuugccaaagagaucgaugucuccuaugucaagauugaagagguaauuggugcagguaagaggaacaagucgggaugcuucagagucguacaaacgugaggaccugaguuugauccccagaccugugugaaaaagcugagcauagcagcacaugccugaaaucccagcacuagagugagggauugggggagggguggggaucggaagggacaugcagagggucuguggugcucacuggccagcccaucauccaucagccuaaccaaacuggguucagugagagacccucucucaagaaaucagguggcuugcuguuguggcaguacgcaucuuuaauucuaguacucaggagaagaggcaggguacucucuugguuugagguuaaccuggucuacauagcaaguuccaggcuggccagggcuacaggauggcucagaggauaaagaggacugcagccaaggcugaugaccugugagggacccacaugcugggaggagagaacuaauuacugaaaauugcccucugaaugucacguguuuguucucucacauguguacaugcacauguguaaccaugaauauaauuacaaaaaguaagaaaaaagguaaaagagguagaagaaaacaccguauguugauauauggcugcuaucacaugcauauacacacaccaacaggaaaauguacauccaauguacauguucacauguucaaugugcguacaugcucgcucucacucucucucucucucucucucucacacacacacacacacacacaccacaaaaguaaaagccugggcuuguuuacaaaugggucagaacaggagaaaaacugaccaucugcauugugacugaaggugaguucggcgaggugugccggggucggcugaaggcaccagggaaaaaggagagcuguguggccaucaagacucugaaggguggcuacaccgagcgccagaggcgugaguuccugagcgaggccuccaucaugggccaguucgagcaucccaacaucauccgccucgagggcguggucaccaacagugugccgguuaugauccucacggaauucauggagaacggagcccuggacuccuuccugcggguaagccuccuccccaccuucacaaccgcugcaucuuccugggagauggggugggaacugaggaagcagggaaagccggacguagaaaauagaauaaagcagaagucaugccugccguccuagcauugcagaggcaggaaguuugugaguguacgucauccuagggauacaaagccaguucuaggcccgcuuaguauuacauugcaagacuuucaguauuguauuacauagcaagacuaccuccagaaaggaaaaaaaaaaaaaaaaaaaaaaagcugaauaguuucagacauggaagaaaaaaaaaaucaaaccagaucuugaauagugacugaauuauuucauugauuuauuuuuguacauuacuggagauucaaaccagggucucauauauaggcucuacaaucucucuauuguagaaccacagacccagccccucccuggggauucuagucaugagcucuaccacugagccauacccucagcuccucacugggggauucuaggcaggggcucuaccacugagccacacccccagcuccucauuggaggauucuaggcaggugcucuaccacugagcaacacccccagcccuucacugggggauucuaggcaggcucuaccacugagccacacccccagcuccucauugggggauuccaggcaggggcucuaccacugagccacgcccccagccccucacugggggauucuaggcagccuucuacuaccugaacuauauucccagccugccucucuguauacucaucauucugaauuucugucuacauuggcucucuacucuaggccccaaacacauuuucccucacuucccgauuaacucucucuuuugcaaucuuuucccacacucaucucccuuacucugcaacaggucccuggucacauagacuccugugucaaugaugagggggucacacugcguuauggaucugcuucagcauccauaggagccugggugggucugggacaguauguacaguguguagcacagcuccccugugugauccagccacagaugccuaauuuccaauucaucaggacaugggaaagagaucugguuacaggaaauacaggaagacaaguuaaaugacucuacauggaagaagccaugaauucagaaggggcgggugacauucuaagggacaauuguuacagcacuucagcaugucagucucauaucaaggacucucugggauuuagggagauacaugcaaauagccaguaugcugcccgacguccuagccacgugggagaaugaggcacaagauuacaaguucaagcccagccugggcaagguaaagagagucugucucaaaauaauaagggggaagaaagggcugugaaguauuuucaugguagauugccuauguagaaaaccccagugaggaccuaggggggugacucagugguagggcaccugccuagaaccccccagggaggagcugggggcguggcucugugguagagccccugccuggaaucccucagggaggagcugggggcguggcucagugguagagcaucuaccuagaaucccccagugaagggcuggugacauggcucaguauagaguguuuaugagguuuuagguucaauugucaucauuggaaaaaaaaaaagcaugguuguggagauggcucagcaguuaacagcaccgucugccuuucuaaaagucaugaguucaaucuugggccaucugcaaaauuuguuuuuaauuuucagccaggcagugguggugcaugccucuaaucccagcacuugggaggcagaggcagguagaguucugaguuugaggccaggccaggaaaggaacucacuacagagugacagccagggcuacacagagaaagugugucucaaaaaaaccaaaaaagaaaaagaaaacaaaagaaauucagauuuuggaugcagccuccuuguucuucccuccagagguguaggggguauagcuccugcauccugccuucaacccagaugggcuccauuuaguuuuguuauucugcuugguauagcuaugagggcaaaaugaaaacaucucaaggucgggcccagaccucaccuuugucaccaugucccuccguuucauccuguucucuucuguucacacgcaguugauuugggaccuugucuccacugccgggcagcucagaguacacuccuaacuggcccagcucugccuaucaaaucuaaggacuucguuaggauaaaaauguuagcugaagccauuagugauggcuugcaugucuaaucccagaguuugggaagcugagccaggaagauugggcugccacaacucuggggcuggcaugggcugcacauugagacccugucucagaaaaacaucucaaaguaaauaauaauuagauguucugauuagaagcagaacgcggugguucaugccuguaagcugaggcagaagggacauuucaaggccagccugggccgcguaguaauuuccaagcuaaccagcuagagauauauaaggugauccuguccaaaagagcacagauugagaugugggggagggccuuagaaacaucucuucacaauaugggaguggugaacauacaacuuuaaaaugaaagaaaacugggcggugugauugguucaugcccguauccccauugguuugaagauggauauaggggaaugggccauauaaacaagacaagacuuugucucaaaagcaaaagccaaacuaugaggcaugaugagaaacggugccaagguguggcuauagcaggggaauuuaggaagaccgggggcugccugagagaacugcaugcuguguagaccccaagauggguaggcgagugauggcugugcugaaggcaggggcgaggaggauaaaccaugggcgauccauccugagcaagccuuucucccgucucuuuccucuccagcugaacgacgggcaguucacagucauccagcuggugggcaugcugaggggcaucgccucgggcaugcgguaccuggcugaaaugagcuauguccaccgagaccuggcugcucggaacaucuuggucaacaguaaccuggucugcaagguguccgacuuuggccucuccagauucuuggaggagaacuccucugaucccaccuacacaaguucccuggugagccuggguccagagaucccagcuaagcauucacacagggaagaaguggguugguuggagaaaccauggguagaaguacuggcagcucugcugggggggggggggggggggcagccgggaguuagggcaguugggaugacaccuguuauuccagcagagaggagguuaagagagggaagcucugugaugguagcuagccugggcuaucuagguggauccuagauagaaagaaaaagaaauccuguaaucccacaacagaggcaguggaggguggaggucagagaaguccaucuuuggcuaccuaccggaacuagggagcuggaggccugcaugggcgacacgugacucuguuucuagaaaacaucacaaaacaggagacagggauggggguagguggggcguggcuuaguuucuuuuccuauggcugugauagaauacucugacaaagguaacuuaagacagguuuauuuugagcucagaguacuagggacagccugucacagugacaaagccgaggcagcagguggucacaucgcaccacaggcaagaaauagaacaauuaaugaaugcauguggcccgcucacuuuguccuuuugauugagugcaggggcccaagcccagggaaccucguuuaacccaguuaaagugucuuucagccacauccacaggcccguccuuuaagagucuagauuaugucaaguugaccacacuaucccuuauggaugauguccuggguccugcugcugccuagguucaccuuugcuggcuuccuccacagggaggcaagauucccauccgauggaccgccccugaagccauugccuucaggaaguucaccucugccagugaugccuggagcuaugggaucgucaugugggaggucaugucuuuuggggaacggccauacugggacaugagcaaccaggauguaaguguucuguggucauaccacgauuuccuggauauucuaucaggauagucuauuaugaauccuggauacgggagugggggauagaguucccagacucuuuccccaucugugugugugggcacagaggggugauguuugcauccaggaguuggcugcagggacuggagggcagaugacgaaaugaguacauuccuugccaugcaaggccgaggcucuccacagccucaccgcuggggugucgggggcagacagguccgggacuuaauuggcgcaccagcauagccagucagucaacuccaacuucugugagaccuugucucacaaaacaagguggaggggcuggggagauggcccuguaggugaagugcugggaauguaagcacgaggccuggaauucagaucccgagcccuuguguaaaccacagggaggugugggagcaugucuguaauuucagauuuggacgguagagacauagaaucauagagcuugauccuggaucaguaagcucuggguucaagagagagacccugacucaauguagaaggugaagggugacugaugaagacaccacacacacacacacacacacacacacacacacacacacacacacacacacacacagagagccacccaugcacauuacacauguaaucaaaggaaagugaugagcuggaagguaccgcagugguccugcugguaagucugaugauuugaguucaauccccggaaccagcacaguggaaggaaagaacugauugcuucaaacaguccucugaccuccauacaugcgccguugugcaugcacacacacaccagcgucugcaaauaaauagauacaugcaauuuaaaaauaagguggagagugagguaggaagguacccuucauugaucuccacauguuacauccacauaggaacacaggcacagaguuguauguaguagcagcguuggauucggggauggguggaggguaggguugggagguugcucucuagacugaagcuugagagcugcagggcugggugaguguugccaaccaaggcaguuuucguccuccugggacucagggggucugugcuuuuggggugccugugguuccuucggcgaacgauucucucaagccagcuucacccagucuuccuccuugucucuguaggugaucaaugccauugaacaggacuaccggcugccuccuccuccagacugccccaccucccuccaccagcucaugcuggauuguuggcagaaggaccggaaugcccggccccgcuuuccccagguggucagcgcucuggacaagaugauccggaaucccgcuagccucaaaaucguggccagggagaauggcgggugaggaucccaaaggacagcuccgacccacaacccaagaguccuuccaaguggcccuggaguacccaugccuuuguguauagacuggucucuguugguguucccagagccuucugaugaggacugacuuagcauuucucuccaucuuuauccucuccaccuuccagggccucacauccacucuuggaccaacggcagccucacuauucugcuuucgguucugugggcgaguggcuucgagccaucaagaugggaagauacgaggaaaguuuugcagcggcuggauucggcuccuuugagguggucagucagaucucugccgaguaaguagaagggaccgcaguggggcacagagcaucgguauaggaggcugagucagacccacccccuccccgguucaguagggaccucugaguucagcuucaagggcuguuuuauaugguggcucagcgcugugaugcccgaggccgagccccgggauccucccacaacagcagggccuggcuaguguucauucuggagccuccucacgccagggucaucuaucucccuucccauuuccagccuguaucugucuuugugccucuaucuacauuccaaacguggcucucacaguaaugugucaacucuggcucccucuucccacccauaaaaggagaggacgggccugagauuuggaaaucccuucccagcuuugaugauacacgguuuuaugauucuaucaacucccaaauaacuguucuccugccugucuauccuuggagcgccuccucccucccaucucugguucucucccaaggccucugcuuaccccagcuuuggaugggugguggugggggggaucacagacuuaugucgggaggagguagcuguggugguauaucacugugcucccagcuccuggaaacuuuuucaauugaggcuagcgugggcuacauaccaauacuuuaaucucaaauaaccaguuaaauaauauguaaaaugaaaaaaaaaagucuccagaugaugucuggccaggcaggucuccuggucccuccucaguaucuucacugagccaaagugcucccuaauuuaaggccuaguucuuuaccuguguggucccugucuguauuucuuucuccuccaaggcaaccucugcagcuucuucccccuaaaaucucucugaggacucucucuuuccuucuucuacggaggccgcucaguaaauguuuggugauuacucuugccuuucuccuccuguggccucccugcuuggcuggucccgggacuccuccaaccuucuguuuuuccacagggaccuucuccgaauuggagucacucuggcaggacaccagaagaaaaucuuggccagugugcagcauaugaagucccaagcuaagccaggagccccuggugggacagggggaccagcccagcaguucugaccuccaaggacucaccaccguggcagauucuucuuuccggggggcagaguuggguggggacucacaagaugagccccucccccucgucacagccuucccauuggauugcacuuugaacagagggggucagagacccaggauuuggggaaccgugccauaugggaucauacaugugcccuccaggcggggaaccccaaacucagagugagucuuucccucaagacugggcaaagaaacaucccuacgucucuaaccucccaucuucccagagggcucucuccccaagcgccuuccaccucaacgggcaugucccugcagaccaaagagaaagggugaccagccugccaacuugggaguggaaaaugccgucccaggaggcaggaaggggcugucaggacccggugauguaaucauuggguuuugauguccugacuugcugucaccaccaaaggcaaucauuuuucccuuguaaaugccccuccccucaucugccuucauauugaagguucugaaguuuuacuguuuuuuauuuuguuaauuuuuuccuccuuccccccucccuccccuucuuguccagauuuuguguguuaaagggcaccugguuccacuaucuccuguugggaacaaggacccaucgauauguucuagaacagugccuuggaaaugccacagccuuagacaguuccuucuuccuuuccuccccccaagugcccccaagcuguguuguguggagggaaggggggugauguuguaaaagggacaggagguuggugguggucaacagaggcagacaacggugcuuggaaggggguucuuaaauuauauuuaaaaagaaacuuuuuuuuuuuuauaaauaaaaaaaaaagggggauaugucucaguccagagggugacugggagcugggguugaccagauuucugagacuaggggaccccuaggaguguggauuuggagggucaggucaggugguugggauuauggugugaggaggggcuggguguugguucucagccccaagguguuuuguuuggguuggugggaggugagucacuggcagcuggugcuaacugcuccagcugccccugccaagagccuccggcaccuccgggguggggcagacaccuucugccccuccucugucuccuuagcucuggcaggggguuguauaagagaagccaagcguguagcccauaguccugcccuagaacugcuuuaaaaggauaagggggcacgggugacuguggguggggggucccaguuaggugcccacaaacuuaggcuggauguccauagcugggguugguuuggugguaaugggagagccagcauuggcugugaggggaggggaagauggggaguggcugaaagggggcccucacaucuguguacuuaugccagguagcucucaggacaauucccccauucaagaugcugcccaggcagguuuuccuggccuccugggaaggggagggggagccgcuccaaugagucugcugcuaacuucucccagacaaggaaaaggaggauaggguccauacuccauuccagccucuccacuucccccacuguuuucucggcccccucucugcuccuggguaugccuucccauugggacaccuguaagggccaguuagugcaggcuagccugauugagcugcaguggaugugaggggugcagaaccucacacacuggccccaaggcaguguugcuaucauuuccccugcacgaaugugugugugugcgcacgcgaaugugcaugcucaugcaugaacauuaagugagaaagacugauucucugcagguccucucauuccccuaaaacuggccaugugggcuagccuggucagccacauggccuaggaauuguuucuucccuccacaguucuagaaggguaagcccauacuaccauucccaccggccccuccucugcugcaaacagcggagcuucgagcuugcuugcugacugaacuagcugccagaacccauaccccuucuuguauuuuguaaaccagggcuugcuaauaacccaggccagccuugguacucacuauccuccugccucagccucuggaauucugggauuauggcaugaaucacacuaaguccuuugucuccucucccugggugacauuuaauaucucuggagggugggaggggcucauuacuaccaggaaggggagugucccaggggacacuaauccagccaacugccuuucgcugccaaacagacauccuggcuagauacagugaccuccacagagagcugcuacgggaaagaaagaugaaggucacagcauccaagcaguacaaagauggaggccagggggagaaauggggcucuaggcaggagguuaaccugcugaggggcacugugccuucuguccuagugagggaaaccaggguccugcagagcaugucccaccccuguccugggcccuuuccauaauauugaguuuggcugacuucaggaaaggucuccaaagguauaguugucacacagauuaauaauaucucccuggccuguguccucccugccucaaagcacucuggccaagucuugguuucuugaggucuucacagucugauccauuauacaccuuggccuccuuuggcugaaccagguggucacuucuaccugguugucagaauggcuccuaaagccaguaacuccacccucgguucccauagcaaccuccugaagggcucuuugaaggaacgaagaaugagggauagauacccucuggaaaaaucccaaccggaaacaggaaacccagaaugcccuugcuucccccuaguggaggaauucaggcuaagcccucucagagcucagggagcuccaggucagcaaacugaggccaccuuaaaaaauaacuuggaggcggguacugguggcgcacgccuuuaaucccagcacuugggaggcagaggcaggcggauuucugaguuugaacucuacaaaaugaguuccaggacagccaggacuacacagagaaacccugucuccggggggggggggggaaccuugggguaggggcauagcagugacaugucagcagguccaagugcuugcugccaaaagugacauaagcuuggucccuaagccccgcaugguaaagaaacacuggcuccugcuugcugucuucugaccucuacguaugugugugagcauuaguaaauguaaaagaaagcccacuggggugcuggagagauggcucucuugguaaaguguucaucacauuaaugaggaccagaacccauguaaauggcccgauguagugaugcacagcacaaggacaguggaggagauaugggagggagagacgguuuccauggaaacuggcugacccgccagccuagcuccuugucaaagucuagugggagaccgggcagugguggcacuggcacacgccuuuaaucccagcacuugggaggcagaggcagaggcaggcggauuucugaguucgaggccagccuggucuacagagugaguuccaggacagccagggcuacaacagagaaacccugucucgaggaaaaaaaaaaaaaaaaaaaaaaaaaaggcggaaaggaccugaggaaugguggcagaggcuguccucuggccacuacaucaagagugcgcacagugaagcgugugccugcgagaugacaguucccuccgaguggguucguccugucuuggagagccacauccugcugcugcucucccagaggaccugaguuugguugccggcuuacaacugccagucacuccaguucccaggaguccagcguucucuucuggcgucuguggccaugugcacacagauggcagacacccucucuuauagacagacacauaaaguaaguggaacaaaaguaugauucagaaugcccuuaagggaagcucccuaaggcccaggaaguaaacgauucaguccuaaaaccgacagaacgaaugcccugagccucuccuucccaaucguauaugaacagcaaggacugccgagaccacucucagaccagccgagacaccccucaccuccccccccccccccgccaacccggcaagcugccugcaggcugugcagcgagcacgagcaccagggcuccagcauucaggccaucacagcuaccuuggggucacuucccggcuguucguagccacuccccuacauuccugcaagcgaucccagaacucuggaccgcagggguggcacuacucugcuucauccuugguucccugucugggggagcauauguguucaugacuuugcaggauggugucacgucuguacacaugauguacacacaugaacacauaugucuacacgcacacacguuauguuuuuucaaacggguaaaggagaugcccaacaggagcuggagaaucggcucagcagacggcagugucugaacccugggaucuuccccuagcacccaugggguguagacauguagaccuguaauuucaacaggcagagguaggaggaucaggaguucagagucauucccggcuacguaauaacuugucuuaaaaaaggaugugcagaggaacagucuuuccugucuugagggguauauagcucaucuuccuuccagaaccuucccucccugccucuucugucuuccauugcuggugcccuaccagagaugauuucgaugcgugacauucuccuuccugaaaccugagguucucucccugggacauugccuccacagcacucagccuucagggauccacacacaucugucucccuuuucucuuucucuuuaggucccagacuagcugucuccaccacaaucagggagaaauucauaucuaaaaacauuaagccugggucuaucaagguaucuuggugaagaaggcaucugcugugaagcccaaugaccugaguucaauccccacgucccacaaaggaaaggaagugacucacacaaacugucuucucaggacacgcaaguggcaggcgcgugcccauccccccacaauaacaaucacaaaacaaaaaguauuuuaaaaaauaaaauaaauauuuuucucugu

SEQ ID NO: 2741 - RNA, 7430 nt, Mus musculus
aaugggcgggggagguggggacucccccuccaagccucagguugcacuagcacccccgucacgugacgggcuguggcgggggcucccggggucacgugcgcgggguggcgacgcgggggagccgugccuuagguugcgggcugcagcggggagcggcggggggugcgggggucgcggcgggucgccgucggagagcgcggucgguggcggugggagccgcggccgcgguggcguuggagggggcggccccgcguccgugucacgugguacgaggcgggcagccaucuugcuacaaacacaaacagagaggagcggccgccgcgggagcgccagcgcccccccccagucccccccugccgccgccgccgccgucccggcccuccgcgccacccgcccgucaccgccgccgccgcugccgcgcccgggucaccaacgccccgggggaccgggaaccucgcgccccccccuccgguaagcucugcgagcaccggagcaggcccgcccccgacgccagcggcggccgcccgggagccuuugcgggcagcagccggagccacggcgcgcgggcccuccuccucguaccccagcgguggccggcgcgccggcccucccucucucucucucucucucgcucucucucucuccccggagcggccccgcggccucggcucggggcucgucggcuccgguggggggggugggggaggcccccgcuugccccgcucugugccucggggcgggaggacggggagggagaggggggacgguggcgccccgcgcaccuggcgccccucccugaagggcacgccguccucccggcccgugcucgcccgcaccccccgcgcucaauccgaaguaacggucgcgucucugggguccccuacaagcuccccgaaaugucccgcucgggcccggccuuucugcuguguggugugugcgcgccccgaccuccccuuuuggcgguguccccucuuccccccucaccccccccccaagcccgcuacgugccaagcacgguucugguagccgaaccggggccuggcgggggcucgcagguccaagcguuccaccacuuuggccaccaugguagcuuuauucugcccgaccaucucgucuugggucuucaccucggucucuuggguuuuaagcggccaccuaagugcuuggucaucgaugucccuuuucccuccucaguuguccggccgcgugagacaccugucugucugucugucugucugucugucugagcuggggcugcugggccucccugaccaggcucuucccaguccguaugucccagcucgaugggacagcugcaggucacugccccucacgguuugccuagaauuuuucuuaauuuuuuuucaagaugaaagaccccucuguguccccucuuagaccuaauaguuacuacaguucccaagcagguuugcagugcugagccugggagaugcuaaauacauaguugguggccugaucuuuccuucauccacccucccucuuuccuucuccuccaucuuccugcucaaagcucccuuuuaggaaaaacccauucccagcagacauugacccucuaagccccccaacccaucuaggaccaguaagugucugguuggcucugguaccuauccauccaacuauuuuccuuugcauccccaggccagccacucuccagcccagcucaauguuuauuucauacaucauuuguacaucaguaucccaaguuaggggaggauuugaggaggaacuugccuuauuauuccucuccguugacuggggugccaggggaggcgggagggggcuugacucccacaugaggauucuaguacacuuuuaugguguguucacucuuguugacuggcuuugucagcuacuggaugcaaguucgugcuuuguagggauagugaauaagggauccuaacuuuacccuagccuuugacaucuguuguuggcauuugagaucggaaucauggcccaauggugagauggcuuagccggacaagguacuuguuugcaagccuguugaccaagaacccacuccugggugggaguagagaacaaacgccgcagaguuguccacugacccugcaugugcccccccccccccagcaucauacaguuagagagagagaaaagaagaaacagcucagcuuuaggugagagagggugaccugaaagucugaagaaaggacucugguggcuguagcgcuugagcaagggugacggccagaauuuggaucucuagagccacuuaaaugcuagcugagcacacagccauccuagcauccccggcagaaagggaagcccucuugcaagaggacccaaaacagcguauucugccucagcgaagagauccugccucaauaaauaagcugcugaagacacagcagaaccugagaauucuacguucgugcauaugugugugugcaugugaauucaaauacauccaugcacaccauacucacacacaaaacauaaaaguucuaagaaaaauguuggcauggaaaccaugcaaacacccaggaagcaggggggcugcuguguguuugaggccagccuuagguucaucagccccaaggucugggaaggaaucagaaacagcuucagacuuacauagggaggcugaacauucaggguaacuccugccaccugucuugggugaugcugagggcaccccgucaggggagguauaacuuuauuuucuauguacuggaguccccagcuaggcaaccuggcagaagguugccuuccccaccccuuuuuacugacugccuaggcuagggguccuuuccacccaggccaaaacuccaguuugccccuuaucaaaugagguaaggcgagaaaauccuuugaaaacugugaagucgguucacaauuggccaagagcuaagguuguccccaugacucaaaguagagaagggguaacugcugcccugcagauggugggggaggggggcuguagcccuucguccucccacuacacauggagggaggauauauuuucuauguguguauguguauauauaaauguccacacauguaugugcauaucuccauucguccugggaaagugguuaggugauugcuuugagugugaggcauuugggggguugacucuguuaaccguaguacaggaaguugcuaagguacauugcuuuaaguugcacaaaguuugggagagggguagaguaaggaggaauugucccuaauuguugucagcuugugcuuggaguucugagagccagagcagaggcugccugcucccagacccagccugagccuccagcaggggucagucuuucaauagcaagggcuaggggaggccagggcuaggcuguggggaagggucuuacaaggcagagagagaggcugaguuggccuggguggaaaggaccccuagccuaggcagucaguaaaaagggguggggaaggcuagucccuacccugcugcccaugguggucuucauuagaaagagccucagaugcccucugaggagcugggaugggcaaucuuaggcuuugauuuuucccccgucauuuuuaaauuacagugugugucugcgggcaugcgugcguguguguaagcauguccuguguguguaagcaugucccguguguguaagcaugucccgugauauuuuguuggggugacacagcuuggaggaguugguucucucuuuccacgguguagguccuaagaaucaaacuccggucauuagauuuggccacgagcaucuuuaucagcggagcuguuucaccaacaugaugcuguuuguuuuuuaaucuauucuuuuccccgggacuuccuuucuggcaggacuuugaauuuucucacgggacagugugaugagagaacccuuuccuugcugccgaggggcaagggggcuuaggcauagcugcuucuuucgaacacugcggugacucgaccugggcuuguggauagaggaggguuucucagucuugucauugagggcaucucaguccaccugucugcaccuggccacaugccacuugacaggccugccucugcugccugccucugcugccugccugggcugccugccugguuugaagugcuggggauugaacccaaggccaugugcaugcuaggcgaacauucuuccuacugagccugucauauguauguaugcuucuguauguggggcuguccuguggcuuguaagccagcccacagcaucccuggucucuaccugcuagaagccaauagcauccuuccuucugcucagccugagcugucuacagucauugcccauauuccucagggagcagggagcaagaguccucagccaagagcccuuggcuucaggcagcacacagggcagagaccuacuuguggcccggguagaaaccacaugguagacugccugcugcuugcuaggucccuucaguguggggaagaagcccagggcugcccaguggcuggcgcugagcccuuuaucgggcugguuuagcgccucggagcuuguccguguuccccugggccuguccugccucugcagugcugcugugcuuuuacuuuucucuuuguaaauuaaggaugucauugucaucgucaucaucauccugugcacuccccccacuccugcuuagugcguggggggcgggguacacgugcgccauggcaugcauguggaggucugaggacacauguugguucccuucuuccuauguggauucuaagggaccaaaccuagguggucagacuuggcagcaagugccuccaccaggcugaucuguauuaucagcccaccucuccuuacuauuuccaaccagggcagcuucaugaagggcgggaggggugccaaaaggugagggugagacacaccaucgaugucuccucccgggcagucucucugcacucagaccagugucugauccacuagcaggguaacugagcaggucccagacugucacuuugcaguugugcaggcaggguguguggguucuugguucagacuagggaaagcuugaguaugagcuuggccccacaguggcuccucuaaagcuuugcugugcucacaagugcaucuaaguguguaaagaccacagguugguguuaucuuucucucuugaugucuaacuuacugcuguuuaaucuuugugaauauauccgugugagagugcacacaugugguggcagaggacaaccuuggcuguuaguccuccuaccuuguuugagacgcagccucuugggguuucguucaucuaauugguccaugagccccaaggggugcuccugcuucaccucccaucucccuguagguacacaagccaucauuccauggggucuggggaucugaacucugguccucacgcugguguagcaccacuuuacccacugagccaucuccagccauccccagggauguucucuuucuaccucccuggugcuaggcuuauaaguagggaagcuugguuuuuaccugacuauugggacgugaacucagguucuugaguuugugcagcaaguacuuuucugacugagccaucuacccugcccuacaaaauuuuuuguugugaugguaggguuuuguuguuuguuuguuuauuuuuugaauaaaugcugaggauugaagcccagggcuuguccaugcuaaguacauccuaugccaccagccucacuaaagcuuuuuaaaugauuguggguguaauggcucagugguuagcugagugguuagguccaggcaguacucucgaggcccuugagugauuuccuucuccaaugucaggugauucacagccaccuguaacccuagcuccaggggccccaacaccuucuucaagacucugggugccugcauucaagggcacaugccaucaucauugcccaccaccuccaaacacauaugaaauucagaaauaaaaugauuagcaagagccaggcgugguagugcaugcuuauaaucccagcacgcaggagucugaggcaaaagcguucucuagaaacuaaaaguaaaguuaccacuuuaggcauuaauuguuuuuuaaugugcauugguguuuuaccugcauguaugucuguaugagggugucggauucccuguaacuggaauuacuggacauuugugagcugccacgugguugcugggaauugaacugggauccucuggaagagcagccagugcuccuaacugccgagcccucucuccagccccacuuuagucauuguuuagguguguaauucucuguguuaauccguguaguguuauucagcugucauggcuauguccacauccuucugggcccagcugaaacucuagaccugggcaguguuugugggcagccccaucagucccaacucuaggucuuugacuuugaccugccccgaccccuggcuacucuguaagaaacauccuacagggguuaucuuucuuggagucuaguccccugucccccucccuccugcugggaacugagcacagguccuuuagacaagcagcaaguacucucgaccacugagccaucucuccagccccaggucccuuuguggcaguuguggaggcugaagccagacagagccuugugcgugcuggcaagugucuggcuguugagggacaucuccagccccuuuaguguuuauuuuguuuuuccuaggggugaggagguggggagcuuaaacuuuuugagggguucgagacaggguuucucuguguauccaacuuuuugggggggggcggauugagacaggguuucucuguguaucccuggcuguccuggcacucacuuuguagaccagguuggcuucgaacucagaaauccgccugccucugccucccgagugcugggauuaaaggcguguaggcgugugcuaccacgcccggcuggagcuuagacuuuagauccuuguguacuaccacaugugguucaugcaaugugaagguaaaacccagggcuuugugcuagcuaggcgagcacucuuccuccuuagugucgucuccagccccuaagggcugccuagucccagcuccccucagggugauuguggagcccuccugaaucuagugcagucauuggggucgggaagggggaguggagugugcagccugagcuagcccaggcucuuguaguuaagacacuuaccucacuguggcuugggaguucuggggugcugagauucugggucaccccauugucugccauggggccuugguuuaguuacugaggagacccucuuuccuagacuccucuaguggacacucucuucuuccuucuagauuccuggcguccugcagcggauggcgacuggagaggcacacugguccagccuccugcccagccugugauaaaaaacccacguauuccccccggacacugccuguccuuccuucucuacucugcccuuccugagagucuccuacccaggacccuagaggaacuugcccuguugcugccacugcugccucauuagc

SEQ ID NO: 2742 - RNA, 949 nt, Mus musculus
guacagaguuggaagugguuccuuuauggaaaaacugaaaauauaauaaaaauuaaaauaaaaccaguuaaaaaagccagccccuggaguuuccaccuccugccucuggcccuccagaggggugaggccauggccccagggcagcaaagggugagggcuuuccugcccuuccucuucccccauuccauccccgacuuuuaucuccacagugggggccccccccuagaggaaccaaaccuggguaugggagcaggaccggaggcccuguagcccagggagggaggcuuggcacauguacccagccccaaagcuccgggccuguagugugggcaugggcagggcugcucccugccugggcccaucugggguuggggagguuaguuccagaucuugaggaaggagucccaggagccuguagccacggccauuccaucaucugugaccccaaggcagcucacacgguuaucauggccagcgaggacaccuggagaacaaagggaaggauguaggaaccggucuggcccacacuucccaucucugccuucugugggcccagaguccucaccugcacggucacccuucauggcaucccagauguugcaguugaagucgucguagccagcgagcagcagccggccgcugcgcgagaaggcaaccgaggugaugccgcagaugauguugucgugggaauacaugagcagcuccugaucagcccgcaggucaaagaggcgacaaguggcgucaucugaucccguggugaaggcauagccauuggggaagaacugcaagauuugggccagagaugauaagagugugaggcaaagccaggggugugggauacagggggcaggcagcucaccauacuccuccugacuuacagccacggcauugauguccgacucgugaccuaugaaugucugucggcacauggaaucccgaacaucccaca

SEQ ID NO: 2743 - RNA, 949 nt, Mus musculus
ugugggauguucgggauuccaugugccgacagacauucauaggucacgagucggacaucaaugccguggcuguaagucaggaggaguauggugagcugccugcccccuguaucccacaccccuggcuuugccucacacucuuaucaucucuggcccaaaucuugcaguucuuccccaauggcuaugccuucaccacgggaucagaugacgccacuugucgccucuuugaccugcgggcugaucaggagcugcucauguauucccacgacaacaucaucugcggcaucaccucgguugccuucucgcgcagcggccggcugcugcucgcuggcuacgacgacuucaacugcaacaucugggaugccaugaagggugaccgugcaggugaggacucugggcccacagaaggcagagaugggaagugugggccagaccgguuccuacauccuucccuuuguucuccagguguccucgcuggccaugauaaccgugugagcugccuuggggucacagaugauggaauggccguggcuacaggcuccugggacuccuuccucaagaucuggaacuaaccuccccaaccccagaugggcccaggcagggagcagcccugcccaugcccacacuacaggcccggagcuuuggggcuggguacaugugccaagccucccucccugggcuacagggccuccgguccugcucccauacccagguuugguuccucuaggggggggcccccacuguggagauaaaagucggggauggaaugggggaagaggaagggcaggaaagcccucacccuuugcugcccuggggccauggccucaccccucuggagggccagaggcaggagguggaaacuccaggggcuggcuuuuuuaacugguuuuauuuuaauuuuuauuauauuuucaguuuuuccauaaaggaaccacuuccaacucuguac

SEQ ID NO: 2744 - RNA, 8298 nt, Mus musculus
uacgauucacuuugauuauguguguguguguuuguccgagcaugugagcuugagccuggagaggccaggguuucgugucucucggagcuggaguuacaggagguugcaagucacccagcguggauguugacaaugaucuccugucccgcugaaagaacagccaauauguuucuuaaaugcugagacaacucuccagcucuguggaugacaaguuugaagccaauuuagaccacauaguugagacccugucaacuauguaaaaaaaaaaaaaaaaaaaaaaaaaagcucuacaaaaaauugaaggcguggaaaguggcucaguugacagagugcuugcuuagcacauaaaagcccucaguuggaucccuagaaccacacagaucuggggcuggcgauguacaccugcaaccccaggaccuguaacguagaggcaggaagaacagauguucgaggucacccugauguacccugucucaaugucugugaacaauagugugcagucgguguguguguguguguguguguguguguguguguguguguguuacucacaugcacucaccuaugccaguuuauuuuagggcuuccucuaucgccauccaccuuaucuuuugagacagagcuucucauuggacuuggagcuugcugcuucagcuacguuggcgauccuuccaguccuuaggaccugucugccucuguugcucagugcugggguuauaggugucauauacugauguauacguguuauaugguauaggcuauauacugccuauuucacuuaaaaaaaaacgaaacaugauuuuaaacauucaaacuuaaguccugaugcuugcacagccagcauuuccacuuguagccaucuuaccagcuccuggagugagugagaugucucuucggcuguggggaguggggagggugacuagaggcaucuguugauuuccaugauguaaauacuccagcagaggcugguuucaaguuccuacaauccacaucgauucacuggauaagcaguuagggagugagguggacaaugggcucucccgagcugguaugagcuggcacaagcugacgccaacacgccacuguucgugaguauccaaaugcggauauucagccugauguuggacaaaugccagcucuucucacugggaagauucaacugggcuuugagagcuagagacuagagagcuaaguggggaaggggcccaagaagauggugcagucuguaaaagugccugacacacaagcauaaggacuggaguuccgaucucuggcacccacagcaagaugccagguaugcuggcacaggugucaggugugcuggcacaggugucagguaugcuggcacaggucuggacucugcacugggaaagggaauugcaagaggagacagcaggugucugaaagucacuagccagacagccuagccaauuaguggacuccagauucauugaaauaacccugucucaacaaauaagguagacaguaguagaggaagacaugagccuuugagcugucgccucugucuccaugcaugugagccuacacccacauguacauacccucacagccacauucauaucugucugucuaucucugucugucugucugucugucugucugucucuauaucuaucuaucuaucuaucuaucuaucuaucuaucuaucuaucucugucugucucugucuauauuugucugucucucuaccucugucugucucugucucucuaucucuguuugucucucugucucuguuuaucucacucugucucuauuucugucugucugccugucccucgugugucucucucucacacacacacacgcacacacacuugacaaaaccaauaaauaaauauuccaauaggcaacacuaauuguacccagugggguacagaaaaacacacgaaaagagaacaaagggagaauguugggggcacgaagaaggggaaggcaggggucagagugaauaugauuaagauacuuuaguguuuaacuaaaaaucaugaauaaaauaaaauuuaaaaguaguguucagcuggcaagaugacucagugggcuuaaggggcucacugacacuucagacaaugcgaauuccaguccugggaccuaccugggagaaggagagagcugauuccugcaaguuguccucugacuuccacaugugcacauggccagcgugugccugcacucacaccuacacaucagaaacacacacagcauaauaauaaacaaaaugaaauaguaacugaagugugugugugugugggggcgcaguguagguaguggaaguaaaagcagaccauuacagaaagagauuuuguaugugugugugugcaugcuuguguguauguguguguaccuguguauauuguguuuguguguguauguauguauguguauaugucuguaugugcauguauauguauauuuguguguguuuguuuguguguguguauauacagauaccauagaauguguaugagaccagaggacaucuugcaagaguugguucucuccuucuaccauguggaugccaggagccaagaggaggcuuggcacuaagugccuuuauccccugagcaaucuugccauccccaaaggaggaagagaucuuaauggagggagucaggggaggaagaggaaaauggaauucaugugaccugaagcagaagggagaauuauuugagggaagaaaaggaacuaacaaaagaggaggagaagagggugggcaagggcagcaggguagggggaugggcugaguggggagugucaggacaacacccaucacuucggauguugacuuuaagaauuaacuuaaaacuuguuaaaggggggaaaaaagcaaauuacuucaagcaugauagcauaugucuguaaucccaauguuccggaggcugacgcaggaagaucaaggaagaucaagaguucaaggccagccugggcuacauagugaaccccuauucaaaugcacacacacacacacacacacacacuuguccagaugugagaccaaugacagaucauagaaacaagccccucccccagggggcugggaagacagcuccaacaggaagcaugaggaccccauuuugaucccuaaaaggcacguggaaaagccaggcauggugguaugcguuuagaaagcucagcacuggagagguggaggcaggaggaugccugcacucacugggcagccagccauacugaaguauugaguuucaggucaaucagauacaaggugagaggccugugagauaagccuuuggguccaaacgcuggcuauggaagggugaagagcugaguuugcaauguaagcacuccuguaaaacaaacaaacaaacaaacaaacaaacaaacaaacacggggaguccacaugugugcaccugaggcuccagcacugugggaggcaaagacgggaagaccucugggguuugguggcugccagccucgcucuagguucagugaaagacccugucucaaaggaauauaaugaaggguaacagagcaggacaccugacaccacucugcccuccaugggggcauaagcaucagggcacacacacacacacacacacacacacgcacacgcacacgcacgcaugcaaagaaaggaauaaaacuaaaguagaugguguccuaaggaacaacauccaaggucuucacaaauuuguacccacauuccugccuaccuguacccacauacacacagacacacagaaaaaagcaacuugggccagaugugcuggcacacaccuucaaucccagcacucagguggcagaacagaucucuaugaguuggagggcagccuggucuacagagcaaguuccaggacugccagggcuacacagagagaccugucucaaccccccugccgacacgucccccaccccaugcucacaaaguagcgcguuuggaggagcuccuccagagagucuucucucaccagcaguugugagcugcuuauauaagcuuggggagggguuuuguggggcguguaaguuucagaagugcccugagccuugcagguuuccuuagcuuccuuggucguaugagccucccuccacccuccugaagggaauguuucuauuuggagggcauagcuauacaguucuacuccaagucuccucucaaccccuugcaaacaguguagaccaggcuccugguggccuguguagcucagccccaagcacacauugcagagaagucuugguucaucugucugcagcacugaacaacuauccuuuugugguccccacugaggacauuucuggauuccagaacuccacauucuccugauuuucugcagcucucuggcuucugcuuuggcaaucuggacacugccugaccucuaaaugcuggaguuccuuagaguuuggucuuuggccauuuugucucuucccugauuuuuuuuaaugacuucaucugcuuaaaugugccacucagucuuggggcucuauuccaagccagaucucugcacugaacccuagaccaccuucugcacaacccaguagacauuuuggcaccucaaaucuaaagcucuuaccuuccuccuugagaugcaguguguucccugcugcaguggagagagagagacagagaaugaauccagccccgugacuguuaaucuugauugucaacuugauaagaguuaggaucaccuaggcaacguguuuuuagguguguccgaaagggucuuucuggaaagacuuaguggaggugggaagacccacuuugagugugggaggcaccauggcuucaccugaggcucuggacuaaauaaaaaaaggagaaagaaagccggccgagcaccaguguuccucucuguuuucugacuguguauaagcaauugugaccaguucacaugccucugcuauugagcucucuccaccaagguagacuguauccccucaaacugcgagccugaaugaacccuuccuuaaguugcuucuguuauaaaaagcaaggcaaucaauccagagcauggacacuuguuguauuuccaugccuggcuucgaucuuucuucucuguaaaccacaggcuccuugcaagguaugcagcuauccuccgggaguaggauaacgucuguacauuacuggggcucagugaauauugcuggaugagcuaaaccagggaaacucguuaacacugaaaccagccugaggaggauguggcucugcagaggcuggcuuuaggcagcuugcucaucuauguggcuuuaaggaagucacuuuggcccucgguacuuugaggaaaccgaaguaaaacuaucuauaagaucuuuuccaaacuguaauguuuaaccuguuaucuauauaagucaugggauucauaagugcacguguaauaaucugugcguaauaaaugucaauuaaagggaaaggugaacgaguggccuugcugguguuguuuugcuuucuguucugugguuuugagacagggugcuguuauggaggucuggcuuuuacaagugugggccaccacaucugaugcuuuggagguuuaaguuggcagaggggggugggggcauccucauuuacucuguggcuauuuuacguguauaaauauuuugcauguaugcacgugugcgcauugcaugacauaccuggugcaucagaagagagcauuugauucccugaacuggaguuacagaagguaaugagacaccaugugaggccuggcaacugaccccugguccucuugaaaagcaguaagugcucuuaacugccaagccagcugcuccugcuuuaauaucugagacaagaucucucacagaacuugagagcucucacaugaacucccugaccagcaaacucucagggcucuuuccauccuggccugcaaguguuggggcuauaguauagguguggcuacugugccuggguuuuuuuuucuuuuacuugguuuucugggaucaaacucaggucuuuauguuugcaugguaagcacuuugcugacuaagccaucucuccaacccugucccccaacacacuuuuugaaacaaggucuccuguggcucaggcuggccucuaguucaauaugugggugaagacaaaugugaacuuucuauucuuuccucucuacgaguauacuucacuacagucuauuuugaauaguguuuuuuuuuuguuuuguuuuguuuuguuuuguuuuguuuuuuucaagacaggguuucucuguauagcccuggcuguccuggaacucacuuuguagaccaggguggccucaaacucagaaauccaccugccucugccucccgagugcugggauuaaaggugugugccaccuugcccggcugaauaguguguuuugaucuccuaaacuccgaggacugucucaaaggccacaggacaacucggacuuuaccaaaacauuuucacaaucuauggggggacgggggacgggacaguucuccaacaauccaggagacucaaggguaaccuucaauauacucauuuaacagauauggaaauccaggcacauucuuauguuguguucccucgguggggugcuccacaguguaguuuucuucaaugguuauuaaaguugagaucgcaucucaacucugcagccugaguccauagucagcaucaugaggauuaauaaacaaaaguauuggugagagauguggcuccauugguggaguguuugccuagcauguaugaagcccuaaguucuacccugcauaaaucaggcacaggguuguguaucuguaauuccagcauuugguagauguaagcaggaggauuaucaguuuagggucauccugggcuacguggugggcuccugaaacucuaucauaaaacaaaaaccuuuaaguaugcaaaucaauaaauauggacuguugcugcggcgguaugaggccuagucuaggaagccuacaaccccucacagugcugcgcuugaagaacugucuggguguaauucccucuaacuugcauuuuaugggauucuaguggucaccaaccacucgcugucuuuuucugccccacuguccugcacugguuuagacuucccuaguuccgccuccgggaagggaguggccucaccagggggcguggccaacccgagaauugggccuucuugccuccagucuggagccgcccaauccggaggggggggggguugaaggaggucgaucacgugaccugggauuuuuuuuuuccccccucccuuaugccuauaccacuucugcugucccuagagaggaugucuugcuccuuuucuggaaauaaacuacgucgugugaucuuugaugaguuagaaaaacguggaauugugcuuuuauuguggcugaggcaucuuuugcuccuggagugguguuuucgcuucuagccuucccccccacacacuugaguauuuggucucguccagccuggcccugggcgcggcggcgacggccgcgucacuggcgggcgggaucccuccgcucuggggagagcugcgcuggacgguugaguuggggugacugaggaaauccauccgcgucgccgccgcugccgccuccgccgcggaggaagacaggaccucccgcgcuccuccaagcgaccccuuggcagagucccaccaccucagguaccuccgcugauaaaaggaguccucaucucccccagccccaaauucccacggguguguguguggcagggggaagccucgguuccuuccgucucccggguuuggcucuugggaaacggacguaacucccagaccuccccucccuuccucuggcccggucguuuccaaacccggaaggggaacugggggggggggggggacccucggcuucaauaaugcaugcgcucccugcaauaucaguggcaauuauuuuaaaaucuagaccccccucaucccagccccgccugccucuugaucccuuaauaguuggggggcuaaauucuggguuucuucuauguccugucccgcccccuuuccccaccaccacccugcugccugccccuggguaacagcccucgugcccacucguuucacacccuugcuugcauuagccuugcagaacuccagaauccuaggagauccaguuaaggccucaaggccacccuugucuucgucuccacccuacugccccuugauucgggcucuggcaguguuuucucagucccgaccccuaagcuggagaucucagcaccuuauucuuuuuacaaauccuuacccaggucuggcaccuagucgccuguccccuucguccagcuuucuuuugggcaaaauggagguccuacgagcugaagggccuggcccacugcacuucgcagcacggccagcccgcgccgucca

SEQ ID NO: 2745 - RNA, 4424 nt, Mus musculus
aaaggaacucucgggaagauggcgcccuuaauuuggucacaaguugaccggaggaaacuuugaccgcgaggugauuaucacaguacaagcggcuguucacaggcgggaucccgagcagagcauaugccgagcucaaggaaagggcacagggacacaauucggugaccuggaggucagggacucucaaagagcagaguccgucaggagaucggagcgggaagacccggaaaaggcguggucagaaacagggcggguuuacugcgccccaaaccggaagacccggauugggaagcgacgaggcgggacggauuuuagccaggugggcguggccacugcggugcgguuugggggcggggccuauaggaaccuggggcccagcuggcaggagaggagguuugggaaccggggcccggggcugcaggauccacaucuagcgggguuccaaggcaguggugacaucaggccucgcucugcucaugaucucccccuguccucuuuucauccaucgcgucacuagcccuaaacucuaagacccucuuguccuccugagcucugcccucggauguccgaccgcccagagccugcaugcgccguggggcgccccaggaccaggagcugguggguccgggggccccugggcgggggucccggggcuccccuccuuccucaggacccguugucccggugcuggucuuucccccggaucuaguauucagggcggaccagagaaguggaccccggcagcugcugacccucuacaaccccacgggaacugcgcuucgcuuccgaggugaagagacgggcgccuuagagcuagggcucuggggguuaguagcaggauaugggaagacugugugggcuggaggaauuaaucaagaggcaagaugccuagcuuugggucugaaaaaaaaaucauguccaucuccgggguugcugacaugaggggccccgguggagcacuauaaguaaaacuugccuaagaucucuucgcguaucuuuaucugacaguucugugcacagcaccugccaaauacacgguauucgaugcagagggauaugugaagccucaguccugcauugacaugugaguggggagguuggggaagcagccaggcaccacagcuaccuguugucuuuucuccugcugacugcagucacucugggaaaaguuucuggggaggagaucuggauuuacaugguugguugccucucacuuccuuuccucccaaugguucagugugauacggcacguggcccccguccccagccacuaugacguccaggacagauuccgcauugagcugucugaggaggggacugagggacgagugguuggaagaaaagacaucaccucuguucuucgagccccagcguacccccuggagcuucagggacauucugagccaacgcccaacccagggccuccuguguggacaggacugaccccagccagacaucuucaggagagugaguugaacagauucuuugugugugugugugugugugugugugugugugugugugguauuguguauauguauugugugaguauaugcauguggguccuuaugcauggacuugagcacaugugcagucucuucucacccuuaguuguuuugagacaggcucucucauugaaccuaauauacauucauuuguagacuggaugggcggugcagaauccagagccuccaccgcccaaacacugggauuauaggcauacacuuccaugcccaguuuuaaguauguucuggagaacugaacucagaucuccaugcuugcauggucagcccuuuuuuugauugagucaucucuccacgggucuugguuuucugcaguacugggcaaaggccuaccagguaccaaguacuguacugcugagcaguaaccccagcccugcacuggggaccucuguagggagagaagacgcagucgcaauacccuagaaagaaacuaaaugggguuugaagaagucucugggcucaggggugugugugugcugugugugugucuguguauguguauggugugugugugugugguauguguguguguggugugcaugugguguguguguguguguggugugugugugugugguaugugugugugugugugguguguguguggugugugucuguguggugugugugugaguguggugugugugcgugugcuguauaugggggugugugugugugugugugugggugugugugugugugugucaugugugugugugugugguguguguguguguguguggugugugugugguguguguguguggugugugugguguguggugugugugugugugugugugugugugugugugguguguguguguguagauaauccugcuugagguuuuuuaucaggugugaggaagaagacuuugcaguuguccugguuucuaacuucuaaucagagagacaaguucuucuccagcuccaacugcagugucucaggugccagcuauguucaguucaaugaaaaaccuguacugagugaucagcucucucucucucucucucuuuuuuaaaaaagaauuuacuuauuuauuuuauauauauaacgagacacaucagaagaggacaucagaccccauuacagaugguugugaaccaccaugugguuucugggaauugaacucaggaccucuggaagaacagucagugcucuuaaccauugagccaucucucuagccccgagcagucagcucugguaugcuugauaugagagauacagaggucccuuccugucagcccaggacacugagaacauaguauagaaggcaagaggaaguggggaccagaggacagagcuucuuguggcuucaggacagaggcaccaaggagaagagaacauucccaggguacccuuagaaggcaauaggauguaaacacaaagacaugguggcacaggccugggguaacaccacauggggguuugcaagcaaggaaggaggguugcagguucgaagccagccucggcuacuuaggaauacuuagaaaaacagcuggaugagaagguugaggagacaguucaguugguaaagaacacggaccggagcucaguccccagcacuggugacacgguagcaauuuguuuguaauuccaguugugaggaugcagagucagacagauccuuggugcuggcuaagcagucggccggucuaacagacaaguccagguuccacugagagacccaguuccucaaacacacguuagauggcaccugaggccucucuacauagcacauguacauguccccacccacccacucauccauguacacacucaggaaagagaaccacagcuggauaugguguugcacaucuguaaucccagcacuugggagggagaggcaggaggaucagaaauucaaaacccaguucuuuuguuuuguuuuuguuuuuguuuugagacaggguuucucugugcaguccuggcuguccuggaacucacucuguagaccagguuggccuugaauucagaaacccgccugccucugccucccgagugcugggauuaaaggcgugcgccaccacuguucggcucaagacccguucuuggauacauaaugaguuuguggccaucuuaggcuacaugcaugugaaucccuguuucuaaauacguaaauaguacacgaaucaaccccaacaacguaguuucaucucucccguccuucccgaucccugagagacuguggcccccagugcucaucucccuccuuuugcagaugccccccagcagcuggccaccagcuccuuccugcucuucuugcuggcaggcgucaucucuguggccuuccugcuccuaccacugcaggaugagcuuggcagccagcugccucaaguccugcacgugucccugggacagaagcugguugcggccuacgucuuaggugagcacaguggaggaguacggggcccucuuccggagaaaggauagggagaggaaggccccuacauggacucucucucucucucucccaccuucaggccuccucaccauggugcuccuccggaccugaacucucagcugaacccaccucacccacccucuccuucgcaggcagggaccuaaggcagccacugugauguuugcaccuugcuccuccucccucgcuuccgcccauccguugcuccuccucccucgcuuccgcccauccguugcuccuccucccucgcuuccgcccauccguugcuccuccucccucgcuuccgcccauccguugcuccuccucccucguuuccgcccauccguugcuccuccucccucgcuuccgcccauccguugcuccuccucccucgcuuccgcccauccguugauugucagccuccccacagcaagcaccugggauuuguacucauuuuccaaguugauuaaaauacauuuuaaaaaucaaaaugagaaac

SEQ ID NO: 2746 - RNA, 19979 nt, Mus musculus
ugauagaggggcccuugaggccccccaagccuagacuggggacauggugugggaaaggcagcggggacgggggccuggggccugggcagccgaggggccuggagagaugagggcaggagcagggaggggccagucaggauggugaggagaagccggagacagaagcugaaaaaauugaccaggcugugcagacaggaggaggggcucagggugagggggguggccaggcaagggaagggcagggaguugacuagcagcaagaaguccagggacagguccaggaauaaggcaggcaagggagggaugaagacccaaguccuggagagaggugggagggcuggauuugcuagcauaggguuggaauuggaugaaccccaaagcaggaggguuuuuuuuuuuguuuguuuguuuuuuuaaaaaacuaguuugaacagcagagaaaaaaaaaggcgugacuccccacugaacccuuguccuuucuccucuggcaggugaagcgcagcugcccuucuuguggccuggaggcugggagugaaaagaaggaaagagggaacccuauuucuguucaguuguuccccccagagcuggugagucuuuaggguuuauggggaggacggugacugcagggcugaggagcacucugugacucccccuccucccuccugcuccuccacagguggaacacauugucuccuuccucccagucaaagacuuggucgcccuaggccagaccugccacuacuuccaugaagugugugaugcugagggcguguggaggcgcaucugucgaaggcucagcccucgaauccgugaccagaguucuggugcccggcccuggaagagagcugccauucuuaacuguacacuucccuucaguaacuuccuccucuuucugccucagcccuuccuuauaggaacuuccuucucuaucgaauuaucugaugaucuuugcacccccucucccccacccccagacccacaaccuuugcaacacacacacaaaaccuuuuuuuuuuuuuuuagauuuauuuuauguauaugaguacacuguagcuguacagaugguugugagccuucaugugguuguugggaauugaauuuaggaccucugcucacuccagucggucccacuagcuccggucaacucugcuugcucagucccugcucgcucuggcccaaagauuuauuuauuauuauaucuaaguacacuguagccgacuucagacucaccagaagagggcacccagucucauaacggggugguugugagccaccgauuugaacucaggaccuucugaagagcagucagugcucuuacccacugagccauuucuccagccccccaccccccacuccgcccugcaaccuuuugucugaaagaaacuuguuagauucaagcaugccccauggaguacuuccuccaagguucucaggccccccccucugacagacagcccacucacagcuucaucaccauguuagccaugacucccugugugcaccaauucuuccauguuuaacccuagagacagcccuauuucccagacguggaguuucuucuucuuuuaaaucagaguuaacuccccccccccgcccccguguguguguguguguguguguguguguguguguguauguguguguauacuggugcaucagcuaguucggucacauguggaagccagagguuggcacuggcucucuuccccucucugacccucccucccuuauguauuuguaaauauuuaccuuuacuuuauguggaugggugcuuggccugcauauauguucgugcaccacaugcacaaagugccaaguaggccagaagagggcaucggaucaucuggaccuggaguuacagaugguucugaacugccaccagggagcugggaaccaaacagggaccucuggaagagcggccagugcucuuaacugcugugccaucucuccagcccugccuucuguuuugaaacagacucuuccacggaaccaggagcuugcugguuuuggcuagacagaauggccagcaagccacagggagccuucugccucuguuuuccccuuccccagccagugcaugcuaggcuucaaagguuccacagcagcuucucugugggugcuggggcucuggacccaggucccccaugcuugcacagcacauaacuacacacuaagcuaucuccccagacuuuugucacuaugacagcugaaaugaaguaauaccuuuuuuucauguuugcauguguucagacacaugugcacauugggaugugcgcguguagacaccaaaguugguaucaggaggcaucuucaagcauccuuccaugcucuauucugugaagcagacucucguagacaaacccaaaacuaggcucccugacuagcuugcucugaggaucccggccagaauugcagacaggccaagaaacccauccaggcuuuccuaucucucucaacgcugguccuuguccuugcaaggcaagaaccuaaccaccaagccaucuccccggccagagacaaaauaauuugcggugguggugguuguccuacuuauuacauaauagcaguaccaacuuccagugucucugaggaacaaaaucaccccagcuugagaacaaugacccaaauacuccacuucagaaaggcccuaccuaaucgccacuucuccucucccccaacccccacacgagaguuuagagaaagcugaccagaaagccauagaugaaagaagauggcuggguugucuuggcuuucccuaucucucuucuuucuguuucuuuucucauuauucuuaugcgucuuugauaucuuucucucuuacaagguuggacuaaagaauugcuuacuaugaagcacaggaugagguggggcagauguaagguauaaauccaaguuuucuguguauaaauucaaguuucccaggaaggagucuggucccuaagucuagggauguaaaaauaaaaucucgauagcaggguaucuggaaaacaaaauccaccucacccaagcuuugacucucaccacuccugucaucucaacccugaaaccaucccuuccuguucuucagauacaaagggccuguauuuccaggcauucggaggacgccgccgaugucucagcaagaguguggcccccaugcuagcccauggcuaccgccgcuucuuacccacaaaggaccacguguucauucuugacuacguggggacccucuucuuccucaaaaaugcucuggucuccuccacccucggccagauccaguggaagcgggccugccgcuacgugguguugugucgaggcgccaaggaugugaguagaggaauucuggucucagaggacucaacucucaccuguccugagucucucccuuaaggagacaucugcccucuuggagggaaccugaaagcaauccauguaucuauuauuuucuuguuauuuguuuguuuguuuguacugagacuugaacucaggaugucacacaugcuaggcaaauauucugccacugagucagaucacuacucuuaagcucucacuacuuaaccuuggacccaagcauuucauucgccaucccaugauccacuugcucuagccucuucccacccagagccuuagguccccagacagcaucaucuugucccacaguuugcguccgacccaagaugugacacgguuuaccggaaguaccucuauguuuuggcuacucgggaacagccggcaguggugggcaccaccgguagccgcgccugugacuguguggaggucuaucugcaguccagugggcagcgggucuucaagaugacauuccaccacuccaugagcuucaagcagaucgugcugguuggccaggagacccagcgggcccuacugcuccucacaggugugacauugugguuugcaaaugucuagccaauucuucaaggccugcugagaaggggagagaaagaaaggggucuuccagagagcauucuaccugcugccggcuccugcucucaaccgcaaaaguucuagaauucgcauagaauuucagauaaauucucaggcugcggauguagcuccaucuccacgaagcacaguauaaaguggauguggggauacgugccuguacucccagcacuggggagguggaggcaggggagucugaguucgcgguucuucuuaagcuacauagagaaguugaggcaaucuauaugagaccuuguuucagaaacaaaacaggaguguggcguagaugguacaauuggguagcaagcaugagaugagcguggauucccagaaccaauguaaaggccagacuugcauugguagucauggugagagucaugauggagacaggagaaucccuaagcccucaggcuagucagcauauauaguggcaggggugagacuguaacacagacagguuaaaagguaaggaccaaccccggaggcuguccgccagcuucugcgcaugcacuguggcaugugugcccaugcuauuacaacgcuuuuuaaguaguuuggaaagcacuauucuaaugaauaucugauuuuaaaaauccaaucuccuccuaaccuccaugugagguacuuuacuuaguguucauguugcgagcugcuggcagccgcaacaacuuagaccccaaauugcacacuuucccagcguccucaguccuagagacugagacccuguggacuuccggaugccaggcgggaaccuuaauagccaggcuucguucuucccaacacucaaauuaagacccagcuaaucacugggucugcucuccauucaucucucaugcugacguaccuccuguuuaauuuucaggguugaagccugggggcugggagcuauucucuuuuuccccuuccccuuucuauucuuucuuucuccuuauuuuauuucuguuguuguugagacagagucucacuaaguaguucaguuugcuagccuagagcuuacuguauagaucauguuguccuugggcucacagaggucugccugugucaucauacuccccccccccaugugugugugugugugugugugugugugugugugugugugugugugugcguguguguuuguauguaugcaggcaugcaccugucauauguacauaggaaaucagaggacaacuuucaggacuuauggucuauucccaccauggguuucagcaguugaacucauuugucacaagugcuuuuacccacguggucaucucauuggcccuccacucuuucccuugucacuuuacucuagggcaggcagcguuucuguugagugucccaugggauguuuaucuggcuauugaugaaucucuucuucuauguaaugguaugccucccuucauaccccucagaggaaggaaagaucuacuccuugguugugaaugagacccagcuggaccagccacgcuccuauacagugcaguuagcccucaggaaggugucucgaugccugccucaccugcgugugaccugcauggcuuccaaccagagcaguacccucuauaucacggguaagaaguaccuccaaggcauggggaaaugguuccauggggaaaguacuuguugugcaagguugaggauaaauucaagcccccagaacacacagagagcaggauccaaaggcagagauggggggccgggucccuguaaacuuguaggaaagccagucuggcauuaaaacagcaagcaacccuaccucaaauaagguugaaggcauauacugacaccugacauuguccuuugacuuugauacgaaugcugugguacaugcaugccauacauauauacacauacaucacacacacauacaucacauuacacauacauacaucacauaacaccauacaucacauaacacacacacaucacauaacacacauacauacaccauauaacauauacacacucguacacacaucacauaucacacacauacaucacauaacacacacauacauacaucacauaacacacacauacaucacauaacacacacacacacacacacagugaaaaauuuaaaaacaacuaucucucucucucuuaagauuccaaccugggcagaucccuccauacaucaaacuccuuagggcagccuaagggagacuauggcuaggcucccagguaucagagcugauguguugauuguaugagacuuccugcaaucauucagcuuuuaccaucacaggugggacuuuaaucccuaggaaacaggugccuaaagcugccgagcugagggcuccugaccccccagaccaggggggaguguauuuugaggugcauacccccgggguguaucgugaucucuuugggacccuucaagccuuugacccccuggaccaccagaugccacuggcucucuccuugccugccaagguaggaugcugguguggaggauggcggggcagcauaggcugcugcagagcagagggugggcuccaggguuggaagauuagauguagguggggcaggaggacucagggagaggaggccagaugggauuggcuagggggcaguucuggagcugaguuuccugggaacagaguggcucacuugcuuuugcugucuuaaccucccuagguccucuucugugcucuuggcuauaaucaucuuggccugguagaugaauuuggccggaucuuuaugcagggaaauaacagauacgggcagcugggaacuggagacaaaauggaccgaggggagcccacacaggugagauuguuuccuggcgacugucauccagucuccuaacccugcacucagugacuuugccauacuuccuagaaaccacuuccucuuccccuaggcaaagcuaagcccaucacuuauaacacccgggugcugcugcaggucuuguccgagaaggucugcucugugcagagcacacuauauaugcagaaggaauugaguggaggagugggcugggggaaccugggugugcugaaguauuaggaaaggugagaugcagcccgagaagauggcucagaauguaaagugcucaucaugugagcccaaagagcuguguucagauccccaguacccauguaaaaagcuggacaugucgguaagcaccuaugauaccagcacugggagagggagaaagaaggcguccaggacucagcagccagccagucuagccaacuggugagcuccagguucagugagagacccugcuucaaaaagauggagggcaagugagaaagacacuacaggcauggcugcacauucccugcacacaugcauagugaugcuagcagaaccugugagucugagaagguucgggugcggagagggaaaggcaucccacauaaugagagcaggguaaagaugaagcuuacacaugagacauaaacgaggaagaaggcuggccagaugggcuagauggaccccagauggacccugugguagagagcacaugucugcuagcauguacaagacccuaauccaaaacccuguugggaagaaugaaguagaggaggaggaagugggagacagcuggggaguguuucagaggacagagauguucuuuauaugcgcaaaucccagcguuucauccccagcaccacauaaaaacaugacaugugguguaaaccucuaaucuucuguuuuguucuucaaaauaggguuucucuauguagcccuggcuguccuggaacucacuuuguagacaggcuggccucagacuuacagagaucugccugccucugccucugccucugccucugccucugccucugccucugccucugccucugccucugccucugccucugccucugccucugccucugccucugccucugccucugccucugccucugccucugccucugccucugccucugccucugccucugccucugccucugccucucugccucugccucucugccucugccucucugccucugccccucugccucugcuccucugccucugccccucugccucugcuccucugccucuccucugccucuccucugccucucugccucugccucccaagugcugggcucaaaggcauguaccacugcagggcccugguucauacuuguaaucuuaguacuagguagaggcagggaaauuggaauucaaugucauuuggcuccauacagaauucaaggccagccucuggaauauaggagucucgacaagagagagaguagcagguagagagaagagaacaaaagacuaguuaggugagagcagagagggugcgcugaaaaccacugggcucugaggcagugucuuagugggcacaaauauggguggaaugauucagaaaggagacauugcagaguuuacagguccuggaauagauggcagucauucagaggugacacaccugccuguaagugcgcagaauccaagaaugcaaaccgcaccaggaugcccauggagggguggcagcacaagagacaagguucuggcagcacacauggaaaggaagagccacaguaggaguugcuuuagggggagaugaacagacacucaaaaaaaaaaaagaaugguuuuaagaaggagacauaaugcaaacucagacuuuuugcagugagaguaaacacugaccuggaaguguccauaugacacguugauuccaggcuguacaacaaaacccaaggcagagggcagaugcaggcagugcccauggcugccacagaggauugagaaggcuauccugagccagggaaagaaggcuugccuagugugcauggacccugaguuucaucccuggaacuaguaaacccaggcccaguggugcgugacuauaagcccagcauguggucuguggagacaggaagagcauaaacugaagaccaucaucagcuacacagugaguucuaggccagccaggcuacaugugagcugucuuagucgcuguucuauugcugugaagaccaaggcaacucuuaggaaagaaagcuuauguacaguuuuggaggguuaguucaugacuggcaugguggugcuggaggucacaccuuuccuuucuuucuuuuuuaugguuacaauagauguuuauuuaaagugugacauagguagaacaaauaauucuuaaauugugauuuggguugaaauaacuuuguaaaaguauggugagaccaggcacacacacagaucuuaacuaaaagaucacuucuuugcccacucuucucucuccuuucuuucccgaauaaccucuuuuagauaggguucaagguagaauuuguccuccucauauuuuguccacugauccuuaggcaagaucugaugccucauagucagguccaggacucucuuaauucgaaacauccugucauuauaaagguccucaggaagccuucuuauggcuucuuuuacaucuucaguuucauguaguguagcaucucacauuaaccccaguugauugaaucccacagcauuauaauaccacuuucgaaaaccauccagccacuugcuugaugcugcaacagcagaucggcccgccauuuugaccuaagagugaggucacaccuuuuaguucuuuauuuguccucaaacagugccacuccccggugacuaagcacucaaauauaugagccuauggggcaggucucacucaaaccaccacaggaccccaucccaaaauaaagagcuauggagaugguuaucagggaaaccauagagaugguuaucaggaaaacaacacuugcuaccaagcaugaugaucugguuaagucucggggacccccccccccgcuccgccaugguggaaggagaaaacugauaugcagguaucccgugggugcuguggcacaugugcaucacacaaaaccaacgaaacuaaaaacuaagcuaacaagaacuaugaaguaauacaacccacuauaaucaccucauuuauuaaaaacacagaauguuuaaucaggccagagggaaggggaaaagauccauuuuuuuuuaagguuuuauuuauuuuaugugugugaguacaucguugcugucucuagacacaccacuagagggcauaggauuccauuacagaugguugugagccaccaugugguugcuaagauuugaacucaggaccuuuggaagagcagucagugcucuuuuuuuuuuuuuuaaagacuuauuuauuauuaaauauaaggacacuguaacugucuuuagacacaccagaagagggugucagaucucauuaccaaugguugugagccaccaugugguugcugggauuugaacucaguaucuucagaagagcagucagugcucuuaaccacugagccaacucuccagccccccaaaagccagccagcauuacacugagcuuagagccagccugguuauguaucaagucugugucucaaaaugaaaagugaaaaaugaguugcgggcgcacuugaguaacagagugcuugucuggcacccaggagacuagauucaaucccaguacugcuuauaaaacuguuuauuuagggaaacaauaaaggcaaucuuagcacagggcuugcuuugcuaguaagaggaucugaauuugauucccagaaaucaugugguggguugguuugcuuguuuguuuguuuguuuguuuguuuuaaaaagccaggcacaauaaugcaugauuacagucccagcuacggggaggcagaggagucuccagguugucucagagucccgggagacuaggccuuagcauaacagcuacaauugccccucugaacaccacacacguauguucaccugugucuguacuauagaacagccauagagaaguuaguaguucguggugggcuuuccaguuggauuuuuggagacaaacgcucacuguguaaccugauuuggacuggaagucacuuuaaucccucugcguccccaugccugauugaccuuuaaauugucccuugcuugguauuuuguauuuuuauucugugugugugugugugugugugugugugugugugugugugugugugugugugugugcaugugcaagaaugcaugugugugugcaaacgugugcagguuccccggcagcuggucuuguccuggggaguugagugcccuguagccucugggagacuuugugugcacaggaauggacagauagcugccagcuuucagggcaggguggacuuucugggacaggaccugcuuuuccuccagcucccaagacugcacucugccccaagccuuccauucagccuuucuccaaccugggauccccacuucccuccaggccucuaguauucccaccuuaaccccccuggccauguugucuguccguucucagguucacuaucugcaacgccccaucgcccugugguguggccucaaccauuccuuggugcugagucagaccucggauuucagcaaggagcugcuggggugcggcuguggggccggaggccgucuuccuggcuggcccaaggggagcgccuccuucgucaagcugcacaucaaggucagagcagggucgggcaagcaggcaggccucagggaggguagaacacuagagccagguggaccacgggacuuaaccucccuucucuccaaagucuuuaaaagaauugugggaagggaguuaugccacaguaugccaguggaggacaggggacaacccguaagauuuaguucuuucacugcuucauauugggcaccaagcauggccccaguugauucucacuguggagcccaggcuggucuuaaccucuagcuuuuccuggcuuuccuguguccccauccccagcagauagcugugaccccuguaagggauccauugguuccaucuccccuguacugcgaagucucccuucuugcaccacacuucucgccgcuuucuccuuagcugaccccauggcucuauccaaguucacauggguccuggaacauagcaagcugaagcucacuugcuggccagggccugucugagaggggucagcacagcaucaggguuaagucggcuuccuggaagcaguguuaagccucccucagcuccacccguucucuccucuaaggucccuuugugugccugcucccucugcuccaccagagagugucucuauaugcuguccagccacgacaucgaacagugcccugucuaucgagaccugccagccagcagggugggggggagcccugaaccuagccagggggcuggagccccccaagacccugggggaacagcccaggccugugaggaguaccucagccagauccacaguugccccacguugcaggaccgaauggagaagaugaaggagauugugggcuggaugcccuugauggcugcccagaaagauuucuucugggaggcacuggacauguugcagagggcugcuggaggggcuggcccagacaccucgacucccgagagcugaaccccucuucuuagccuuuccuccugaaggaagucgagccgugggcuagagcugagaagagauggagugucagagaacacuguguguacaugggugggggguggggguggggcuguggggagcagugcugcguauucgaggggagaggagggaccucuuuuauaaaugugcaggggccugcccuggaggagccccuaaccugacuaucaugagcgagaaauuugauggacaguagaauaaaaggcuaaagccaagccuguuuugaaacccuggggccucauggagggguggccugggauggagggaggccuggcuggugaggggguggggggagacagaaagagcccaagcuguugucuuacugaggaagugccagcacccccagcuaaccuuccccuucucacuccagaagccccacuuugugauguggaggucaggccugggcuugugaaguaacucggacgacagacacaccuuacuucccacuuugaaaccucuguugggucuguugguuuuguuugugacagagccucacuguguggcccaggcugaccucuuuaaucaugcucacgcugacuccauuuccagagagcuaggauuucaggugugccuccaucauaccugcaccaaaccugcaaucugaucgucacuucuaggguaccucaccccuagcccacagucccguggaaucagcaucccguccucuucugucucccaucuuuucccuuacuuuuugcuccguccccucuuugcccagggacagggacacuccacaccccccccccccuuaacccuucuguaccuuaaaauaguuggaagagaaaauaaggagucagaaagccacuuugcuuggccugaucugguccaguguuaaggggagguccuaaguaugugcagaagcuccuggggaagggggugcaggccuguaaucccagcacgugggaagcugaggcagaaagaucgaaagcuccgacuagccagugcgucauggcaagccugucuuaagcaacaagaacuaucuggaagugugcagugggacaguggguagccaagagacuuggggacauccccucuagaugccgagaaagcaacaggugaagaaggguccagccugcaccugaaagucuccagcaaaugccagguccccaggcaaaggacagagggcaguggcauaugacuagauguguucccagcauucucuggucaauuaauauauguccaagaccuagagaggccucugaagggacucaagcacugucccagcugucuccccgucccgccuccccugcugcccgcccaguuggccaguccccacgcccacacacccggggcugcuucaucugguccugauuauccugcugcugcugcugcugcugcugcugcugcugcugaacucagcugcugcuuccagcacuuccccccuacacaaugcugccugcugcccuaaccuccuuucuggggccauuccuuuuggccugggugcugccucuugcccgaggccagacccccaacuacacgagguaggucucauaucuuucagauggcuuccacaggaagcuucagaaugcuugugaguccugggagggcugugccugugggucuugcaagcucuucugcuagcaaaucccuuuuccucuucagauucauauccucccugucugcugcaaggccacacuggucuguaacuuccacuguucccacuccuucacuacuguucuucugcccucugccccuccauggagcuugaacccagaaagccaagaccuugaccuugucuguuagcugacauucaggaacugagauugggggaaggguagcaagcagaaagucagguacugguccuuagccaggagcauggcagcagggcgaaggugggagccccuagcuguguguccacuguugcucuccucaauucucuugcccccucccccucguggccucguggcuugucacaucuggaaguaguuaggcggcuccuguccuugacugccaggcaggacagggaggggggguagaggagguuagggggacugagaaggauucccggaauuccuggcagcguggggguggagccucuaggggauggagagacggggcgguugccuagccccacuuuccgugguccuuggacuggagucuccaguccacaggcuggggcuucuccaacaccaucuucccauauugccguggcuugcccuucucacgaaccaucaaugcagggguucugccugacaccuccucuguccuccagaccuguguuccugugcggaggggacgugaccggggagucagguuacguggcaagugaggguuuccccaaccucuaccccccaaacaagaagugcaucuggacaauuacggugagaaggccccucugguccccauugcucuucaucagucucccaagccaaaccuugacagcccagggacaccguccccaccaccaggcaucaccucugggaaacccucuuuuccucuuugguccaagggcgucaggccccaugguaacaugcucugaaguaccuccaaccuuccuccucuugguccaaucccacuacugggaacugagcccugggacuuuggcauacuaggccagaacucuaccacugagguccaucucuuuuauucauuuagguuuguuuuugugguuuguuuguuuguuugcuugguuuugguuuuucgagacaggguuucucuguguagcccuggcuguccuggaacucacucuguagaccaggcuggccucgaacucagaaauucaacugccucugccucccaagugcugggauuaaaggcgugcgccaccacgcccggcccuggugguuguuuuuaauguguuugucgggcaugaguuugcacacgcaugcaugcauguaugcagaggucagagcagguguuccagaguugugcuuuucuccacccuauuuccuugagacaaagccucucacuaaaucuaaagcuaguaugagagccagcaagccccagugacccuccugucugccucccaguaggguuaggguucaaggcauauguguggagacuucaaugaggccuuuuauguggguucugggggauuugagcuugaauaagcacuuuuacccacugggccaucucccuagaucgcuuccccuuuuauuuuugaaacauggucucuguaaauuaugggucuuggcauuuaugguccuccugccucuguuucccaaauagcugggaucccaggcacacaccaccacuucuggagcugagcccuaaguuuuuggaggcaggaucucacuguguagcuuagguuggccuugaacuuugaggcaauccuaucagcacaacaaacccuggaaucacaggugugagcugccaagccuaguuuaagccuuagauuuuuauggaaaaaaaaaaacgcugagacuccauccuuaauucgcuccuguuuucucccuccagagaccacaaggcaggagcagagcccaggcccuguguguugcauuggccagggguccuuuccaguuauggcuauuucucugccuaggaaguacuugggggagggggcgaugcccacggucaggguuguuuggggccugauuuugcgggacccccauuccccuuuuuucaggugcccgagggccagacugugucccuguccuuccgagucuucgauauggagcuccacccuuccugccgcuacgaugcucuggaggucuuugcuggcucuggcaccucaggccagcgacuuggacgcuucugcggcaccuucaggccugcaccuguagucgcaccuggcaaccaagugacuuuaaggaugacaacugacgagggcaccgggggacgaggcuuccugcucugguacagcggccgggccacuucgggcacuggugaguaucuucgccuccucuuuccccucuccugaccccaccccgguucagguccccaccccugcccuaacuuugauccuccccagauuccucccaagaguuagggccaccacuacucccuuucuucucacuaaccgccccuucagucccuccucccggucuucucucccccucccgcucccaccuaccccucuuccagggccucccccaggugcgaggcggaaaugggucauggacccgcggguggaaugggcggccugggguuacugggacggugaguaacugcccgccccccuccgcaaucgggcuccucugacaggaguaagggggcaccuugaagcugggggacaaggauucccucaccggagcccccuauacccagcucugggaucccgauugcggucccaucacccccucccggcagcacaagucucucuggaaauguuucaggcugagaccucaacagaggggagggcacccucaccacgugagagcucucuagccugcugaagaggauucuucugcucggccgggauggagagaugggaucuccuaggggaagaggcgugguguggcggugggcuggggaggggccaggagggauccauucaucuucuccucucuguuggccaucccagucccauauucccaggcguuugguaacccgcucuuucuacuguuuccccuuguguccccucaucuugagacccagacuuccuagcggccugccagagcucccagucuagagcucucuccuagcugacagagggucucuaccgccccccaccccgucccucucucccuuucucagagcaccaguuuuguggggggcggauggagaaggcgcagggaaccuugaccacgcccaacuggccugagucggauuacccaccaggcaucagcuguuccuggcacaucauugcacccucaaaccagguacugaccuucuugccuaggcugcccacuaggugcccaggcaacauccuuaaaagcacacggacagcaaaaccuuauugaacuucuguguccugaucccugagccuguccugguagagaccaaaaccagacccaucuuacaugcaagcaaaaaugauaaaagugugugaugcuacugggguggaguucuccaaaggaugcucccuguagaguauagggguguguguguguguguguguguguauguguguguguaagacccucagacuaccagugugcaaacauuagagggaacaaggggacucacuauuagugcuacuuccaaguaucccuaaugcugaaaaaggugcaggacacacuauuugguccuccuuggccuguccugcuacguagccuaaugccucuaccaggugaucaugcuaaccuuugggaaguuugauguggagccugacacguacugccgauaugacucugucaguguguuuaacggagcugugagugacgacucaaagaggcuggggaaauuuugcggagacaaggccccuaggugagugauccuuuugaugggcagaguuggggcuaacccugcaucccugugugaaagacuggggggggggggcucagcugaccaggcaagaucugagcucuaggaguccaaacuacuggucagaacaaguagaggacguagcaaagguguaguguaucuucuggagucugcagagcuugugugugugggggggggagauucugaugucagaggacugguuuauuaagcuuggccaguggggacagaacagagugccgagucuaccugacaccucagcaaaugcuccucugcccacugcagccccaucucuucugaagggaacgagcuccugguccaguuuguaucagaucucagugucaccgcagauggcuucucagccuccuacaggacccugccacgggaugccguagagaaggagucagcccugaguccaggggaggacguacagcgugguccccagucccgcucugacccuaagacaggaacugggcccaaagucaaaccacccacuaaaccuaaaucccaaccugcagagacaccagaggcuuccccugcuacccaggcaaccccaguggccccagguaagugugagaagguggaagaagguacugaagagauggcucgguggugaagagcacuggcuacucuuccugaggacccagguuugauucccagcacucacaugacagcucaaaaucaucuguaacuccagacauacaugcaaaacaccauauacauaaaagaaaaagaaaaugaaagaaggggauuggcuaaaggaagcacuauuuauucauccauccauccauccacccacccauucauucauucauucauucauccauccacccauccauucauucaucuauccacucaucaauccauccauccaucuauccacccauucauucauucauucauucauccacucauccauccauccaucuauccauccagcacucacuggugccuguuuccugucaaugucugggacuaguguugggaagcaucgcuggguagaacucuggguuuacauccauacagcuguuguaauuucagaugugauuagggaaagcaggguuugccuagagucucccagugagggcugagggcauaugcucagaaguagagcauuucuaaaauucucccaauaaggggcuggaagcuaagcuaacuguagagugccugcuccagaauccucuagugagguucugaggugugacucaguggcaaggugcuggcuugccuagaaucccccagugagggacaaaggguguggcucagcugcagagccccuggccagcaugcaccagacucgguuuccaugucuagcgcugcaaauaaaggacuagauaggcugacaugaggagaaugggccugccugcuagggaggccacccuccacugacaugaggagaauggcccugcuugcuagggaggccacccuccacagacaugaggagaaugguccugccugcuagggaggccacccuccacugacaugaggagaaugggccugccugauagggaggccacccuccacugacaugaggagaauggcccugcuugcuagggaggccacccuccacagacagcauugucucuuccuagcugcccccagcaucaccugcccaaagcaguacaagcggucaggcaccuugcagagcaacuucuguuccaguagccuagguaagacucucuccugcccuucugacuuccuguacucucaccggagcccaguccuagcaccugacucuucaccucucaccgacaucuugcuacaguggugacaggaacagugaagaccaugguccggggccccggggaaggccucacugucacugucagucuccuuggugucuacaaaaccggaggacuggaccugcccucuccgcccaguggcaccucucugaaguuguaugugcccugcaggcagaugccccccaugaagaaagguaaggcacacgggaaaugggaguggguguugagcacacugaagguguggagcuguuaaagucugaccaagaagaugcuuugacaaggucuugauaacuugagcucuccccuccuccuccuccuccuccuccuccucaggagccaguuaucugcugaugggucagguggaagaaaacagaggccccauccuuccuccagagagcuucgugguucucuacagguccaaccaggaccagauccucaauaaccuaagcaagaggaagugucccucccaaccuaggacagcugccugauguccuagccagauacagccucagagcucauccaaauaaauguuucuugacucaggaaggga

SEQ ID NO: 2747 - RNA, 2256 nt, Mus musculus
uugucuuuuuuuuuuuuuucuuucuaaaacauuuuauugaauaauaacaaauccacaagcagugguuucacugguagucaucugucagauagcuccgcuuuccuuaaugacccuggccaaggcaaacaggccauuccaacauaauuacuaacucuuagcugauacauuaaacauaaguuuauaacuuacuaacaacauaagucauauguaacauaucucuaucuaccucuaucccuauaucuauauauuacaggcuagcuaccaagaguuaagguggcaaacacuugacaagccagaguugggagacagcugggaagucauaggagucuguagggugagauaacaaaggacccugagcccucuggacaggcacugaagucaugauuggauuugacugcagggucaugguugagcuguagaguugaguuccacugcagagccuaaaaggcaagacuggguccagaugaauggaugagcaauugcacuggauggcagcgcaagauggaucaauaagaggaugguagauggcaacuugaguaaucuguggcaaaguggggaccaggcugaaucgaaggcauugggacuucaggaauucuucacccauuagacccucgaugcaccugugugguucuucgugcugugcugggccucuuucuaccacuuguuuuugaugccucuuugcugaucucuugugaauuggaugucugggcacaccucauccuugcucuuagugucuuggucaccuccuucacguucguagaugagucaucuuuccacaaaguccuccugcucaccgccuugagcuucucuugaacucccuguccaggugaagccacuccugcugagacgaccaucaucucaucuugacggggcuuuuuuuuuuuuuucccugccgucuucuuuuggaauuugaccaguucggacguuuuuuuucuucuugcuuucuuguuugcaggugugcaggguacuuccugggucauugccaggucauuugcugcuggagagucaucuuuuaccacugacucggguccugagggacuguggggcaucucucgagagucuuccuuaucuuuucucuggugaucucuggaggacacuggagugguuuuuccuuccugaaugcagccagggagaggcacagcucggggagaaggacugggcugcucauccaggaccucaaugauuggcugugcgguugcucuggggucacagacucuuggugcugaggacagaugacuuggcagcuguagucuccccucccccagccugaaaccugcuugcucaggguggagcuuccugcucauucguucugccacgcccacugcuggaaccugaggagccacacacgugcaccuuucuacuggacccgagauuauucggcgggaaucggguccccucccccuuccuucauaacuagugucccaacaauaaaauuugagcuuugaucagaaugaauuugucuuagcuccguuucuucuuucgccccgucuagauuccucucuuacagcucgaguagccuucucagucgaaccguucauguugcgagcugcuggcggcugcaacaggcagcgauaucuggggucggggugguggcagcagugucugaagggagcacccuucugcuggguuggccaggucuucaagcagggucagugggggucuguuuuucucuucguagguauaaccaacguuucugaagcuucugaaaauugccaccaggcugggguauucccggagguugaccuugcugaacaacgucagcagcacugacggguggaaagucugcuccagacuggugagaauauugugcaccacuuuggacagagggaccagauuuugauaggcuuccagagauuccuuguacauucucucagugaugaaggauuugucccggagcgcuucgaagaaggggaauggcuuguugauggcauaggcgauguucaccuucauguauaugaaaugcuggagaagagccuuuuccaaggcuuuggucagagugaacauccuggaugcugggagcugccacggguucuccugaguucucccaggucacugccuggauuaguuaagggguuccuggauccuuccuggaaaagccugacagcccagucuggaccagaaguuaugcugccuuggaagucccgcggggagucaggagcagcccaauucccaacaauuguucagucgcagcugugaauggaaguccaaggaucuagcaguuacucagucucacgcagcaagcaggcgaaggagcaa

SEQ ID NO: 2748 - RNA, 1264 nt, Mus musculus
auuuagggggggaaacauuuuauucuauuauaaaaaaaaaaaaaacuaacaaaauuacagacuagcauuccagaguuaugagggcuacgcuucccagcgccucagcauccgaugcaugagaaagguaucuucugaagggcggggccgggcuugaagccuuagugggggcagcccauccacugucaagugcggagauucggaccacagagaaucuggguugcacagcauggucaugucugggcccggcccgagcaccuccuaugggaaggugaagcagguuacacucgagguggaggaagagagcccaggggguagagggauguccaggucccugcaucccuuccuucaccuucaggggcggggcucggggcugcgguggcagcaucgccagcuucucccucagcgccgcguucaguaccugcuccucgggcaccugcagacucaccaggucucgguagagucgcuuagagcgcggcacguucaacccugcgagcgcagggaaggcgggacugaggaucgcccuucacccagaccaccgcgcccggccggccgccugccccccucacccuccgccacggucuccuccagggcacagcggguccggaacgacuuucucagcugcuccucuaccgccuuggaggcaucaaacuggccgcuggcgacagcggcgcgcgcguucugcagcuccagacucaaagccaggcugcucugcagggccggugccuccagcucaugaucgucgcccggugcaccggccaccagcagcggcucggaccgcaccggggagggcggcgccaguugaaaacgaaccugggaguggagggcggaaccgugagcugcagaucccggggcgcucggcgggcggggggccgggccuucacgccgcucaccugccgcccccuccggcuaccgccccgccgccccuuccgcugacccgggcugcucuuccgcgccuucggacuuucgggcagcgggcucgggcuaaggcucaaguccaagcccggcucgggcucuggggcucgggguuccggggcucgcggcuccggggguggccccgggaccuccagggccucuucgccuucaauggacucuaacgcagacgccccgaagcccaucaucuuguucuaaaggcucgggguuucaggacgcggggucuccucuuuucucccacccuccggggcuaccacuaccggaaaccguuagcccuuacccaccggaguaagacacgcccgccgcgccacuccauuggcgcuccuggacguca

SEQ ID NO: 2749 - RNA, 1477 nt, Mus musculus
uaugucgauccugaugccucuggauucuccuucucugcuguucuccaacaucagguguagcugcguagguuuauugcuacauccuuuccugugcuccuaucauugugaggaaaauggguugaaccagagaucagcgcccuaagcaaaauaaaucagauucagaaacauugcaaaugguuucuuucuaguuuuuuuacuuuauuuucaguuauacugggagugaaugaauugcacacccauauauagguacgugcagaagacagaagaauacauuagguccucuagaacuggacaugagccucucaauauggauguugggcaccaaacuccaguaagaguagaaagugcucuuaaccauuuagucaucucuccaggccccacauagaaaaaauaguuauaaaggaauaaagaugggaccaacaggagaguaacaaguuugaguaaugagaggaaauaugaugaaaggaucauguaaaauuucaugccaaacucccuuauauuuuuauacaaaguguauacacuauuuuuuuuaaagccaaguguacuggcugguuuugugugucaacuugacacagcuggaguuaucacagagaaaggagcuucaguugaggaaaugccuccaugagauccaacuguaaggcauuuucucaauuagugaucaagggggaaaggccccuugugggugggaccaucucuggguugguaguuuugguucuguaagagagcaggagaacgauggcggacgcggagacaaaacgcuguugcgacgaaagagguucuggcugaggcagcagccauucuagaaccuguaggcuugcaggaagaagcagagcugccugccaagaucauggaggaguucaugaggaagucgcggaagaaagacaaacugcuuuguagccagcuucaaguagugaacuucuuacagacuucucugccucaggaggauacugaccagaauccagaugcuuuggcuucugaagaugcaagucggcaaaaggcaacugaaacuaaggagcaguaaaaggacaugaaggccacauacauggaucacguggaugucauaaaaugggcccuguuggaggccuuaccccagguuaaagaggcucacaggaauuacaaagagcuucagaaggcuuuugagcaacucgaggcuaagaagcgaguccuugaggagaaacuucagcuggcucagaagcagugggcgcugcaacagaagcguuugcagaaucugacaaagacgucugcagaggucaagaggcgccgcgggaagagggcucuggagaagcuugacggaccccaccaggaacuggaaaccuugaagcagcaagcgggacaggaacaggggaagcugcagaggaaccagagcuaccuccagcugcuguguucccugcagaauaagcuggucaucucugagggcaaggcugaggacaaaaugucaaagggcgagcccuuacagccaaauccaaaucuccuuaaa

SEQ ID NO: 2750 - RNA, 1477 nt, Mus musculus
uuuaaggagauuuggauuuggcuguaagggcucgcccuuugacauuuuguccucagccuugcccucagagaugaccagcuuauucugcagggaacacagcagcuggagguagcucugguuccucugcagcuuccccuguuccugucccgcuugcugcuucaagguuuccaguuccuggugggguccgucaagcuucuccagagcccucuucccgcggcgccucuugaccucugcagacgucuuugucagauucugcaaacgcuucuguugcagcgcccacugcuucugagccagcugaaguuucuccucaaggacucgcuucuuagccucgaguugcucaaaagccuucugaagcucuuuguaauuccugugagccucuuuaaccugggguaaggccuccaacagggcccauuuuaugacauccacgugauccauguauguggccuucauguccuuuuacugcuccuuaguuucaguugccuuuugccgacuugcaucuucagaagccaaagcaucuggauucuggucaguauccuccugaggcagagaagucuguaagaaguucacuacuugaagcuggcuacaaagcaguuugucuuucuuccgcgacuuccucaugaacuccuccaugaucuuggcaggcagcucugcuucuuccugcaagccuacagguucuagaauggcugcugccucagccagaaccucuuucgucgcaacagcguuuugucuccgcguccgccaucguucuccugcucucuuacagaaccaaaacuaccaacccagagauggucccacccacaaggggccuuucccccuugaucacuaauugagaaaaugccuuacaguuggaucucauggaggcauuuccucaacugaagcuccuuucucugugauaacuccagcugugucaaguugacacacaaaaccagccaguacacuuggcuuuaaaaaaaauaguguauacacuuuguauaaaaauauaagggaguuuggcaugaaauuuuacaugauccuuucaucauauuuccucucauuacucaaacuuguuacucuccuguuggucccaucuuuauuccuuuauaacuauuuuuucuauguggggccuggagagaugacuaaaugguuaagagcacuuucuacucuuacuggaguuuggugcccaacauccauauugagaggcucauguccaguucuagaggaccuaauguauucuucugucuucugcacguaccuauauaugggugugcaauucauucacucccaguauaacugaaaauaaaguaaaaaaacuagaaagaaaccauuugcaauguuucugaaucugauuuauuuugcuuagggcgcugaucucugguucaacccauuuuccucacaaugauaggagcacaggaaaggauguagcaauaaaccuacgcagcuacaccugauguuggagaacagcagagaaggagaauccagaggcaucaggaucgacaua

SEQ ID NO: 2751 - RNA, 1495 nt, Mus musculus
guuuucuuuuuuguuacaaguaauugucuuaaucacuguucuauugcuguaaagagacaccaugaccaaggcaacucuuccccuccccccaccuuuuuuuuuuuguuugugcgacaggguuuguuuguguagcuuuggcugugauggaacucacuuuguaguccaggcuggccuugaacucaugaggucugcccgccucgauuaaaggcugugauuaaaggcgugggccacaagcccucccaauagcaguugcuaaguuguguaaagagguugucuugaaacugaagaagcugaacaauucaagaguaauuacuacuggggagauggcucaggggaugaaguguuaggaccugaguuuagauccucaguacaucguuuuaaaagcuaggcaugcuggguaugguacacaccuuuaaucucagcauucaggaaggagaggaaggcggaucuccuagaagucugccuagacgaauagcaaguucccaccagcuggccaacauuguaagacccuaucucaacaaacaagugaucaagucucuauagauuauaugcaacaugaaaaauuuuauauccugaauaaauugucuuccccauucccuuuuacagccuuuccuccuuuugaucgcaauuuucucuguguuuaguauugacaguguauccacuugagaccuggaaacuaauagcccuccuugggagguaaaggcaagaggaucaaaguucaaagccaucuucagauacacacuacagaacucauggccaggcugguuuacaugagaaccgcuagcagcagcacaacacgcagagcacccugagcuacuaaguacuggcagcugccccgcccauuagcagcaccaaguauacacugagcaugcaccgcuccccgacggaagccgagaaggaaaggggcgggccguggcuggcgggcgcggggaaaauggcggcggcagcugcggcgggggcgaaugggagcggaggcagcagcggcauggaaguggaugcagcagguaacggggugcgcagaccgacuucuggaguugcccuugagaaguggucuugaguacuucuuaaaccugucccaggauaacuugagggcagcgauggacggccgggcucugcugguccccugcuuccaugucuaggggaaaaugugugggcccgagcucucagccgcuauguuuuccuuucaccuuuaacaguccccagcgugauggccuccggagugacugggaguguuuccgucgcucuucauccccuugucauccuuaacaucucagaccauuggauccgcaugcgcucccaggaggggcggccuaugcagggugaguguuguguguaaaucucaaaaucucuuggagauuuccuccagucacuccccugcgcccuuucuuccaaauuauuguuuccccagucguugauucacgccgacucgggaaagguuuuccgagacgccuguuccucaccuaguuuccuugcgcuucuguuucucuccccuuag

SEQ ID NO: 2752 - RNA, 6709 nt, Mus musculus
cguugaaagauugccagauccuggcggguuggacacccuguuucccgcgguucgaaauuaaugcucgcgagugugugugugggaggaguguuucuuaaagcgccagccuccgugcggccuuuuguuccgcguccacaaggcgggguggguucaacuuucaccguguucucgucuauccuccagaaccgccaugauuucccaguucuucauucugucuuccaagggggauccgcucaucuauaaagacuguauccuuugacccgggagacgggguaggguagcuggguagaaaucgaauccagaucagucugugucgccuguuccuuaacuaucuuuccaccuggcuaguccgcggggacagugguggucgugauguggcagagcucuucuaccggaagcugacgggacugccuggaggcgaguccccgguugucaugguaacuacugugguuggugugcagggccuuagaacuguggaggugggugagugccuccucccugucaagggcagcuugguaggaagcuugggggcggggguguguguguggggaggauuuguuuauaaauguuuugaguacuaacaagaagccaguuacagagccaugcacccuauuuuuugacuaucaacaacuuugagagguagauacuaccuuuccacguuaggcggccaggucuuagaucuggggcaucgcccaucacuaguagaccucagggugccaucuugcagguuuccuuacuacaauucuggucuuuucuuaauggccucuguccucaacucugccucaguaucacggugaucgucauuuuauucacaucagacacagugggcucuauuugguggccacaaccuuagaaaacgucucuccuuucagccuucuggagcugcuuucccggugaguagaguugggacaggcacuuaagaaggagggcgugugagguuuauucacacauaauuugcuguguuuccuuaggcuagccacucucuugggugacuacuguggcucacucaaugagggaaccaucucacgcaauguggcgcuugucuacgaacuccuggaugaagugcugguaaagcccaaaaacuuuggucuuuuuaaguuuauuuauucacguguguguguguguguguguguguauuugcccacaucacugcacauguguggagaucagguaucuucuacuuguuguagaaucugcuaaauccaauauagauccaccauaacucaagcacuaggucaaugcagaugacaaaaagguauuguaaucaagccaguacugaucagucagggcuguagaacagacuccugaacuugccuagcaguuaaaggcugacaccacaaaguggaggggaguggggugagcuguagcacuguccaaucauauuuugacauaagggguugagcaagggaacuuugaccaaucagauuaggaguaguuuucugggcuugagaacacgagcuuaguugaucuugccagcaagauggagaaguuguccuugaggugucugaacucaaacagcuguucucuuaccagcugucccuaagauggcgggacucagacaacuguacaaguuguuccuaagaugucuggacucagcugggcagugguggcacacgcuuuuaaucccagcacucgggaggcagaggcagguggauuucugaguuugaggccagccuggucuacaaagugaguuccaggacagccagggcuacacggagaaacccuugucuuggggaaaaaaaaaaaaagaugucuggacucaggcaacuauuuacaacagaagccguucagcuauugggaaguccucagcucccccagagccugggaucuugaauuuagcuucuccuuaugauuaaauggagucuaaaaaugaaaugauuuuauuuaaaauaaguuucuuuugcguguucccaaccaacauacugucuaggucccugggauugaacuaagguuggcuugcuugauagcaagcaccagcagagcuaucucacaggaugucugucugucucccuggcuccguuucuccaccuguguguccuucucuuuccuguuggacaauaucggguauugguccugaccuucuaccuuguucaagacagaguccuuugcuggucaugguggugcgugccuuuaauauaccagcauccagaggcagauggaucaguuugauuuuugaggcauucccagucgacauagugaguuggaggccagccaggguuacaugagaccuugucucaaaauaaaaauagaagccagccauaguggugcacccaggaugcugaggcaggugaaugaaucucuugaguucaaggccagccugaucuacagaaugaguuaggacagccagggcuacacagagaaauccugucuugaaaauaaaaauaaaaauaacaaagaaaaaaaaagagaagugaaaggcaagcucccuuuguuccccagugcacguacacuaagcuaacgagccugcaagcuuccugggauucuccugucucuauuucucgucucugaaugggagcacugggauuauagaugcucauuaucauguccaccuucuuauuuacuuacauuucagggacugagcucagguccacacacuugcucagcaagccuuuuacccacugaaccagcuccccagcuccaaggacuucaauuucauucucuuauuccgugcuaccaugaagaaauguccucauggagugugugguugggagguugcggccacaccauuucaacucuuucuguccauuaggauuauggcuaugugcagacuacauccacagaaaugcugaggaacuucauccaaacugaagcuguggucagcaagcccuucagccucuuugaccucagcaguguuggauuggucaguagcugggaaagaagaggggcaggaggguuggcugugagcaucaaagcugaagguuuguugcuuuggacgcuuugcaguucggggcagagacacagcagaauaaaguggccccaagcagcgcagccagccgcccuguccuguccagucguucugaccagguaagggaaggauccgugaggccagacuugaugaggguuuuuuguuguuguuguuguccuaggacucgauuaucuuucuauucccuuugauguguauuucuuccuuuaccccuggccucccaucccaggacucugcuucaacucuccugucccuucugcugccucuuuuauuuuaggcaugaguguaugugcagagcaugcuuuuguguggaggcuaaaggaccaggccuuugcugucauucucaggaacgccauccgccuccuuugaaacuagcuugaagcucauugacuaggcggguuggcugauccaaugagccucaggucugcguauccucaccucucugguguaggcuauagguuaccuauaguaccuuggcauucacauggauuuugaggaucagacucagaucgucauauuuaugugacaagcacuuuuuuugacugagccaucucugcaguuccuguucuuuugguuuuuuugagauaggcuuuccuuugguccuccaacccaggcucuuaccuuguaaccuaggcuggucuugaacucguggcaguccuccugccucagcuucccaagugcugaguuuauaggcauguaucaccaugccugacauugccuguccauuugaagacaggguuccaggcuggguguucgugcuuuucauccuaggacuugggaggcagaggcagagaggcagaggcagguagaucucuugugagugugaggccagccuggucuacaaagcaaguccaggacagucagggcucuuuacacagagaaacauggucgaaacccugucuugaaaacaaacaaacaaacaaacaacaaacaacccagaaaacaaaacagauuuucagcuccauaacucagauccuuucuuuccuagagccaaaagaaugagguguuuuuggaugugguggagagacugucuguacugauugcaucuaauguaagucugggcucccacuccuggacgugaagggcagugguaccugggggaggcugagcuugacuuucugccucuagggcucguuguugaagguggacguccaaggagagauacggcucaagagcuuccuucccagcgguucuggugagaaccaaugguuagguguggcgcaggcuuccuugugaugugcauggugguauuugcuaucccuuuucucauguccuuccucccacagagauaugcauuggcuugacagaagaauuuuguguuggaaagucagaacugagagguaaggcgagcgugaauuucucccuccagaauaauauggagagaaguuggaaaugucucuuuucugaaauaugggucaagagaaccgucuccucucucucucucauauauguguauauauauauauauauacauauauacauauauacauauauacauauauauguguguguguguguguguguguguguguaugguuguuugcuuguuuuuuucaagacaggguuucuuuguguuuguguagcccuggcuggccuugaacucagaaauccgccugccucuaccacccaagugcugggauuaaaggcgugcaccacuacugcccagcauugucuccuucucuuggcagguuaugggccagggauucgaguugaugaggugucauuccauaguucugucaaucuagaugaguuugagucucaucggauccuccgccugcagccaccucagggcgaggucagguuuagggcuuauuccuggugcauuccaucuaccaaggggagggaggcaggaccgguguaagaccaagcugaccugucccucucuggccucagcugacugugaugagauaccagcucucugaugaccuccccucaccacuccccuuccggcucuuucccucugugcagugggaccaaggcucaggccggugagacuauuuccuguguuuuagaacuacuccaugccaucccgaggcuuacauguaccagggcuuacuauggaaggguggugguagagaugauacgauguagucuuggcuaguguuguugggauggaucucaguccuuuccuucuugggguacaaucuacccagucucuucccauggaggcccuggguuagcagugaugggaugccaggaggauaugauuuaauuguaugccacccuuuccaggcuccagguuuaccugaaguuacggugugaccugcccccaaagagguaaggguuggggcuggucaaauugcgcgugguggcacauaccuauuucucagcccuugggagauagaagggucaggcgaucacgagaccaaccucgaauacauagagaguuuggaggccagguugggcuucauaaagcccugucucagaaaacaaaacacacaaaaaaagugggaguuagucaagcccaguucagcugcacgggacagaaaauaggcccaaggaccugcuaacucauccuccagauggguccacuaaagcuuuguaguguguaguauguaccuguuaucccagcagaugggacacugaaacagaagguucaccuuuugugaagugagacccccaucucaaaaccaccagucauuugcauccaucaacuuuaaauuccaguugagucagagguugugguguuugggaaaggguuggaugugggaaugcaucugcugaacucucuuaugaaggacuagagaagagacuggagguauggaucagugugcaguguuugcuuagcauacacagagcccugccuuugauccgcagcaccacaaacagugugguggugcacaccuguaauucuagcacuggaggaagcugaggcaggagaaucagaaguuuaaagucauccucagcuguuuacugucucaagagcagugcaaacaaaaagguccaggguaaguaagacacugccauccuggagcugacccuuccuuuccucuuuacagccaagcucucaacauucaucugcaccuuccccugccccgaggggucaucaggucagcaugcucgcugggaagacucccugggcagagccucugcucuaccaaggaaguggccacuuaguucagcaucuucccuaucuaccguccagccugucucaggaacugagcaguccagaucagaaggcagagcugggagaaggagcccuucacugggaucugccccggguacaaggaggcucucaacucuccggccuuuuccagguaugccuuguugauccuacacaccuccuguacagcccaguccugcugccgaguagcugucuagccucacaucuucccugacucuuuuacuuacagauggaugucccuggcuugcagggacuucccaaccauggaccuucucccuuggggcuggguccugccagccucuccuuugaacucccucggcacacaugcuccggucuccagguucgauuccucagacuguccuuuagugccugugguaaugccaauccucacaaguggguucgacaucuaagccacagcaacgccuacguaauucggauuugaagcuccccaagcaaggauauggacagcaaugugagcaggcaguugaacaggaagaggacauuuucuuuguggcuuuggaccuggacaggaaggucccacggaccuuaugugaugcgggaggcucacaaacuuacaaauccaacuuuuauucugaggaacuuacuguacaauaucuaaaaagaaagucacuggggaaaaccuuuccuccuuccucccucac

SEQ ID NO: 2753 - RNA, 9180 nt, Mus musculus
acagauggaugucccuggcuugcagggacuucccaaccauggaccuucucccuuggggcuggguccugccagccucuccuuugaacucccucggcacacaugcuccggucuccagguucgauuccucagacuguccuuuagugccugugguaaugccaauccucacaaguggguucgacaucuaagccacagcaacgccuacguaauucggauuugaagcuccccaagcaaggauauggacagcaaugugagcaggcaguugaacaggaagaggacauuuucuuuguggcuuuggaccuggacaggaaggucccacggaccuuaugugaugcgggaggcucacaaacuuacaaauccaacuuuuauucugaggaacuuacuguacaauaucuaaaaagaaagucacuggggaaaaccuuuccuccuuccucccucacagguuguuugaguguguaggaaucugcacaagagaggaggucagcacaugugacacaucacagagcaggcuggggagagccagguccaguaggcugcgagccauuagccuuuggagucccuggagcuggaggggggcuguccccagcuuccugcuuccccccacagaggguacuucccccaaguggggauggugaagaagaugaaggggggacuggagaaggaugagaaggagggccuccuuugccuuccccuguugggggaagagagaccacaauguauuucugaacacugccagaaccagcaggggcugugcuugggggugcagugguagcaguggagaccagcuugacgaugggcugcacgcugggaaccgugguggugacaggagagguaguaguagagccugagccaggagcugaggugcugagggacagaaccugagcgagaaaggagggucuagggucauguuguccuugcuucccccagaauccuuuuccagguaucuacuguugacacaugcccuccacucccaccuucccuuguaguccccagugaauggauggucaagacugcugcuagcuugaggccucuaagauacugagaaguagcucuuaugcuguccgaguuugagcaugaagggauuagguuacagcuuggagguuuccccaggggcaucacaccccucacccuggcuccacauaccugcuggguugaugaggcacuggaagaugaggacauuacaauaaacuugguuggaggaggagaaggcugaggaggagcagcagcucucgcagacaccagugucugaacaggcaaggcaauggagccagggaccuucaauaagccaggcgugcgagggccuggcugaggggccugugaaagggucagugugggccgaggcuaugaagagaacagacacaggaagaaaauguuaacauugaaggcagaccugagccacuccagguagcuagcucuucauugggcgugggagagguccagcucccugagacugcuggcuaugacaaacgcuaucccaaaccuggguacauuuccucccucagcagcugaccugugugauggugagugugguccuguugaccugcugagcuuguagagcagccugggcccuggccuucaccacaugggaacagagaaggggcccaagggacccaaauucuccccgguaggcauccugauugucagguggagggcgcagcuuggccaguacuggggcacaguguuucuguagagaaggcagaguaagggcugguauccucccacaaagaugagaggagcccauccaguguuacuguuagaagucacagugaaaagcaauggccucuggacacagcacuugagcugaagcaggaaggaguucuaggcuagccugagcagguggcguaucucaaaguuuuuuuuuuuuuuuuuuuuuuuuuuaaaaagggccaaggagaauauagcgucauugguagaaugcuuugcaaacaaguauauggccccaaguucaauucccagcagcauaacaacaaaaagaauggggguggggacuggaggguaacucagguuuagaacacucccucagggugguuauucacagacaucugggacucuaguuccagguuuguuaccuuccucuggcuuccgugggcaccucuacccaugguguacauucauaaacauaaaaaagucuuaaaaauaaaaaggaaugauuucaguggguaugguggugcauuccuauaaucucagcacacagaagacagguaaaaggauugccacaaggcuaguguugucuaccuuacaaguucaggcuagccaaacuauccagcaagaucacaucuauaggagucaacaaacucccccccaaagaaaaaaaagacuguuuccuuccauaaggaucaacugacaugaacaggguuugcugaugacauauuugguguucaugagccuugggcagaguaagccauagagugaggcaaacaggaugaaggcagugugguccagaaguuauugacuaucaaggcuuucugcuugugccuugcuuuccauguacacaacagugcuagccucuugaguaaaagaguaagaugugccucgugcuugcuaaaacacuguagccaugcuuguggcaacugaggguggggcuggugggaagaaggggcggguacggugggguucaucaccaggagaaggcucugcacauggucugcuccaauacggucgauguugcucagcacaggcccauccaagacacugcggauccguuccccuuccugcugcagccuuggcagaauuagcgucuuaaucaccuggugggaaggaaggggagaaucccaggcuaaaaggucaccagaggcuccuccuacaccaaauguaacugccccucccccagcucuuccuggagacuaacaucaugucccagcucugcuaggccugcaauggagccauaucgaguuguccauggagucuucucgucgacccagcucuguagagaaaaagaaaaccccagaugaaaaggguuagaaaggcuaaccuggcacauaguagguagagacaggaagauuugaauuauuauuuuuuuuuuuugaagauuagaauuuuaaaaccauccucaaaccaggcaugguggcgcccaccuuuaaucccagcacucgggaggcagaggcaggcggauuucugaguuugagaccagccuggucuacaaagugaguccaggacagccagggcuacacacagaaaaauccuguuucaaaaaccaaaaaaagccauccuugcuuacacuguaaguuuaaggccugccuggaguacaugguauacuguuucaaaaaagcgauggcugccacaaagugguggcacaugccuuuuaaucccagaacucacaggaggguggaucucugaguucaaggccaagccuggcuacagagcaaguuccagggcaguuagggcuacacagagaaacucugucucaaaaaaacaaaacuggaaaaaggaaaaaaaaaaaaagaaagacuaacugcgaaggauugacaucaccuauaaacacaaaacauuaggacacaaagguucaagucccuugggcccaaucuccauggcuccauguucccacuaucauuuccacugccaaaugggugaagcucucucucucacagguagcccuaaaggggugguuugcaucauuugauaacauuuuuggggcuuaccuugguaaaggucuuagugauucgggauuggauguuguuggugguugugcugaaaugcuuacagauuugggccacuagacgggcagcaaaaucccggagugcccagugauuguccacaucuggccgcaagcacagcugucuacucacaaugcaggucauuacugcuggaaugagcucaugcaccugagagagaccaggcccugucagugagucugauaccagaccuccuguggugagguugccagaagggccccugacccugcaaaagacagcagguaggcgagaccacucacauauuucucuagauacagugugggguuguccaucagggccuucaccauacgcaucagguagauaagcaaggccagguuauucugaacuacauucacacggaccuaggagaggggaaguugaugguaggcacagagagcccucagaugaaccuaccuugucaucccccucccuuggagccucaucaugggucuguccuuucccaguucucucacccccucugagaugaagguacugaaccgugguagcaucugauagagcccuggguccguggcaaugcucugcagagcuuccugugguagggggcagugagucagguggggccauugacuguugaaaacucccauuguuccaggaagauucuuucucugaccgaagggagccagagggcaggcuuaccgcucucuuggccucacaggaucccacacaggcuuccgugaucuccuuguaauacagcugcugcuccacagacagcucauggaugcugcggggcuucaggcggaaaggggcccccuccagcaagggaggugccuucuucucuuuuccugugugaaaugggagacaggcuugaaaaagaaaacuuagccuggggagauagcucagucaguauagugcuugcccuaaaaaaauacaagguagauagcucaugaggacugauagcuaacacacacacacacacacacacacacacacacacguacacacagguacacaugucuaaaaaaaguaagcuuuagaagacgcuucugcacaggacaaacccucaccacaacaugcaacucuucuauaggcgucugggcuuuucugggguucuuuugucccuggccucauccacuucacugaggaccaccuggcuuugggauaagaguaggaaggggccuggccaggacacugaccuuugccaucagcugcagcugccccuugaccuuugccuuucagggguccaucuucuucuuggccuggcuuugcugauuucagggguucuguggccucagccuucugcugcucuuugggagcuggugggaaaguggucacagcaggagugaugagaagguaggaggagcucuagaggaccagggauggggaaggagauuaaggggcaaggaaaaccuuaccuggggguggauucucugguauagcuggcuggcagccuucgaugcuuagccaaugagcuguaaagaagacgucaagcugaguucuggguauguacacugggaagccgacccugacggaggaagauguauuccccuuccuaguccccuucuugccauucacauauuggauguuucuuucuucucuugugaaguuccucccagucacacgcuugcuuccccuccucccugggcacccagcucuacccucccuccaccuuugaggcagacauccagaggcacccgaggcagagggguguugaugaugucacucagguccacuuccuucucuucauagaaguacagcucccggcccccgccagaggcaaaccggaaagggaugaacuccugagcauggaagccauacaguggcuacaccaggagagagacagagaaggacaugagaaacagcgcaagggaggcauggccacacgugcauugucuccccacucuaaagccgccugucuccuucaaguccccccaaaucaccuccacauucuuuaacuucaaugcauagucaaugucacugguagugagcuucugucguuuccccaugugcaugaacuucagggcauccuagggggugggggggaaagagauuuuguuuuuguuuucagagacaggguuuucucuguguagcucuggcucuccuggaacucucuguauauaccaagcuggccucaaguucaagagauucccccugccucugacuccaagugcugggauuaaaggcauaccccaccaaugccccacuaagaagagauacucaucucugacccugagaaauacgggucagugaguaaagcccagcacgcacagggacccgaguucaauccucagcaucccauaaacaagacaugguauuagaaccucaaucccagcagugggagguggaggcaggagggucagaaguucaaggauaucuggaguuacauaggagguuggaguguuagcacaaagggaagcuggacaaaaggguuaccugggcaaucuccuugaugcgguagcugaccucaucugucaguagcuggcaagucuccuccugaaucugagcaaugcccauagauucugccaccaccuucauggacucagagggcaacacaguauugcugaguuucaguuucuucuccucggccaugcuggaauuccagcuccugucccuggaaggaugccuccccaggauggaaagauggagauccugauaguggggugggguaagauaaaaaggaaaaauaauucaaacccuacaucugaguuccuuccuuccuuccuugcagcucacccucaaagcaaagcuaccaaacaacagcuuggccuguccuuucuccuuuuagacacaggggcucacuaugcagccgugacacuucuaauucuagccuccugcuucugccuuucaaguacugggauuacaggcauguauuaacaugcccagugacaauuuuguuuguuugcucuuaguuuuguguacaggauuucuguagccacaccuuaaacucuguaaugaaagcuagccuugacucuggauucuuuugcuucuaccuuccuaguucuaggauuacagacauguaccucuacaguuuuguggucugggaaauacucuaacaacugagcuacaucuccagaccaguuuguccccuguccuuccaccccaaggcuguguaaccccagcugaccuggaacuugcucuguagaccaggcuggccucaaagucagugaucuggcugccucugucucuuggaugauaggauuaaaggcguguaccaccacugccuggcucaggcuuuuuuuuuuuuuuuuuuuuuuaaauagggccucuguagccuaggcuagucucuuacuccauauguggcugagaauggcccugaacuccggguacuuuccaagugcugggacuauaggcgugcaucaccacauccggcacaagucauucuuauauggacgcuuaaaucaaauccaccaggcuggaagaugugguucaguaguaagguacuuagcaugcacaugggccuggguuugauucccagcagaacuuuaaaacuuaccaggcagcccaacccgacccuuuuuggcccagaugauuaucaccuauucaucugcugaacucagucgcuggacaagguguuccuauuuccaucuuggcuuuuuuugugcguuuguuucuuaaaaccaaaguggucugucaaaauauaaacuagguaacuauuucuuuccuauaacgacuccccuugccuccuguccagguguagggguuaacacuucuaauuucaguggacugccuuggguuucaugucaggcuucagaguguacaugcuguacacccauauucccaguacccuggaggcuaaaguggggacagcaaguuugaggccaucccgacucugcaauaaguuccugucuaagaugguuucuuucuuuucucucauaucucugaucaccugccccgcccccucccacuuuacccugacaucauucuccuugcuguccuuuaaaucugacagacauguacuuggcuuuauagcuuuuguuguguucuuccuaaacguguuuggcugacuaccugaccccacccaccucucuuuaggggcaggucuccuauagccccacuggcuucaaauucacuagguagacaacacugguccuuuggccucuaccucccaaguacugggauugcaagcacauaccaccaugccuggcuuuaccuguuugcuauguuuucuucuucuucuuaauaauagugauauaauauguauauauauaaaaucacucuagauuaaaucuaagaccuuccacauguuaaacaacccuucuacaauugggucucaggcucgucuggaauucaucccguggucuugauuuggagagccuccugccuuuuacagcuguuuaccaccaagccuggcuauuauuucuucuuguuuauuauccuuaccccaccaguaaacaagaauaugucuguuauguucacugaccuaucuggugccuagggcauuguuaaauauaugaauaagucuuuuuuuuucuuuuuuucuuuccuuuuuuugguuuuucgagacaggguuucucuguauagcucuggcuguccuggaacuaacuuuguagaccaggcuggucuagaacucagaaauccgcccgccucugccucccaagugcugggauuaaaggcgugagccaccacugcccagcaugaauaagguguaaguguucacuaaauacuugguauaacaauuaccaaaaugaaaaagacacagacucaagcuuggaguuuacucugugguuaaaaggaaaggagcuugccugacacuggacaugaaaccaaccucaagaguguucagaacugagugcuagggacugguucuuuucauuccaagucuucucagacuuuuguuaaaucuugucuacaggaaauacaauuauucagcacauacucuguaccuggucgggucccaguccucuguggugguacccuugccacuaagguuucauaaaacacucuagcagccucgggaguuucucagaucaguggaagcgacaggaagacuucuuagagaagggauaacuugagcuauaucuuuacaucauuuuucucagcuagggaagugauucgaagauuacccgggcagcgcuacaggagguucacaagccacuacaucgccccaccauccuuccagugcagucacgcacaggguccccacgagcacggacacacaaccaaccgucuucuucccaguccucacaugggcccuuucaaagggucuccucacggauacaccucagacuuucccccgccagccaagcaccgggagcaguaaaagccucucaccgcugccaaagcgccgcucacccggcgcucggcgccaucuuggccccgcccccugacaggaguagguccuggcagaagccaaaaaguuaucacuguucuucccuaugucaaaauagaccauaucguuucacagucugaaauuauauaaaaauuucauucuacgugcauguguaaagaucauauuacucuauucuaauuacuucaauuuguaucuucauuacccagcugucaggaccuucagaaggcgccacaaaacugagccaucacgcuccacccacuuucg

SEQ ID NO: 2754 - RNA, 9180 nt, Mus musculus
cgaaaguggguggagcgugauggcucaguuuuguggcgccuucugaagguccugacagcuggguaaugaagauacaaauugaaguaauuagaauagaguaauaugaucuuuacacaugcacguagaaugaaauuuuuauauaauuucagacugugaaacgauauggucuauuuugacauagggaagaacagugauaacuuuuuggcuucugccaggaccuacuccugucagggggcggggccaagauggcgccgagcgccgggugagcggcgcuuuggcagcggugagaggcuuuuacugcucccggugcuuggcuggcgggggaaagucugagguguauccgugaggagacccuuugaaagggcccaugugaggacugggaagaagacgguugguuguguguccgugcucguggggacccugugcgugacugcacuggaaggaugguggggcgauguaguggcuugugaaccuccuguagcgcugcccggguaaucuucgaaucacuucccuagcugagaaaaaugauguaaagauauagcucaaguuaucccuucucuaagaagucuuccugucgcuuccacugaucugagaaacucccgaggcugcuagaguguuuuaugaaaccuuaguggcaaggguaccaccacagaggacugggacccgaccagguacagaguaugugcugaauaauuguauuuccuguagacaagauuuaacaaaagucugagaagacuuggaaugaaaagaaccagucccuagcacucaguucugaacacucuugagguugguuucauguccagugucaggcaagcuccuuuccuuuuaaccacagaguaaacuccaagcuugagucugugucuuuuucauuuugguaauuguuauaccaaguauuuagugaacacuuacaccuuauucaugcugggcagugguggcucacgccuuuaaucccagcacuugggaggcagaggcgggcggauuucugaguucuagaccagccuggucuacaaaguuaguuccaggacagccagagcuauacagagaaacccugucucgaaaaaccaaaaaaaggaaagaaaaaaagaaaaaaaaagacuuauucauauauuuaacaaugcccuaggcaccagauaggucagugaacauaacagacauauucuuguuuacuggugggguaaggauaauaaacaagaagaaauaauagccaggcuuggugguaaacagcuguaaaaggcaggaggcucuccaaaucaagaccacgggaugaauuccagacgagccugagacccaauuguagaaggguuguuuaacauguggaaggucuuagauuuaaucuagagugauuuuauauauauacauauuauaucacuauuauuaagaagaagaagaaaacauagcaaacagguaaagccaggcauggugguaugugcuugcaaucccaguacuugggagguagaggccaaaggaccaguguugucuaccuagugaauuugaagccaguggggcuauaggagaccugccccuaaagagagguggguggggucagguagucagccaaacacguuuaggaagaacacaacaaaagcuauaaagccaaguacaugucugucagauuuaaaggacagcaaggagaaugaugucaggguaaagugggagggggcggggcaggugaucagagauaugagagaaaagaaagaaaccaucuuagacaggaacuuauugcagagucgggauggccucaaacuugcuguccccacuuuagccuccaggguacugggaauauggguguacagcauguacacucugaagccugacaugaaacccaaggcaguccacugaaauuagaaguguuaaccccuacaccuggacaggaggcaaggggagucguuauaggaaagaaauaguuaccuaguuuauauuuugacagaccacuuugguuuuaagaaacaaacgcacaaaaaaagccaagauggaaauaggaacaccuuguccagcgacugaguucagcagaugaauaggugauaaucaucugggccaaaaagggucggguugggcugccugguaaguuuuaaaguucugcugggaaucaaacccaggcccaugugcaugcuaaguaccuuacuacugaaccacaucuuccagccugguggauuugauuuaagcguccauauaagaaugacuugugccggauguggugaugcacgccuauagucccagcacuuggaaaguacccggaguucagggccauucucagccacauauggaguaagagacuagccuaggcuacagaggcccuauuuaaaaaaaaaaaaaaaaaaaaaagccugagccaggcaguggugguacacgccuuuaauccuaucauccaagagacagaggcagccagaucacugacuuugaggccagccuggucuacagagcaaguuccaggucagcugggguuacacagccuugggguggaaggacaggggacaaacuggucuggagauguagcucaguuguuagaguauuucccagaccacaaaacuguagagguacaugucuguaauccuagaacuaggaagguagaagcaaaagaauccagagucaaggcuagcuuucauuacagaguuuaagguguggcuacagaaauccuguacacaaaacuaagagcaaacaaacaaaauugucacugggcauguuaauacaugccuguaaucccaguacuugaaaggcagaagcaggaggcuagaauuagaagugucacggcugcauagugagccccugugucuaaaaggagaaaggacaggccaagcuguuguuugguagcuuugcuuugagggugagcugcaaggaaggaaggaaggaacucagauguaggguuugaauuauuuuuccuuuuuaucuuaccccaccccacuaucaggaucuccaucuuuccauccuggggaggcauccuuccagggacaggagcuggaauuccagcauggccgaggagaagaaacugaaacucagcaauacuguguugcccucugaguccaugaaggugguggcagaaucuaugggcauugcucagauucaggaggagacuugccagcuacugacagaugaggucagcuaccgcaucaaggagauugcccagguaacccuuuuguccagcuucccuuugugcuaacacuccaaccuccuauguaacuccagauauccuugaacuucugacccuccugccuccaccucccacugcugggauugagguucuaauaccaugucuuguuuaugggaugcugaggauugaacucgggucccugugcgugcugggcuuuacucacugacccguauuucucagggucagagaugaguaucucuucuuaguggggcauuggugggguaugccuuuaaucccagcacuuggagucagaggcagggggaaucucuugaacuugaggccagcuugguauauacagagaguuccaggagagccagagcuacacagagaaaacccugucucugaaaacaaaaacaaaaucucuuucccccccacccccuaggaugcccugaaguucaugcacauggggaaacgacagaagcucacuaccagugacauugacuaugcauugaaguuaaagaauguggaggugauuuggggggacuugaaggagacaggcggcuuuagaguggggagacaaugcacguguggccaugccucccuugcgcuguuucucauguccuucucugucucucuccugguguagccacuguauggcuuccaugcucaggaguucaucccuuuccgguuugccucuggcgggggccgggagcuguacuucuaugaagagaaggaaguggaccugagugacaucaucaacaccccucugccucgggugccucuggaugucugccucaaagguggagggaggguagagcugggugcccagggaggaggggaagcaagcgugugacugggaggaacuucacaagagaagaaagaaacauccaauaugugaauggcaagaaggggacuaggaaggggaauacaucuuccuccgucagggucggcuucccaguguacauacccagaacucagcuugacgucuucuuuacagcucauuggcuaagcaucgaaggcugccagccagcuauaccagagaauccacccccagguaagguuuuccuugccccuuaaucuccuuccccaucccugguccucuagagcuccuccuaccuucucaucacuccugcugugaccacuuucccaccagcucccaaagagcagcagaaggcugaggccacagaaccccugaaaucagcaaagccaggccaagaagaagauggaccccugaaaggcaaaggucaaggggcagcugcagcugauggcaaaggucaguguccuggccaggccccuuccuacucuuaucccaaagccaggugguccucagugaaguggaugaggccagggacaaaagaaccccagaaaagcccagacgccuauagaagaguugcauguuguggugaggguuuguccugugcagaagcgucuucuaaagcuuacuuuuuuuagacauguguaccuguguguacguguguguguguguguguguguguguguguguguuagcuaucaguccucaugagcuaucuaccuuguauuuuuuuagggcaagcacuauacugacugagcuaucuccccaggcuaaguuuucuuuuucaagccugucucccauuucacacaggaaaagagaagaaggcaccucccuugcuggagggggccccuuuccgccugaagccccgcagcauccaugagcugucuguggagcagcagcuguauuacaaggagaucacggaagccugugugggauccugugaggccaagagagcgguaagccugcccucuggcucccuucggucagagaaagaaucuuccuggaacaaugggaguuuucaacagucaauggccccaccugacucacugcccccuaccacaggaagcucugcagagcauugccacggacccagggcucuaucagaugcuaccacgguucaguaccuucaucucagagggggugagagaacugggaaaggacagacccaugaugaggcuccaagggagggggaugacaagguagguucaucugagggcucucugugccuaccaucaacuuccccucuccuagguccgugugaauguaguucagaauaaccuggccuugcuuaucuaccugaugcguauggugaaggcccugauggacaaccccacacuguaucuagagaaauaugugaguggucucgccuaccugcugucuuuugcagggucaggggcccuucuggcaaccucaccacaggaggucugguaucagacucacugacagggccuggucucucucaggugcaugagcucauuccagcaguaaugaccugcauugugaguagacagcugugcuugcggccagauguggacaaucacugggcacuccgggauuuugcugcccgucuaguggcccaaaucuguaagcauuucagcacaaccaccaacaacauccaaucccgaaucacuaagaccuuuaccaagguaagccccaaaaauguuaucaaaugaugcaaaccaccccuuuagggcuaccugugagagagagagcuucacccauuuggcaguggaaaugauagugggaacauggagccauggagauugggcccaagggacuugaaccuuuguguccuaauguuuuguguuuauaggugaugucaauccuucgcaguuagucuuucuuuuuuuuuuuuuccuuuuuccaguuuuguuuuuuugagacagaguuucucuguguagcccuaacugcccuggaacuugcucuguagccaggcuuggccuugaacucagagauccacccuccugugaguucugggauuaaaaggcaugugccaccacuuuguggcagccaucgcuuuuuugaaacaguauaccauguacuccaggcaggccuuaaacuuacaguguaagcaaggauggcuuuuuuugguuuuugaaacaggauuuuucuguguguagcccuggcuguccuggacucacuuuguagaccaggcuggucucaaacucagaaauccgccugccucugccucccgagugcugggauuaaaggugggcgccaccaugccugguuugaggaugguuuuaaaauucuaaucuucaaaaaaaaaaaauaauaauucaaaucuuccugucucuaccuacuaugugccagguuagccuuucuaacccuuuucaucugggguuuucuuuuucucuacagagcugggucgacgagaagacuccauggacaacucgauauggcuccauugcaggccuagcagagcugggacaugauguuagucuccaggaagagcugggggaggggcaguuacauuugguguaggaggagccucuggugaccuuuuagccugggauucuccccuuccuucccaccaggugauuaagacgcuaauucugccaaggcugcagcaggaaggggaacggauccgcagugucuuggaugggccugugcugagcaacaucgaccguauuggagcagaccaugugcagagccuucuccuggugaugaaccccaccguacccgccccuucuucccaccagccccacccucaguugccacaagcauggcuacaguguuuuagcaagcacgaggcacaucuuacucuuuuacucaagaggcuagcacuguuguguacauggaaagcaaggcacaagcagaaagccuugauagucaauaacuucuggaccacacugccuucauccuguuugccucacucuauggcuuacucugcccaaggcucaugaacaccaaauaugucaucagcaaacccuguucaugucaguugauccuuauggaaggaaacagucuuuuuuuucuuugggggggaguuuguugacuccuauagaugugaucuugcuggauaguuuggcuagccugaacuuguaagguagacaacacuagccuuguggcaauccuuuuaccugucuucugugugcugagauuauaggaaugcaccaccauacccacugaaaucauuccuuuuuauuuuuaagacuuuuuuauguuuaugaauguacaccauggguagaggugcccacggaagccagaggaagguaacaaaccuggaacuagagucccagaugucugugaauaaccacccugagggaguguucuaaaccugaguuacccuccaguccccacccccauucuuuuuguuguuaugcugcugggaauugaacuuggggccauauacuuguuugcaaagcauucuaccaaugacgcuauauucuccuuggcccuuuuuaaaaaaaaaaaaaaaaaaaaaaaaaacuuugagauacgccaccugcucaggcuagccuagaacuccuuccugcuucagcucaagugcuguguccagaggccauugcuuuucacugugacuucuaacaguaacacuggaugggcuccucucaucuuugugggaggauaccagcccuuacucugccuucucuacagaaacacugugccccaguacuggccaagcugcgcccuccaccugacaaucaggaugccuaccggggagaauuugggucccuugggccccuucucuguucccauguggugaaggccagggcccaggcugcucuacaagcucagcaggucaacaggaccacacucaccaucacacaggucagcugcugagggaggaaauguacccagguuugggauagcguuugucauagccagcagucucagggagcuggaccucucccacgcccaaugaagagcuagcuaccuggaguggcucaggucugccuucaauguuaacauuuucuuccugugucuguucucuucauagccucggcccacacugacccuuucacaggccccucagccaggcccucgcacgccuggcuuauugaaggucccuggcuccauugccuugccuguucagacacuggugucugcgagagcugcugcuccuccucagccuucuccuccuccaaccaaguuuauuguaauguccucaucuuccagugccucaucaacccagcagguauguggagccagggugaggggugugaugccccuggggaaaccuccaagcuguaaccuaaucccuucaugcucaaacucggacagcauaagagcuacuucucaguaucuuagaggccucaagcuagcagcagucuugaccauccauucacuggggacuacaagggaaggugggaguggagggcaugugucaacaguagauaccuggaaaaggauucugggggaagcaaggacaacaugacccuagacccuccuuucucgcucagguucugucccucagcaccucagcuccuggcucaggcucuacuacuaccucuccugucaccaccacgguucccagcgugcagcccaucgucaagcuggucuccacugcuaccacugcacccccaagcacagccccugcugguucuggcaguguucagaaauacauuguggucucucuucccccaacaggggaaggcaaaggaggcccuccuucucauccuucuccaguccccccuucaucuucuucaccauccccacuugggggaaguacccucuguggggggaagcaggaagcuggggacagccccccuccagcuccagggacuccaaaggcuaauggcucgcagccuacuggaccuggcucuccccagccugcucugugaugugucacaugugcugaccuccucucuugugcagauuccuacacacucaaacaaccugugagggaggaaggaggaaagguuuuccccagugacuuucuuuuuagauauuguacaguaaguuccucagaauaaaaguuggauuuguaaguuugugagccucccgcaucacauaagguccgugggaccuuccuguccagguccaaagccacaaagaaaauguccucuuccuguucaacugccugcucacauugcuguccauauccuugcuuggggagcuucaaauccgaauuacguaggcguugcuguggcuuagaugucgaacccacuugugaggauuggcauuaccacaggcacuaaaggacagucugaggaaucgaaccuggagaccggagcaugugugccgagggaguucaaaggagaggcuggcaggacccagccccaagggagaagguccaugguugggaagucccugcaagccagggacauccaucugu

SEQ ID NO: 2755 - RNA, 3794 nt, Mus musculus
cauccugagcccuagacagguuggacuaguguuuauuaggcagaagggaagaaaaggggucccccuagucauaguuccccuagucccuuagcguagaagucucuuaagccuggugccucgcucagguggggggucaggaaggagguagugagcacaagcccaacuccagcaaggacagcagaaggugguaugcuuccccacccccacaccccggggacaggccccagaggcaggcuucuucuccagcccgugccuuuuauagcucagacaucaauagguucacgaccucgguucugccucuucacuacaaacacccucuguccugacacagucaccagcagcguguguucaccaaagaccacugcagagggaagggagcaggaguuaguggguacaguggucaccaaggagggucacaaaaaaaaaaaaaaaaaaaagaauuggcauaggacaaagcaaccccuuguccuuauugcucuguacucauccuagagggaccuaguaugaaagcaguaguugaaccagggacuacaggaggaagugggaguugguggaauggagccaggaauuccuucccugagcagugaggccgcuaaaagaaacccccccaccaaaggcaggagcucaccagacaggcguuugaaagggauguucgugccauggugcaacuggaagccacaggcugugcugaccaacuccgagauggcacuggcugcuugcucaucguucucaagguccccagaugacuguguguggaugaaggaggguaggagcaaaagacagacaucagaguuaggaacaaauucaaggcacaggaccucugccuccuauacuuaugaucucccuuuauacuugcccguagucccaaauuacccagcuucagaaaaauaccaccuacaaccccuuuaugauggugcugucuuuccuugugccaucuuguuucucauucugaaaugccaggcuucauuugauagccaugugaggggucaaaaccuagaguaugaucaccaagugaucagguccccagucccucaugugggagauucuaggcaggggcucuaccacugagccacaccccagccccucacugggggauucuaggcaggggcucuaccacugagccacacccccagcgccucagugggagacuccugggcaaguguuuuacuacugagccacgcccacagccccucacgaaggauuuuaggcagauguuauaucacugagcuaacugcucagucuuugaagguucuaccuguuacucagucuucccacuuguccugucuguaggcuaugaagcagaaacacccacuuugucuuuaaaguuuucccucuggcuaacccuugggcaaauaacaagacaguaguccagacguccucuggacaguagaacagacuguuucaacauccucuucccaccgcuucuaaauggguccuuaacuagauuuaguuccuuuugcucucgguaucuccagcuguauacugggccuauauucugcgcuugugaaagucucaugagaaaacaaugaaaacauaacagugccuacauaauaaauguacuacaaccgauagcauuccaucucacucggugucuacagucaggccaucaaaauucuccuuagcuaccuccuuggucagcuuccuuucuugaugucuuauuuguucagguaccauaguauuuuucugguuuccccuguucagaguccuacuggauaaguacuucagaaagguagaguacauguagaaguacuuuaccuaguaauuaucucugggcuguggggguggcucaguggauaagaguuuuugcuguacaagcaagaggacuugaguucaaauccgucaggaaugaccacacucacaccuggaaucccagcacuguggguguacagccauguggacugcugaggcuugcucaaggccgccagucuagguacggguucagagacccugccuuaaggaauaaggcagagagaguggugagagugggucucuaaugcccuacaauggcuucagcacaugcaugggcacacacccgugcaggcacuaaaaacauaagcuaaaaugucuucuguccuugcuccucacugcuaccaguccaguuuccugcuuauauggcucuccugggacacuugugcuacaccauuucugugagucacaguuguuuuaaaacccuuuaacccucaagauuugucgaaagauguugaagcuagccgcaggaaguucaguaucagucuuaccacagcauccuuccucuucaaaugguuucaacacaaaaccacggccaacucgggcacuggcacacucaggcaagcaugcccggcucccaacccugaggguucuuuucucuuucacaauuuucugcccuugcagcguagcucaauuccugccucuagagaagucuugcccccaccccaccccaccucaccccccaaaauucuagaggcaggcaaaaauggaucagagcauaaaagugcuugccucaaugccugaugaccugaguucaauccucaagacccacauggcaggagaauucacuccaaaguguccucgaacuuucacccccuguggcacccauacgugcgucccuacaagaauuuaacaaauaaaaacaaacuacaacuaacuaacuaauuguauaacuuggguaaugguuuguuuguuguuuuuugaggcugaguuacauguaguccagguugugauugaauuugauauguagccaaagauaagccugaacaucuaacccacuguuuccaccuuccaagugcugggacuacacucuguuugguuuuaugcaguauugggauugaagagaaggcucugugcaugcuaggcaacucauucuccguacuaagcuaccuccccaaccuuuugguaauuagcuuuuauaccacauauccaaauacuacauaaagcuuacuauauggcaagcaaggaaccacagagaagacaaaaagagacaacuuggaaauauuugaagggauuucugggcuguguguccccaaaggacccccccacacacacacacacacacacccuccaccccacgcuuugcuuucccacaacgcaccgccagcacugcaccuucgcucagcaccagguagccaagcuggucugggauucgcuccagcccuugggucagugcggaagucuagaggguaaagagacaaggagaaucaugacagccuugcaaacccaucucccuccuggauaugagccuuccaaggcccucauaauggcuuguaacacugagucuccauccacggucacuauuggaccucugagcucuuccacuugucauguaggugacccaggaggccuuccuagccccucaaccccuccucaugucccuucccacuccaguccccuuaugccccgccccuugugccaucuagacuacucccccgcugcagaacacccgguagcggagccuuccuucuccagcccucccugucgcuucccucccaucucuguucccuuucggucccaggguggacuggaggugacagugaaaugcaagccauaagguggcaacagaagcucggaaaacagggacgcggaaccgcaggcgugcacacccgcgcaugcguccacacucaccaucgcagccguaggugcaguguaagcagucugccggauagguaguuuccggcuccaggcucgggucaggugguuucaccagcugacuguagcccagcccuucgcuugaggauuggauggcggguaugucauuauacuuuaucaaccacugcggagccccgcuuuccgaacacauucguggauugguugcauuuccc

SEQ ID NO: 2756 - RNA, 2621 nt, Mus musculus
agaaagcggaagcggaaggaagggggcguggccuccgaggcuucuuggcugagucgaggggugagugcgggcugcugaggaaccuuuaaggaugcuagacuggcuucuuuggguagaauuuauuuuuauuugucuccgccucccuccuuuccuuucuuucucuucuucccucucucucuugcuuucuucccugacuuucucuuucuguucccucucucccacgcuucuucccuuuuaugacagcauuucuuguagcccgagcuggccuuaaacuuccucuaaagcugaggaugaauucaaauuuuugcuccuuuugccuccauucuccggagcgcuggcauuacagguaugugccaucaggucugacuuaugcagggcugggcguugagcccagggcuucaugaaugcuagguaagcauucugcaaacugagccacaccgcugccuuuuuuuuuucugauauuuuguuguuguuguuguuauuauuggugauguguguguguauguguguuacuggaaugccugagccucaaccucaugcuagccagucguuuuaccaacagcuguauccccagcauugagggaauacugaaagaaaagaaagaccccauuacuuagccuaauuucuguccaauaaaagauucuccaucacuucuccuuuuagagcccuacauagaacaaagaacugggggcaggggagauggcucuuugguuaagagcccuugcuguucuugcaggggaccagggguugggucucaacacccacaugguggcucacaauauuugguaacuccaguuccaggagaucuguggacaccagguacauuuacacauguaggcaaaacacucauacacauaaaauaaaauaagucuaauaaccuuuuaaaaaauaaguaaacguuucguagcauuuauucauccaacaaauauuuugauagugaaauuagcacagcuccauaacaaauauuucguagagaaauggacauauaucaugccccaaacuuucucugugucgcugucaucuuuugccccuccaggggguuuugaggaacugcuacaugaaucugucuugaggcuugaaguggcaaaguuagggguugggggaggcaacagauucugcugggauuucuagaggaaguccagacaacaacagucucaucuuagagcaaacuuccuguuccuuccaagggaaauacauacgcaccuagagguccuccacccgucgcauauguccuaauuuguagucugauaccuauggggacaguagccuugaggucuugagaggcgaggagacuguaggaggaaacugcuuagcaucaaguuuauccuuauacuguagcucuggaguagccaagcguucacauuccucuuugucuuucugguuuaguccacucugaaguacauagcccaauaccuuagcugaaccaaacuguaaaggacggagcuuugcaucagcgauguauuuggggucuaaagccucaccucccaccaagcaacguuuagccagagcuucucuucgagcccggagcucagccacagcacguugcagucgacuccugccauacuguucuauccgcgcccacagacuacgguugaagugaauauaaagagcccaauccaaguuauuccaagcucgggccuguuugguuagcugcugaucuucaccagucaccacagucuuauuggcaguucugauaagacucugcuuuuuuccagccugggcauugugcaugaagcccaccacaucguccagacuccagcacagggcaucugccaacaggaccagugacucaucaaaguacucggccaccaugaccaggucaaagacugaguccaaccaggccagaccccauuggauaaaggaugagggccuaaaaucugaggagacaaggcuggcuggcugcuuguaacuaucagcagcugugguaacaggacggaagagaguuccagggcuagcaccggaagguacaauauguagcuggagagauuuggggucucuggguagcuggggacucacuuucauggucuuugucucugggggagagggcaaaccaaagucaaaccauaguaaguuacgggcguagugguugccacgggcuccgggucuguagaaggcuugaggauuggacaggaaggcggccaaagacggugccuuucggaaagccgaugaaacugauuuguaauaggagaaggcagagcgggcuagagcugcuggaucucggacaauggaaaagaagaagcuaucagaaggcaugaccugaaguaccugcagaagaaagaaagagaggaagagcuugacugaggagaaaaugaguccaagcugaggcucugaugagccgucaggcucugcuguacacccccaguuuccccuacuagcugugugauguuggggaaauuacauagcaccucugaaauucaauuugcugucugcaaaaggaaaguagucagagguucccagguaauugagaauacucgaaauaacagcuagucagaaaucuagaacacaaagcucuuacugguuauuaauguccuuggguuuuugugucuucguugguagagaaaacucucaaaccuggggcuggggagauggcucagucaauaaagugugugccacacaagcau

SEQ ID NO: 2757 - RNA, 6353 nt, Mus musculus
cuccccggcucccauugucuccgcagaugccuccugguccugcuacggugcugggguuguucaguuuuaggggacacgcuccuauucuuuucuucgagacgucccgcggccgagaacgggguucuagaguuccgcggacucuucuuuccuccuuaggacccacuuugccccgucccagggaggagagcaccuaugucugcgcugcgaccucuccugcuuuugcugcuccaucuguguccgggucuagggccgggacaugggagugaggcaaaggucguccggaguugugcagagacucggcaggugcugggggcccggggauauagcuuaaaccuaaucccucccucccucaucucaggugagaagaaagagggaagagucggggugggaaggggcggggacggguccuccccaucucacaauaacucuuuccuuucagugaccauuaugaugauuguuucaucuguugagcaucuuucuucuccaguaacuuccuucccgggaucacaauaaaccugcugcucauauaauaacucucauucaguccccacccaaggaauucccuucucuguaauuagcacacccguuagugucuuucuaacagccagaaaucgccuugcaauuccugugagcuucuaugacaauacuuucuugcuuaccaaguagccccaccccuacaaaucccguucuucauuccauaguugucccauaagucccuggaggaguggguugugcaguguuggggaggguuaccugaagacccucuggucacuaauauggcccucaaagcagcuguucaauagaugaucccauuacaaauaggagugaagcugagaugggugagggacaauaaaagaggguucagguagggcugaaggggcaaacaaaggaaaaagcaaccgggcagguggaagacaaaaaucagcccccagagauaggcgagggaugaaaggagauuccuaauaucccuucuugccauccaguccuccucccugucuccucugcgcaggugagcaccuucaagucuguccucaggaguacaccugcuguuccagugagacagagcagaaguugaucagggaugcugaagucacauuccguggccugguagaggacaguggcucuuuccugauucacacacuggcugcccggcauagaaaguuuaauggugaggaccuuugggggguucccagaugugcuucacaccucuuuguguuuaugcaccccguuuccuauucccaccuccugcagucauagcuaggccaccaccacccaccccagaauccccugcuuauuucccauccccacuccacauucucuacaggacccugcccuuccuuguuccuagucugccagcuuacucagcuucuaauucuuuugccucuucuuuuccucauuccuuccugccucugcccuuucccugcucucccugucucuguucccucuucucaucccuccaccuuuguuagaguuuuuucgggagaugcugucuauaucccagcauucuuuggcucagcucuucucgcauuccuauggucgccuguauucccagcacgccgucaucuucaauagccuguuuuccggccugcgggacuacuaugagaagucuggcgagggguuagaugacaccuuggcggauuucugggcacagcuccuggagagagccuucccuuugcugcacccacaauacaguuucccuccugacuuccugcucugucuuacucggcuuacuucaacugcugauggcucucugcagcccuucggagacucaccccgccgccuccgccuacaggugaggaggucccacaaccugaacuucagcaaccuccgacccuuagugaccucuaaugguaugaacugucaccuccaagacaaucacccccuuuuguucccaugucaccucugaccucauggccucuaucuuggccuucucugacuuggugauccccaucucaagcccuggucaccuaugucugaccccuuggucuccuuuagcuacauucuuugcccuacuuuuauauauacacuuggcccuccacccucagcuacuuucugccaacaccucucuaauccuaacaugguaacuucccgugggucaacgaaauaagaauggccaccaaaguugggaaucauuuucaccuacaguaucacauugaauuaucaccauaauuguuugagguaaaugagagcauccuuauuuuacagaggauaaaaauggggcucccaagcaagucucaaagccaauaagcagagaugcaggagcucacacccucagucuucuaacuuuagguucaguguucugauacauauucuacccuacuagcucuuuccaaacacccagcccuucuagaccacaauuccuuugggccuauugaauucccccucucuguaucacccaacaguguacccuccccaaguuaaucccacaaacucaaccuccuucugucucucacuccaguuuugacuaacugauaauuuuuguggguuuguuuguuuuuucucaucuucuuuuccuccagauauccagggcacugguggcagcccgggccuugguccagggucuggagacuggaagaaauguggucagcgaagcacuuaagguuagaggggcccugaauauggacagagcccaggaugugaagaagacaggcaccaucuggcaggagaggccuagagcugucccuuccuuaucuguuccugggcucugguguuccagaggacaucaggaaggaaggccagagucaggccuccccggggugucugacaugaucuccugggacuucugguccucccucuggugacccacaugccuucugcugaucuuucuauaacaguuugagauuggagugaaccccucaauguccccuccuuccucccugcuacugaagaucucucuucaucacugguccuguccccagccucaccuccugccuccuuccucucuccucagccuaagcucacucuuggcccugaaucuuuccuuaccaccuccuccucaguaucauccuagucaaaccccucucgugaaccagaaucagcaaccuuuucucuagguaccccccuucucagucccacagcaguccugugguaucgccaggugccacauggggucaccaaccacaauuguucacauccagcuuccaacagauagccuggggaggugggucaggccggaucuuugaccucucuaugcccagcaccaaguuugcuaagaauagccugcguguucauggaugcccagacccauuuucuacccacagguaccaguguuggaaggcugcagacaggcccugaugcgucugauuggcugcccucuuugucggggaguuccuucacuuaugcccugccggggcuucugccucaauguagcccauggcugccucagcaguaggggacuggagccugaauggggcggauaucugggugaggggccucaagaagcccuagauggaggggaguccugaguaagguugggggccauuugaguaaggagaggguggccuaaaaccaaacugggggaagcacaagguggggggggguggucucaugcagucacacagcccaccuacaagcaaacaaagugcucuuuccuuuaaggccccagugagaugugugggaacauauuaaaucagagcuguccccuguccccuuucuccccuucccucaagauggucuccugcugcuggcugagaaacuccaaggacccuuuuccuuugaacuggcugcugaguccauuggggugaagaucucagaagguuugaugcacuuacaggaaaacaguguaaaggugucagcgaagguauagagagggaaggauggaggugaggugugggugucagaaacaauaaggcauauagaggacuguaguuuccgagacgggacacucugauuggcuucagaguggcucuugaggucuuucccuguaugauagguguuucaggaaugugggaccccccaucccgugcagucccgcagccggcgagcaccagcaccccgagaagaggcuagccggucguggagggcuucagcggaggaagaacggcccacaacagcggcaggcacuaaucugcaccgcuugguugguaguggagccaccggggcugguggguguggcaagacagcugcucacaagugcugcagcuuuguuuucugucgggcagguuugggagcuccgggagagacuuagccgaguacggggcuucugggcuggacugccuguaaccguauguggggacucccgcauggcggcagaucucucacaggagacggcacccugcuggacuggaguugggagaggccggugagucucgggcucaggcggcuaugggagucuggaaggagggaaggcugcagccggagcccucggggugcugugcucucagguauaugucgccuguggucgugggcuccuugaaugagcagcuccacaacccggaguuggauacuucgagucccgaugucccgacgcggaggcggaggcuacaucuccgagcagcuacugcucgaaugaaggcggcugcgcugggucaggaucuugacaugcaugaugcgggugaggcucagaaacucacucugcaaggccccuugacccaggcccugguccauugcuucccaagucccgcccacuaaccuccaucugacugcuaugagccagcucuggagcccagcccauugccucucaagucucaucuugcucuuggaacuucccauugcuccuugacaccaccccaacugugcuuccacuccugcccaucccccuucgaggcccacacauugccccacuagccacccuuccaccccucauccccgccccacauuaauuagcuucauucuuuucuauucacuuaagccuuaagugccugucucaaaggucuccauccuugacuguggugggagacacaaacauuccuacagagaacacugaggaaacuuauuguaaagaacugggggcagggaagcuagcugugcugucacugggcugccccaccuccaccccacccccacccgugaaauuaaccaaaaagagaaccaagcacauccaacuuuucuuagguuggcucccaacuccuccucccuccccaucccccuuucucuaccuuuguuuucuggcuucuugucugcuugccauccccaucgacucuuuuuuuuuuuuucuucugcucugucuuuuccagucuccuugccuucucccaucuccuugucuggugugugauuaugcguuuccuuccugguauuccugucaccgcucacaguuguguguccuucucuugccucucugaaucuccuuuuuuuauauuaacuauacaaaguaauagauuucauuuugacauuuucacgcauauauaugaaaaugugcuuaugguuuaucucaguuuccauuugaaaucucuugcucuuccuuccuaccaucuaccucugauccucuccaucuacacagaugaagaugccaguggcucuggagggggacagcaguaugcagacgacuggaaagcuggggcagugccugugguucccccagccaggccuccaaggccaccucguccuccucgaagggacggucuuggagugagaggaggaaguggcagugccagauacaaccagggccgaagcaggaaucuggggucaucuguuggccuccauaccccacuuguccuccuccuccuucccucagcccugacccugcuuguacuucgauaacgagggaggggcgcccuagcaucaaaaggcuuaguggcucuuuuucuuccaccucccucagccaggcaugaggaggaguggaagggggcuacagagagggcagaaagggacuuugugggugaauggcuggggccccaaauccaggaguuuccaauuaauggggugggagguagauggguuucauaauauuuauuuuuucauuugggaacuggggauauuuauuuaggaaggaugguucagcucuuuuaaaucuuugggcucacugaugggguggggggugggacacgggguugaaggaacuugaaaguggggaggaaugguacuauuggcauggggguaccugguauugaaaauggacacauaaacuagcugagagugaugucacuugccuguaaacccauuauucuuugggaugcugaggcaggaggauugagaguuagggacuaauaaagcuaggugcugacaguagaacaggaaggaggguagaaccugaguuuuguugccucuuuuaaaaucaucugcuucuuaaguauggggcggggggagggacccaucuagcgaccuuugccauccacauccaucacaaacuuccacuucauauuucaguguucauaucagugucuauugguaaauaaagaauuuauuggaccacgugu

SEQ ID NO: 2758 - RNA, 25037 nt, Mus musculus
ugauuaggaaauuaaugcuuuauuaaaguuguuauguuuauguuucuuugaaguuguccuuaaugguaguagaacucuccagacacaugcccaaauacaggaaucauuuaucaaauauaggaauccauugaauuacucauuugugcauuuagaaguugcagaaagucagcuuuugcuaguugaagcagucucgcugaggauaaaugugaauauaccuccucuuaguguugugucucucucuccuucaugaggauugcuccuucacacacauuuaguggaugauuccuccaaagccaaguaaucuauuuccuagaaaguucauaugcucauucuuuuuuuaaagauuuauuuuaguaugugcauaguguucugcuugcaugucaggagauaccaugguugugaaccaucaugugguugcugagaacugaacuuggcaccuuuggaagaccacucagugcucucaaccucagagccauucucacuauccuucuugacuaugggucagggucaucugugaaaagaaaguaaugagaagccuguaugaauuguauaaagcauggaaaugguugauagauugacauuuuuggcccacuaauaaaaauauaauaauuuuucuuaaauuuuuaaauuuuaaaauuuuaauuuagguauaauauuucuucuuacccuuucuccacccaagagcuacaguacaucucuacccauaauuuuucauguucaaggccuuuuuuugcauaaauuguuauuuuuugucuguagguauauagcuauguauauauauucaugaauguaaccugcucaguccacacuaagcuacuuaugugaaaaagauauuuuuaagauagaaguaguugaaucaggagguaaauaauuuagacauauacuguacugucauuuuuauaaaguuuugaugccuaagaccuuguauucuuacuugugucucugucuaaggcaguuuacauauacuacucauuagaggaguaaaagagaguugacugauuccuauguccugcguaggugacuucuaugugacuucuauauaccuagcaauccaaccaacucuagcuugucauuuuauuguacaauuugaugugacuugaacccaauauuaugugcacagugaacaucagugacuacuaguucaacaagugaagaaugcaaaaguuaaaaaauuaagguuauaauccaacauauaauauaaaaaguuuacagaagaguucuaguguuucucauguucguguguaaucuucccugaugagauggaccaaauuuagauugcacauacauuccaacacaaacuucaucugaugccaaugcuguucuguaaaauauuacuaaagaauuaauucacaaucauuccugauguuuaaaaacucccauggaagagauggcuauuaggcuuccagaacauuuccagaaucaacauuauuuguuuauauaaucacacgagaaauuaaaauuuuuaauuuuuucuguuuucucuucuuuauucuuuaguccuuuuuuuuacaguccagucuucaucccauuccuggucugccccucaacugcaucccaucccauacuuccucacuccaucuccaagaugauguccccaacccauccaauuccgccaugccagucuugccuacucccugagaccucaagucucucgaagguuaggugcuuauccugucacagaggccagaucaaguagucuacuaauguauaugugucaggggcugguguaggcugccugguugguggcucagugucugagagaucuugggaguccaggucaguugagacugcugauguuaauuggacauaagacuuuaccuuuaguaauuucuaucggaauugaaaagguagacacaaaagucagugauaagagaauagaaaagcagcaucuugccaguccaguuucacguuuucccuccugaauuccagacaccagaugugcacaaggauggaaugaagggaacaaagcuuaucugaucuggauaggugugucagaaggaaucugguucagcuguuauuacagagaaaaccagcuuucuuccagauguucagugaaacagcucucuuuauuuggggggucacaagggccauauaaaccuuggguacuauguaggguuuuucagggugaguauacauuauugacuguagcugagaugcugggaaugcuucauuugaaugaagagaaauuccaggugacugcuggacauguccuuaugggaaggaaugaaguuaaauuuggaauuuggacaaaaggcugugugacuacccaaagguuguggguguggagaacacaagacuaugugcacuagagccugcaugcccagaaacagggauagagcaauccuugaaccugccugucucaagaugagcuugucaggguuuugacaugccacaacugcacccuugcucuaggccaguucccccauucacagggcucacuuaagccauaguguaugucauuguaagcuacuucacuugaugacucuugcaggagggagagaaaaauaaaaugauuucucgaaggaucuuauagagguauaaggaguccugaaagggaagggauaaugaagaagaagcagaauaggauaaguagaauaaaacaaugauaagaugggaagaaaagagggugagaagacaagaggauggaauagaaacaguccauucauaacauaucuucucauccauccccagugaguaaauccccaacucagaccuuuggaaagcuucuuccuccuuuacauggaggaauguuuuguaauguuuagauacagggaacuuagauuucuuuacuauuuuaaagacuuuaaauguuugacacauuugauuucaaagagcauccaccacacaucaucuuaauacugggagcuuccuuauuguaaaguuguacaaagaaccuuuaacuucuaaaucucauaauaacugaacaacaccacgauuagaauagugaauaaacugaauuccuguauaugauucucucuaagggcuauaagugaaaccugcaaauaugccaaucuuguguacuuauuauuucauuuuuaauguucuuguucaauugugacaccagguucagccaggagaauaaagauagaaucaauccuuauguauacaugccuuuuggaaacgguccuagaaacugccuuggcaugagguuugcucucauuaacaugaagcuugcuguugucaaaauccuccaaaacuuuucugugcagcccugugaggauacagagguaaggcagaauauauucuuuuuuggauuaguuuuguuuuuuauucagauguauuuucauaaacuuggggauauauauauauauauauauauauauauauauauauauauaugaaggcaaaagacucagaaacacacccacuucuauuguuaggagucacacaaaacccucaaccuacacacacauggcaugauguagggggccuagcaaagacccaugcaugcugcaugauugccacuucagucucugugagcuccuaugagcucugcuuuguucuguggacuauguucuccugauaucauugaccccuauggcuccuacaauaauggaacauauuuuuaaaguguguuucagguuaacuauauaugaaagucuauauguguaucugucuugauguuccugaaagacacagucucauugaagucagucaucuggucuuccaaaucgucaacccuauucuguguaaacuuuuaaagcaaguugucacauuuagaaacaugcuugaaaaaucuccucagaaaaacuuaagaauauauugucauuaacuuaacugaagaaaugauacccagcaaguuuaauaucaugugugcuaaauacgaugcaaaagucagagcauauuuguuauagaaaagauuauaauguguuuguuuuaccuuugaaugcuucaggacaguaucuuccugcucuuuacaugaccacagaugaguugcuuuaguuggagcacagacaaguuuugggcaucucauaaucucugacaaacucuaccuacaugaucaaauaagaagauaucccacuacaauuuuguucuaggccuauugcagaauagguacucaauauauauguuaaagcauaaauagacaaucauauuuucauauucuauauaagcaauucaagauguucaguauuaaaaugauauuuuaucacuuauauagauuuuaaaaaacaaaauaaaacaaagcaggaaguagucucuuugguucccgaugguuugaaacauacuauguuccucgcuaagccuucaauuuguauuccuccucccucuuacuucucaauauuagggucacagccaugcaacaacauaggaagaagccauuauuguucuuaauguauuggcuagaaaccugugaaauuugauaauucauuuaacuuaccaauguguuuauucaauuauuucagauuccuuugaaauuaaguaagaaacugauucuuucuccagaaaaacccauuguucugaaaguuacagcaagagauggagccauaaaugaaggcugauuuuguucucaaguucugauauauuccuuaauggaugcacuauaaauaccugagauuuuaauuuacccuagaagaaaaucuagaugacuauaaguguaaucugcugcacuuugcaaguugaauauucagagucuuuauuuuuaauugucuugguagagucuugauuauguaugaaaggaaaacuauugaucaguaauguauauuuucuuucauauuaaagguccauuuucccagagauaguaaaauauguuucacuucuauacugauuaaaguuuucuuauuaauauugucaaucuuucuucauugaagaaucuuuaacuucccauuuuggcugcccauucuacugacaacuacuuugacuaguuguuacuuguuuuuaaagauuuacuuacuaugguugggggaguugaguuuucuuguucuuguuuggggucuagaacuugcuauauaacucacuuuguuugaaacauggaauccuccagagugugcauauugauuucuuggauuacagccauguaacaucacacacaaaaugcauuauuauucucuuuaauuuuuauucaauuuacauccugaucgcugcccuauuccuaucaccuuccaaagucccuaaccccucccuacuucccuucuucucugaaagagagaagagccauccccaggguauccccuuaccaaggaacauuaaaucucugcagggcuagggccagguguaucccuaaauaaauauauuuagggauagccccugcucuaguuguucaagacccacauugcauauuuguuauauaugugaaugggggacuaguccugccuguguaaggucuuuuguuuguaguucagucucugagcguccccaaggguucaaguuuguuggccacguuguucuuucuauagaguuccuauaccccacagaauccucaauucucaauccacccccuaacucuuccauauugguucccaaacucuaucaaaugcuuggccauggaucucugcaucugucuggguaagcugaagagaagcgcaucuaugagaacagccauggcaggcuccugucuaaaaacauaauggaguaucauuaauacugucagauauugcucaugggauaggcuuuuaguugagcccacuauugcuuguccauucauucagucucugauccaucccccauuccugcauuuuuuuuguaggcagaauaaauuuaggguaaaauuuuuguggauaggcuauugucccuaucgcucuguugguguuccuaccuggcuauaagagaugaccucuucagguucuauauccccaacucuuugagucacaacuaaggacacucucauugauucacaaguacauagggacacagguagagaaguuucuuuggaccaggcuuuggaauaaguaagacacaaccaccauguaagguguuaggguacauagagccugcagccuccaccacaggcagggguugaggagguuggcaggcauuaguugauaagguuagggcaggagauucuuugcccagacauuguguuaucuggguauuuuaaaaauaguaaaacugucagguguuuuccauccacaggacuaagcuggacagcaggauaaagagagcagcuggggcuguuguuggcaguuugcagauacagcugcugaggacagaauacagaccaagcuccugggaagauaaucucagggcuaagccaagugugcagccccaagccaagaagcaagucuuuuuuuccugguuauaaagucuagguuggcaucuguggguuuucagggauugcuugcaguauguccagucccuucuaucucuuacaguuucuaaugggaaguugguugucauucugguaggacugcauuugcauauuacauggcccuuuucccuuguuccuuguaauauuuuuucuuuauccuuuagauucuguguuuugauuauuauauggcaggaggacucuauuuucuguuccagucuaauugaugcucuauaugcuccuuguguguuuauagauaucucuuucuucagguugggaaaguuuauuucugugauuuuauugaaaauaguuucuagccguugaagcuggaacuuuucacuguuuucuauuccuauuauucuuagguuaggucuuuucaugguacuguagauuuuguggguguuuugugugagaaaaauuuuaaauuuaacauuuucuuugacugauguaucaguuucuucuauugugucuuccaugccugagauucucucuuccaacucauguauuucuguugaugaugcuuucaucuguuguuccuguucucuucccuggauuuuucaucaccaggauuuccucaguuuguguuuccaccauugguucuauuuccauuuucaggucuuucacaguuuuauuuauucccuucaucuauuuuauugcauuuuccuacauaucuuuaagggauuuacuuguuuucucuuaaagugccucuauccguuugauuguauuuuccuauauuuauuuaaaggauuuauucauuuccucuuuaaaugccucuaucaucuuaaaaaguuuggauuuaaggucauuuucuuguguuuugguuguguucagauauccagggcuugcuguaguggagugaagugucauauuucccugguuuuuguugguuguguucuuuugaagacuuuuagucauuuggguggcuuuugucccugauuguuccuauuguaguagguauuggagggaggucuaaucuccaucacccugguguggcaagccucugauguaaaucuccgugcugaacagcuccagaucagcaggucugaugaaggugaucuagaguuacugggauaauagcaguuuagcugggauagaaggcugcucagggcggcugggggcacuccagaagacucagcaaguaagggauauugaugcaggaaaggaacauaaccuguaugcuucuggaucagcaagucugaugaaguuaggcagugagguagcaggauaauagaggucuacacagauaguagguggcucagagaagcugggggugccccagaguacucagugggccauguuauuauucuuaaaguauuuguuguuacuugauuuccauugaguuuuuuuauuuauuguguuuucacauacgcuugcaacuguugcaggcccuuaggaaauuaaguaagaaugcauguauuuaucuauaaaagcccauucugcuuaauguucagucaagagauugaagcauagcuguaaauauugcucagauuuguaagcauaagacuuuaggcuggauuuugagaaccucaguaaaauacacagggagucuuggguaccugcaacaccaggacugggcagguauuuacaggcagaacccuguaucucauuaucaaccuauucuaaauaucaaaaaauaaauaugaaagaaaauugaaagacagucauauguaucagaccucacgugucuauaugaaauguauauacuacccauauacacauucacauauagagacacuaacauguauuccagacauauagacaaaauauacaucacauaaacaacauaaaaugaguaaaauaaaaaucuggagaagaaaggaaggaauggaagagagcauagagagggaaaaagaugaagaagaaagagaaaagggaaauagaggagggucaaagggacaaagaaaauaaaaggguggaggggaaaaggaaggaaggaaaacaacaaauaauuuaguuuugaggaaugaucccaugucugguauacaauaacaacauaaaauaaaaacaauaauuaugucuaaguugucacauuuucacagccaugaagguucacuuacauuccugugcagaaacuuccauggaaguauacaaaguuugcauuguugagcauccuccaacccauguuuauuaguuacauuccuaaugcugugaccaaacacaauuuucaaggcaauuuacaaaaguguuuaauugggauuuugauuucaacgguguaagguccauaaugguuaggaaaauauuguggcugggcuuccaaccuccccauggcucucugcaaugucuuucuagcugcuaguaggaugguccauuaaauccuaguuauagcauucaacaucuaucuacuccaaaaucccagaguuuacagauucauuuaaaagcaauguuggcaagccuuccacaggaagugcccacucccugguagcacuuuccuucuuaguuacuuuuuuauaacugggucaaaacacuguaaucaugaaaauauccaaaauaauacauuuaauugggcuuacacuuccaggggguuaaagauuuugguagguuacaacaauguggaaacagaaacagaugagaagucacaucuguaucuagaaaaaggagauagagaggacacugggaaugacucugucuuuugaaaccuaaaaaccuaugauuugugccauacuccuucaacaaaguugcacuuccuuuuccuuccaagaguucaaccaaauggagaauggauauucaaguauuugugacuagggggggaauuuuuaauucaaaaauacuaacccauguacuucuacaucucaauaguucuuucacugaacuuguccugccucuacagacauuuuacaucaaaauaucucugugaguccccaguuuucucucucuuagaauuuuuuacguauccuuaccuuacucuuauuucccuaucaauucaucauagaaguaacagugaaguccuaauucaaacacuugaaagugguccugcaaucuaugaauacaacauaugauuaauaaacauagaugauuguguucuuuuuuuauuagauauuuucuuuauuuacauuucaaaugcuaucccaaaacuucccuauacccucccccugcccugccucccuacccacccacuccaacuucuuggcccuggcauucuucuguacuggagcauauaaaguuugcaagacuaaggggccucucuucccagugauggccgacuaggccaucuucugcuacauaugcagcuagagacacgagcucuggggguacugguuaguuccuauuguuguuccaccuaugggguugcagacuccuucagcuccuuggguacuuucucuagcuccuccauugggggcucuguguuccauaaaaacauagaacacuuuacgaauuugcaugucauccuugcgcaggggccaugcuaaucuucucuguaucauuccaauuuuaguauaugugcuacugaagugagcacaauuguguucuugaaauagugauuuuguaaaaugaguuagucagagaucaaggaaaaucauugggguuggucauaccauaguguuaaugacaacccugaccaaaugccuaaaauguuauggauaucuguuuacuucauggauaguggguucauuguucaaauaauggucaaagaugacaucuugcgaacugaggugauuuuaugacugaacccugugacccucagauuaaacaaccucaugaacucaaaaaaauuauuuccagugguucucaaaguuuuuugcuuguuuguucugguauaugaaaucccucucuuuccuuuuaaauugggauuauauaugaaauuuuuauuuuaugugcauaugugggcuccaucucaagucacugcuuggggauggaguuucggaagagcuuucaggagucagguaucuccuuccacugcaagagaugcacaauucaacuucagcuugucagacuggaugucagaugaauuuacuaaaugaaccaucuuugcaaauccauagcuacuuucuucaauuaaaauaaccaagaauagacugacuuauagaagucaaaauaagagagcugaugagauuuccuuuauuuaaaaguauuauuuaagaaaaagugauacacacaaacaugaaagcauuaaaaugauggaagaggauagggcuuaccuaggauuccaacaucuuuaugcuauuucaaagucuagguugagccaagaaaugcucuucuaaacccuuucagaauucuuugcauuguaaacagaaguugaauauauuuuuaaugcuccuucugaaauuacuacaaagauagaacuuuuccucuuuauuauguaucuugugauaacucuacacagguaacugaauuauuuaaauuuuugaaaaauaaaacaauuuuaagacauuaaaaauuauauugaugauuacaccagaaguuuagaaguucucucaagcuuuuggauuguaggauuacuacuacaaaauaauccuucuacuaaaagcuaucuacaggcuccauguaauacccaucaaaacauaucaaacacaauucuucacacauuuuuuaauguucaacuucauauggaaccacagaaauauauaaaagacacauauauacauauacacagauacacacaaauacacacaauggcucaaaaacuauaaauaauacaaaugauuagagguaucaccaucacagacuucaaacuauaggaaugaaaacagcaugccacacuacugccagcaacuggcagaccacauggcuccagcugggugauaucaacuuggcggucuuucugggccagagcuccugagucccuuggcagauugcugccacaccagcccaacacaauuacccgguggucagccacccuaccacccaucaacccaguagaaacaaaauucuugaagauuauaauuaaccaaucagauuuauauaucaauaaauucucaauuuacaagaugccaaaacaauuucagaaccaguuaauaauaauagaagcuccuuagaacugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugucgggccuagcaaacacagaaguggaugcucacagucagcuaauggauggaucacagggcucccaauggaggagcuagagaaagaacccaaggagcuaaagggaucugcaacccuauagguggaauauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaguguaaaugagcuaaauaccuaauaaaaaauggaaaaaaauaauaauagaagcuguccaccuagauaagacaaauaucccaaucauucuauucuuuaauaucauaacuaccuguggcuaauuaaagccaugcugguucagguuuuucuuguucgucuacuuccaucuuggccucucccccucucccuuagaugcuuucugucccuauaacucuuaggucugccucccuuuucccuguccaaucacagaccucuugcugcucuuauauuuuagucugauuggacagggaaaauccugucacauaucacccuuucuguuuaaauuaaaaaauaaaauaaaauaaaacuuuucuuucaaaauauaaauugagcaaaacuauuaccauuuuguaguuuauaagauacgagauaaaccuaacacccauuccaucauuuaugucaauuaaauacaaccucugucaucuauccuaacuuaaaagauuuauaauuuuacgucagacuuauguccuuuagauugcaagccaucugaaaauccuccucuaaaaucuuuucucucaaaguaaauagccuagguuggcuaugagacuauauaguuuuucaaccccauuagaaauccaagaauaacuaauauuaccugacaauaugacaaaauauagcuuccaaaauuuagugaauuuauggagaucacugaacaccuggacagucccuuauacuucaaaagguuguagcauuggucuucugccuucugguccaggaucauuugacagaccuuagagaaacaggaaauuaaggacuagccccuucuaucucagcagaacuaagcuuuccuaaccuguaaauuuugucccauuucuggacaguauuaugucuguagaugagaugagguauuucuuuccuaguggcugucuugucacuacuggaacaacuccauagaugcuccauuucuccucugaauccaagaaagggaacgcugucaagaucagacuugucucaacaaguaaauaaauaacauuaaaugucacauucuguggauuucugacauuuuugaaaaccaacuaucuauguaaaguaaccuggacuguuuucugcuaacuacucucagcuauuucuaauuaaaauaucugaaaacacccugacaauaaacucagagccacgaauuugcuauuugguccuuaacucacaggcuuaaccaucacagauaaguucauaaauacaguaauagaaggacugggucuaagaccuguacuuuaaaauuuuuaguaucaauagaagaauuuauagcaaugaaaaccugauuuuaagaaauuacaacuucagcuuaauaaaaauuaaaguguuuucuacuaaaugagauuauggcuaugcauuaauuugagcuauuccuccauguuucaauuaugaucauugcuauauugucuagaaagaaaaccuauaauaacugccuccagccccaaagcucagggaacugggcgauaagucuacauaacuucuuaaagcugaauauggguguugagauauuuugaagaggugggggagaaugugcaaauuuauauaaccacuuagaaaauuaauuugcugguuucacagaaaaccuaucuaucucaagacccaguuauacuacuccuggguauuauacccaaaacuugcccccccaaaaaaaccauccaauaggaaagcaucaguuucuaacacuauuaaugauacuuugcuaugcuuucagacagaagcaaguaguccucugagaggcuccacccaucagcugauucagacaaauacagucacuuguacccaaacaguggauggagacuggggauucuuauggaagaauagaaggcaggauuguaggucccaaaggggauaggaacuccacaggaagacgaaaagacucaccuauccuggacccuugggccucucagagucugaaccaccaaccaaagaacagacaugggaccgaccuaggucuaccagcacauauguagcaaauguacauguuggucuucauaugggucuggaacaacaugaacaagggguaucccaaaaccuguugcuggcacaugagauagguucucccagcuuggcuuccuugccaagacucagugggaauagaauaugccuagccucaaagacuugaugagcuggggaugggagguggacaggggggacaagcagggacagggacagugagagggauguauacugaauaaauaaauuaaaaaaaaaaaaaaagaagacagacaaccugccaccuuccuggucagagcacagcccgggaggcuucugccucacguuccgcgggggucaccuugguuccgagaccccgcggccggcggucugcgggugagagugugaaacacagaggccagcagcuucuggaacgggcgagagccacagagccucugaggcggcaccauuuccggcuccggacaaccggccaccuuccuggugagagcacagggguccacccagcccgagaggcuucagccucacguuccgugggggccaccuugguuccgggacuccgcggcgggcagucugcaggccaaagcaacacagcuucugggaaaaauccuguuuugggccuucaucuucggccaggaggagguccaaacaccagauaacugugcaccucccugaaagaggagagcuugccugcagagacugcucugaucacugaaacucagggaagagagcuagucucccuggucugcugauauaguguaacaaaaucaccagaggaaaaaucucuaaacagagacaacuauaacaacuaacucuagagauuaccagauggcgaaagguaaacguaagaaucuuacuaacagaaaccaggacuacucaccaucaucagaacccagcacucccacuucgcccaguccagggcaccccaacacaucugaaaagcuagaccuggauuuaaaagcauaucucaugaugaugguagaggacaucaagaaggacuuaaauaacucacuuaaagaaauacaggagaacacugcuaaacaaguagaagacauuaaagaggaaacacaaaaaucccuuaaagaauugcaggaaaacacaaccaaacaggugauggaauugaauaaaaccauccaagaccuaaaaagggaaguagacacaauaaagaaaacccaaagugaggcaacaguggagauagaaacccuaggaaagaaaucuggaaccauagaugugagcaucagcaacggaauacaagagauagaagagagaaucucaggugcagaagauuccauagagaacaucagcacaacaaccaaagaaaauacaaaacgcaaaaagauccuaacugaaacauccaggaaauccaggacacaaugagaagaccaaaccuacagauaauaggaguugaagagaaugcagauuuucaacuuaaagggccagcaaauaucuucaacaaaauuauagaagaaaacuugucaaaccuaaagaaugacaugcccaugaacauacaagaagccuacagaacuccaaauagacuggaccagaaaagaaauuccuccugacacauaauaaucagaacaacaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaauuccaucccaagcuacuauacccagccaaacucucaauuaccauagauggagaaaccaaaguauuccacgacaaaacuaaauucacccauuaucucuccacgaauccagcccuucaaaggauaauaacagaaaaaaaucaauacaaggacgggaaccacgaccuagaaaaaacaagaagauaaucccucaacaaaccuaaaagaagacagccacaagaacagaaugccaaccuuaacaacaaaaacaacaggaagcaacaauuacuuuuccuuaauaucucuuaauaucaguggucucaacuccccaauaaaaagacauagacuaacagacuggcuacauaaacaggacccaacauucugcugcuuacaggaaacccaucucagggaaaaagacagacacuaccucagagugaaaggcuggaaaacaauuuuccaagcaaauggucugaagaaacaagcuggaguagccauucuaauaucggauaaaaucgacuuccaacccaaaguuauuaaaaaagacaaggagggacacuucauacucaucaaagguaaaauccuccaagaggaacucucaauucugaauaucuaugcuccaaaugcaagggcagccacauucauuaaagacacuuuaguaaagcucaaagcacacguugcaccucacacaauaauagugggagacuucaacacaccacuuucaucaauggacagaucguggaaacagaaaauaaacaggggcacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaacagauacaaaaauauugaaauugucccaugcauccuaucagaccaccauggccuaagacugauggucaauaacaacauaaauaauggaaagccaaaauucacauggaaacugaacaacacucuucucgaugauaccuuggucaaggaaggaauaaagaaagauauuaaagacuuuuuagaguuuaaugaaaaugaagccacaacguacccaaaccuaugggacacaaugaaagcauuucuaagagggaaacucauagcucugagugccuccaagaagaaacgggaaagagcacguacuagcagcuugacaacacaucuaaaagcucuagaaaaaaaggaagcaaauucacccaagaggaguagaaggcaggaaauaaucaaacucaggggugaaaucaaccaaguggaaacaagaagaacuauucaaagaauuaaccaaacgaggaguugguucuuugaaaaaaucaacaagauagauaaauccuuagcuagacucacuagagggcacagggacaaaauccuaauuaacaaaaucagaaaugaaaagggagacauaacaacagauccugaagaaauccaaaacaccaucagauccuucuacaaaaggcuauacucaacaaaacuggaaagccuggacgaaauggacaaauuucuggacagauaccagguaccaaaguugaaucaggaucaaguugaccaucuaaacagucccauaucaccuaaaaaaauagaagcaguuaucaauagucucccagccaaaaaaagcccaggaccagauggguuuacugcagaguucuaucagaccuucaaagaagaucuaauuccaguucugcacaaacuauuucacaaaacagaaguagaagguacucuacccaacucauuugaugaagccacuauuacucugauaccuaaaccacggaaagacccaacaaagauagagaacuucagaccaauuucucuuaugaauaucgaugcaaaaauccucaauaaaauucucgcuaaccgaauccaagaacacauuaaagcaaucauccauccugaccaaguagguuuuauuacagggaugcagggaugguuuaauauacgaaaauccaucaauguaauccauuauauaaacaaacucaaagacaaaaccacaugaucaucucguuagaugcagaaaaagcauuugacaagauccaacacccauucaugauaaaaguguuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauauaauaguauauauaagugacccuacaaauuccaccagagaacuccuaaaccugauaaacagcuucggugaaguagcuggauauaaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuauaugauaaaaacuucaaaucucugaagaaagaaauuaaagaagaucucagaagauggaaagaucucccaugaucauggauuggcaggaucaacauuguaaaaauggcuaucuugccaaaagcaaucuacagauucaaugcaauccccaucaaaauccuaacucaauucuucaaugaauuagaaggagcaauuugcaaauucaucuggaauaacaaaaaaccuaggauagcaaaaagucuucucaaggauaaaagaaccucugguggaaucaccaugccugaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgcaucgauccauacuuaucuccuuguacuaaggucaaaucuaaguggaucaaggaacuucacauaaaaccagagacacugaaacuuauagaggagaaaguggggaaaagccuugaagauauggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacugauugggaaaggaucuuuaccuauccuaaaucagauaggggacuaauauccaauauauauaaagaacucaagaagguggacuucagaaaaucaaauaaaccauuuuaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcugguacaaccacucuggaaaucagucuggcgguuccuuaggaaauuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacauuaaacucaagaaaaaugaagacugaaguguggacacuaugcccuuccuuagaauugggaacaaaacacccauggaaggaguuacagagacaaaguuuggagcugagaugaaaggauggaccauguagagacugccauauccagggauccaccccauaauuagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaagaaucaaggagcuaaagggaucugcaacccuauagguggaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguagggggguggggguggguggguaugggggacuuuugguauagcauuggaaauguaaaugagcuaaauaccuaauaaaaauggaaaaagaaaagaaaagaaaaaaaaagcaaaagaaaaaaaaagaaaaaaaauaaaaaauaaaaaaaagaaaaaucauuaauacauaaauaaucauauucccaucacugcacacuggcaugucugcuccaucacaguaacugggcugacccagagaagaauuugaugaaacucaaccugaaguauuuucuggagcaggauuuuuuuucauaaaauaaugcagagaguccuccaguggugagaaagcccaauauucugggcaagugguuuguacuggcuaguuuugugucaacuugacacagacuggaguuaucacagagaaaggagcuuuaguuggggaaaugccuccacgagauccagcuguaaggcauuuucucaauuagugaucaaggggggagauccccuuguggguggugccaucucugggcugguagucuuggguucuauaagagagcaggcugagcaagccaggagaagcaagccaguaaagaacaucccuccauggccucugcaucagcuccugcuuuuugaccugccugaguuccagucccgacuuccuuuagugaugaacagcaauguggaaguguaagcugaauaaacccuuuccuccccaacuugcuucuuggucauaauguuuuguccaggaauagaaacccugacuaagacaugguuuucuuaucuaauaucuccaccccagucugauuucaccauauuccuuuuuuaaaaucauacccaauaucaauauagauuccugguuuucucauuuuuuacaugguaugugaguuucuuuguuuuauaaaccuuucuucauaaccucucgucuuucuuggaacauagacaggccugguuuacaguauugcucugauuuggcuuucugaaagaaaaggcaggauuuuguauacacuaugacugcacaacuuuaccuuucugauuagagucuauauuuagccaaaacuuucaccccuuccccuaacuuuuuguugucccuaccauguccuuucuauguaauucuccucgcauauuuucuauaaguaauguuguauuaaucacuagucccucagugauuugcaucugauuccucugcuccuuuuuucuuacuuauaccuagccaaaaaaucuuacauauaaguacagagagaaguaaguauguccuacucucuaaaacaagccaaaaaaaaaacucuuacauauaaguacagagaaaguauguccuacucucuuaaacaauugauacauaaagaauuucuaaugacuguuuuauagucaacaacuacuauaugguaauagagaucuuacagauggauauuaacugguguugaaaauacuggucacaucucugaggauggcugaggggagagcucagagaccugcauacaagccugacaauggaaauuaccaccucaagaccacuaacaccuugucuuucuuuaacacugggaauguucccaaugaaggaaggaaaacuuuacugaauuaaagcagcaacaaaacuucaccacugauguaaacacagaugggcaagucccauuucuaaaacacaagaaaccaugaaaauccaaaucaauuccccuucaauaauuauuaagcucauaauaaccccaaauaagagaaacaagcaaaacucaaguuaaaaauuaaaaaagaaaaugacuguaaguuuguucaaagaauucauauaacacaagcauaucuuauagugguugacuugaugcugcuuguauucuaaugcuaauauuggauccccaagacugauugcuccagagacguagacauaaacacuaagugacaccauuccaaaauuauuucuaauugguaaauaaggaggccaacagcucauagcucgggagaagagacauuagugugguuuugguuucaugauguuggaguuggaggagaaccaucaggaaagaaguuucaggaagagagagaagaagccaauguagguuaggagggcuaccaugagggcuguccaauugguguaaagagcaaccaaggugaaacauagcgaggaguaaauaauaacucaggguugucuauaggaaagucaagucuaacugcauagaggguaggcaacacugcccagcucuuguauuuuuaaggcuuauuguaaauguaauggauguguguuguuuuucuuugagaacuaacuaaucauagaaacucccagggcaggauuaaaugauuucuacaacaguaucuucuaaauuaaucccaagaaaacaccaaaugcagaaagaaauaaggaaauugauuuaagguauuaaaauaguuugauucuuuaaaaauaaauaaaaaguagaguuuaauuuaaaagauagagauacaaaagagaaucaaaaguaaaugaugacagaaaugaaaauuucauuaaguuauacauaauauucaguagaaaaccucacagaauggaucauguagaaaacagacaauggagucaggaagacaagagagaagaaaagaaugauuuaguugugguuaguaaucaauuugauaaagagggugaacaugggacgcuuccccagaucucggcucuaccaccauccacugccgucuuaccgcccaccauggcccuccugcacuccagccgcauccucuccgggauggcugcugccuuucacccaggccuagcugcugcagccucugccagagccagcuccugguggacccaugucgaaaugggaccuccagaucccauccugggcguuaccgaagccuucaagagagauaccaacagcaagaagaugaaccugggaguuggugccuaccgggaugauaacggaaaaccuuacgugcuccccaguguccggaaggcagaggcccagauugcugcaaaaaauuuggacaaggaauaccugcccauugggggacuggcugaauucuguaaggcuucugcagaacuggcccugggcgagaacaacgaaguguugaaaagcggccgguucgucacugugcagaccauuuccgggacuggagccuuaagggucggggccaguuuucugcaaagguuuuuuaaguucagccaagaugucuuucugcccaaaccguccugggggaaucacacgcccaucuucagggaugccggcaugcagcuccaagguuaucgcuacuaugaccccaagacuugcgguuuugacuucuccggagcccuagaagacauaucaaaaaucccagagcagaguguccuccuccugcaugccugcgcucacaaccccacaggcguggacccucgucccgagcaguggaaggagauagcguccguggugaagaaaaagaaucucuucgcauucuuugacauggccuaccaaggcuuugccagcggugauggugauaaggaugccugggccgugcggcacuucaucgagcagggcaucaaugucugccucugccaaucguaugccaagaacaugggccuguacggugagcgugugggagccuucacgguggucugcaaagaugcagaagaagccaaaaggguggagucacagcugaagaucuugauccguccccuguauuccaacccaccucucaauggggcccggaucacagcaaccauccugacuucuccagacuugcggaagcaaugguugcaagaggugaaaggcauggcugaccgcaucaucagcaugaggacccagcuggucuccaaccugaagaaagagggcucuucccacaacuggcagcacaucaccgaccagaucggcauguucuguuucaccggccuaaagccagagcagguggagcggcugaccaaggaguucucggucuacaugacaaaggauggccgaaucuccguggcaggggucaccucuggcaaugugggcuaccuugcccaugccauucaccaggucaccaaguaauucccaggugcgaaggaacagagaccacuuucccgacagccuuugcgcucgugagcgucaugugcagggugagggagggugggugguggugaauagauccgguuuccaaccacggugcacaacucagcaacugaacucgcuccucgaaagagagguagggcagaggcuuccucggcugguaucuggaacuucgucggcucuaaaccaaacucccucauccuuuugucuccagcuuuucugaaaguuuacacacgcaagaaaaaucacagcaccaaacaccugucagccauggcacuggaauaggucagacgcuuuaccuaaagccucaggugguaucaggggcucccccguggaccccgguagagccucacguaauagaggcuguaagagaaaaauaacuaguucugucauuaacaguuguccucaaguucguccuccugguguggagcaaacugugucagcagaccacauuacagaaauuaugcuuuacaaaaaccaacaggucuguugccacuucaacagggacaguagaagauguagugucguguccgccugccccuugucauugcuguucuagagccuagagucucaucccguucuacugcgaacguccgccucagccuauggggggaguuacauaagaauggagagcauagguuuucugcuccugcauagccuccucucucaucaaagagccguggagagagagacccugcccuugauuucagaguccucuucagucauugauugauuggcuccuacugggauggggccucugcccagcuggaccucuucauccauccuggcugcacagccugucucuucacaugagucagacgugcaggguaggaucagaaggagauacucugggguuugugugcugccagcccggcucagacuccgcccuugggaaagauaaccaccauccgcucuaaucauguagacguacugccgccugguuucucuguuacaauaaaauuacuauagagccagaaaaaaaaaaaaaag

SEQ ID NO: 2759 - RNA, 17219 nt, Mus musculus
accaauaguugccucuagaccuauaagcagacucaaggcaaagcaggccccuagaggggagguagaaaguauaguccucgaggaaguaugcuacacuacaaaggagcuuugugaguuugcuaagucauucaaacagaagucuguuuuauuucugugaagagauaccaaguccaggcucuuucuccuccuuuccacguguggaucaggauguagcucucagcuaccacuucagcaccagguacuucaccaugcuccccacaacugugauaacaauaauaacagacuaaccucugaaacugucagcagccccuccuauccccccucccaguuaaaugcuuucuuuuauaagaauugucuuggucauggugugcaccuuuguuguucaaaaucaagugaccggccccgaaauuauaaacauagaggaaaugguaaaaauaacucaucagguuaauauagaaaagaccaugaauuugagauggagagagggaggggauaugaaaggguuuggaggaagaagacaugguaagaguuggagagaggaaaggaaagaaagaaaugauguaaauauauuuaaaagaauuuaaaagaaaaaccccauauacaccaguaucacucaaaggaaaaaaaaaacuuaauuauuuucaucacaaaaggucacacacuuaagacaguauauaauuuuugccuugaauccuuuucuaguacauuuuggaaaguccagaccgucacagcuguaccagaaaaaaggcucuagguaagccugaaauagaacccagauccucauucuuuugagcaaaccaugugaccuagcuuauucgcuauaaauuauggaggcagacacuguacauagcaagcuuuguguguguguaaaaucacgccacacguuuaugugauuuuagguauaggaauauaaggaauaugcugaguuucacaagaaacccucugucuuaaaauuagcugcagccaagaaccugucauucugagcuccuacagcugugcguuggcgccaucuacugucacucaaggggcuggacccggagcccuguccaaucggaggcacugaguugagaaguguccaaucagacacacagagggagggcggggggcgggcuuuggcugucaccgguccuuugucugggagccgccaucuugggcucgguguuccugcccaggagccuccugcgcagcuuuguuggcguagugacgcugugggugcuggacgauggugggaggacaccagcgucucgcagaaguggacuuggugagugugcgggugguguccggaggugauggcgcgggagcugggcgcgcuguugcggaacggggucugcagucaggccucgcgggcgcucgcgcuggauccccggggcugugggacugcucgagcccgggcguccugucccuccggaugcggugacuucagcgggcucugggcuacucugagaaggcugcuugguucccgcagguuguguuguguuggguucuuuuccauuccgucugugaggcuuuuucuacgagagugaguguggcccaccggauacuuaguuucuccuuccuucuuaugagccugcugguuuccucuaauuuuuauagaggguugggcauccagucucaaauccagaauccugaaugccagccccgccccuccauauucuuuauaagcguucccugccccuauauuuaccuuuuugccuauuuucucaaauaccaacuuccaguuuccauuauguuaacuguuauucauuguacauuucaaauaugcaguauuguauaauguaguuuuuuuuuucaauuucuagaguacuagagaaaaguacacucucaagaacuuuaaauuuuuuuuuuucuguuugugaacacaucacgaaaacagaaaggaaaacaaaucauuugacuccugaacauugugggaaaagucauugaguuuuacaugaaugcucuguuaauguguuucagcaugcauauuaccauauagcaacaaaauggaauacuuguuaacuauuugcauaccaaaguaucugagcauaacaguuuaguuuuguuuuaaugcuggucauguuuacaaauguccucaaaaguucgauuguauuuuaaguuguuuaugggcucauccuuggggcaucuuuaugcacaguaggccaugucuggaauucaguucaaucaagaaccaacucauugccaaguugagcaaaugauauuauuuagaaaacauagguaaagaccaaaacaccacaacuuaguaaguaguagauuauuuuacuuauauguaaauauguuuauuugugugauuguuugccauuagcaugcaguaccuuggaggccagaagagggcacuggacccacugcagcugcuguaacaaguugugaggcaucugggaacugaacuuggguccucuggaaggcuggcuuuauuaagaaucaaguauucuuaaauacugagccaguucucgagcccuaagauuuuuauauuaccuaagacugacuuacagagaagucaacaaaagaugaugguuuaaaaagucacggguuuggcccugcccucacauugcauacaccugaagaacauuaaagaguauucauuucuaagugggccaguauagcgauucauauuucauugacucauugcaacuugaauuuuggagauuuuaagucuuucuggggguuaggaaugggaguucaggguucuagaaacauuuucaaugugcuacaaguauuaguuauauugcaggaucaaugucaaguguuugagaacagcuuugcuuagugaaagggaaagaacaaauucaggauacuuagcuguaucuuucuccacauuccaacaagacaaaaugcuuuguagaaucaugucuucgggucacuuucacaguaagguguuccaugcaccgugauuuguauuuaucuacagaaaucauaagugaccuauaaguacuaaaagugaagaaaauaauaauuggugugccugugggagcauuagccauguuugcagauuucuccugagaugagaagucagaaacagacuguugcuccuugauuucuuggguucugcuauuagaacaaguguccuuuauggaggacugagaaggaccagaucaaugaccggaggagacuuguuguuuaguggugaccauugguuuugguugucagguugcauuugguucaaguccuggauccaaguuuuuuuuuuuuaauuuuuuuuuuuuauuuuucauuuuuaaggacuggagagcuggcuuagccauuaaagguuacacaccuuuaccacaauacaaacagcgguauuuuuuauugauucucuaacaguuucauacauggauacagagugucuuaaucaaguuaccccugcuccccuuaggcacccccaauaggcccuucuccuacucuuauuguccccuuuauucauaucacccagagucuaauuaguuaggccagcugccuaauaccuguugggagucccuugacuuggaacagguacagaaaccucaucuacaagcagaggcugagugagagugagcuuugaaugucagcaacuugccaggaguucucuguccauaaccaggacagucccauugaaaggagcucuguuuccuaaaccuucgauucuggcugcuugacgcauugcuugugaggcugucaaugggaaagugcaggucuggcgcccgcccgcacugcagagguccuggagagcauucacccgucuuucagaucccugcugucugaauggaggaccacaguaggccacgggaggaggagaaucaagaugcugcaguugacagucaggugacccucugaagcucaucugccucuucaaccaucagguaagugcacauaccaaaaagagcccaccugauccuagccuaaauuacugaccagcccaaucauauuguauuuaaaaaauuuugaaggggcuuguuaccuaguguagauaauuaucacccccuacgauagacaggauuccaaacuuuaaugacucuuuguuaauauuggcaaagcaguagguacuuuauagguagugguuuccucuaacugaaagaugagucacauggaaaaaauguagacauguauacguaggauugguguucaacucacaguaccuguuaggcuggcuuuauuaauuuacggguuggugacucugcuguuacuuagggccccaaaggcagccccuccuguacaauggaaggcacuggguugaggaaucaggcagaugaacaguagggggcaaguuuucccagucucgcuagggccuuuuacucugaagcucgccaucuugggaugcgucccuaggcucagucuccucuacucuggaggucuagguggcugugcuguagacucuguuacccugugacgugcuggugcggggaguuccauagggaggacgcuccauguccuggaagccagaaauggugagugugugggucaguguuuugaaccagggucuauaauugguggggaucauuuguggcucuggagucuacaggucagaagccuguacugagucacugggccccagguccccucucucuguggggugggugaugggcugguaauugggacccagguggccugucucauuccugcaagaggacuucaacuccuguuggaacucuuugugccguuaguucccuacugaccguagggcagcagguugggccaucaaugggcacaggguacauucuguucuguuccaaaugauuaaaaaaaaaaaguuuuuaaaguaucaugacuuuaacauuuaguacaaaugauacaacuuuaaaaaauuguuuuacgauuucauacguaugcauaguauacuuugauuaauacccuauuguccuuuugucauugucccuucucaccgaauauuccuucccaacaagaccuucucuuucuuguuuguuuguuuuugaauuauuuuuaauuuauauuuuauauauuuuuaauggcccacugcauuucaguaggguugcuagcgugaguguggcugggggauuauugacugcaaggauacuuuaaucagaggcaauacuaaggaauauuaaacacuuacauucugcucauacuucguaaggaaugguggagccuuaugagacccuccccuacccaugauggauugcacuggguccccucuuguguagguggccacugucagccucuuuuucccaaggcuacauggccuacuuguugguguacuuuuggccuuuggccuccuuccacucuguguugcuugagcugaggccacuggccaucuuggcuucucacugcccugucuaucucucucacugcccugucugucuguuucacugcccugucugucuaucucacugcccugccuaucucucucaccucucugucugucucacugcccugccuguguaucucacugcccugucuguguaucucacugcccugucugucuaccucacugcccugucugucuaucucacugcccugucugucuaucucacugcauuuucaacuucaagucuccucuuuucccaggauucuucuccucuguucagaauaaagucugucuuuuguugccaugaucuucucgcucuucggucaccucuagacaacuucuguuccucagccugacccaagaaguucccauuuucaaucaauuuuaacuuucuuuuuuacuugaugucuuuuucauuguaggacuuaaagaauugugucaaacuuggaacuucacacaucuuagcucacugcuaugaacuccccaccccacccccgccccgaacuagagguggcagcuuuuaauuuauuuuaaagcauaaaagauaggaacauagcuagguuuuaguccugcauguccucagaugucuacuggcuccuuguuccucguuacccacuauacacuggcacgcuuacacugucuagucauaacuguggauacuuuugcuaaauguaauggccacuaccugagauauacugcugucauuuuuguuuuaagucccuaugguaagcacagggcaugcuaugcagcacuuauauuaugucacaccgcuuaguagggcugaagugccauucuuauuuguaauguuuguugaguuuuaauuagcauuuaggacaguguauaacagcauccuuacacuguuuguuauuucagaugauuuucacuaugaugauuaauuuuccaauaagaucagaagcaauuuuuuuuucucauacuaaucugucaucaggagcauagagcauuuacuucuccgacucauaguaccagagaaaaaaacauuuuuucccucuguguaguacauucucaaaucucaugacacagggaaaaugugaacguguggaugauacuccugacuucugcuuagaagacuguacaucacuugcauucacagugcagagggagcccagauagcaaaggcagacuucagguuggcucaugugaauguugggauccuucgguauuuuucucugguaaagccaugauaaaucagagcuaugauaguugaaguguugcccuuuuucccauaaccucucuauugaagccuauauccaaauccacaugccaacuguaugugaagauagggcuuauagcaaguauuuaguauuaaauaaggaaauauguguggggugcuaacacuguaugguuguacuucccucauccaaaagaggaggaaaagccgggugcuagcacaguguaagagcguuuaucugucaugcccaaagcuacaauuugaaccuuagaauugaagacaugaaaauaagaggaagggagaauuaacuuguucuuaaagacacucugauuaggcugucaagaagggagacuuuauuuguuauugucuggacauauucuuaugugugaacauuuucagugauggcuaaucuugcuugucaacuugacauugcugggaagaggccacuucaguugagcaguugccucuauuagauugaccuguggucauaucugucaagaauuuuauugguugcugauugauguagaaaucccagcucacugugggugacacgauugugggcaaguuggccugggcuguauaagaaagacgauugacuaagcuagagggagagagccacuaaggagcauuucucuguuguuucugcuucuguuccugccuacugguuccuauuugaguucuggacuuaguacccuuugaugauggacaauaucuaagcugaaggguguaauaaauuuuuuuucucuuaaaguugauuuugaucagaagcaaauuaaaacaguuugcuguguuauuauuuauuugcuuuacugggugucgaaaccagggcuucaugugcuaggaaagcuaccgcugagcuacagucccagccuuuuugucgccuauagaguguguuuauucaaucauacuauuuggaaucguguccagggacuucucuuuggauuuuagguauaugcuagguacaugaagaugauagucuuccucauuucuguuucauuggauuugcaaguucccauuauagagugauaaauguuucugccauugggcauguuaccucugcaguguugugaguauuucuuagggaggcaucaaguucuauucacccagauaacacaccaaugaauaggugaaagaaacuauucuacccaaguccugcucagugagcguuacuuagggcuccuuaauaggagcacuguuaacucuuaagcagcuacuccacggaagggaaugucucucuaauugucuguacaucuuugagaaggguuggagccccucuccuuauaacaacugucucuaaaucagaggucagaguuaaugauguagcguuaccuugguucauguuaauuuacauauugcaugccuccuuuuagacucuugauuuaggaaauggguaauaguuacuuuuauguggaugcuagcaguagcaguuauuuuuguuuaguaagacaauacaggauuggccguagcugcaguuauuuuuuaaagcagguuuaauuuugaaaaauuuuauguauauggguguuugaguguuuuacucacaugucucuguaacaugacugugcauggggcccuugaacaccaauagaucuucugaauuggaguucuagaugguugugaccuaccauguaggugcagggaauccaaucuggauuccuuggaagaacagucaguacucuuaacugaugagccaucucuccagccuuggacaguuacuuauguauauaaucgacuauuaacauguccuugacaauaaacuguuauaauuacuuagauacaaaaauuacuggauaauaaaugauuugaacauuuacugauauuaauacucacuauaugagcauucuuagacacaguauucugcauaguucuguuaagccuagcuuugugguguuauaauuggacuucuguuacuucauuuucaugagaacacauacaugaaaacauuugauauuucugucuuuuguaaguagcauaugcuuucuauuuucuacaucacuguccuguuguacauagaacauugccucuuuuuguauacaucagcaauauguuuguccuugugucuuuggacuauauuaggugcuuuucugaggagaauuuuauuaauccauuuauuccuaguaauaaggauuguucagcaucuuuaaggaaaacuggauaauuacauuuucuuuaauuauuaaauucauguauagauaacauaauacuuucucccauaauacagaauacagauccaauuuuguguuauguaagacagguauccacauagaaugaugagcucaggagaaaugugucauuuacaggggcuggugucauuugaggauauagcuguggaauucaccuggcaggaauggcaggaccugaaugaaggucagagaacucucuacagggaugugaugcuggagaacuacagcaacuugcuguucuugggugaguggaagauggaauauaagcugucuaucaaaacuaauuguccucaucaugggaugucuccucaaaugaagauucuuucuucucucugccuggcuuagaaggcuaauaguuuccauuuacagggcacugcaaaaccaaaccggagcugaucuucaauuuggagcaaagacuugggucauggauuguagaagccucacaccagugugucccagguacgucagugcauaguauuuagggauuaagaugaugagaacuaaucagauacaguaacaaucuaucuccaugucccaguccuaaagauggcuaaucucaugauuaagacauuugucuaauacacugucugacuuaguuaggguuuuacugcugugaacagacaccaugaccaagacaacucuuauaaggacaaccuuaauuggagcuggcuugcagguucagagguuuagucuuuaucaugaaggugggacauggcagcuucuagguaggcauggcacuggaugagcugagagaucuacaucuucaucugaaggcugcuaguggaggucugccuucgaggcagcuaggaugagggucuuuaguccaagcccacagugacacaccuacuccaacaaggccacaccuccuacuagugccacucucuuggccaagcauauacaaaccaucaauaugcuauuuuuuuugauuuacuauaaauuuauuucccuauauggauuuuuuuaaacuuuaucugcauuuauuuuaugcugaauuuauuccugggccgugaguuuuuguuucuucaguuucuccugggauaucuuuuucuucugugcagccuccucugcuggcuuuggaacgaucuguuccuucucagugaggaucaucucacuguggcaggggagcucauguguggguuaauccguccaugagcucuguagguucguuggcgcaucuuauguucgucuggauguguucaaugacaagagaaucuacgucuaaacccuuaaguucagcguuacucucggcauuuuuaagcaugugcagcaaaaauucagcacucuuuuuuggccaucguccauguccagccccacuguuuggccugggcacaccuaccgacuccaccauuauaccgcaggaauggcacacacugcuucuuuaaagugacauccuucagauacuugguggccuugcggauaugcaaacccuugauggccugagcaguuucccggguguucuuaaagugaacgcgaagguuuggguuugaaccucuugauuugcaugauuuugugggguuuucugggucaagagaguagugaaccauuuuggcaggugaccucuggcugcuuacaggaagaggagccccuauauggaucuuagagaaagaacauauauuguuuuauuuuaggaaaagucuaauaaacugaguuguauggaaguagauaggcauuuauuuuauuuauguaauuaaacuaugagaugaguauuuuucagguuuacuacauaauaugcagguaacugucuaccaaaaccuuagucauggauauuaguaacagagauacaaauuuaugaaugagccacuuaaggcuaguauuaaauuauagguauugcugcacauggacaggugaaaucugagagaauagcguuagaguguucuagaguaaagcagcugagagaacagcguuagagaguucuagaguaaagcagcugagagaacagcguuagagaguucuagaguaaagcagcugagagaacagcguuagagaguucuagaguaaagcagcugagagaacagcguuagagaguucuagaguaaagcagcugagagaacagcguuaguguucuagaguaaagcagcugagagaacagcguuaguguucuagaguaaagcagcugagagaacagcguuaguguucuagaguaaagcagcugagagaacagcguuagaguguucuagaguaaagcagcugagagaacagcguuagaguguucuagaguaaagcagcugagagaauagcguuagaguguucuagaguaaagcaguagguucagagugcuuuacgauucucugaacaaaaagauagaagguagcaaaggacaaacuaucccaagucuuuagggcaacuaaaaagaagaaaacaaaacuauaaugcguuugugcaugccccccccccccauagccuccccccccccccgaacuauaaugcacauacacacuaaguagccuauaauuaucuccuugugcagaaaaaacccaaagcaguaagcgcaggcuaagucuggagaauguaggcagcccuagggacaacuggauagaggagaaacccacaguugucaaaaaggcuagauccaguugaguguuccuugucggaaagugacuucauuacagacuagccuuggaggagaaaccacuuagauugcucccuuaccuucaagugcuauaccuagaauccaacuugagagaaguaguugugguggcacucauucuguuuuugagacugagagacuguggaccugaaaucaagaaauaaucacacaucacagagaguauagacaugcuuucaccauuauuaauugaacaaacuggaagaccuuuuaagauaaagaucuaauuaguaucuuccaauaagaauccuaaauuuaagucuucuuaaauauaaagcagauggccagguggaauaaaaacuaagauguuacuugcucuauguagcaucuccucuuauuggccaaaguacuuaugaaccgaaaauaugaauaauauuuuuugagacaaauacuguaaaggcacuccucaguaagccauccucacaccagauuaauuuagaugggauaaagaaauaaucugaauauuuauaaaggagccaauccauuaaaauauaauuauuccaaauucuuaugcacuaaauuuugguguucuggguuccauuaaaaaaaaccaaagaagacaaguuuuagaucacgcguuagcguccuggagugaauaaugcgcauuaauuaauuaauuagcaucccuggagugaauaaugugcauuaauuaauuaauuagcguccuggagugaauaaugugcauuaauuaauuaauuagcguccuggagugaauaaugugcauuaauuaauuaauuagcguccuggagugaauaaugugcauuaauuaauuaauuagcauccuggagugaauaaugugcauuaauuaauuaauuagcaucccuggagugaacaaugugcauuaauuaauuaauuagcaucccuggagugaauaaugugcauuaauuaauuaauuagcaucccuggagugaauaaugugcauuaauuaauuaauuagcaucccuggagugaauaaugugcaucagcgacaaugcagcaaagacauccggcugaggcgacauccgcuuucaugaaugaaauacucgaguuaaguagcuaaaauaguuuauuaucaucaacagcuaacucaggaacaagauuucgcagggaaacuuuauaguugaacaauagugugcaucaaugagccugcagagacgguuuaguguauacugucccaguggcugugaaauacacaucuaagcuuugucuaaaacaaaugaaauuugaaguuguaaagcuaucucuaauaaacaaaaaaacauugaaaauaauuucuuuaaucuuuuaaaaucaaaaccggaaaugcuaaaacccaauagccagagaaauuaaagaaacaaauauguguuugaacaguuuugagugaucaguggcucguaaaaguaugggaguuaaaucuccuaggacgaaguaaacucagaaaaguaaaaggggaguguguggacggagggaagagagccugcaggcgugggcgggggaguguguggacggagggagagagccugcagguagaaggggaguguguggacggagggagagagccugcaggcgugggcaagaaaguagagaugagcaucaucacuguacaucguguucacauacaaaaccaagacaguauucaaugguauacauggauaaaaacacaauacauauuaauaugcuaaacuuagaagucacauaugacauugaguuagguaaaggaaaauucaugucauuuugguaagcaaucuaacaacuucuuagauuuuucguuuuugguaaaaugauuuaaaagcaaauagauggguaaagcauagauuaagaauuugugugguguguguguguuauccuaggauguccaguuugugcuuauuaauaugucuuaacuaucauuuuagauuuccagaauaugaguacccugaauaagagcaguccagauaccaaagcaagacacguguggcaaguugcccucaacagugaaacaucaaaggaguuggcuggaauagggaauacuugcaaugugagcacaaaccauauuucagaucagacuaucaagaaugagaacucacuaggaaugaguccuagaaaguuuauucuguggaaggacguguaucuccacacugaugcugaugagauagaaguuggagaagaaccugaagaucuuaauggaacugcagaaucugucacacaccccgagcaaguuagucuauacagguuucaaaggucacagaguuacuuucaaagucugauaccagggaaauccuucaacacaaaagcaguauuacuuacucauaaguucagugaauaugcaaaauccuuaggugauacagcauuuauugacaaagagauggcucagauaagggugaaauccuuugaauguaauguaucagagauaaacuguagcaagucugaccuuaaugaaaaugaacccacgcacaugggagagaaacauuacaaauguaguaacuuugagaacccuuuuauuauugaaucauaccuuccaaaacauaaggggcagcaugagaagcucuuuauccagaaggaauaugaguuuucucagcagucagaagugagucuucaucagaaaauccgcagagggaaaaaaaccuaugaauguaaaauauguggcaagugcuuuuauuggaaaaccagcuucaauagacaucagagcacucacacuggugagaagcccuaugaauguacagaaugcaguaaagcguucugccagaagucacaccucacucagcaccagagaguucacacaggcgagagaccauacauaugcuuugaaugcaggaaagcuuucuaucguaaaucagagcuuacugaccaucagagaauucauacaggugagaagccauaugaauguaaggaaugugggaaagcuuuuugccaaaagccccaacuuacucuacaucagagaauucauacaggugagaagcccuaugagugugcagaaugugggaaagccuucuccacuaaguccuauuuaacuguccaucagagaacucacacaggugagaaaccuuacgaauguacaguauguaggaagucauuuaucuguaagucaaguuucagucaucauuggagaacucauacaggugagaaaccuuacgaauguaagcaguguaugaagaccuucuaccguaagucaggccugacucgacaccagagaacucacacaggugacaaacgcuaugaaugucaauuaugucagaaagcuuuuuacugcacuucacaccucauuguacaucagcgaacucauacgggugagaaaccuuaugaauguaaggaauguaggaaagcuuucuaugauaagucaaaccuuaagcggcaucagaagauucauaguaugaagaaagccucugagagcaaacagucuaacaacuuuuuucugagugauacuucucaacaucagacgauguauuaugaauaugaagaaugcaagaaagcuuuccaccagaaaacaaacuuuacuuaaacauucuucuuacagcuaaggggacccugugauuggaaaacacuuauccaaaggucagaucuuacuguacauuggagcacuuauucaagggauuaaaccaaaugaauaaacggugaaggaaaaccuugaucuuuguuuguuuaucaaagaacucacaauugacuguggcagauaauuuagccagguacauuaacccaacauaagaccgauguuuaugguagaggaucacuugcacucaggcaauagaggaagacaccgugauuuaagaacaaauagggcaguuuucuacuugagguucuccugacuaccagaacccaggggugugaaaccagcgaaagugaggagugccccaaacucugaaugcaauuuggaacucauuguuggguguuuggggacaugccuguaaucuuaauauuuggcagggugaagaaagaggugaggaguuguagucuaaccuuugcuacaaagcaauuucaaacccagccugggguacaugaggacuuuuuuuuuuaaagacaauugauuaaaaauaagaaucugagaaucuaaacuucacaaaccauauaaaggggacaaaggacaauacagaucggguuaaauguugcuauaccucacuuccauuugaaucagagaugcuauaagaguccuauuugugugaauuauguggaaacguguggaacuuuguggaaauuacaugacccugagcuucacucauaagaguccacuugaauuuaggcaguuaggguuguggauguagcucagugaaguguuuggcugcuauuauuguaaccugucuuucauauaaauuacacauauuauaaauauuaucaccuuagaggcuuuaucugugcaugcacuccacagcacauagaucaaggucagaggacaaaucccaaggccaguucucuucuaccuggcggguucuuaguaucaaacgcagguuaucaggcuuggcagaaaacaucuuuacucucugagccaucucuccugcuuuuguauuuuauacuuaacaacuguuguaaguuacaaguaauucuggagguauuuucaccuaguccagaaugcucuacugggaaggacaggaaggacauuucuuuuuaucacuuuuuuuuuaagucucccuaacuucagcuugcagauaaggucuuggcacaaaugcuuuggcugauagcaaaguccuccuuaucuugccucagcuuugugagugcucagauuaaauguaugugcuacuaugcccacccauagaauuuuaaggcauaaaaaaauuaaugaaaauuucuggaguuacuggauacuauguucauguucuaaauaccccaucagugugucucacacacacacacaaauugagcaaaugaaagaucugauuuuacagcucagugaagggauggcaaaucucuugacaucaagagaaaugaugguaaugggaaauuucaaaguuugcugcaucaggucucuguaucuuggcccucacagaaaagaagucggggaagcugaaaaagaaugaauagugaaauacaacauacucucauuuggacuguauuaaaauccuacaauguaaaaguauucugauuauauuauuugaguguuaaauuggaaguaauaaaugauuuaaaaauauuauuuuaaguuguauucagcaguuguguaugaacaagcaggauggucauucccagucagcauaaguugaccuccauucuggggcauuugugguugacauaaaugaaaguugauagugauacuggaaucuaguggacaagcucauaaguacauucuguauuauauaguuuuagaaauccaaaugaaggcacuuagcuuaaguacaugaaauuuguaauauauguaaugaaacaaaugcaucgagagaccaaagagguaggguacauggccuuuuuauguucauaguucuuauugcaauuucagacuuaacaguauuaaaucacugugguuguaugauuuaacuugguauugcugugaccagcuaucugacagaaccaguuucaggguguaaauauuuauuuuaggccaucauuucaaauagucaauaguuacuugacccccuucccauggauaggucauggucggcgagaggguuagcaagcacuguuuaacauuaaaacaaauaggaaacagcaaagaaguggcugaguaccagguuuacuuuuuaacgauauacaacagcaacguauaugaaaaacaaauauauccccucucccacaaaaaaggcaagcaaaaggacuuuuuauaucaccuccuagaguauugccaccauuggagaaucaagcauccgauacauaagccuucagggaacauuucagauccaagucaauauaugcaguuucacgguaaacaaccaacccauucauauguuguuaaauauaucauguucauauaguguuguauggauauuuuuauaaaacuauucagauugaaacugacaagcuauccacugcuccaaguggguuauugauacugcauuuucaaaguuuaaucaacauaggacuucauauucugucuaauauaaagucauguugaaaugcagaaacugguacauaguugacaucugauuaaagcauuuuugguaaaca

SEQ ID NO: 2760 - RNA, 1472 nt, Mus musculus
uagaggaaaccagcaggcucauaagaaggaaggagaaacuaaguauccggugggccacacucacucucguagaaaaagccucacagacggaauggaaaagaacccaacacaacacaaccugcgggaaccaagcagccuucucagaguagcccagagcccgcugaagucaccgcauccggagggacaggacgcccgggcucgagcagucccacagccccggggauccagcgcgagcgcccgcgaggccugacugcagaccccguuccgcaacagcgcgcccagcucccgcgccaucaccuccggacaccacccgcacacucaccaaguccacuucugcgagacgcugguguccucccaccaucguccagcacccacagcgucacuacgccaacaaagcugcgcaggaggcuccugggcaggaacaccgagcccaagauggcggcucccagacaaaggaccggugacagccaaagcccgccccccgcccucccucugugugucugauuggacacuucucaacucagugccuccgauuggacagggcuccggguccagccccuugagugacaguagauggcgccaacgcacagcuguaggagcucagaaugacagguucuuggcugcagcuaauuuuaagacagaggguuucuugugaaacucagcauauuccuuauauuccuauaccuaaaaucacauaaacguguggcgugauuuuacacacacacaaagcuugcuauguacagugucugccuccauaauuuauagcgaauaagcuaggucacaugguuugcucaaaagaaugaggaucuggguucuauuucaggcuuaccuagagccuuuuuucugguacagcugugacggucuggacuuuccaaaauguacuagaaaaggauucaaggcaaaaauuauauacugucuuaagugugugaccuuuugugaugaaaauaauuaaguuuuuuuuuuccuuugagugauacugguguauaugggguuuuucuuuuaaauucuuuuaaauauauuuacaucauuucuuucuuuccuuuccucucuccaacucuuaccaugucuucuuccuccaaacccuuucauauccccucccucucuccaucucaaauucauggucuuuucuauauuaaccugaugaguuauuuuuaccauuuccucuauguuuauaauuucggggccggucacuugauuuugaacaacaaaggugcacaccaugaccaagacaauucuuauaaaagaaagcauuuaacugggaggggggauaggaggggcugcugacaguuucagagguuagucuguuauuauuguuaucacaguuguggggagcauggugaaguaccuggugcugaagugguagcugagagcuacauccugauccacacguggaaaggaggagaaagagccuggacuugguaucucuucacagaaauaaaacagacuucuguuugaaugacuuagcaaacuca

SEQ ID NO: 2761 - RNA, 2140 nt, Mus musculus
cucaugcagcccaaaacugaaagcucaucugcugggguuccagagccggguaccuggcuuccugcgagugacaggaugaccugagaguugggaaaggguccggggaagauaggauguagucaaugcugaauuugaugucucugugugucguagggcuggccugggccucgugaucuggggcuugagcgcugucggggcccggggacccgcgcgcuguugguucgaggggacccggggccuccucgcgcuuggggccgcgucuccugcgucgccgacggaaguugccguucucgaaaagguccaggagggacucgcagccgcccgcgaacguccaguaguugccuuugcccuugucguugcccucgguccguggcaccuacgggagugugaggcucagcgaguguccccagacuccgggcagggcgccucaggcaagugugugccgggcggugggggugggaguaagggugggggcagcgggaaucugcuagaaaggaacuuuggugccggucgugacacccccgcuacccugccccucugccggucaccagggaugacuggggacacucggggguccagugugcacagagggcgggggaggggcucaccuugacgaagcagcuguugagcgacagguuguggcggauggaguucugccaggcgcgcugguuggcgcgguaauaagggaacuugcgcaugauaaagucguagaugccugauaggguuacgcggcccgcggggcucuguuggauggccauggcgaugagagcaauguagcugcaacaggggggccagacagagggggcugcaucagucaggguggcucugaaccgcagaagcgcuggugaagucagaccugcccugagacuggcuggaacccucgagaccagauggaaccuccauccacuggagcuccaaggaccugcucagcagacugccuugaagccucuacagauccucuggagucucccagaagcacccugguuccuuuaaaacacucuuuaccaucugaaccacuccccaccagcuagagacccccgagaccuuaugaaucccgagacccucugaaccccaaguuucuuuggagcccagggaguccuccgaaaucucugauacccucuagacucugcgggacccuuuaaaacugcccugggccuauuggacuccaguggggcauugaggguacagaagaagcugugguucgauagucucacugcuccguacuuuuacccagaccccacuuuuagccugcucagcacuuggaggauuccccccucacugcccaguggcuaucuccagagugcgcugaaacguguccuuccucagagauccgcauaaagaacgaaucccacaucuuccuaguccuggugagguccuggcuacacagaccucuaccgcuccugugggacccaugaaaccugcccccggggucaccuguacgcuggccuuguaagccgcuuuuccucgucggagcugccggcaggguagucgucagcgucgucauugaagcaguuauagggauacugugagcugucaaacaucguggcugcccuguacuggccugcacugcgggccgccgccgccgccuccgugcuggccacaggcagccagggcccagcacuagguucucuuggcugggacaacagcguuugagugcagggagcggggagccugggcuucugggguccccgccugcuccgccugguucucuggcguccaaucccagugcggggguuguucccagcuaccacagagugggaagcacaguuggggagcgcugccacccucugaccuucaggcaagggaggccaagagaguggucuggcuucacagucaggacaaccccucuccguccuccccugaggccaauccugagacuauggcagaguccacggaguccagauucgcagauucuagggucauugcugcaccuacaccuagaggcaauggggugcggggguggggggcagucuuaaaaagcugaacugcuguccccuuuccuacgggcuggcugcuuucagccccagaguccaaagacugguccaggcugaugcgggcuccugccccaaccugucucccuguuucugcauuguaccagguagcugauggagauccaaggcccaggguuccuuccgacauc

SEQ ID NO: 2762 - RNA, 49206 nt, Mus musculus
uggggagucuucggucccgggccugggcggugcggacgaggccugaggcggcggcgcgaggcaggugagcugcggccagcgggcuguaggggacgaguaggcgggugggcgcugcggacuccucucggguacuagggacugucucagggcgggccgggauguagguugcagggauggccccaagugggaaccgccaacuggccacgacgcgcgugacgcccuucgcguugccaggccgcgcgcgccccggcgcccugaguccaguugucucgugugcccgggcacucugguuccccuucgccccggaccccugcguguuggguuccggggucuccugccacccgucgaggcgcacccacgcaggcgccauccccggggcgcucccuucuggggcacagguguuguaggugcggcgaugggcgcgggcccgguagcgagucccuggccugcacacccugccaccagcuuguuaucccguguuaguugccuucgcccccagcccggcacgcaggacgguaccaaagcuggcccgcuggagcuuuuuuggaugcagccggggggacccgaugcagucagcccggcgaacuuuggugcuccccgcuguguagagugaaguguaguccugcggugugcgcuucgcgccuccuggaccaaauacuaauuagauuuuaccauuccguccauugcaccggugucgaauuuuaaccugacuguucauacauuuuagaucucuccuaaggucuuuucuuuuuucuuucugcgucccaaccucauguuccuuuucgguccuuuguuugugucaggagacagggucucauuuacguacuucugacugucucggcuguguagaccaggcuggucucacaaagauccagacugugucugcuuccuaagugcugggguaaaagggaugugugcaacuaagcuggcaucuugaaacagguccucagauagcccaggcccgccuagaauugacuauauaguagaagaugaucuugaguuccuaacccucuugcuuccacguaccuaggauuagaucacaggugugcacagcccuguggguccagcccuggguauguucuugagcagaguugcaguaauuucugguucuucucucuuuugguuuccucggccaggccagucuugaacucuuugcuuuuucgagacaggguuucucuauacagcucuggugauccuggaacacccagagauccaccugccucugaacccaagugcugggauugaaggcgugugccaccacugcccggcucaggccggcacuuuuauagcgugcaggcuguggagaacucuacccaggcuguggggacugggcaugagucuaugcucuagucaccagagggucugauaggaucgucugcccuaccuuuuuggucguuagguuuuuguuggggguaggucuuugguagcuccagcaggcucuuaguugcaaucugggugcugugcuuccagcuccccagugcuggggucacagguguguggucccauguccucacuggagaguugggccagagauuuggagagguacuuuuuauuucccgaagguuggcggccucaguuuauuuauuuacccuuuguuuuuccugggagagagcagaaaggggaugaaugugaaagccagcugcugugugugcuugcgugcgugcaugcgugggugggugggugacuccccuuuuaacuguauacagcguuaugcaacuaucaccauuaucuaguuccacggcuuuucaccaccuuaaagguaaagccagagcccacccgcuuuccuccucccuguccguuagcuucugcuuacagccugugugugcgccuguucuaguuaacucauuuaaggcucauccgugcuguguagcaugugccccuacucuauuacuuucuguggcugaauuguuucccacuguauggaccuauuaaauauuuaacaaauacuuucuaucacauuuuauucacaugaauguuugcugaggucaggggacaauuuacuggagucacuuguuuccuucgccuguguaacuccugggggggacuaaacucaggucaucaaguguggucgcagucacacugaaccuccucgaaggccuuauuaaauccucuuuauccacaucaguggauuuagugcugccaggaacaugggaacaaguuuguguuugaacaccuguuuucgugugugugugugugugugugugugugugugugugugugugagagagagagagauuguggaggccuaagguugauguagggugccuaucucaaucauucucuaucuuuguuuuuaaucuuuuuuuuuguguuuuguuuuuuguuuucuucaagacagggucucacuuuguaguuccagcuguccugguucuguagaccaggcuggucccugaacucaaagauucuccugccuaaaccuuccaaauucugggauuaaaggcgugcagcaccugcuuccuuaauuuuuaauuuuuaaaacagugucucucacuggaacuuaauucuuuuuuuuuuuuuuuuuuuuuuuugguuuuucgagacaggguuucucuguguaacccuggcuguccuggaacucagucuguagaccaggcuggccucgaacucagaaauucaccugcuucugccucccaaaugcuggaauuaaaggugugcaccacauugccuggcaauuuuuguguuucugacucuuuacuggcuaggccaugguuccagccccugaacaccuguuuuuaguucuuggaguauagaccuaggaguagacuugcuggcucacaugguaagucuauguuuaauucugugcggagcauccagucugcuuuuccgcaaagcugaauguuuuacacucccacccacaaugugggagacggcccacuuuguccauaucuuuccuaaugcuugguuuccuuccguccacccacucaccccaucucagugaaguauaucuuugacuuuggucugcauuucccagaugacacagggaugugugugaauuuuuguuuuagguccucauuggccgucuguaugucuuuggaaagaugccuguucugcccugucccaguccaugugcacaugugcauguguguagaccaggcugacuuggaacacauggucuacuugccucuuccucccaagugcugggauuaaaagugugauccaucaugcuuagccugucccugucuuuuaguuagguugucuugaugauuugugaaaguuguuaauacauuccagauacacauaccugacucacaaguaccaccccaccucuaucuacaucucucuuugagguagcaucucaccauaaucucagacugauuucaaagucaugauccuucugccucagccuccugggugcuaguaugacugguguuugcuucaccuuugacuccuccccuaauuauuauuugugugugauauguaugggcauguguguguauagucagaggccaauuuuguggauuaaauucucuuucacuuuccauugguccuggggaugaacucugggcaucaggcuuauguugcaaaugcuuuagccauugagccauuugccagcgguggucaucuuuuugauaguguuuguugugcuguuguuuauuuguuugaggcagggugucauuguauagccuuagcuggccuggaacucacucuguacaccaggcugccucaaauuuaagagacuucucugcccgugccucuugggcauuuuuaaugcuugaaguaauaaaguucuguuuucuuuagguggguguauugcaaacccuaggucaugaagacuugucuuuuuauguccuuuguaaaaguuugauaguuuuugugguucuguuuagguuuuugaucuguugugaguucauugugggcuaugaugucugaggaucugacuuaauucuuuccauagaagcucaaccguucuagcagcauuugcagaaagagacuuucuucccuugucaguuggcuucagaaggaagguuaaccuuugacccuguauacuuucuguuggaauaugucugccuguaugucagggcuguuuggccugcaguggauuucucagcucagcuccuuuuuccagacuuaccuguucucuggaaccuucugcaguucuguguaaaugaggaacggcuuuuccgggguuugcagaaaugguccugggauagugacaagggucacagcacaucuguauagccuuugggcagcauugcuugucaggauagugagucuuucuguucuuggacuuuuuacauuuccuuguggcauucagugcccaguucugcccuugggagguuaaauugauucccaaggccuuuucuugccuguacgguuggaaggaauucucaguuccacuuagcccuuguucauugcuagcaugagaagcacagcuagcuuuguguggcugugcauccugccacuuugcugaauuuguuagcuuuaggcuauucugucuaugaacuccugucagcugagaguaaagguugccucacuguuacuguuacugucuuuccggucuguaccccuuuucuccccuugucuugaguaguugcucuggcuugaauuuugugagauccacugcugucuuguccuuuuccuuccugcacuugggaacauuaagucuuuucgccuucaggugugaugcugccugugugcugcauucagggaguucccucccagacugaccuggcucgggaugagugugugccccuccugccucuacaggauuacaccaccacaccugguuuaugcagugcagggaugcagcccagugccuguguaugagaaaugugcauucuacccccugaaccacacccacacacuaugauauuuuggcaagguggggucagcuuuguaccuuuggaguuuaucuuuaaagagcugagaauacagaugugagccacuacaaguggcuauugaauacuguguuguucaugaagggguguggggauucucuguaccuacuaccaugcgcaggugguuucgccugagggcaucgccaacagacuucaugucugaccaccuccaggcuccuaguuuccuuaacacccucacuuccacaugucaaaggggugucacuaguucuccagucuuuggaguucuucaaugaaaaccaggcacuuuugcuguuccaaaagcuccaucucuuggcucuuucuuucuguuccaugcguauuugccuuuccagaaaaucucacgccuguguucaacaccuaauuuguuccgugugugggugcgugugccauacguaacaccuaguuggagaguggagaggagagcuggcccaagucagcucucuccucacaccuucgucccagggauccaacucggggcacuaggcuuugugacaaguaccuuugcccacugagccgucuugcuggcccugugcucaucugucacaggggacaugcugacuggagcuuacugggugcccuguuuucaacaaccuguuuaauuggugugugcuucacccuucuauguuugugaguccagugcucucccaaguacucugcuccuuuugggggucacaucccauaaaccaggccacucuacauuugcucccaguaaacaguggcaccaauuuaaaaguccaccucaggacacuuguccucccuuaaaggucucaaguaaggcaagagagccccagggcuggcaggaugcccccccagggcacugaucccucggcggcugcuccucagugccuggagaagggagugccuuguuguucuggugaaugcucaagggauaccggcugaaggguugccaugccaccuucuugauugaaaacaugcucuuguuuucuccucccuacugcccaaagucggaaugcacugccauucuggaccuccuaccccacuagauuuuccgauggcgaaucugagaaugcuagcucugcaucugaaaccggucccuucccagaugacagaugagcagcucucacugaggugcuggucucugaugggcucugcucaucaagcagugccgucuucaggggucaggcaggagcuccccaucuuuuggaggugugggucauagauuuuaguguggaaacacaaucucugaccuaugcagaauuaaccugcaagucacugacaggcgguaugaaaggguuuccuggacggcgguugcccagcagcagagaggauucccccagggcgggugugguuuuagagugccacugccugccugcccuggugcugcugcugcuuucugcuuucuucuuuuuucaauguugggacugaacccagguucucacacacacuuaccugcuuaguccugucgcugagcuguaugcccuggucguagucuuuuuuauuuuauuauuuuuuuuaaaguccuuuuugggaugaggucuuacuaaguugcuggggcuggcuaaguguucuguagaacaggcagaccugcuugagauugcccugucucagccuuucaaguaauugggguuauagaccuaucccaccauaccagguuuaguagugaugguuuuuauuuaucuguuguuagugguuuucugagacagggucuucuuguauaacccuaucugggccagaacugucuguguagaccaagcugaccugaaacucagagauccacuugccucugccuucuagggcugggauuauagguguacaccaccaugccuggcuuucauuugugguuuuuguuguuguuuguuuguuuguuuguuuguuuaaagcagagucugacuuuauaacccaggcuggccucuaauucucuguucccaccucagccuuccuaaugcuuaguuacaaguaugcccuaucaaaccuggucuaagguaggugcuguguguguauggggggggugauuuuuuuucccaacaaauauggcagaauuauuuauuuuugaggaaggggggaccuugcuauguagccacacuggcuugaagcuugcaguccucuuguaucagacucuguaguuguacucuaggccuagcaaaaacuugguuuugcaagagguuacucugugauauucacagccauagugcacuuucauagcauacaaaacccccugaguuucaucuccagcauugcaaaaccaaagaaacaacaguuuucaaguguuuuucuugacagugaacauagucauugaaccugccagguagcaccuagcuaauguggagagcuaaguguccuaggugauggugagucaguaagguagagguggaacauaaaugcacugaugugugugcuguggcuguguguggcugugccauccuggcucuuguaaaagguccuauagguagggaucaagugaagcgucuaucuggaagggcuaggggagcacccacuaccaguuauggugugaugggguuucagggcaccacugagggaugaggccugugacagauggugcuuccuaugaagcuagcuggcauccuguacucccuaacuccuugaaugagugcacugucagaccugagucuucaggguuugaucucaaaugguagagaaagugguuuuaagacaugcugugguccacuucugggguaggucaucaugauuucuggccaaaucugugguauggcuugcucgauguacuuuacugacagaaccaggagguaccagccccaauuacagcaucuuccaccuucccagagucagaaggaagugcugccaucacuuuucagguuugccuuucagggugucucugacaccaaguguucuguuauuuucacaaagaguuucaucaccaggggugcagaucagaucucauuguguggccaacacccucaggcccaacccagacagcuguccccugcuguggcucucaguagggaccaguagaaagauugugcuuggguuauuugagagcaguucuguucugugucuuaggugugugguguuugcaugaagcuacuuuuaauguagucuugauauuuuccugaugugguucuguguugcugugaagaaaguacauacugucuagguggcagggauuugggugauagauagggugcaacgucugaaaugcauucuuuuguuuguuuguuuguuuguuuuguuuuuguuuuuuccagacaggguuucucuguguagcccuggcuguccuggaacucacucuguagaccaggcuggccuugaacucagaaauucaccugccucugccucccaagugcugggauuaaaggugugugccaccuuugcccgacuccugaaauucuuucucgaugaaagcauucacaggcaagaccugggcuuuacauuuucauccucgguguauguggaucuugcaaggagaaugguggugcgugagaagucauugcgcugaaggauccugcugagacacgccugcuuagaaaaacacuucaggggcuagugguguggcggugguugugguagagcguuuuaccuagcauguggaaggcccuccuguggacaacuuggaaggcagagcuccugugucugcuuugucuggagcccuggcucuccaccuucuguucucugggccagugugcuaggcuagugcucuggaguuggcgcucagcuccugucuuugccccagcacaagcugacuuggagcaaauccuuguuuucaagacuggggaaccugugaggagcacagucugagcaagguucauucaguggucacacugguuuaggcagcuagacaggcuggaggagugacaggaccucuggugaccaacagguucuugucaggguuugcugauacuguugaaaacaguugcauuucuucacuuacgguuuuguuacccuucggccuauuguugcagaucauuuccaaucagucccauaagcugagaccccacagaacaaccucuucaggguacggccaggaggcagacucuggcuagcagauuagaggggccuugggaguggaacagugugaagaugcuaagcccaguuuuggacaccaggaggagcagcagauuacguuuggccuguagguggugacaugaguuugugaggguccaggugugucugcaccauccaugaugaucaauggacuuuagucuucuguucaagacagggcugaguuaaucuuccaacucugagauuguuagccuaggaggaaacagaucuuaaauuuauuuuuuaaccuucacguucauuuaauguuucuccguguguaugagagauacucagagggaaggauggaguguguguguguaugugcacgcgcgcgcaggcucacacagucaguucuugguucuugccuguuaucucauggguuccagauauuugaacucagauuguuaggcuugacuccaagcaccuugaccugcugagccaucuuaguagcacccucccccaauagcugugaaccuaaaucauucuuuguuuuuacuuacugcauagcuuguaguccugcaaaggaauugcagugugugccugucagucucugucugccuuacguggacuuacccauuguccucucugauuugauuuuuuuuuuaaaacaucaucuuauucucuuuauauagcucagacaaccuugaauucagucugccucggcuuccugaauagcacugacugcaggugugugccacagaguaaaauaaaucuuaauggugacugucguccuguaacucagauccgcagugagcuugagaaggacugggcuguucuccugugugcacugcugcucauguguguggaccugugagugcagucaugcuuucugggcucuggggugauuggcuggaucaucaguagaccacuggacuggugaguuugggcccaagauagaugguucaggauucuguguccucaaguagcaguauugggaaagagggagagaggugaucugcacacacaguguuuaguaggcuucucuggagaauguuauuccagagcucucuagauucaagaagcaucgaguuuaauggaggggaggguucaaggucuguucuggcucaaugucaucaguuauuguuuccucccuguccagaccuggcugccuggacucagcauguguucacacugguguuuuguguagcaucaccuuugcaucucaguccaucaaacacuuuuucagcccaucacccucagcugcaggucuccugcccacuucuguggaccagcaagccuuugacaggaaccuguccccggccccugauugccuuugcuccucuugcagauuuaugcucaaaggaaguuagguucuccuuagaugauggcaugguuguuccacugacugugagaacugggaugaacugugcaguggccauguuguauaguggaugugugggcuucucucuccuggagcuuuguguggcuccauggguaagagcgugccaagguauuucuucucauagaaaugcauacauagcuucuuacaugucccugcuucccagcuuugggaaucaagucuuggcugugugagacuauguugucccacauaggugguaugagugguaugacagggccaagucucucucugcuauuacccccaguaauuccucugccuuccaauccuuaucagggcuuguagguauuagcuguuggauuuuggcacucugcauguccuggggauugagacaggucaaaaaugccccauccacuagagcguuuagauuagaggaagcuugaugucagugcugucuuugggcucagaauugaucaugccaaauagugcacuugccagcagacuggauagugaaagucccuuuggggagugaagguaggaaguuggauuuugauguuaagagaauugugggaagccgcccccacauucgccguuacaagauggcgcugacagcuguguucuaagugguaaacaaauaaucugcgcaugugccaaagguaguucuccaccccauguacucugccuucccugugacuacaacucggccaugggcugcagccaaucagggagugauacguccuaggcgaaggauaacucuccuuaagagggaagggguuucgcuuucgcuuugggcuuggggcuuugggggcuugcucucuugcuccuaaagauguaaacaauagagcgcgcucuggcgcucuggcuccuaaagauguaagcaaagggggguuuacacucuggcuccuaaagauguaagcaaagggggguuuacacucuugcuccugaagauguaagcaauaaaguuuugccgcagaagauucugguuuguugcguucuuccuggccagucgugagaacgcguguaagagagaauaaugggaugaaaagaaguagaacaccuguacugaagaaauaagaauggggauguguacugaugcugucacucagcacagaauguuccgguaaccuggucggaauccauuauuacauucugccaggguggggcucuauugugccgggggcaggggagcagugugcuugaggccuuggaggccagccaggagguuggagccagugagguuuugucagguuuugugcuuugacagucuccucuaggucuguucaagagucgcuaauauacaaagagggggauggagcagcuaagcagguaucaggaauuauguggguucagcaguuacaguuaugguuaucuguagaagguuguccacauguccccucaccuaccaggaguguagcuggaacguugaaguguuuucucacaggugugucaugaaguucuuagaccugcuggcugugaugacaagugccuucuguccuagcugcuggcaggauugauugagccaugaguagaagucagccucgaagacgucaugagacuuuauuucucaaagaccaaaagagaaucaguacugcaguaaacagcaguagcagcagugugugauacaccauauuauagcccaggcuggccuagaauuuccaauccucccuccugugucucccagauguuggcaugauugguaagccauguaucaccauagagauaccauacagauauaguagcuuuuaugaguguuuucuuuucuuuuucuuuuuuuuuuuuaaauucauuuauuuauuauauguaaguccacuguagcugucuucagacaauccagaagagggagucagaucucguaacggauggcugugagccaccaugugguugcugggauuugaacuccgaaccuucggaagagcaauugggugcucuuacccacugagccaucucaccagcccgaguguuuucuuuuuaaggaaauauuugggcuauuuugaggaaaauaauguuaggauuggcgugaugggugguucaguggguaagaauacuuccugcuuuugcaaaggacccagguuucauuucccaacacccauagccaucuauaaguacaguuccagggaauacaacccccucccccuuucuggcuucugugagaaccagucauguacauggcacacaugcguauauguagacaaaacacucaugcacauaaaaaacuuaacuccuuaaacaaaaggcaaaaugauauaaugaaagugcuuucagccaggaagugguggcacaugccuuuuaucccaacauucuugaguuugaggccagccuggucuacauaggacaggacuacguaaagagaaacccuugucuugagaaaauaaaauaaaagcuucgaugugacuucaaaguaccauuugugugcaacacauuguucagauuuuguuauuuuccauuuuauuuucucuucuauuaauuugauauuaacucuguuuuauuugaaauaagauugcccucuaguucagcaggcuucaaauuggcaguguuccucuuuucucuaccugcugagcucugguaguaaaccaccaugccuggcuuccucaguucuguuuguuuggugguuuggguuugcuuuugugucucuccuuuuaaaggggguagugggagauggggagucuuacuauguauauuaggcuggccuggaccucacagcaugcauccuaccucagagugucaggguugcagcuaucaaccaccacugccuuuccaaugggccacgauucacauuacuaugaggaauugcuuuguuuuguucguuaguucgucuguccuuccuuccuuccuuccuuccuuccuuucccuuuguuuuuuguuguuguuuuugguuguuguuguuguuggguuuuuuuuuuuuuuuuuugguauuuugguuuuuuugagacaggguuucucuguagcccuggcuugucauagagcucacucugcagaccaggcuggccuggaacucagaaauccgaauaccucugccucccaagugcugggauuaaaggcgugcgugcgccaccacugccuggcuuauuuuguuuuucagcucugggguggaacauaguagugcacagucucaagcacaguccuacugaguugcaccccauccuugugaggacuuuaaugcauuccauguaaacugguagcuugggggaaagauagaaaagucuuaaacuccuuagucuucuuccuugcuuugcugcuguguuuucuucuuugguucugaaauaccugugcaaaucucagcuuugcagcaaaguauugcacugcugcucucugaucaugggauaaaagugaguccuuuuacuuaaugcuacuccuuacuccagaagaagagaacaugugacagcuucaagaaaugggaauucacaggcccagugugguggcacaggcccuaaaggacgccccagcacucaggaagcagaggcaagggaucuuugugauuugugaguuugagcccauucuggucuacauagugaguuccaggacuacauaagagaccucaaaaucaaacaaacaaauaagagaggggaagguggaaggaaagaagagagaaaggaaggaagaaaacuguuuuagcuugguaugguggcucacaccuuuaauucuagcacuuuggaggcagagacaggcagauccccuugaguuuaaggccagcuuggucuacaaagugaguucuaggacagcagagcuacacagagaaaugcuguucccaaguaucaccucccccacagccaaaaaagccacauuuaaaaaaagccuuuuggagucacuguuaaguuuuucuuagaaagugcccaauuuauauaagccuuaccaagauuucucuugugacuuuuuauuuuuagagagggucuugcuauguagaccaugcugacuucaaacucaugaugauucuucugcuucagccucucugguguugggauuuuuaucaugccuagcuugcuuguuaucucuugguuuuacuugggggugaaggggggcuaguauaugauugugcauguacaagcauggaggucagaggaaaaugucaaguguuguuccuuccuuccacuuuguuugugacagugguagugugcacuaggcuggcgggcucgugcacuucugaccucccaucucaccaucagaacacuaggauuacagaugaacuucuaugucuggcuuuauauugguucugggauccaacccuggugggcaagcuuguguggcuagagcuucguuuuuaugugcacauuuggagggaacacaugaaagaaacuuugacuugggacuaagaaaaacuaugucuuuuguuauaaucaaaaugggacugccagcccugucucugaaguccuguuaacccucuaacaccugguccucuucugucucuucugcagcauggucugagacggugaacauggacuuuucucggcugcacacguacaccccaccccagugugugccggagaacacuggcuacacuuacgcacucaggugagugagugcuuucucugguggggugcagcauugagggcacacagcauugaacucuuagugaucauggaggccuugaguggcuucuauagcuguagacuucugagucaccucuuccagugacucagguguuagucacuugaagugacucacuuuugcaggcucuaccccuuggccaugauugggagcaagugguuaguauggccaauguuuugucauuagcuuuaauaguuugagcauccaccagagacccuggacuaggggcugucuuugggaggugcaugcuucaggcgcaugcuccagacaggaugucuggguccuuugagucagcagcugcuugcuccucuguucuuuccaguuugccuccuccaagcuguccuguaugcuaaggagaaucaguuguacuacuagguuagggcaugccuggcaggugccuagcaagauaugggaggcccaugagauguaugugcugaguuguccaguggcucuccuauacaggugaauccacaagaaaaccuaaaggaaaucagaaaauguuuaaaaauaaaacucugugugugugugugugugugugugcgugugcgugugcgugugugugcgcgugugugugugcgugugugugcacaugugugcacaugugugugaguaugcaguguguguauguggaggguagagauggacaaguggguaucuuuguucuuaccuuuuuuauucaugcgagaucucacugaauucagaguucaccauguuugguuggucagucuagcuagccgguuuguuccugggaucuccacuuccugagcacugggacuauggacaugcugucauggcuuugacgacacauggagaacacuuuucuccugaacuggccccaagaggaugcuuuuagacagcaguggucagcugugagugugacuacucuguuuuccauuuccauccucagucaaguugcacuuguugggugcagucuuauguuuucagacagguuguccccacauagccacauagcccauguuugaggccagugauguuuuagccuggagccuguaguaugucagaaguaaaugagugaccagcacaggugacuucucugagccugucugggaacauagaaacaguuauucuugaugacuuauuuuuagccuuuaugaccuauuuuaaguacagugcugaagaauccguguggccugcagugagguuugcaguauuugcucaguuaggcuguggggccugugauggcaacguguuagguauguagacuagaguccaacugaggauuuuaauccauagagaugugcuuaaaguacauaggacugaguaggccagaccugucucgggauacuaagguggguggguggucagugagaaccauuagucuucccaaccuuaguuggcucuuugggguggguaggauugacagucaggagagacauaugacuggaguucugagccaguuaccaguggguagcaacugggcccuaaaaguaaguaagcaugccuuaggccaugaacagcaggggccaggcaugagagcaggguugggacaguggagcuggacugccagagaugcugggaagacccagcaggaggcacuuagccuaggcacagcuauggcacaggguucuguggguacagcuccaggcuucugguccuaacuuuucugacggcuuaugcuccccagccagaugcucaguguaacaggaggcagagcagcugcacccugcuuuccuccaggaacaccugcuaacccauuccagugcugguucagcagcuuuccgaucucagcucucaaccagcucagcgacuauccacacacuccauggguuuaauuaaaaugucuuccucucagaaaaugccaugcaccaugagauuuuggagcucuauuuguaccagcuccauuuuucagugacauuggcucucucuugccuccacugguuuacucugaauacuagucagauaucaguuuugauggaauguggugacauaggccuuuaacuuaagcacccaagaggcacaggcagguggagcucuguuugaggccagccuggccuauagagaguucgaggguaauucagacccuaucucuaaauacauacauacauacauacauacauacauacauacauaaauacauacacacacacacacacacacacacacacacacacaccccagccuggcuuauagagaauuucaggguaauucagacccuaucuuaaauaaauaaauagguucccagauucuuuuuguguuuauaguaaguuuuuucaaaaggcuccucaccuuguguuuagauagcuucauucuuucuugagucuaccaguauuuccuguaaaguggugguagcccuagaacauugagcacuuacuguuucucuauguacacacacaucucuguuuucauauuugugugugaacauagauaggaggagagggguguguauguguugaggccagauaucaaucucaggaguuaucuaccuuuuuuuuuuuuuuuuuuuugguuuuucgagacaagccuauagagagugucuuagucaggguuucuauuccugcacaaacaucaugaccaagaagcaaguuggggaggaaaggguuuauucggcuuacacuuccaugcugcuguucaucaccaaaggaagucaggacuggaacucaagcaggucagggagcaggagcugaugcagaggccauggagggauguucuuuacuggcuugcuucaccuggcuugcucagccugcucucuuauagagcuaagacuaccagcccugagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacaauugaccccuugucaacuugacacacaaaaacaucacuaguaagccucaacccuuacaaucuuauucauccccauucuaaauaacuuuaaaagucccacagucuuuacauaugcuuaaaauuucaaucuuuuuaaaauauccaucucuuuuaaaauccaaagucuuuuuacaauuaaaagucucuuaacugugggcuccacuaaaacaguuucuuccuucaagagggaaaauaucagggcacagucacaaucaaaagcaaaagucaaucuccaacuguccaaugucugggauccaacucacgaucuucugggcuccuccaagggcuugggucacuucuccagccaggcccuuuguagcacacgagucauccucuaggcuccagaugccuguacuccacugcugcugcugcucuugguggucaucucaugguacuggcaucuccaaaacacugcaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacacauuaccaaguccagccacagcacaagguacaacuuuggcuauaucuggaacacagccacugugcuuucagaaaauacuucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacaggaauggcccugaaaagagucuuuaauuuucccucugaaauuucacacaccagagcuccaacuucugcaguguucucaacauuaucuuccaagcuccuacacaacauccgacagaggucuuaacaauggauggaucuucaagcccaaaguuccaaaguccuuccacaguccuccccaaaacauggucagguugucacaggaauaccccacuucugguaccaauuugucuuagucaggguuucuauuccugcacaaacaucaugaccaagaagcaaguuggggaggaaaggguuuauucggcuuacacuuccaugcugcuguucaucaccaaaggaagucaggacuggaacucaagcaggucagggagcaggagcugaugcagaggccauggagggauguucuuuacuggcuugcuucaccuggcuugcucagccugcucucuuauagagcuaagacuaccagcccugagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacagagaguuccaggguaauucagacccuaucucuaaauacauacauacauacauacauacauacauacauauauacauacaugcacacacacacacacacacacacacacacacacacacacacacacacacaccagccuggcuuauagagaguagcccuggcuguccuggaacucacuuuguaaaccaagcuggccucgaacucagaaaucugccugccucugccucccaagugcugggauuaaaggugugcgccaucaugccuggcucuaccuuauuuuugagacaggauccuaaccugagacucauugacugagguaggcuggcugguagggaucugccugguacugggguuacacucacaggcuacccauucuuacuuuuugugggugcuggggauuaaacugccgcuuguauuccaagcacuuuacuaacggauuuaucucugcagcugcugacuuuauuuguugagaggaucuuacgaggcugugcugaaguucaguuauguguugcuagccuggcauggcuccaugcccagugcuaugauagagucuugugucauugucuagagaagacucgaggcuccucuuggaggauugagguggcuuguguuguucuuggacccaccuguugucagcccagucagcugcucacaagggucacagcagcugccuuugccucccucagagaggaaaccucucccagaagcccucuggucuugaacuguaugcucuguagacaguccuacuuucucucugggaggagggagggagggaggcugccuacagggggugaggugacugcaguuagccagccucagugugccuaggagccaggaggcuguagcaggccaaauacauagaaagcccaguggugggacugaacacugagucagcugcuugaagccagggccucgggggugagcugcucugcuggacuggggcaccauguggcuaaguauauuuguuacuuuucacgucagggcccugauaugagucuggaugcugugguaggacccacaggagaaccuaagguguggagauugaaagaagugacuaauaagaaagggucccuggaggcugggagggacccaguauagggcacaggacauggcuucaggacgcuaguugcuacggcaggaaggaaggaaggaagggugugugucaggcuucccucuuugaggaacucuauguguguauaugugugugugucugugacagcagcugccacucaauagagcagagacaguagguuagagacuugccuaggcuacaaagugaauucgagggucuauggauuccacaggcuuaauggguuaaaucacauauaacuaccaaguccaaugaauugacuccuaucccugggaaacaaaugaugggaagagagaauuguuguucaaaguuguccucugaccugcacauaaaauucugccagccccaccccugcucaauguaaaauuuaauuuuuuuucuaauaacuaaguucuuggagagugggucuauaagagcuguuacuuuuuuucucaggauagucuuugagacuuauaacuagcgucugugucuucaucugccacuuuguucuuccuguccuggauggagccuguaaacacagcuacuaaaaaugcuucaggauucagggguuuaugcugccuggagugggaugcagggucccuccugcauccggcucuagguguccuuaugaauggaaaccaugcuuagggguaauagguuauagccuggacaaccuggguagcuggugacacacuaaacuacagucccuacagaacuggggauacagcagauaaacaguagagaccuggaaacugucaaguccgguucuucauuuggaggucaguaggggagcugguccccucuuucuucccuuuccuuuuguaucucugucccagacgcugcugugcuaucaagauuucgaauucuucauugcccagcacacagagaacgugugagaaccuucuagauacuucugagcuuauguguuauguagagacuuaugugaguuucuuucacagugugucaaccuucucaucaguggaaaaauacgggucagaagccuuuggggaagguguaauuggacucacaguuuugcgggucucaggcugugguccuuggcuguugauucuggaccaugggauguauaaucgagcugaguugcuuaccucauugaugaaccaggacagagaacauggaaauaauuggagaccaagcauaacuuugaaaggcacagucucaggcccuaccuauuguuuccagaaugcuucagaucagcuccugcagcuagagaugaagccuuuauccacauacccuguggcgucauuucauauccagcccauaguaagcagugugaguggaacaguuucuguuuucucuuagccuuccaugugucucuugcaggacagucugguccuuugcauacagaauagcagcagacagccuuugcucuuccuaccauacuacaggaucaaacacucccugagcugugaggcucccuuaccuagcagcuagaaucugagggugaauguguguugaggaaggggaaccuuagucacuguucuguugcuguaaagagacacaaugaccaaagcaacucuuaaaaacaaaaacauuuaaucagagacuuguguacaauuucaggggauuauuccaucaacaaagccauuccuccuaauccuucucaaauaguucuacuccauggggacuaagcauuguauaugagacuaugcaagccauucuuauccaaacuaucacaguucuggucuauaucugcaagauuaauucugauguaaaauaucaucuuuguaaacuaaagccauaauuauauacaguacuuugcuagaaggaaguugucugauuuuaggguucacugaaacuagcuagcuaguguucucauugaacacaugcugucagcuccuaucucauccugucuuggccguuaaucugguacaccagaguauccuaaaguccaugccugcugacgccaauugcaucgccuucugaguagucagacuaguggugcuuaccaggcuggcuugguauuccaucuguaaggucuuacaucacccagacccucaaggcuccagagcccuuguguuaacaggacauaauuauggcuugaaagccucuaaccucauggcugcuaagguugcccauaaaggaguguuccccaaggugucugcuguucccucaccuacuuuguucucaugagguguccaaccgacagcacucuuugccucuucccccuagcugccucaugcuuaucggucgucacccucaucacugcagcuuuuucuccagugguacuagguuccuugugucuugaugaagaugggugcugcugauggggguagcauagucuuaacccaagaguaccugagugggcagccagcugccuucuucuggccuaaacaaacuggguaucacucagagugaaaauacauucuguccacugcacugagcugacaacugccagggaggcauuggacguaacaggcuuuuccaugacucggguuuucucuuaaucuagcuucaguuuauaaaaugugugcucuagggcuuuccauuuucuucucaagaacauacuacuaaauucacuuuuagucucugcagugucacugucuuguuaguugcuccauugggccuggugucugcuuauaaggguguucugauuuuaucaugauacacagacaccauucccauucuaacagucuuggccugccucaaacaacuguucucagccaaaguuccaggccugccagucugggucugcaggugaaggagguuggcaaaggcgcaugcgcagcugcuuaccugacugauaccuguccuugcagugcagugaagcuauaacuaaggacuguugugacuccuuaccuggcuggccgcccgugcuuccucuagccaugucuucuuccaguucuaguuacucgucggaugcucuggauuuugaaacugagcacaaguuggaaccuguauuugacucuccaaggaugucccgccgcagcuugcgucuggucacaacagcuucguacagcaguggggacagccaggcuauugauucgcacauuagcaccagcagggccacccccgccaaggggagagaaaccaggugaguauuauguggcuugucuucacagcugucacccccaccucuggcuuuucagauugucaggucaagcucuuccccuggaauuguuugugcacacaugugcagaucugcccugugaacugacugaauuaguucuggaguacuccaaguauuugcugucuaccugcauaguggagcugauggugaugugugugagauggcaauacagaugcacuucucauggucauagucauccuggcaugagcugagcuucagugccuaccaaauggagaggaguggagccuuacugggucugugcugcugaucugucauagccaacgcaagccugucugugacaugugggagcuggguaccuaugcacguacaguuggauggccaguacauuuugucucuauuccuuucaugccuugucuucacuguagcugacgguaaaaguucucacuaucuguaccuuuugagacugaauaguuuauuuauuaauuuaguuuauuuugcucacaugaaaauugcauuaccuuggagauugcuggcacuuuguucacacuaccuggggcccuguggguagugugccccagccugagaccugcaggcuguaagguaaaaugucaggcuauugaguuguaguagcugacuccuaagcacagcuugcugucaggccacccagagguguggaggugucccgaagcuacagucccuuagacaagagaccagaacaaugacuaugguauauauuaguacuggccuucaucacaccaguuuccuggaggagguuggcuuggaugccuuuguccuauguauaccuacucaagucacuugaugcaagauacuuagaggacauuuggauuuuuuuuguuguuuguuuguuugcugugagacaguaucuuaccauaaccagggcuggccagaacucacagagaucugguuaccucugucuccugauggcugggguuaaagacaagugccaccacaugcagcugccaucugcuuuugggcugcucuguugugugaugagaguaaaggcagaaguuccuucgguuaaccaucaccuuugcugugccugcugacagcagaugcagacagcagcagggcuguugguugcuugcucuuccuugaucagaaaaggaggugguaugcuuaaaugugugagcuccagcauuuguuuaacuccuaagucauuuuuuauuuucagguuauuucaaguuugagccaauguuggguugucaggcccagaauagucugaaauuauuuuguguuuauaguuuuagaacaaguucuuagucguuuuuuagaaugacuccagcuuuaaaaaaauuccuuuuuuagaucaaugaauguuuagauuguaccagacacagcauaagaaaaugacuuguccuaaaacguuguguauguucccuggcacaaauuuuauguuaguaaaaaucuaaugauucuguauuuucuaagcaaagucuaaaaauguguuucuucuuuguaggacagucaaacagagaagaagugcaagcaagccagcuuuuaguaucaaccaccugucagggaagggcuuguccucgagcacaagccaugacagcucuugcagccugcggagugccacggugcugcggcacccugugcuagaugagucccugauucgugagcagaccaaaguggaccacuucugggguuagucacuagagacgcagacacccucauccccaguguggccgugucugcauuuguucugggagggagccagugaggucagggucuccagggagauguggaugcugccuucaucugccgccucaguggcuuaggugagcugguaguacugcucucugaaacauggcugauuaaauaaauaagcaggcagcagucuuacagccauucuuaauauggcacacuuaaauuuguuauaaaauccugguauguucuagaaaacacuaggcaacuagacagugaagucaaacgugagucauuagaaaauacuuaguauaaguuggucauggcuguguauuccuauaauccaaacaccccggauguggaggcaggagaaucagaaguucaagccaauccuaagcuacauagugaguucaaggccagccugagccccagaaaacccuuucucaaaaaacaaaggacuugcuguaaagcaaucaauguuggaaggcaaaaggcuaugcccgagcucagcuauagagacaucugaacccucaaggugaccugugccauguuaccaaagcugugcacacagacacacagcuccuccgcugacucacagggcugccugcuaaguucagcuuauguucuccuugcucuacugggggaguuggaagugcuucacuucgggaugccucugcuuugcucagucagggagccugucuuggacccaggaccagacaugcuguaaguuagaaguccagaagcauuggacaauggugcacaccuauaauccuagcucucaggaggcagagacaggaagagcucuuugaguucaaagccucccuggucuacagagugagcuccaggacagcuagggcuacacagagaaacccugucucaaaaaacuaaggaaaaaaaaacccuagaguuuccauaaagcuagcuagaucuucccccuugucuguccuugugggccagaaugugcuggagugcacagcucuccaugccacugccuuugggugacagguguaccgagcaucuuggaaauagaccacaacagugccacagcauagcacuggccuaucaccggguacaguuguggugggguugguuguauuucacaguguaauguguguguguguauguuucaggucucgaugaugauggugaccuuaaagguaauuacuuugguacuuuguacacuuuuuaaauagaagccauugcuacguaaucgguagauagugaucaguagcuuucauuaccccuuugaaaaccucagguggaaauaaagcugccacucagggaaauggugaacuggcagcagagguggcgagcagcaauggauacacuugccgugacugcaggaugcucucagcgcgcacugacgcacucacagcccacucugccauccacgggaccaccuccaggguguacuccagagacaggacucucaaaccacguaagucuucugcuucuguaguuaguaaaaaggccggcccagcucauucuuuucucguaaaucugacuaugggccaaggauguggcucacaguaugguguuuaccuccuaugugccaagcucugcauuccauccccagcacaggccuuggugucuugcacuguuugccuuacagaguugaacucaguauucucacagcguugaauaggcucacauuaacucuguccuacuugucgcuucccaguuugugguucugugguuaguuuuuuugugccuggaaguaguucagauuugguaaauuugggcuugacaugaauaaaagaaaguuccuacuucuguggcuucuuacuggggagcuucucugugucacccaguacaucccagauacucaaguagcuagaacaccagaaguuaaugcugcugagagugagagcucuggugugaugcuaugagacaggugcucugggagggcaacucggagccuggcaucugggugguggcaucagaucauuggacacgauagaggugggugccagcgucuugaccuuucuaccugguacagagguuaucacaaguggcugagcaggcagguugauuuggacugcuugaacuuucuccuaaacauugauagaccuuucuguguuccaggcguggugcugggccuuccucacccaggagugucacaggaagaccaggagcagcacugaaaauucaguccuuauugcucaugucuaguuuauucuguuacuacaggccuguucuuguguucaaggcuuugccagcacuuuaacauuaaugucacaaagggagaaucauagaaagggaagagacaggugacuggaccaagugacacugcuuuuccuccuuauaugugagugugagagccacagugaacuuggugccucccccugaccuugcaucacucagcucucacugagucagggcucaccucagaugguccuagcagcuuccuuugcacagcugagcacagcugacagggcaaggguugggcgaacagguauccuugucaccacacugcccuggacagugcuguacugucccagucaguggcaggcgguacugguguaggcuucauaguucagcccuccagcagcuucugcuucuacuuagcaagaugaaacuuguaacaaacagaaagaccacuguguggccccacgguacagccuguacacugagugcagcuuuaagaguuugugugcuaauugggaugguuuuggugccugugcugagugugcuguuucaggauacucuccuucuagggcuggagagacggcucagugguuaagaacacugacugcucuucugaagguccugagaucaaaucccagcgaccacaugguggcucacaaccauccguaaugaaaucugacgcccucuucuggugugucugaagacagcuacaguguacuuggauauaauaaauaaauaaaucuuagaaaaaaaaauauucuucuagcugccuuugauaaaggcuggccuaccuugcucucccugcagcagauaaggguuccuucccuucuuuuacuuuuugguccuggggaucgagcccaaggccuuggacaugccaaacacaugcucugccacauggcuccagccuuggcacccuccuauccuugccaacucaacuuuuuuuucuugcucacaucucagcaguguggugagugucugauuaucuaggaagccaccaagcaugucucuagcaucccuccagccugggagggcaugugcacagguggccgugggagccucuugacguuaggcuaacugcccagcuuugugauuuugcaguacaguguucagacuggaaaauagcucuuucacuauucuuuuggggaaaaaaaaacuaagauuaaucauaauaaaauuuauuauuacuuuacauguauagguguuuugccuguacuauacuuuacauguauauguguuuguguaccaugugugagcagugcccugcagaggucaaaaaagguugaaucuccugggacuggaauuauggguggcuauaagcugaucuggguccucuggaagggcuccuuccugcugagcuguuucuccagcacucuuugaaauuuuaaaguuguaguauuuucuuucaaaucacaccacucagacucacugauucaugauggucuuuuacucaacuuuugaacaaacugagcauaucuggccuugggagaaaguggaaguaguacuucgugguccguaggucuccaaugccccucagaugccaaagggauggccagccaccacuguucccaaugugcuccauacucugugaaaaagccauuucccaagaacaggguuguuuguuuguuuguuuguuuguuuguuuguuuuugagauaggcuuucucuguauaauccuggcuguucuggaacucacucuguagaccaugcuggccucaaacucagaaauucgccugccucugccucuugagugcugggauuaaaggcgugcaucaccaccgcccagcaaccaagaucaguuuugaagacaugguuuacagcauuucccuccacauacuagguucacagaaagccuucuggagcccagcagggcaggauccagggagcugucagugugugccuccauggcucagcguccucacugggucggacuggaagugcucagcugcugugccugagaucucaguuaaggagaggccaccacagugcuuccucucugucuccagcuggcucucugguggauguucucagguggucucuucccaaguguccaguuuuaaaaugcuuugcaacuuggcuuuucuuaaaaguuuggccaucugguucauuggguaaacaagucuaugagaagaaaugacgcauguucaugguuuucuacuaggcggaguguccuuuuaccuggauaggacucuguggcuggccaaguccaccuccucauccuuugcaucauuuauaguucaacuuuuccaagugguuuuaaugaagcucaauuuugaaacuuacaaauugaaaggcuaugaauccagagcuuaugaaucacagagcuaugagacaaagagccaugagucagaagguauuuaaauauuuuuuuuuucuccuuucuccacugaaucaugcuuucaagguggagaaagcccugcuucuucugaggcucuucuucaucuucugcgggcuccaugcugcucucucagcugguuucuguggcucuucuuccugugggagcuugucaaguguugauguggacuguguacaguucagcuuccugaaaaugggucaggauuuaggcuuuagaauuuuauuauuguaugcauaaauacucauggaguucagaggacaacuuugugaaguuguuucucuccuucagauucuaauggcuuuaaguuuuuaaaaaaaguagggaugggggcuagagggcuggcucagcaguuaagaacacuuguugcuccuguggagaaccugaguuugggucuccacacccacauuggagguguauacccaccuguaauuccaguaucaggaucugagacccucuucuggccuucggguguaccugcaugaauguacauauaauuaaaaacauaguuaaauaaaguaaagaaaguuaaugaacucaacuuugacuuuugcuuauuacuguuaagcaaaaccaguucauuugcaugacauuuagaaucccaccugagagaacuuuuagggaagccugucuuccccugugguugcuaaugcguauucacagccugcagcuuuccggguuuccugcugccuguggucaccuguguggugagagccaucagcaucucugacacuccugaggcauggucucuggucacacuggcuuuauagggcaucuggcccucaagcugacugugagcuuccuaagccccuucugcauguguugcagcccaucucggucacugugggaggaugacugccggagaacuuuccagaguggacggggagucccugugugaguacagcuuccucuuucaagauggugcuggucuuggaggaccccagccccauuguaauacugggccuccagccaugcagaaugaacagcccacccuagcuuauggcuucacuggcauggcuggucuggcugccgccagcucucaguacuggcagugagucauccccagacugugccugcugugauuuaggggauaguuuccuagguuuucgaaccuucugugcaguauucugauugagguuugcauguuaaccugucacuccacuccuugucaccacaccacaggcgaugacuguaaggggaagaagcaccuugagauacacacagccacccacucgcaacugccccagccacacaggguggccggggccauggggcgccucugcaucuauacagguuauaucuuguaccuuguucuauuuguucuuguugaaagcgcugcuguguuugguuuauuuacacugccagugucagaaagcacuauaggaggugacaguaaaaaaacagcuguggggcuggagagauggcuuagcaguuaagagcacugacugcucuuccagagguccugaguucaagucccagcaccacgugguggcucacagccagcugcaaugggaucuggugcccucuucuggugugucugaagauagugagaguauagucaugugcauaaaauaaauuuaaagcaaaaccaaaacucagcagcugugguuuagaguacagagaaccagcugggcauguuggcacaagccugggaucccagcacucuagggaccaaggcaagaggacuauaugcacucaaggccagcauagacuauacagaaucccuuuggagcacuuuguaaauuuauuuaguauggguucacugauacuuguguuggcaagugcucuuuuaaaaaaaaaaauuauuuaauauauuuaaguacaauguagcugucuucagauauaccagaagaggacaucagguuccauuagagauaggugugagccaccauguaguuucugggaauugaacucaggaccuuuggaagaggagucagugcucuuaaccgcugaaccaucucuccaaccagacaagugcucuuacagugacuucccagccccaggaaguacccauagaguguguuuugcagcccugccuacaacuauagcagauacuauuugggaacaacucuaagucaacauuuuuugguuugguuugguuugguuuugauuuuuuaaagacuuuuuuaguuauuuauuuuauguauaugaguacacuguugcugucuucagacaccagaagagagcaucagaucccaugacagaugguugagagccaucgugugguugcuaggaauugaacuuaggaccucuagaaagagcagucagugcucuuaacugcugagccaucuguccagacagauuaaaacauuuuuaauccuuuuaaagccacaccccuuauuaucuguuguguugaaauagaaacgguaacgagggcuaaaaugcagauacuaagugacagccagcagccaggcuaugguagccacaugccuuuaauaccaacacuugggaggcagaggcagguggauagcucugaguauaaggccaccauggucuacagaguaaguucuaggacagccagggcuacacagagaaacccugucugccagcaaucacuggagaaaacggagaaaguagacuuaaaaaaccaugugguugauagcauguacauacaguugcuuagauggcugagguagcagauugucagaggcuaaccuggcaacauaaaacugucuuaaauggggccagcaugaggaagugguagguuuucugcucuguguugaaugcccauucauuuuaauacuuauccaguggagcucuaaaacuuuagucuacugggacuuggggggugggggauaguggagguggguuuaaguuuuguuuuuuuuaggcaguuuuuuguguaguccuggcuauccaggaacuuacucuguaaacaagguuggccuccucagaggucggccugccucugccucccaagugcuaggauuaaaggugugcaccaccacugcuccaacaacuucaguaucuuacuaccuucccacugugaacauuugaggcaccacucaucuagaaggucaugaacaccuccuagacccccugauaguauguagugaagagguaccugccugccucucuguuaagcaauugaugguaagcugggcaugguggcacaugccuuuaaucccaguacuugggaacuugagaaguagaggcaaguggaucucuugugaauucuugacuauccuggucuaucuagugugcuccaggacagcuaaagagugggucccaaucucaacaacccccuucccuaccaaaaaacaaaacaacaacaaaaaaacuauggugagucaaguaugauggcucuuucacuugggagacuguuaucuuugacuguguccugaguucaaagccagccugagucuaagugaggacagcaagguuuuuucaagaagaugugaguguccuccuggcuuaguacaagagggaguuuguauacuggaaaccuugcucacucuacugucaggaugugcugaccccuacaaucuguuucacagugcccucugcuaugucuucucugccacaggugaccucuugguucaagcacugcgaaggacuagagcugccggguggucuguggccgaggccguguggucggugcucuggcuggcugucucugcuccaggugguuauguggcuucuguguuagcgcucucacagaguccggggcagcgauaagcaauguacuagagcaggcuggagcuuccugccagguccucacugugacaugcuugcugucugcuucggggccguggcaucuugugugggguguguggaccucaggccgcaugauccauagccugaccugcauggcaguggugcuucccucuguccguccuguguguagcugguggcauucacucuucuccugccuguggcuuccuucccagagacacccggcucugugcugcuucuaaagcgucuuucaugagaccccuugcucuccucucuuguagggaaggcagccucgggaaccuucugguggcuagggagcggcugguaccaauuuguuacuuugauuucuuggcugaaugucuuucuucuuaccagguaagaaacugagggugaaggucuuagccaguguugggggcuccugugucaaggucggggugccaugucagcauuggagccuaugcuugcauggggugguaagcagcuauucuguauuaguuguaggaagcucuauaauggcuugguuuacauuugcagugucggcaucaauauauuguuacauguuuuacaacaaaccuuccuauuuugguuuuucaaauuaauggagguggaaaaggcagcuaccaucguuaaguacucuggaugaauguaaaagcauacagauggagggcccagucaaauccuaugcucacacccuagucuagagcaguucucuggguaccagcucaccaaggugggugcuaccccuaggacagggccucaggcccucuguguuuuucuuaugguacaagguagcaccucucagguggccaagcaggggguuaguguaugcacaggugggcagaauggcaugccaccucugucuuuccaaaguuaaugguuuccucucuguucuuaggugccuucgaaauauuugcaagguuuuugucuugcuccucccacuccuacuuuuacuagguaagacauggcauggugaccuucagagaccagcacaugcccacaguggaaacaaaaaaucugaauacauuggggcauguguacauuugcauacagcuaucuuuccuccccaggugcuggugucucccuguggggccagggaaacuucuucucacuccuaccagugcugaacuggacggccaugcagccaacacagaggguggacgauuccaagggcaugcauagaccuggcccucuucccccgagcccaccuccaaagguaaccagcaagagaggucuuggugauaccaugagcauguguucuuuaaagcuuuucaugccacuuuugaacagccaaucuuagauucugccuuaggggaaaaguauuuuugagcagacuuucacuuuguaggauggacuagaacucacagagaucuauauaccugucucugacucauaaguguuggaauuaaaggcguacuccaugcauagcccuaaaaauguaaaauaauaaauuaauauguguacauauauacauauauguauaucacauauaaaauaaguaaauauguguguguguguauguacacaccacaaguuuuauagcuuuucagaugcagaauuauauuuuccaucgauuauauaauccacuugauuaugagugugaacacaacaugagaguagaaagaaugaaccagagaagccggacgugguggcacacgccuuuauuaaucccagcgcuugggaggcagaggcaggcagauuucugaguucgaggccagccuggucuacagagugaguuccaggacagccagggcuauacagagaaaccuuaucucgaaaaaccaauuaaaaaaaaaaaaaaaagaaugaaccacagccccucaugugccagagggucccucugguugugacuucagccuccugguuccaucucagguugaucacaaggcuucccaguggccucaggagagugacauggggcagaagguagcuucuuugagugcgcagugccacaaccaugaugagagacuugcagagcugacaguccugcuucagaaacuacagauacggguagaccaaguggaugacggcagggaagggcugucacugugggucaagaaugugguuggacagcaccugcaggagaugggcaccauagaaccaccugaugcuaagguaaggcccagaaacuccuuuggaccuguugcacacauugcucccagcccauguggugccucuccagugcaaauaccuccuggcacaaggaaacagagagggaccaggacaagaucugcccuuugggcacaucuuuggugccuuaauacugccaucaaaguccuuuaagcauugcuaccaccacccaguggugucagcacccggcggguaacgaguucaucuguagccugaucuguggguaggguggagccccuagucaccuuagugacugggucuaccaggcugaggaccaagccuucaacacaaggugacauuucuuauccacaguguaacagaaaucuuuuuuuuuucuugugauguggugcugggguagaauuaauccagggccuuguucaugcuaagcaagugcccauggaaagaaaccuauuucacuugaugcuuucguugauuauggccuuaaugaacccagaaagguuggguuagaacugaaaauccuccugccucaggggugacagcguggcaccaucauccugucccuagucgacuaccuucugaaucagggaccuaaucacaugauggagccuuacuaugaauggugcuuuuggauguugcuagugagugugaacaaccauguauuucguauggguaagagaugguagagggauaugacugugcccugggucuuuauccauggggguuuacuuuagaacucugaagaccaggaagcccacuuccuauauagaggaagcugcuaguaugguuucucucagguuugagaccuccagccagagacaggggcauggcuagguccucaagaugcuauagcacccugugacuacaguaagaguuacuggccugcccuaauggcauauacgcgaugcugaacucucagccacucguucuguauucauucucagacugacuucaugacuuuccaccaugaccaugaagugcgucucuccaacuuggaagauguucuuagaaaacugacagaaaaaucugagguauuuauuguuuuggggggggugugugucugugugugucugugucuaugaguguguguguguuuacuugguggguacacaugcaugggagugcacacauggagacaaacaaggaggggauccugcccuguuacucugccuuuuuuuucuuugagacaaggucuuuuacugugccuucuuucuccacuucuuggagcauuggguuacuggcauguauacagccacacucagcuuuuuacgugaaugcugggguuuugaacuuagauccuuauccacccaacccucuccccagcccugaaguauuuggaccugccuuuauaacuggagcccuccaagaaaacacugaacucagaccaucaagcuuggcacaaguaccuucacccacugagcccuuuuaccagcucaaaccaguuuuuaaaauaaagaucaacuggaagccaauacucuuaaaggccuguagccagagggucuugcuguugaucuguacaacuggaagagaugucuuaugguuuuguuuucugggcacuucaacucuguugcuuaacugcaaaccugaccaaacauaaguggcugugcuggcuuugaaauccagucaccuccugcucaagaaucccuaugauaucacucaaccuccaccaaaaagcuuagaacaugguuugcaucaaaucagcgugagugggagaggcuaacuauugugugcugguaaacuggguauugcuauaggucugcagugccaaccaugugacccuugguagauuuuagcacguuuaaggcacaggaccuagcuaggcauggcagaugcuugugugcucacugaacugaacuaaagcaugaguuacugagucagaguaaguagauuagcccauggucucuuggggaccagcuucuccuuccugauuguugaugucagggaaguugaacugagcaggaagaaauuuugccucaacucgucacgggacccagaacacauuugaccugaacacucugacuccgagucagaaggaggcccagacauacuugaugccuuugcccaaacauccagaagccugagacucaucauuuauuaugugagguauuaaguuacuugggcaugauuuaugaacucaaugcguaacuguuuacaaaguauccuccacuucccaggcuauccagaaggagcuggaagaaaccaagcugaaagcaggcagguaggugaccucaaggagcucugauuugucucccacgguacucugcucauuuggaggcuguuaacuguuuacuggguauuaggguucaaaucaucacuugccaccugaaguuaccagccuugggguaucuuucugggaauccucucaggcccaugcaagggacagaggcccuaaggaauuaggacuuucuuuagacaguacauagcuaggucccuucuuggccaugaggagucaccuguguucuugggggagucccucugccaggagccauucucuguccccgacuucauuggcuccaucggugucugaacagacgugcauuuaggcccagcccagccuuggugcccagcagccaugcaucuuuuuucuauaccacacuuucuguaccuagugcuggugguccuuaugccuagcauuguaucuucuguguacacucugggauugugugugccuuuguagcugcugagguggaugugacugcguagcagcuuuugcuggcuaaggugcucucugcauauggugugggacaggagggagugugguacacuuuguucuugccagaccuggcuucaguuaacacugacuuagugugugaauguguagaugcagagcauuuacauggagagaacuguuucugcugggcaaaacaguguucaucucacagccccuccccaaagucagccagaacucuuacccugacaucaccuuccaucccacuguccaccccauagacauagagcauagagcugcagauucagccucaaggcuacggguagacaucagcuuguuucuggucuguugguaauuuugaggacauagacauguuacuuuguuuggaggugaggcuuucucugagugcaucugggcccugaccccugucucccuccccgguugaugacuuccagcagggaugaagagcagccccuccuugaccgugugcagcaccuagaacuggaacugaaccuguugaagucacagcugucagacuggcagcaucugaagaccagcugugagcaggugagugcugguguuaggagacugcuaccuugaaaagaaaagcucaccuggcugugucagagugauucauuguggcugccuucaaaacuuuuuuuuuuuuaaaauguguguaucugcaugagcagacagauagagggacaugaacagaagucagaagaagccaucaccggucaauucccaucuuuuagagcccauuuccuuggaggcagggucuguucuugaggccauggcuaguaucuuguccuggcuggaaaccagcaggcccuggcaguuagucuuauuucuuuucccucagagccgggguuauaggcaauugucauguggugaugggucuguguuccaguccuuagugaagagcucuucaccaagucaucucuccagcccuaccuuuuuuuuuaguuauauuuuaaauauuugugugugugugugugugugugugugugugugugugugugugacugugcaagcacauguaagucgcaagaauguaagaaugugccaggugcacgccuuugaucccagcacucugggagacauaggcagguggaucuuugagcuggucuacagaguugaauuccaggacagccagggcuacaccgagaaaccugucuuggggugggguguggggauagauaagaaaguggaggucagaggauaauuuggaggaguugauucccucauuccaccagguugauccugagaaccaaacucagguggucuaacgucaggcaggcaccuuuaccuucugaguuuuucucucuuuuuuuuuuuuuauuuuaaguuugugacugugacaagggcaggugggaauggaguggcauacagcuuuaaucccagcacucugaaggcagaagcagacaaaguucugugaauuccaggccagccuggucuacagagugaauucuaggacaggauagccagggcuacacacauagaaacccugucuagaaccuagaggcugauugcacagugaccuacagaaaggagaugugugcucugugacccccacugagucuacucagcagcucccaccacccagccucacagugaggccugggcaggcugucauccucgcuguucuuauaaacagcuugagaucuagccuguuaggaggcugagucccuauguaccacauucuccaccccucaaaaaaaguguuuguuuauuauugugaugcuggagaugaaccuggagucuuaauaggccaggcgaaugcucugugaccaaacugcuccauuuauacuggaauguuguagaaauucucaagucacacauugauugacuccugacugucccaaacccagcagcguagcacagucacaccugagcucacucugccugaucacacaguacaacugacauguuagggauuaugagagagagagugugugugucucuauguuccugucuguccguccacaguaggcccccagaaugcuuugccacuugcccauccaugucacaacaugccacagauguugcaaggcccauuauccuaggucuauugagaauguaaagagccaccuuauuggcagaauccucacaagccauguuuagaccauagauuaacaugucuggauaaugagcucagagaccagguaacgggugagcuugguugggauaacaggguguguggacaggaaucugucuccugugugcacuacccucccugggugcuggcaggcuguguccaguuacagaugcacucuuggguauugucuuuugaaaugaauagagaugagcagggaucagguggucccaggagacugagggaggaaaagugcuuaauguggcuguuugaggggacagagaacaagguugaagguauggagcccugccagcuuugugguaagaagaugcauuuccugggcuuugcccugugauuguuucguuggaggcaaaagaauuuuguaugugguacauagggacucgaccuccuaacaggcuagaucucaagcuguuuauaaggaacagcgaggauggcagccugcccaggccucacugugaggcuggguggugggagcugcugaguagacucagugggggucacagagcacacaucuccuuucuguaggucacugugcaaucagccucuaguucaugcagcacucuaguucauuccuagucuguuuagaaggucccagagguuugggaagaaucuuaaguugacuaugaaggaggcaguuguacugcauugugcccugugucuugcaguuccuucuggagcugaguugaacaguuggcuccugcagugccaccugcacacuguguauucuucccuccaccucaccaggcuggggcccgcauccaggagacugugcagcucauguucucugaggaucagcagggcgguucccucgaguggcuauuagagaagcuuucuucucgguucgugagcaaggaugagcugcaggugcucuuacaugaccuugagcugaaacugcugcagaauaucacacaccacaucaccgugacaggacaggccccgacauccgaggcuauugugucugccgugaaucaggcagggauuucaggaaucacagaagcgguaaguaagcagacagguucagccuccaccacagacacggaaugugugugccaguguucugagaacacgauguacuuaaccuugccccagaugaggcacgacugcugccaccacugcgaagcauuccuuagcuuugcacugagugaagccuuuuguuccagggcuucccauaugccugugcgcuuauaaacuuccagcugugugcaguuucccuuaguugucacauccuagcccugauguccaacucacccuuccccaaugauggugacagugcccaggacacccuggcucuuguaccugcugugaacucacaugcccuagugauaagagucugguccugcccugcucauuuccuggauggaauguaguauguuugugucccgcaagcauaggcaugcaagguccugagcacuugcuuguaucauuaaugcucauuuuuccuucugggccgccagcaagcacauaucauugugaacaaugcucugaagcuguacucccaagacaagacggggaugguggacuuugcucuggagucuggaggugaguaaccaauagaagaggugagcaggagcauaugagaccaggacaggaaucugggcaggacuacaagacacugccacccguucccacuacccucaggguuuucuuguguaguccuggcuggccuggaacugaaucuguagaccaggcuauccucaaucucagauauccuucugucucugccucccaagucugggauagaaggugcgcacuacaacugccugaccacagccacacuuucaguaugacaguagaguauuauucuggaugagguccaagaguuuauucuuccugggaagaaguugcccacugggguguguaagcugggcugcacauucacaggacacacccaggccuagccucaaguguuauaacugagggcuguuugccuugcuuccacaaagugggguuuaucauuuuagggaagucacaacugcagggccuucccaugugcuugugcauuugggauugcacaccugggugagaccuuuaagcccuuucuggaaauagaaugcagacacccgcaucuuaggaggcucugcuccacaugccaugcagaaacggaacuucuagaaauuaggacuugcaggugagaugcagacugauaccaacaugcgcucccuucccccucuuuuuaagauuuauauauuuauuuuauguaugugaguacacugucacugucuuaagacauaccagaagagggcaucagaucccauuacagauggucaugagccaccaugugguugcugggaauugaacucaggaccucuggaagaacagucauuauucucaacugcugagccaucucuccagcccucugauacaaaucuuuuuguuuuuuguuuuuuuugguuugguuugguuuuucaagacaggguuucucuguguagcccuggcuguccuggaacucacucuguagaccaggcuggccucgaacucagaaaucugccugccucugccucccaagugcugggauuaaaggcaugugccaccacugccuggcugauaccaucucuuaaugagcaguuuuuaaaagucauuuagaugaggaggcucuuugagaagaguaagcaaguggcuaaccccacccagcccuaagaaauuggcuauucccacacuaguaauaggcucacacuacgcugagauggcucaaccagggaaggaguguggggugcccaguuggauguagacauuguuucccuaauuuaagcagccuguaauaugcuugguuaugagccuggcuaccaucacuggugggccaucuccaugugguaugaggcuguuagugugggaauagccaguuucuuagggccaggugggguuagcugguugcuuacucuucucaaagagccuccuggucuaaaugacuuuuauuuuuagaugauuuuaauuauauacuuuaaaaugagcugauagcagaaauuauauuuagaucagagguacugaauggcuguuuggguuggcagcugucacuauucuggggccauguuggagcuuguagacuuaugucaccagcuuaaauccccugaggccccaagagguugccccagcagcuggucuuagauuagggagaagguguuuaagaaguuuggccaguguccaggagcucaggucuccaucugcaguaucagagccauguugucugcuguuuuauuauccacugccccuccuccucugcaugucagagacagcacugaagcuugacugagguagacugagcccacgugcucuagaacugggacaugcuaugucucugggagacuuccucagaucccccccuucuuuuuauguuuuauauuuauuucauguuaugaauauuuugccugccuauauguauguguguaccacaugcaugccugguaaauauaaaaucagaaaauagcaagagaucccuugaaacuagaauuauggaugauucugagccacccaguggcugcugggaacagaaccuaugucuugacaagcacaaguacucuuuaacugcuccuccagcccugaccucuuaguucuuauuggcuaauguccgggccgccugcuccuccaacagggcuaaugucuguccccucaccagcuaguccuuuucccaggggguuuggcuaguggacauuuguaacagaauggccuguguugacuaguuaggcagccucuggaaguuacuuguccccuaauaccagugcuugacccuuauucaggaaaccauuaacaagucuuggauagccacugucccucguaguuacacacacacugcugugaaggaguaagaugaaccaguaucaaagacagcccacugaguugcugagugcuaugcagugauuggcucuggugguuacuggaggcugaggagcugagagcagaggaaauggugcuggguauuuacacugugaggcugugcugaguccuuaaggugugccagccccacaaauagagggaugcaguguguauguguuugggucacaugcaugguuuuucuuagaauuuauuuuauggguauaaguaguuuucucugcgugugugucauucuacaaugugugccuggugcccuugggguuuagaagagagcaauuggaacccuuggaacuagaguuacagaugguugugagccaucaggcagguacuaggaacuauacccaagugcucuuaaccacagagccauuuacuaauuuuuguguuuuaauauaucaguuaaaaaaaugaaugcaggcugggaaaaauggcucaauggggaagugaggaccaguuuggaucugaaaacccacaucaauucuggguaagcauagcagcccuauagcucuguugguuggauggcagagacaaaauccccagagcaagugagucugggaacucaguugaagcauucugccucaaagaauaagauggugggcaaucgaagaagacugcuauugucaacguuaggccuuuaacucuagcccaucccugugcucacacagauggggaaaaaaguccacuuuguaacaaaagcaaaaagauaagguugaucaagguuccuuuuacaaguagagcaagugcuggguagagggauggguuugggggccuggagagaucgcugacuggguaagaacauuggcuguucuuccagaggcccuggguuugauuccagcaucuauuuaguagcuuacaacaucuguaagccuagcuccagaggauccaauucuugcccugugggcaucaggcauguauguggagcacagacauucauggaagcaaaacacccacuguagccuccaggugucacucccuggcauguugcagucaggugugacacaagugcccuguguuccagguggcagcauccuaagcacucggugcucugagaccuaugagaccaagacggcacugcugagccuguuuggggucccacugugguacuucucacagucaccucgaguggugauccagguaagcugcaguucacagggcccugcaccuuaggcccccuucccccaccuccaugaaaguaaaaaaagcauugagaauugguaggacccuagcacucagugugcagccucacugggaggcacccggccacacucccaaguugcuccuggcccugcacaugcacucaugcagccucuucgugugacuugagacccugguggugugaggcuuccugguccugcuguguggcuacagggaggagagcugaagggagcaucagagggccacagagccgugcugguugcuuucugccugugcugucuugggucccagccaacugagaacagccacuguguccccagacauggagcaucggcuucgucugcacugcuguggcuugccucucagcggaaagggaacauuugaauggacaggacugaagcaguuuccaguauuuuucuaugaagccccagugagucucucugaccuguguacacaggcucagacuuuacaaauucaggaaguggaguuuuuuuuucagcagaccugagacugaggccccuacugcaagagcccaccuugcuuucagugucuucuagccuagucuggacuccagcucccuaugucaucacagaugacccugaacuccucaucccaggaucucuaucuguauuuguguccacaaucaucugugugguccaaaaguaaaauggaaagugccagaaaucaggaaggugugucauaaugcagggcaaugaaagacagugaaccaagcuuuggagcuagagaaaaacuaaggcagcugucacuuugaaaugugucuguugaguagugcgacaggugacuguguguggggcccuggcugucaugacugcaggcugaagcgcucccggcugccagucaggcugugagguuuacccagcagacccugggcuuugugcaucucauucaccuggauauaggcaaugucguaauuuuuaauuuuucucaaaaacugggaagacuggauuuuuagcuuuucauuugugcccauggaaaauuaaaaggccugguauucaguaugguauagacaggucucugcuguacacucuauucugcuguccuuuuggguuucauggaagccuugcugcauaggcacaugaguauacuauuggcauggcuauuaaccccucugauuuuucuagaauucauguccugguccugugauccagauuugguucucaugacaaguccugucccagccugaguuguacuguucucuuucccuagcccgacaucuacccagggaauugcugggcguucaaagguucccagggguaccugguggugcgguuguccaugaagaucuacccaaccacauucaccauggaacacauuccaaagacacuaucacccacugguaacaucuccagugcccccaaagacuuugcagucuaugugaguacaacauugcugacacucuggaaacagcuuucuccucuccacauuagagagacauuuccuuuauccagaggguuaugguuugagauuauuuccugggcagcccuuggcccuauccucuuuauccuucuaagucagcaucacuggaaugucacacugcagugcuagcacggcaguaugcuguucaguucauauaucuugaaaacagaucaaguuagacacuuaacuuaugacuuauauccaucacuuucauuuguccacuuagcuuuaacaacugugagguauugaacuaaaaaaugcuauuuugccucaaacaugcuagguaggggcuuuaccauugagccacacucccagccccucacugggggauucuaggcaggggcucuacacugagcuacacgccccagccccucccugggggauucuaggcaggggcucuaccacugagccaugccuccaguuccucacuaguaagcucuaaguaaaagcucugcugagcuacagccucagcccuugagacagucuugcuugccauguacauguuuguauauacuuugggggcacaguuaaggcccuuuagugguugugcacaaugcuuguguucagccacuuugaucucuuauagcuuuuggaacucaccaccucucuuagucauauuucacugucagaauccuguugucacucuccauuaguaguuaaugccugcuaauugccuuugaagcccuuucccauuauaaaguccuuuacauuuccucuaauauagaccccaucauuuuaagcauaagugacaugugguagccuuagggauggugacucuugcccaccucuccaaccaucugucuacagaucuucucacacuucucaccuugcugcagccugucugcugcucacauccugcuuaugucccuuacuugcagcacccagagucugcacaggaguuuuugagggcaucugggcugcgagggugcuaagagugaucacaucaccucaucacaagcuggcccuguguuggcuaagugcauauuucccuaaugggaguagccauaguugcucuugaaugauuguggguuacaggaagugagugacagugugccuguccagggagggccucuucaggucuuucucagggagauaaguugucacucaggaaagcagggcuugaguagugauugguguuaucucugugauaacacauggucauugcagggacuggaaacggaguaucaagaagaggggcagccucugggacgguucaccuaugaccaggaaggagacucacuccagauguuccacacacugguaagcacaaggaucuguccucucucguucaugccuuuguggggcaggcauauggagacaauaguggggaucaccccauggccagcucugugccucaguaaaagaccaaacacgcuaguccaugagucccaacugcucuugaggcuuauuugggauauggcugcauccuguuacauaucccacgggggcaagggauugguggugguggguggucucugacugcuaaugugaaauaacuuauucucuuaacuucaggaaagaccugaccaagccuuccagauaguagagcuccggguccuguccaacuggggccacccugaguacacuugccucuaccgguuccgaguccacggagagcccauccaguagagcacuccagccauguacaugucuguauauaccaagacgccauaacacuggaacucauugagaaagagagcacgugagcauaggaacuugucagccacccuucaauaaaugugcugugguccugaggacgugcugaguccucugaggcugugcguguguucucaaagcccaaaagccggggaggcuuuuuuaauucauuugaauguaugauucucggacacuccuuuugacuuagggauuugcuugaaugcauaaagucaagaagcagauaggcuggcagguuuccaggcuccugacauaaaggcugagagcucugcauuggccauccucuggaugucaagaaggcaaagucccaucugcuaaacccacguuucuuucagggaaaacuguugcucugucuucagucugaccccuuccagguucccugguggggagaggcuaugucauagacugucugcuuugagcugggacuccucugauuccccaggggaguagaucgggcuuugcagaagagcaguggggugugcacaccaugaauggugcucuugggucucagccaggccguuccuggcagaucacagaauggacaggaaccuugagaagggaugcucugcuguccuugagcuaugagucucugcugaagggggaacacuaagguggugcuaguggcugccacucuuggucuuuaucacagcagcauucugugcugcccuuggguuugccucuacaccauuaucagcccuucucacugauucaaauuuggguauauuuaauauuuagacuuuugugaguagacuuuauaacugauacaucaucuggacacuuaaaaguguuuagaugucuuaccuaaagaauuguuaaguuucauugguuagacagccuuggcagaauacaaagcucaccugcuggggcucagaguucugggauuucucgcauguugcaagcagcccuuaagacaguggcccaaagcacaucccacuccauaggguuagagccacugccuguguggccagguugugugggaugcacacauuuugcauacucaagguuacaugcagaagucagaauuuccuauauuaaacuaaauuggggaauuggggguggagauauuucaaauauuuauuuuuaaagaugcaagauaggacuuugugcaauguauuuuuguaaaugcuuuucaaaacacuugucuuugguagugcuucuacugccacuaaauuaagaugcuauugagauguuuaaauaaaagaguuaauuuuuaaaagugcaugugcgauuucaagugauuaauaaaaguguguauuucuuuucuu

SEQ ID NO: 2763 - RNA, 4652 nt, Mus musculus
cuugguucuuuucacguuuuaaugagauccauuuacagcucgcuguucccaguaugauuuucuguggugguaaguccuucuaccacacaucuuauggcggcaucccaccagccugcacagcagcacccagucuccuuccaccuucacggaagggcaaacaccuuuguaaacaaacuuugugagaggagcaucccagagcaggaaggcguuuuguuaaagggccuuucucagucagacacgcuguucacucaggaguuaggaguggcaucuggggugaccucacagccuucuggaagacaggaagaaggcucuggcugcacuggacgguguauacauggucaguuacacaucacaagcaaagggaagguagccaguuugggucugguacauaaagucugucucuagacuccuccacguagcaggcauguaacauggugcucccauagcauggccuguccucguaucaacagcagacuuguguucugggaacguaggcuauggaaagaaagccaagcagcaggcccgccuggugcccuuugaggucagaggucaaugucacguggcccgcugccuugggaccuugaaucuggauggcagcauccaugagcuggacagucaggaaggaugccagcagcuccagagaugaccccgcaaugugacgucuuccccaagccacugggguuugagaguaugacauagcuuagcccacucaccaccugugcuaggugugugcaaguccugagcaccagccugcgccccugaccuuuuccucucacacagcacugcugaaccugaccucugacugcucugugcugucuggaaugacggccuugagcguggcauggcagaagcgguucagagccggcaggcucgucuucugcuccacauagagccugagcuugucccugaaggucucucccaggaagcuguagaugaggggauucaggcagcuguuggagaaggcugcaagguugacuauguggccugucaagggguaggcgugacggaaagacugcuugcagggaguguccccuggcugcguccacugcaguagguggacacugaugaagacguucuccggcagccagcagaugaagaaaacaaggaccacugcgaagaucauccucagggcuuucugccugcgugggcgcaggccgcggugccugugggcccggaugagggcucgcacgaugagggaguagcagaggccaaugauggcgaagggcaugaugaagcccagugugaccuccagccacugcaccucccugacaucagcaaagcagaagcaggccuccuccgugugccgcaggugcaccgcugugaagggcaccagcguggcggacacugaggccauccagaugaggccacagcugagccgugcguggugcuuggugcggaagaggccacagcgcauggccuuggccagcgcuagguaccugucgaagcucauccaggugaggaagaagacgcugcuguacauguugaucugcaggaagagggacaugaaggugcagagcacugcgaugucguaguacugcucguccagguugaacaccucaaucagggagucagccaccaggaugaggucggccgccgccagguugaugaaguacaggucugggauggucaucuucucccggaagcugauguucaccaccaggaugaggauguugcccacaaagccaauaggaaagaggaagaugguguagaggcaggagaggaagagggcaaucacguacugcugaugcucagagagguccccagugagguuccccggggcaucuucccgcagugccagggacaaguugagggccagaggggugcuguuggaaggggcuggccacacgggaccuagguagaucuccaccccaacaguuugggcuggaguagucgcauccauggcuucccucggcaguuuucaggauuugcugaaagggucacagaaagcuguuuuaugugacagcuccaucuucacaaagaaagauaaaccaggcauuugugaggcaggaagaaucguccugggagccuguuagucucagaaaaccagaaggguggacagggugucugaugucugggcuggugcugggcaggcacaccugcugccugcucaccuucugggcaccuguagaagcagacggggcaagacuuagcaucuagaacccugagcauccugaaggagccagguguggugcaugagugacaacgggguccaccuggacucuggcuuucgccaccccccugagcuggagcagaagagauagacguggauagacguggaguguuccuuuauguucccuaagagcgcccacaguuggugacagucugugagucaugggagauguagugggaccagucagaucacuggcccgugaaauaccgugaguguguggugugggaauuugaggaaaacuacuguuugucgagacaggaagucucauuaacuucagcagcuguuggaaagagacgugacaugggaagggaaaaacccagccuuucucaaagguaguccaagaacccaagggcugggagcugccuuuucucuugcaguaaagugggaagagaaauuuuguucuuugaccuguggcgguacugaguguggugccaggaggagacaccugccaucguuuaaagggaaaacaaguaaagaacaagcauuguuauuggaggacugggauguagcucagugguaaaacauuuaucuggcacacaagagagcuguggguuccaccuucaguaucuuucucuugugugcgugugugugcaugugugugcacgcgcgugcacacacgcgcacacacacagagagcuguaucauuuuuuccugagaugaguuuuugcuauguagcucuugcuguccuggaacucacucuguagaccaggcuggccucgaacucagaaauccgccugccucugccucccgagugcugggauuaaaaggcgugugccaccaacacccagcucacacagcugguuuugaggcagggucucuuauaguccaggcuguuccaaauucacuaaacaguaggggaugacuccucguccucccggcuacucuggagguugugcuccggaggaucccuggagcacaggcguuuuagacuagcucaggcagcagccugagaccccgaucucaaggaauaaggaagacaggagagaagaagggaagcagcuuguccuuuacauaaguuccugugaaauacaacauuuuaggcacugcagccuggaagcugagcuucauuggucccuggggaugguuccuagccuguaugacucugccucggggcucucugggguaauccagguucucagcggcacuagcagugucucgagacccuagggugucacuguguaggagaugggugcuggcaucuggugaguggaagcugagaaugcuacuaaguguccauauugccccgggcagggacauggcagcuacugucccugugucuuccuucacagucagagcgagacagcaaagugcuccucagaugugcuccugaaaacacaucucuguugcuuugcuuguggugauugcauuugguuuugagguggagcaagagcaaaccagagguuuaaauuggccuuucucuccccaaauacugcuucauuaaaaugaugggaagaagaaaggaggggcuguggccacauccugccuuggauguguggguguggguggccaacccaucuuucauggacgugcccaucugagccacagaagcgccagucuucugagucuagcuacaaugcagaggguuucccuucauuucuucugauaccugagccuggugcauacuuuaaucccagcacaaaaggaugagaggcaaguggagcucuaaguuugaggccagcccagucuaugaagugaguuugaugccagucagggcugaaacaaacaaacaaacaaaaccugaaaauuuaaaaguacucacccagagugugugaguguugaggcuuggccacaauuccagcagcuuaaggggagcagaguccuuggauggcuuucucccuagaucugaucagcuguuuuggugggugcauggcagaaaugacacccuggcuucuguccuugguccagaucgcugcucuguuaaucuaacgaucagacuuaguguccuucugauuuucuguuggguguccugaucuggggaaacaagacuagguuuuugccaggcuuacgaggccccuguccuugaaacaguuguaagcuuccaggacucccuuggcagacagaguggcagcaucgugguguuacagggcguagccaggacccaaguguggccgagcuuuagguaggcaugcuguuguugccugcgccuggauagaccuugcucacaccuaucgugcaauccuggaggccgagggugcaugacugccccaccagugccaccccaccccagcaaggaguuccgagccacacgcagucccggaaccugagugugaaucuuaccugugccguggcguuaccaggccaucugcuggaggugcuccuggagcuugcuccagggauggacccuggacuugcagcacuuuggggacggugcccagcagggacccagcaggagaggaacagaagcacccgcccgaugccuggggauggaugccuguggccguccagcagcgucuggcccccuuggcacagcgccuccuuuaua

SEQ ID NO: 2764 - RNA, 13346 nt, Mus musculus
cauuuugggcgcgcuggcgggccgacucuagauguuaggggauugguugguguugguguggcgucaucagagcgcgccgggaacgcccaggauguaugacucuggaucugucggcuggggauaaauggcccaggcugcugcaggggcaaugcuacgcuuuccggccuugagagaagucgggcgcuucgcggcgauuggagcugcaguuucuacugcggugucaccgggauaaccacaaagggcaccgcuugucugucuccgccucugacuacccgugagugccagguaccggugugguugcgggccgcuggggcccggggagcuggugaacuaggggcuggcgucuccgcgcugugauuucucguggccuggccaucaaggaguuacugucucagcacagugacaucucacauccccaggucaacugcccugagccauugucgcggcagccaggcauagugguuguugcaggccuguagucucagcgcuggggaguugaguuauuagaucacaagcuccaggcuaaccugagcuaaguagugagacacacuuucaugaaacagucuacuagcagggcaugguggcucgugccuuuaaucccugcacuccagaggcagagacaggcggaucuccgaguugauagccaaagugaucuacaaaacggguuaagggacagccagcacuacaaaauagcgucuguccuaggcccccggcccccuguuuaaaaaaggggggggggagaaaagaaacagucgguggucauuugguaauacgucacgugcugcuugcuuugaacaaaaacauuucauaaugcggauucuguugugcacgacuuaaaagguuuccuccccgacaggaaugagauccacccuaaccacuaaaugcaguaggaaaggaagggggaagggugggaagugaauuggcuuagagguguuagaggugacguuugaggaagugacacuguagacugguccuugacaagucaaauagaugucuucugaagccugagaguucucaacaaggaguagauaagaaguucccagcagagaaaguaauagaaagaugugaaaagcucuuuggggacuugaccuguggaaagugcaagaguuucgagucauuugauaggugacaggacuuggaggagacuuugcuucaagccuggucuccgggaugccagccucucugcuugucuguuucuugugguuaauuaaagugccgcuugccuugaucggcccuggccugaugucauuauggcgugugcacaaaguaaaacugaaggcaugagggagggagaggcaagggacagccuacucuggggagcauagucaacugaugccacuuagcaccuggcaccgaaucuuguugaugucaacaaguguauugaggaguugagacugcagcuugaguuccaaggagaccauaauuuucaguggcagcuauggacuccauacgggaagccuuucuuucucucaccacauuuguuuuguuuuugccagagcuggggauugaaccuagaacuucccccucccacaugcuacgcagagcauucucuuauuaacccaaggcuugguauuuaugaugaaacgaccacuuugcucuuugcugagaauuuaugagauggcagucuuucccauggccccaggaugguuuggguuucccgugcuucucacaaauagcuucucugugcucuuuggcugcaggugacaggcccugggguccaacucagaaccucauucucuucuaauucccacaggugauacuuaaauacaucuguguuuuuggacagcauuuauaauggaguuuccugacuuggggaagcacuguucagaaccaacuugcaaacagcuagguaagaacuuuugggggcucuugcuagggaaacagcauuacauuggcugcucugcggaggacaccuggcuggugcacucucucgcuaguuggccucuguccugguuuagcuucucagcaugaaaacucuggugcaggaacacagggucugcucagaauugcaaguuaaugaccccuuaaggccacgcaauagccaccagggcuuugcagauaacaaaggcagcuuggaugguugcgaugccacaagagaugauaucuguguugaaaagacgugaagacauuuguggggccuucauugucucuugaccuuccugcauuucuaccuuugggacugggguuguugcucaggugguacagcacguguccagcaugucugaagcucuggagaggugcaggcaggaggagcagagauucaagguccuccuaggcuacauaugaguuccaggacagccugcacuaaauaggacccugucuggguuguuuguuuguuuguuugugguguuuguuuguuuguuuguuuguuucuuaauuuuauggcccaaaguuguuuucucucacaugugccaccuccgggaugugucugucucucagacuccaguucuucagaggacuuaccguuuuauccugauuuuuguuuuuuagauuuucugccaauaacaugcgacgccuguaaacaagauuucuguaaagaccauuuuuccuacgugggucauaagugucccuuugcguucaagaagguaacaugucaugcuggggucuggacugcgcggcuacagcucuuccauccagcuguucugugcaggccagagcauggucugugauggccgcgcuuugaguuuugaacggguggguuuguuacguacauauggcaagccaaaguaaaaacaagcagaaaaguagguagagagcuagauggauggguagguggguauuauuggcgcucggaacauccugcagaaacagacuggggagguuggcagacucagcuggaguucccaguucagcuuccccacuggcugagcauccccugcugaagucuucuggcuuccugaccccagggcagguaccuuucuaccucaggauaagcaauaguucccucuguuggaaguagcuuuucuucuagcuggucucugggacacggugcuuucacucuggucugcauugcuguucucugucacagaggugauccaugccccuccagaagucuuggaggacacccugaaacauucacgccuugguguaaaauggguugggagugggcgauagcacagcuaccagagccagcuccucagugagcuccuggcaguuuagcaauacgaugcacauuacagcagugcagcgggcagcuacucccuguaauucuuaguuguuuguuuccuuguuuugagacaggagcuuacuguguagcucuggcacuuuggagcucugguggcuugaaauuugcucuaucaauuaggaugggcucaagcucacagagauccgagucuaccucccaaguacugggauuaaagugccagcuaaaaaaaauuuuuuuuuuuugagccaaggucucuuguaaccgguguuuacaucaaacucacuauguaaacaaagcuggccuugagcuugugaucugucuaccaagguugggaguagagcucuacaccauugcuacagacuacuagagcacacuuccaaguaguucagugcccacacgugcccaauggcguccucauuggacagcgcaggacugcaggguagcuguaaagcuaucaagacucuauuuucacagaccuggagucaaauuaccguuuuaagcgaaucacagaugaaugaaucagguuaaaauucccacaagacuauucuuaucuaggggcggaauggauuugcugaucaagagauaagguucauuuagaaaccgaacagguucuaacaagugcaugcacuugggacagaggagggcaggggacacagccaggccccccuucuauugcuuuccacguuucuugagacaggaucucuuauuagaaagucuaaucuugggccagcaggccaagcuccuccuugcucugccuccccagcuacaaaugcaugcugccagccaggcagagugguggacacgccuuuaaucccagcauuccagagucagguggaucucagaguucaaggccagccuggucuauagagcaaguuccaggacagccaaggcuaaaaaaaaagaaagccgggcgugguggcgcacgccuuuaaucccagcacucgggaggcagaggcaggcggauuucugaguucgaggccagccuggucuacaaaguaaguuccaggacagccagggcuacacagaaaaacccugucuugaaaaaccaaaaaaaaaaaaaaaaaaaaccuggcucaaaaaacaaauaaccacaccaccaaaaauaagugcaagugccuggcucuuacaugggugcuggggccugaacuugggucugagccaucccgaaacuccuuagacuggguguguaagggaauaaacaaccauggagcgagugaccaacucuguucaccauaagauuguauggaagggaaggacucucggagauucuggagguugugugcucugagcugugccuguccugugccuguggcagaggacagcaguagcggucuucuggggcggucggggucaggaaagccuugugguagcagugucugcagcuugucaucucuccagguaguguauuuguguggaaaucagaggcugcguuucuucgguagguggacaguagccagcaguaggcugugacccucaccucagcccugugggaaagucuacacccucuuagccagacugcugggugugagggcucaggagaggacagucccaggugccauccaccuuggcuuguuuuugguuuuguuuuuggcuuuuguuuuguuuuguuuuguuuuguuuuaagauaguuacucacugccaggaguuuaccaaauagguuaggcuggcuggcuagcaagccccaggaauccuccugccuccaccuccccaguuuugggggaccaguauacuccaccaaaccugacuuuccagugggugaugggggcuggagcucagguccuggugcuuauauggggauaucuuuaccaacuggaccaucucccaucccuaagggugugucccacacuugagcaguacagcucgccuuuccccuucacacacugagcuugcguagucuccagcaccagggaacagcaggcguccaaguuucuuguuccuuuggucuccguagcagguacuucuaggagacuccacacuauucagcagacacuggaagguccccucaaguccacggcuucacucuaucccagaagugacucgcagaucacgucagugaacucugcccacuuccccuggugccauauggacagugggugacuuagugucacaugccuuaaccggggcuggccaugguccagucaagccaucgggauggguggggcuggugacucagguuccuguuuuccagacucugaugacuaguggucaccuguuugugugucagcugaaccuuuccuugugcccaugcagguagcaucuguccagagagcacacagggcugcuuuguuucucgauggucacauuaggccacugugguagccacccucagacaacaggccacgcaagccuaugacccuguuuccuucugaugucagccaccccgugcccuauggcauggaccccucccucagcagugguggcucaguuuugacuauacuacuuggucguucuuggagcuccucauucucugcagagccuccugagucucucuggcugccacagcaguggggcagagccugagcacugcugagggcgucucccuccuugugaagccgccaaggaucagagugacuccugggacccuuccugucaguguguccacuuuggcucuaaggggucagguggguccccucccacagccaucuuaugcccccacccaaaucgcaccagcuuccuuucucacuugagguuccuccaaaguugguggugacccuuuuuguguuuaaacccccacuagacaaccucgaggcgucagguugaggucugagugugagucuuggucuuggucucauuguugguuauuucaggaugugcaggugccuguguguccucucugcaaugcccccaucccugugaagagaggugagaucccagaugugguggucggcgagcacauggacagagauugcaccuuucacccugggaggaacagaaacaaggugagaguuggauuagggcuagcacaggccagugcacacacgcuacugcugcugcugcugcugcuuuucuaggaaaggucaauuuucuuuccuuuccuucucccuucccuuuucuuccuucuucuuucuucuucuucuucuuuuuuuuuuuuuuaauuuuuuuuuauuuuugagcuagcaucucacauaguccaggcugguuuagucuuucuauugagccugaucccccgacuccuucuccugcauaccaguaugauagccaugcacuaccaugccuguuuuauacgguguugggaaucaaacugaggacucugugcuuguuaggcaagcacccugcaaacugaaccacaucuucagccccaaaauucuauugucuaaguguggcgugcugacaguccgugggaagcagagaucuuccuguguuguggauggugaguuugccuugugggaacaguucccaagccugacaagggccccagguuagguccuugcuuucaggaaucccaagggucugagaugaaagaaggcaaggcgccgggccugguggcacuugggaggcagaggcaggcggauuucugaguucaaggccagccuggucuacaaagugaauuccaggacagccagggcuauacagagaaacccugucucgaaaaaaagaaggcaaggcuuucuagacccuucuguuuacucucucagcugugacugggcccccuuuucugucuucucccuggggugugacgggggaaaugcuccugcuucgcucagccucccagcagccauuucugcccugcaguguggacuugcucugaggcucucuuccagcuaaugcugggucuucucucaccugagcuccaggacaagggacuuuagcuucuguaucugauuacacgcuucccccacucccuuuccuccuccuccuccuccucuuucccuugaccuucaccucucccucccucccuucuuguuuuugagaucuaguccagcucacuccugguccuccugccucagguuucugaaugcuggaaucacaggccggcacugucgugcccagcuuucuguuugcuuucccaggcuccuuuccuaaaggaaaucucauccuugcugcugcugugucgauauuucaugagggcagaacuuccaggcuugcagaucccuuccuucgcagcgcagcugucugcaggcuggggagcccucgccaccccacugcuccugcccugucugggaggcuccucuccuguuuacuccgccaguucucuucuucucagcccggccucacccugcccugccaauuuccagaguaagcacacaccgcacgugugcacaggggcagagcaugcagcuuaguggauaaagcguucugccugguugugcaagcgugacaaccugagcuaaauccuuagaagccauguagagguagaaaaauagaugcuuccacuaggguucugaccucuacacacgugucaugacucacaccugugcgcacacacaguuucuuuagaaagagccuguguccucuucaauugccaucaguccuaagggauccucuucaauugccaucaguccuaagggguccuccucuccccuucccacccccagcccuggguuacgaaugcacacaccaccacacccagcuuuuuuccaaggcugcuggggauuagauucagguccuuaugcuuaacagcucucagcuccauguaguuagaagcuaucuuggugcacuucuuaaauaauuugacauaaguaugcacaaagcccacugagcagcucagcuucagacaggagggcaugaagucuucuguggagcaccacaccaagccacauuaucagccugucccauucuggagccugguccccacugcuaagcccuuuuuacaggguguaguucuuucugccugacacuccaggcgccuauguaaaaucguauccuguucucucuuggcucagcccagauugcccagacacauccccacccccgucugcauccaaacagcugaaccuuccuuccuccuggggcagccuguucacacacaggcuccugcugcaggccucuugugccucaggggaggucuuucagaggcuggcacuggcugcugccuaaaccaccccuuaccuuagccuuaguucauaggagucagggguucuggggauuuauaucaccauccagagcacaagcugcuggucugugugauaccauagauacaccagcauucuugaacucgugaauauaaccucugcugucuccacagcucaucauuugcccuccuggggcugcugggacucuugccuugccucccugccugcccuguuuucuuucugccucauccuccaggaaaucucuugcugccucccccaggugccccagcuuugcugucuccauaggcaguuuuuaccccucagcuggcacaagcugccuaaucagaaccuuugcauccucuuucugagugcccagggcuuguuaccuuuuuauuucaucuuaaaaaaccaaaccaaaaccaaaccaaaaaaacccaaaaaacaaacaaacaaacaaaaaccuuuuuuuuguuuuuguuuuuuuuugggggggguguguuuuuaagacaguguuucucuguauagccuuggcuguccuggaacucacucuguagaccaggcuggccucgaacucagaaauccaccugccucugccucccgagugcugggauuaaaggcgugcgccaccacacccggcuaaaacaaacuuuuaaaagccacacgugaugcacaacuuuauauuuagcaguugggggggcagaggcaaggggggaucacugugacuucaaggccagcauggugcauaaugagcucccagguguguguguguguguguguguguaggcagaggaggaugucugcugaccugcucuaucguucucugccuuguucccuucugacagaguuucuuauugagcuuaggcuggcuccugcuagcuccagugacccuccugucucuggcccucaaggacgagggcguguguguaaccauguccagcauuuguguguaaccagcccagcauuuguguguaaccaugcccagcauuuguguguaaccaugcccagcauuuguguguaaccaugcccagcauuugacaugggugcuggggauuugacuuuugaucuuuaugccuccccaugugcuccaucucccaagcuucaggguuuguugucgaugcuuuuuuuuauugggcagugucagggaauuaauguagcacuaagccauaagcauaaucuuuuuacuuuaaaaaaccuucauuacgucauuuauauguguugguggugagguugaggaguggggcucagcagaggccaggacucgaauguggagucaguucucuucuaccucagccucuuugaguaguuagaaucacagccuggugcugcugggccagccaccggggcccaucugggcuggugacgugcugauccgugacuuuguucuugcagguuuucacacaucgcugcuccaaagagggaugcaggaagaaggagaugcugcagcuggcgugugcucagugccauggcaacuucugcauucagcacaggcauccucuggaccacaauugccaggcugggagcagcucagccagcagagggaggugagcacaggcucccggagccgcugguaugcagagugccacacagaagggaacuuagacucacagucagagcuggaguucugugacguuaguccugcagcugccacauacugggggcuucaaccagggcauuuauucuuucaugggcuagaacagagaguugguagcugacuccuucuaagaggcccucccuaccucucccaguucuccuguuuucugguucgcccaguguucccuggugagccuggcuuuguagcccauugcauacauccuugccuuugucuugguguggcauuucccagugcauuucugcauccugccuucugcucucuguuggcuaaguggcccgccaucuugacugaugcccggacagcgggugcuuaguuugauccaucucagugaaaacuugucucuaagugaggucccucccgagggcuggggguggguugggguggggugaaacauuggucuuuugggggaggcgauacagguugaccauuauugcuaccuauuuaagugguagaaaucugcacuccugggucaaaaugaaauguaacuuccuuuuuguuguacgugugugcaugcaugagcauugugugcacaugcgugcacauggaugauguccucaauuuccaccauguuugacccaggccucucauuugcuguagcaugugccaggcuaggugacuggagagcucccgccuccaccgucaucccccugggauugcagauacucacuagcaccugaccuuuacacggugccaggaguucagacgcguccucgggcuugugcagguguccacugagcugucuaccaccccuuaagucaccauuuauuuuuaaucuugcauugggggcaagaguauacacaugcgcuguggcaugcauauggaggucagaggacagcuaagauacuuuuuaauucaguuaaccuucucaaacugucuguaugugauccgggcuggagcccaacuaucuaagugcauagacaugagugggugggcucucuugaugugguaagaaaguugaauaacuguaaaucugacuuucucuguaggacuucuacauccagagcugcugagcagaagccaucgggagucaguuggcuggcccagcggcucagguacuagucccaauggcaugugagacucaggcugugcuuccauaagaaaggccagagcuggccacaguagcuauuuuuagaauguccuguguuuccucuaaggcuguuucucaugacagaccucuucuagguaguucugacauguguggucacucacggauucugucucuuccaggcgcacagugaagugacagcgagucuccugugggugccacacaccagcuccuuccuguuggauuuugaucuugggacguguccuccaacacuuuuccugcuucuucugcaucugagucuuuauagaagagucucccauugacuguucaaguuacggugaauugauggcucaguggggaaagcacuugccccacaggcaugaggaccugaguucauccccagaacuggaugugacugguguacacuugucaucucagcacuugggagguggugagaggaaaaucuccagggcuuucugaccagcagccuagccauauuggaaaguuccaggccagaaagacgcugccucaaaaaccaagguggacacuuucuguggagggacaucagaaguucaccucuggccucacacccacacccacacacccacuuguguauacacacacacacacacacacacacacacacacacacacacacacacacacgaggcuguccagcaacuucuugggguggguuagguuaccauagcaaacagcugcaggguucaaggccugaggacuugcuuaacucuccucagugguggcuuuggccugugcuaaaccucuccaggacuugguauuccagaaaauucuguccugugacagaaaagaaccaccgucugcucuguauucuccccuccauggcuuuuguaauaaggugccuuugggcacagucuacucaugguccccaagaacaagaguggacggggugcccuuuccuuaccucuggcuggggaugcuauggaggaagggugugcacuuggccugcagugaugucuccaagguugacuuaagcaaccagccucaccaugccaggacuccgcaugccuggcuucaggcuguuuugugguuugaggcagugucucacuguggagcccuggcugucauggaacucacccuguagaccacacuggccuugaacucagugaucccccugacucugccucccaagcguggauucacuuuuaacucccaagaagagcaccaagaaaugagagccauuucagaaaugucugguuuugccauagaagcuucuccucuucgugccgaauccccauggcagcaggcugaggguguccucagcacuuuguggagcagaaacccagacagaagaaaagcagugguucugggccuuggggugcagccaccaucacuccugugccaccuguguggccugaaccaugucuacccccaaauggccauggcaguguaggggaagaugcuugggguacucuggugaccuguauaagcguuuacccucacuuuccaggagcuuggcuauuagagaugacaugggaccaaccacccagcggguuuugacuuucgcccuuaguucugacagccuuugggacaguuaacugcaugaauuccauacauagcagcuuugugcaggguucguggccucuagcugucaugggaggcagggguggguucuacucacucuguucucuaagccagugccucucgucacaucaguccagcucuagacucaucggugcacucauccuggccccagugccugguuagaucgggggguggggggcuggggggguauuugcuuuuagaacaaggucuaggcaguggugcuauguggggacauugagacaaaccaaucuuuuguacuuccacuucccagcacucuuucauggugguacacacuugagguauagcuagcauaacaaagcuuuugauucaacuuaaguuuuaaaacuacuggguucaauaauuaggcaguguuuaaaaggggaguuggauauauacgucuccguccuaaccaugguaugcaauaguguuuccacugagaugacucuaaguuggaaauuaaaagcacacugggcgggcuggggaaugguccagugauuaggagccugaaccucucugcagaggaccagaguuugguucccagcaccacccauauuagauggcucacaacuauguguuaaccucagcuccaggggcaaaugaugccucugagcucugggccuugcacucacaugcccauguucuuaaacaugaauucggaaguacaguggcaaagguuagagccuagcguuguggguuaacccuuacccagagcccaccagugaggagcuggggccacaauucaauagaagagcacuugccaagaaccccucgggccugguuuaguggaguaccugccugucaugucaucaggccucagauucucucccuacugcaaggaagcaaaaucaccaggcuuuagagacaauaucaaaugcaagacauuguguguugaaauaucuuauguauaaugguuaauaaaaauuauuuauuucacccauuuuuuauucu

SEQ ID NO: 2765 - RNA, 1176 nt, Mus musculus
ugguuugguuugaggcaggguuucucuauguagcccugucuaucuuggaacucacucugagcaggcugaccucagauaucugcuugccugagugcugggauuaaaggcacauaccacaaccucccuggcuaacuuuauuauuauuauuauuauuauuauuauuauuaucauuaucauuauuauuauuagacaggguuucccuaaguugcccaggcuagccuugaacuucuaaauccuccggcuccaaguucccaaguaguucauaugacaggacugugccaccaaggugggcugacccuguuuucucagauaggaaagcugaacuuuaugaaaggacggggaccccucuagagucacaacaauaaugaggccagccuggcuuucuggaacccucucuagugguucccagugggugcacaugauaggcaagcugaagaaagcacagccuaggguagggaaagccaaccagcucuguggcccugucuuugccucccugcuacagcuuccaagcugaugagagauccuaagccacuguacaugcaugagauaagucgacauuugccugggaauuaaguggcgcucacugacaggcagagggaauccgccaaccaucagcacuaaugcccuuauguuccaggcaggggaggggaaagaaaggaaagcuagguugagcaccacaaccuguauuuacauaaaucugcagcuacaagcagagacuaacccccccagcaccccaccaucccaaugcaagcuuccuucacaaaaucuaaggcuaugacaagcuucuguuucuggcuucgggaaggucuccuugaaccaaaguccuccaaaaucaacauuaguaaggcagacauuugcugacuuucuggcuggccagcuccaaauugcucuaccuucuacauagggaagcuggacaagggacagcaugacugcuggauggagacugggagaauccuuuuucugucccugauugcuugaccaaauggugcugggacagaauccagagccuugaacauauuaaauaaaugcucuaggcugagccacaccccagccccucacuggaggauucuaggcaggggcucuaccacugagucacaucccagccccucacugggggauucuaggcaggugcucugucuuugagauagauucccaucuucuuuuuauucucuuuuu

SEQ ID NO: 2766 - RNA, 6398 nt, Mus musculus
uuauaggugugugguugaguauguauaugugugagccaguucagcuucaggcaucaguccucauagagucuaacaucugccauuugagccagaaucucucaauggccaggagcucaccaauugguucucaaccuucuuaauacugugacacuuuaguacagcuuguguuauggugauucccaaccauaaaauuauuuucauugcuacuucauaacuguaauuuugcuaccauuacaauuccuaauguaaauaucuguguuuuccauuggucuuacgugaccccugugaaaggguuuuuugacacauaucccacagguugagaaccacugcucuagucucagucucucccgcacugggaucacaagugcgcaucagcauccccagcuuuucauggcagugcuggaacaauaauguagcugaauuuugcuacuuaguagguuuucuucuaccauuucccauccccuuuuuucccuaccauuucaacacccuaacacuagauaagagacagagaaagagacaaagagagacagagacucacagagagaagagaaaggcacacagagagaaagagagacagaaagagagacagagggggguugaaaggugggugguguuuucauuagacuacuaaccgcugguuaggggcacugaguuccuuggggcaacuuugaucuucuccaucaggaugucuaauuucuucuuguaguuguuucuucuuugcauaugacugcuuaacagaccauaacuaacaaccagccaacaacccacaucacaccucucaggaccuagcauuuauauacccucuaaggagucccaggaauuccaaaugucacacagucacagaaucuaucugcagcuggcaaaaucaugccccugccagagcacaaggcagaucauagucugcuaacguggacgaucugaagcagcucuauauccccacaccugggauuaaaaugaaaacauauucuuauaguauuucugugguuuuuuaaaagaaacuaaaauuccacaguucauggaauagaacucaaguucucaggccuucaaagcaaucacccacaaagccaucucccuaaccccuguugaauuacugucuuuacaguuccucugccauugaucuccaacuucauuuauggcaggcauucuacuaaaugaauauacuaagacuuguuuuguggccaugcauuaggucuguucuggaguguucuguguccuacuucaagccagccagaacuacacaguaagauccuagcucauaaaacugcccuugaauuccccgcccccucuuccuccauuucagcuggcucacaggugcauacccaucacgcucagccuuuccuuaaaggggaagccuggcuuguugacuugagaugagagcauuggauacauucugucucuaagccuggcuuuccuggauacgcuauguccaguucaauguguuugcuaauuuccuuuacuuucuuugagcaguguauuuaguguguguuguuacauuuccaaguggccaaagcuuugcucuuggcuuguucugguuucuccuuuaguccugaagugcucucuggacacuuccuuuccuuuuagccccuuguagcugucuggcuacuuuguuauggacucuuaaacuacacagauuuuaggaacugcuccauuuuauggucaguggucagcacaacaugaggaacuguauuaaaggguugcagcacaacaaauuaggaagguuugagaaccacaguucuaaagacuccugaguugcuuuuccauuugcaguuucuccucuagccuguggucacucuccagggugaaccagggggccugagacagauuccuuaccugauucuagccaagcuucagggucagccaagaaccccuggcuugaguccuuccuuagaccuaaguaagugcuguccacugcuguccucccacuagggccaugaccuuccaucugugcuggacugcaguggcaccugguuaugucauggucuccuugcagguugaagguggaggagcuggagggugagcggagccgucuggaacaggaaaagcaggugcuggagaugcagauggagaaacuaacccuacagguagguuugguggccagagagagguucccuguagacaguacuccuuccagccccugugaaugaaccugggcuuccuccuaugcaucccccccuuaccuggcugagagcuacugcuggguucugcaggaccacaggucugggccacucuggcucgcugugcagggaccgcuucauacccuugguucuugugcuucucagcacugaccucggccucucuucucucuggugcuguacccugucacucccauuucccuguggucaugaccuucucugcugucugcauuagacuguuucucuucuuuuuaguuuuccuccuccugaucacacugcucauggcaagaagcccacagguuagagauugccuggcuucuagacaggccauugauuuuuaccuuggcaccuauuagaggcaaucaaauuguguccccauuaccaaucuuggugaugggagaggugacaacuuugaugaagugagguguucugaaccuuggcuguacucaugccgagcccuaggaccugucauccuguucuguucuaauugggccacuguccugggcugagggcugcaggagggugaaucaaggcuaccuggcuacagaacugugucaggauggggugauaaauggauuucagugcagcucacagagacgucagggacaacacaacuagaggaggugccaguguucuaugccccaugugggugacauaagaaugggauucacaagaucuccuccccacagcaucacaagugugugugcuggcacuguucagcccugcagcucagagccuuccugagggccagagugcuagugaccauguccaccccugcucugugcugcuguguguacugugugcaggcaggcacuaagugcauacgucugucaaccauacucauggcauggccggagacagcauggagggcugagucuguggcccuggagagcaggguccaugucagcugauguucaggaacccaggaaugguauucccaguuggcauggaggccugaggugggggagaggcagcuguuguagaaauuucuagacagccccauagacccugccaccucuguaggcugugcuuauacuucagaaagggaccuuaccagagccagacugggaaagcgguuacucagagacugccccaugaggccuaacuguucugugugggcuucuccuccaccccaccuccacccccaccccacugcucuuaggccaggguugcuugcuguccuccagccucacucugaucucagagcuggaggcuguauagcaggacucccugacuccuguugcauccuaaaccaccuucuccccuagccaguacuggaccucugcuagacuccccagaugagcacauaucuggaaguccaggugauugccagagugcugggcucuuugcucuguccuguacuauucauacuaaaggucuuuccaugugaggcugugcccacuauuuuauuaguaaauaaaccauuuacucaagcuguuuggucaugggaguuuggcccaguucccucuacauaccagccuuuccccucugugucccccuauacccuugucagacaaacuugugggugaaccagccuggcaguugccugugucuugcauaauugagucuccuuccuaggucacuggccucagcuccagggccccaugcuaacugcaagucugacugugucuguucuguaugucccagcuguuggcacaucugggcagggaggguuuuuacaccaggauugaacugguucugcaagggggcauuaguuaccugcgguaaggaacagucccuguccaaucucagugucagcuggcuccucaucugcugucccuucaguguguucaggagcaccugugugagcagccaguuuguaacacugaaugcaggguggcugcaguuccugagcacaugggcacagaagcuaugacacaugagacugguccugagggaaaggcaaacgggccuggguuuggcucaguagugggcaaggaggugacuuggacacaugaaaagagaaaggccgccaccuaugaacacggugggugggcuugggcguguugguuucugaucugagcugcugcacuuuauaaggcugggugaugaggauucuugagggaauccugugcuagguccuuucucucccccaugccccacuaucccccaacugccuucaaggccuuguuagaugcucugacauuccuucuucaucuaagucaaagcccucguucccauuauauguuggucuuggaccugggcacccucugguacuggggaagaaacauucauccuggggcuucuccguauggccuggccauagcauuugaugccggccccuuugagacccagccuccucugcagcucuaacggggcugcuuggaccuggaaucuuguggucuagccuuugggcuuccucaagccuuacccaugugcucaguaugcaggcagccuccugcgcucccacucccgccucacucuucccucuagagaagaagaguggcuucaaguuggcgcuucaaggaagauugauuaaaaucagcugcgguucaucuuaauugggaacauaugcucagagagggagcucaacuaguuaggauuuuuuguaauuaguucacagcugguuggcggggaagcaaaacucuggugaccacuuagagcugggugugugggcgugcuuggggguucaguggaggggucaucacaguggcugaaugcagacuuaccaaguugacgcacgccauccuuccuggguuuccugggucauuggcuguuuguaccaugaccugugugcauugcuaggguagcuagggaauaggaaacggguacuaagguguacuugucuaauggacacacgccaacuggcugaauggacggcugacuuaugauagacagcccuggcagagcuucugggagguuagacacuguggugcaggccucgagucucagcacuauaguggcuguuccgaguuucagagccuaggcuacauggugagauccuguggaaaguaugggggcaggugucuauaggaagaccuuacuuagagauggggaaacuaaggcuggcacagaggcagauacagggauugccagucucuguccuuagauaccuugugcuuucccuaaaagcagggacagcugcuuuauuacagagaccccccauguuccucauagccucccauaaagccuccacauagugcuucugaugagcuaggucaggacagcuugguguagagucaccaaggagaggccugccaggggcucugcccacccugcauggugacaagugagguuccuccauuugaaacguggaugccuccugggucccacacuauaggcuaagggcagccuccauggacucgggcccuacugcuuuuccccaguguuuuaacugcaagcguuuucaagauagagaaguagaaagaauuuuacagugaaugcccacuuacccaccaccuacauccugucgggaauggcacacuuguggcuguaugacauuccuauccaucccucugccauccauuaguucguuuuauucuuuugaugcauuugaaacuaaauugcagacaucuguauacuuccucuaagcacucgagcaugcauguaauuaagcgaauucaucucuggaaucugacgcccgggcccccgccgucccacaguaucgccucaucauagagcagagcuccucccuccaccagugaggcugugccaguggaccccagugccaggccucugagcuggcacauuccucucacagucaggggaggcuaggcugguguccauaccaccuuacaguccuucuaaagugcugcucagaacagagcccagacggcugcccagugacauuuaaaaucagaauaucuuuuuuggaaauggagugggcagaaaauugcuggguuuccugcaagcggaaagcuuucugagccugcagacgucccugcuccugucugcgucacaagcagcagugcgguuagggugcccagccuuacuucuuccugugcccacaccugccgcacauaguucuacaauuucaggaugucacuuaccaugagacacccaugucaggcaagacccuaagauaaugaaaaaaaacaaaagaagaagaagaacaacaacaacaacagcauugucuggauccuugagcuccagguugugccagcacaagucccuuaccugagugcugagugacacuaaggagguggcaucagugcucccugugugaaggucauggaucaugggagacgucagagcagaguguuggaguguccucuaggagcaucucacacagucccugcccacugugacuucucagcccaguucuuu

SEQ ID NO: 2767 - RNA, 16518 nt, Mus musculus
uaaagaauuaaauaugugcuccacgggcguagccugagaacaaaccgcagucccgccaggggacccggaaccaaacugggcccggcugccugucccgcagggcgcucuuccacugccccggggugcgccguaauguauggaauagcaccgcgcaggaggaaagguuuguuuguuuuuguuuuugagacaauguuucucuguguagccucgaacucacaaagauccacccgugccugccucugccucccuggaauuaaaggcuugccgcacaacugcugggcacgcucggaaagggaacaaaguuuuggaaaguugcguugccucugaaucuugccacuuuguauacacagguuguuuuguuugggcacuguuuugauugguuagcuuguuucacuuucuuucuuuugugaaugagaaguccugggaagaaguccuucacguugcggguccagagccugaugaaauuugucuaggggcuaugucuuuagccuccuuccuacccguugcuuuccugccucugcgucagcucuaacguguugugacuaaugaauaaaaaccucuuggaauaaauuaaaacccgguuucuaccaaccaaaaucccccggacagcaucagaagcauauagcugguauuucucuuugguguaacugccuacuuaaaucuuccaacaggccgguuuuuuauguuuuauuauuuuauuuuguguauggguguuucaugugcaugcaugauguccauagagaccagaugaggucagcagagccucuggaacgggaguuagaugucugugagccaacaugugugugcugagcacugaaccuggugaucuuaaccugagccauuucucuggcccaccaccaauggcuugguuugcuuugguuguuugguuguuuuuguuuuggguuuuuuaaauaauuuuauuuauugauauuaauaaauaauauuaauaaauaauaaacaauuuauuuauuuaauacauuugaguacacuauagcugucuucagacacuccagaagagggagucagaccucauuacggaugguugugagccaccaugugguugcugggauuugaacucaggaccuuuggaagagcagucaguacucuuaacggcugagccaucucucuagccccuuguuugggguuuuuuuaagacaggguuucccuguguagcccuggcuguccuggaacucaaggcuagccucaaacuuacagagacccaccugccucugcccgccucccaagugcuaagaauaaaggaguguaccaccuggcccccaccaauguauuuuuaaggugcccugacucaugacuuuguucuguuacuauaaaaacuuccucauugcuuccagacuggaauguggaauauaggguaaccuaagucuguauuuaugggacauagucauucauuuuuggcuugaauaaacaaucccuccaguugguugguaguggcacauguuuuuaaucccagcacucagaggcugaggcaagaguaucacugugaguucgagcccagccugggcuacaaagcaaguuccuggacaaccagggcuacacagagaaacccgaucuagaagaaaauaauaauaauaauaaaauggacuggagagauggcucaaccguuaagagcacugacugcucucccagagauucugaguucaauuccccacaaccacaugguggcucacaaccagcuguaaucugucuguaaugugucugaagacagcaacaguauacucacauaaaauaaauaaaucuuucaaaacaaauaaagauaaaaauuucucucaucccuuuugagaugaauguuguguuuuggguucaaaccgagaaacagagucuuacccuguagccuagguuggcccggaccucacagcaacccaucagccaucugagcacaggcaaaacggcccuggcccucuacugaccauugguuaucagacuauugaaucaaagggcccgagacuccuccuaaggauagccuccccagggggcagacgcaggaagaacuccucauuugucagcugaaggugaggacagacuuagugcugagacacugaugagacugggcaaccaagacagcuuccuucugccuucucuucaaccuuugacuucaacccuagcuaggccccugacacugggaccuagggacacccuggaugcagcuuugagucccucuucccagugaggccacacugaauaaagucccuuuuucugauuugcuaucaacuugucucuuugaaauuauugaggaggaguggccaagucuggcuuguugggacccagccugugacacuuacucucuuaacacagggacagcaaagugccaccgugccuagcuauggggggggggggguugagguuuuauuguuguuugguuggcuuugauguuuucaauagucucauuaugaagcccugguugucggggaacuauauagaccagacugaccuugaacucacagagaucccccugccucugccucccugguguuaggacuaaugaaguguaucacuuuccucagcugaggauuuucuuguuccuugcuuuuuguuuguuugcaaggcuggagcauucccagaauuucucuuaucuuaauuuggcagagucgcguuaaguugccccgccuggccuugaacucuuguucauccuguccuggccucccaaaucacuuguauuauagguaugugauaaugugcauacucgccucugcuguugucuugcaacaccggggcucuugccucuggaaggcaaggcagaggcaggucaacccuaagggauagcaacauucuuccuguccaagccuuucucuaguaacauuguaucuaguuuugugguugcuugguuggcuuucaugguuuucaagacaguuucucuguuguagcccugacucuccuggaacucugccugccaaguguuugagauuaaacacaugcaccaccacauuaggcuuaacaguuuauuuuagccagguagugguggcgcaggccuuuauucccagcauuugggaggcagaggcaggcagauuucugaguucgaggccagccuggucuacagugugaguucuaggacagccagggcuauacagagacccugucucaaaaaaacaaacaaacaaaaagaacaguuuaucuuuuuuuaaucuuuuuuauuuuuuuuaucuuuuuaaaaaaauuuuuuuaucuuuuuaaaaaagauuuauuuuauucauaugagugcuuugccugcacauaugucuguguaccacauguacgccuggugcuugcggaagugguuagccuccaggugggugcugggaaucgaacccagguccucugcaagaacaacagguacucuuaaucccagagccaacucuccagcuccaacagucuuuuaaggagaacuuucacaaagaacuugugcuuucuccagaaccuugugcggugcugacugacaaaucagagccucgauauugugggaagguugcagaugcagagccuaaagagagccuauuuuugauuauucagccuccuuaaauagccauuccuuuugcccacuugcccguguccgaccuaacagauaaaaaccucucugaaugcauuagcucggcaaccuuuacuaucuaucaacuaagaggcuaaauaaaugccaucagguaauagcuaaggcguggacaucggguaauagcuaaagcguguagccccgauuccucugccuggcuguagccaccuaugcaguuuccacugguguauuugaaaaagaggcuugacagccaggcauugguggcggcggcugugucugccuuuaaucccagcacucaggaaacaagggcagguguaugaguucgaggccagccuggucuacagagagaguuccaagacagccagcacuacacacagaaacacugucucaaaaacaaaaacaagaaaagaaagaaaagugcuuugacuuagaacuuuuuguguuacuauaaaaacuuacuaaauguguauuucuuagccacagccauucaguuccagcuccagaauaaacucguacccuuugaugugaaagugcugaaaugcuacacuuugcaucaacacuuucugguuuaggagcccucagcccucacccauuuuagcugucagcaaggcugaccucaccccacagcaguccagcuguugugaacccugcacagacccauugaggaagcaacauggcaacuguaccacuuggugccaacuugugaauuucgcuucaacuguccuguuuaaaacacucugugacagaguuuuuuuguuuguuuguuugguuuuuguuuuguuuuuuugccacgaaaagccuuugugaacuccagcagccauuuuuacccaggcucgagugggaacacuucccccagagugcccagugggccugugguuagugcaaacggggcuuuuacagcacaaagaacugacaauaaaggugcaggcucaacuuccacagccucucucugggucuauaaggacaggcuucuguccaugguuuuuguuuaguuauuuaugugugugcguauuuugcuggaauguaccugucugugcaccacauuagugcaguguccaugaagaccagaacaggacauuggauccccugggacuaauuacuaaaauuacuaaugguuggggcugcuaugugagugcugagacuugaaccuggguacauggacacacacacacauacacacauacacacacacacacacacacacacacacacucacagaugaugauaaccaugcaaccucuucuuuccuaaagaaggcugacauucaccgaggagcaagugucuugcugcgugcuuuagcaaugacauuuaugggcuuuggagcagaaguaucauagcaguauauucuuccacuaaaaacauuaaaaacagggcuggagagauggcucagugguuaagagcacugacugcucuucugaagguccugaguucaaaucccagcaaccacaugguggcucacaaccauccauaaugagaucugacgcccucuucuggaaugucugaaggcaacuacauauacuuacauauaauaaauaaaucuuuaaaaaaaauacauauauauauauaucaacaaagcacccccagaccaggcaugcauucacacugaacacgccucccccuaauugcucuagggauugucucuguuugaagaacagagguguugccagcauucaccagagacaaggagagcaagcccucucuagaaaccucagccuccaccucuuuccaccagucagcccagcagaggacuugcugugcucagagagcaccacagcaaugccugcuccucacaacugacaagucuaggagcugaagacuuuccauaaggccagagccagguacaucuguccucuguagcucaggcugacccuaaaguccugauccuccucucuuugcugggauugcaggcacgcauugccucaccuggucuauggcgugcuaggggaggaacccagggcuucauaaaugccaggcaagugcucuacccacugagcaacacucccagucuagcgaaaggguuccauugcuuuaguucuuucccaccucccuggcccuugaauaccaggucgauuugguuuuguuuugggggugcgagagaacauacuugggaccuuucacacaguagacaggcucucuguugcugagccuugaucccagcccaacaaaucaauggucuuucucccucccucccucccucccucccucccucccucccucccuccuucauuuauuuauuuauuuauuuaguguagcccuggcuguccuggaacucgcucuguagcccaggcuggccucuuaagucacaagucacagagcuccuccagccucugcugggauuaaaggcgugugccaccacugccuaguuugucuguuuuuuguuuuuccuuuuauauccuucacucuccuaacauucucuucaaacauggcgugagccagguguggcaguguacacuugccaucccagcacuugggaagcaaggcaggaggacugugggcucauagccagccuggguuauagugacacucaaccucacaaacagacaaguaaacaaaagccagaaaaauaaaaucaugauagagaagacugcuuuguuuucagcauuuaaaagccuuggaaggaaaggguuucuuugccucacucaucccaaccacaguccaucacugaaggaaaucaaaguggguucucggggugggaaccuggaggcagcagcaacuggagacggggagugggguauggaugacuggcuuguuccucaguccugcucaccccgcuuucucauacaacucaggcuaccugccaagggauggcagcacccgcacagggcugggcccugccacgucagucacucaucaaugucucccuggcucagccugugagccgauggaggaauuccacagucagauucuuucuucccagacaaauugccaaaaacuaacaguaccaauauaucuguucauauugugugcagccugcgugugcgugcacgcgcucucgcugcucuggggucccggaugcugcacucagacugucaggcuuagcagcaaucccccuuuccucacugcgccauggcgcugcccauucuuagcacuuuuucacggcccuugaaaauauuugcuuaucucuuuaaaagcagaggugccuuggggugcuggucauauccacaaggcagcuugaauccacgcuccuccggaagcacccccagaauggcagggcagacucacggccuccuggugcccuuccccccacgguacuggguggcuaacagguacaccuccgaagacucuuuccugcuggccuccgguuucaccacccuugugcucuggaauuccugggucagucucuucugcagcagguggcuuuuacuuccggcccagguuuuacacagcagugucccuccgggaugcaggauguccacagccauguccacaaggguaaggcacaagcugaugagcuuaucgugaucgaggucucugaucccaguggcauucggugccaugucacucagaaucacaucugcucuccugcugggaagcaguucuagaaucuucuggaaaguucuggggucagucacaucagcagggcauagaaaaguugcucccgccaaagggaauaugugaaggagaucgaccccaagcacaaagcccacaggagagcuggaaucuaaggaaguaacacaauguguuauuaaaccaugaaucucccuaccaaaaaacaagucacaaaaggcagucaggcacccaugcauguaugugcgcaaaagaccuuugguaugaaggcacaugaguuagauguaauaauggcacaggcuauaaccucagcacuuugggagccugaggcgggaggacugucacaaguucaaggcuaguuugagcuaccaagugagaucucgucucucaaaguugaaaaauaaguaaauaaauaaagacacguaguagaguguaggguguccucuacucccccuggcauagcuggggaaguugagaccuagaaaggaaauggccuugccaucguggagagugacaagccgaggugaaccgcagccaaggugcugaaucccacuucacugucaguucacuaccccaggcuccccucccacagaaggacucuucuuccaaaugauuuuuuauuuuauuuaguaugcguugguucuaaaaugggaaucuuaguagguagcccaggcuagcccaaaacauaauaaguuccugacuuaacccagugaguaccugagguuacaggugggcaccaccauacccagcucccaacaauccuuuuugguuuuuaauguuuguuugcuuuuuauuccuugagacaaucucacuauauagcccaggcuagccucaaauucagagaacugaugccucugccucuaaagggcuagaaccaugugagaccaugcucuacuguuuugucuuccagauguauuauuuauuuacauaugugugaaugugcacucaagugcagguaccugcccaguucaaggccuggaugugaaaucacggaggcuaggggcugccugaugugggugcugggaacugaacuugaguccucucugagagccaagcccuucauuuuuggcucuugguucuuugagaacugugugacucaggccugggauuccugguucuccugucucuaccaccagagggcuagggucacagguauagccaccacagcugggcaaugucacagaugcagcuguuuuuucgcuuuuucucuuuccuauuugggcaccauuucacacacacacacacacacacacacacacacacacacacaguacacagccuaucacauucccagaguaaggaauccaguggccccagugggaccuccaagagcuccuaggcuucagggacacauuaguaguccuguccccaaacccugcugucuuggaguuucuacugcugugaugaaacaccauaaccaaaaauccaguuggagaagaaggggguuacgugacuuacacauccauaucacugucacugaaagaagccagaacaggaacucaaucaaggcuggagccuggaggcaggagcugcugaugcacaggccauggagggugcugcugacuggcccgcuccccuggcucgcacagccugccugcuccccuggcucgaagagccugcuuucuuacagggcccagacccccagcccagguggaaaccuuuuccuacucacagugucugguuauggugcuuaugacagcaacagaaagcaaaggaagccauuauuguuuaguuuucuggggcuuuuuguuuuguuuagagaaagggacauagugcgaacccaggcuguccgccaacuccugugguuuucuucuuuguucuuuuuuaaacauuuugcuuauuuaaucauguaugugagaggguauauaagcaagugagcacacgccacggcacauuuguggaguccacacagcaacuuucuggugucaauucucccguccacaguguaaauccuggggcgagaacucaagcuugucagccuuaccggcaugcaccauucaaccaccaagccagugggucacagcccagagugagaaccacugcugacuaacccaucuucauagcaucaccaccacccugugcucccuucccaacccccuaccucugcccuuuuuuuuuucucuaguacagacauaccauguagcugggaugacccugaacuucuaauccugccuccaccucguaggccugcggggccugacuuuacuuagcagcuguguccuguacccagccugugucguauuucuguaacucucaucucuaaaccuacuuagaaagagccucaaacaaugucucuagguaagagcugcucacuagcaguagucagaggagcugggaguccagcaggucccaccugcgccuguggcauugacgcgcugcacugccaccugacuccaggcucccggagcugccccgcaguccagcacccggagaccgggccucaggaucugaugcuucucauucaucuccaggaguuugaaggcacugcggcagcgguaacucuccaccuuugcggccuucacaaacggauccuuuagaugccgcgugagccacaggugcucagcgccgguccggccccuguagugacacacugcuguguguaaccuccgaaccuuaaggggaacgccuaccagcuucagaugccugaaaugacgaaaaaagaguuagcgggugggcauuacacagagaggcaagaaagucuugguucaaccuuuuuguuucugcauauguaugugcgauaugcaugcacgcauguguauuagcauguaugugcacaugugucugccuguguauggggguccaaaguagagaagggacguccccuucgcuugcucucuaccuuauguauugauguaaggucgccaaccugccagucuaucucgccagcuuucuccagggaccccuuuucucugccuccccagcacugggguuacauuuggucagcacacauguccaguauuuuguaggcucuggggauccgaaccccaauccucccgaaugcacagcuuuauccacggagcccauacaccuauuucuauguugcaagccucacucacucacgucuguacaugaauaaacaucguacacccgugucccgcuccccgggacggaggucgccagcaccccucugcaacacaauucacugagcucccuacuacugucauccacuccguuccuguaugcaaagacguccuuuuagcgcaggcagacgccguaacucacucacccggccauugcugcuugcuggugguuuccucccgccgccggaagucccgcccucgcuuccaacgcgaggcuccgccccgggaaacuuuggcuggggcgcgaagguauggauggucccgggcgaaugagaucugggugcgggagagacgcuggaggucgggaguggggugccagggaaaaucuggggagagaagggguagaaggacuagagagcagcuucaaacccaccaggaaaacugggguacugggcaggccugaggucgggaagaccagggaaacuacagagaguagggagcagaaaugagagggagaggggaccugggcgguaagcugaugcaugggcaguuugcagccugucuguaccggccauagccccugggaggggaggcuagggaacggcauuugcagagugcccccugcaggcagguucugggcucugcacuccaugugcauugucuccaacaccugcaacacuugaccucaauucagaccaaagguuguccaaaguucccugacacacauccgauuuaccaccuaucacagcuaccaggacacccuuguuugcuucuaggcucugccauuugaccucggagcacuaguuuucgccucagaaacgaagaaaguaagucuuaaacucuguucuuagucuuuuuuuuuuuuuuuuuacuuuuuuuauuagguauuuuccucauuuacauuuccaaugcuaucccaaaagucccucauacccucccccccacuccccuacccacccacucccauuuccauugcaaagggaaacaguauggggacucuguuugaagcaaugccaaucaacagagccauagccacacccauucuaccugauuccaaucuauguccucacugcucauuucacugagacaaggagcugagcacgcuggugcacgccugucauucuacacucaggugguugagcgggaagauugugaguuuaaguccagaauggagaacauggcacaacucugucucguuuaaaauccuugcaaaacaaaucacucaucuguauggaaugugaggacauuugucaucacucccuacaugaaaacaauuuacauaguuugcauguaaagugggccggaggaugucuguaaguuacaggcaaauaugccauuucaaagaagugauuucaucauacuuuaaucccaguauccauggaaggguaagguauccugguaucuguggauaugaaagauauccuguggauauccuguggcuaugaaagacagcuguauacagccggugcuuaauaagagauggcugacuuugcugagucaggaagccagaggcucaggcacaggcaagucagaacacaggccaaugcuaagcccacuucuucuccugacuuaccucagcaccaggccuaagcuuccgggucccuuuucuuucccuuucuucuuauucuguuuuuaaauuuuaacuuauauugugcacauauaggguuguuggauuuuuuuauucgagaacguauaggguuuuaaaaauauuuauuuuggggggcuggugagauggcucagcgguuaggagcgcugacugcucuuccaaagguccugaguucaaaucccagcaaccacaugguggcucacaaccauccguaaugagaucugaugcccucuucuggagugucugaagacagcuacaguguauauaauaaacaaacaaacaaacaaauaaauauuuuaaaaaaccauccagaggugguguauagcuuuuaaaaaauauuuauuuuuuauguucauugaugcuuugccuccauguauguuuguguagggggccauauccccaggagcuagaauuacagacaauugcaagccaccaugugguugcugggaauugaacuuggugccccuggaggagcagccagugcucuuaaccacugagcagccaucucuccagcuggaauacaggaguuuuguuaacauuuauacuauaugugugccugguacccaaagacgccagaagagggcaucagaacagaguuagacagucgugagccaccauguggaugcuagaaauggaaccacaguccucugcaagagcagcuaguccuccuaaccacugccaucucuccagcccuuguucaaguuccuuuucuuauacacugcagccucuuaggagggucccaguuucuguauacugccuuagccaguugaggccuaggaaacaauaaaauaagacgcuuugucugggggcuggagagauggcucaguacugggaguauggcucaguaguagagccccugccuagaaucccccagugaggggcugggguauggcucaaugggagagcauuagccuagcaugcucaaggcuuugaguucuuuccccagcacuguaaauacauacauacauacauacuuauauacaugcauaaaaauauaaaugaaaaggggaccucaaaggcacauuuguacaugcccugcuaagccacaggguguauauccugugacuguguauuuagcaggucauaccauccaccucucccagaauguaucucccucccaccuggccacaacagaacucauaugaugcauacucuaacagacuacagaccaaucaaaccacauuuucccauccucuuaacaggacccaggagagcaugagcaccuccaggcuuuauacccuugugcuagugcuacagccucagcgaguucuccugggcaugaagaagaggggcuuuggugcuggccgcuggaauggcuucgggggcaaggugcaggaaggagagaccauugaggauggggcuaagaggugagaagaagggaagucugaccacagagccagccuagcuggggaugaagcccaagagaguaggaaauauacccuuaagacugaccgaugcuauguagaccaugcuggccuugaacucgcggagaucuacuugccuuuacuucuagagggcugggauuaaaggccuaggccagcauaccuggcuuuuaaauuuucuuuaagggucuggguuuuuuuuuuuuuuuaauaugcauuggugcuuugcccacaugaaugucuguaugaggguccuagauccacuggaacuagaauuauagacaguaugaacugccauguaggugcugggaauugaaccccaguccucugggagagcagccagugcucucaacugcuaaaccaccucucuagccuccuuaaagggucuuucugcauauuccagguggccuuuaauuauguagcccagguugguuucaaaccccaaacuuuccugcuccaaccuccuuaguguugggauuacaaguguguaaucccaugucugaauuuaugaaguucaagucauuucucaacuaguuauagcaaugccucugcacgcuguccuccuggaauacgcaggucacaaguccuggggcugcugucccgugccccugucccuugcaagcauggacgccauguucaugagcuagcuaaugcccacguccuuccuuaccuguccagagagcugcuggaagaaaguggucugagcguggauacacugcacaagguaggccacaucucguuugaauuugugggcucuccugagcugauggacgugcauaucuucucggcugaccaugugcacgggacgcccacagaaagugaaggugagccaugggcagggaaggauggguacccagacucacuugccagccuaggagaaaggaaccaacccuugccaaguauaggcaccaagccuuucuaucuuugcuuugcgucugaaccaggggcagccaggcagagcagacuuguagcguggggaugagucaauuucuuucuuuucuuuuuuaaaaaagauuuauuuauuuauuauauuuaagcacacuguagcugucuucagacacuccagaagagggcgucagaucucauuacagaugguugugagccaccaugugguugcugggauuugaacucaggaccucuggaagagcagucagugcucuuaaucacugagccaucucuccagccccaguacauuucuuuauuucacagauuauggaaaugagccaaauauugguacaugcauuuuuaucccaacacuugagaggaagaggcgggguaucgcugugagcucaaagccaaccugaucuacauugugagaccuuguuucaaaaaaaaugaagagccagguaguaguaguacaugccuuuaaucccagcacuugggaaacagagcuaagugaucuuaauuugaggccagccuggucuacagcaugaguucuaggacagucagggcuacacagagaaaccgugucuugggaagaaaaaaaaaaaggaggaggaggaaggggaggaagaagagaaggaggaggaaggggaggaagaggaggaggagcagcagcugcuggggugcgguucgguugacaggacucugguuagcaagcacaaagaccugagcuccauccccagcaguggcaugaaccaugugguguuucaugucucaaucccaacacaggagauuaggccucagaaagucucacaaacaacuaagugaauaaccagguauguugaggcucauccacaaucccagcccugaggcaggaaaaccgaaucggagggaacacugggcuacagaauggguucuaggcuagccugagcuacauaaaagaacccugucaagaccaagagauggucaugagcuauaaaauuagaccaggcuccuuucucagauacgucagcuauagcagugcacacugauaaucccagcaccaaggaagcugaggcagaaggauugccuugaauucaagacuaacauggguaacauacucaaugcuagaucauucagagcuccaaagaaaagucccuguauccaagaaaauaaagcaggcaugguggugucccauaccuguaaacccagcaaccaggaaucugaggcaggaggauugccacucacuccauaccagccugggcuacaguguagagguucuaucccaaacagcuccagaggaugaggagaugaaggcucagagcuaagagcacuugcucuugcaaaggaccuaugugcuuuuagccauccccaaagggcugcucacaccaguccagaacacagguccaggggaucugaugcccucuucuggugucuauaggaacugcaugcaugcuguauccaggcaaaacauucguacauauaaaauaauuuuuacaaaauuuuaaagaagggauaauauuagaaagcugguucugcaguuaagaucacauacugcccuuccagagaacccacauuugauccccagcacccacaucagguggcucacaaaugauuaacaccagcuucagggggauccaaugucuucggccucuaugggccuauacaccaacacaauaacauacauguaguuaaaaauaauauuaaaccuguaaacucuuucuuuugauaaauaaccaccaccaccaaaaauguccaaacaacuggagagagauuucaacacuuaacaguacucgcuggucuuccagaggacccacguucagucuccagcaccugcacuagucagugugcgaccggcucugacgccagcuccucuucuggucuccucuagaacccacacacuuaugacauucauccacaaagacauauucagauacguaacagggcucugcauucaaggccagccaggguugaauagugagaccaugucucaaacaaaacaaaaucucccaacagguauucacagggacccagggguaagcccucucaggucggcugaaaucuauguucuuccucuucccccuccccccaacccagaaaugcgcccucagugguuccaacuggaccagauccccuuugccgaccuguggccggaugacagcuacugguucccacuccugcuucagaagaagaaguucugugggcacuucaaguuccaggaucaggacacgauccucaguuacucgcugcgagagguggacucauucuaauacagaagucuggcugguucuggccacucaggaugcuacacagccgcaagcugucggaccaagggcacaagcaggggcugguauuuucugugugcgagggguugggguugaaaugugaaaugucaccaauacaccaauguuugaauucuucguccccacauacugguccuguuuuagaagguuguggcaccuuuaagagccagagcccugcugguggaacugagucacugggggucggagaauggaggaugggccuugcuuuauaggugagcaccgcuuacugucugcucacacuccggcuacugugucagauuuuccacgauggacuguauccccagauggaugagcugaaauaaaccguugcuccucuaag

SEQ ID NO: 2768 - RNA, 16518 nt, Mus musculus
cuuagaggagcaacgguuuauuucagcucauccaucuggggauacaguccaucguggaaaaucugacacaguagccggagugugagcagacaguaagcggugcucaccuauaaagcaaggcccauccuccauucuccgacccccagugacucaguuccaccagcagggcucuggcucuuaaaggugccacaaccuucuaaaacaggaccaguauguggggacgaagaauucaaacauugguguauuggugacauuucacauuucaaccccaaccccucgcacacagaaaauaccagccccugcuugugcccuugguccgacagcuugcggcuguguagcauccugaguggccagaaccagccagacuucuguauuagaaugaguccaccucucgcagcgaguaacugaggaucguguccugauccuggaacuugaagugcccacagaacuucuucuucugaagcaggagugggaaccaguagcugucauccggccacaggucggcaaaggggaucugguccaguuggaaccacugagggcgcauuucuggguuggggggagggggaagaggaagaacauagauuucagccgaccugagagggcuuaccccugggucccugugaauaccuguugggagauuuuguuuuguuugagacauggucucacuauucaacccuggcuggccuugaaugcagagcccuguuacguaucugaauaugucuuuguggaugaaugucauaaguguguggguucuagaggagaccagaagaggagcuggcgucagagccggucgcacacugacuagugcaggugcuggagacugaacguggguccucuggaagaccagcgaguacuguuaaguguugaaaucucucuccaguuguuuggacauuuuuggugguggugguuauuuaucaaaagaaagaguuuacagguuuaauauuauuuuuaacuacauguauguuauuguguugguguauaggcccauagaggccgaagacauuggaucccccugaagcugguguuaaucauuugugagccaccugaugugggugcuggggaucaaauguggguucucuggaagggcaguaugugaucuuaacugcagaaccagcuuucuaauauuaucccuucuuuaaaauuuuguaaaaauuauuuuauauguacgaauguuuugccuggauacagcaugcaugcaguuccuauagacaccagaagagggcaucagauccccuggaccuguguucuggacuggugugagcagcccuuuggggauggcuaaaagcacauagguccuuugcaagagcaagugcucuuagcucugagccuucaucuccucauccucuggagcuguuugggauagaaccucuacacuguagcccaggcugguauggagugaguggcaauccuccugccucagauuccugguugcuggguuuacagguaugggacaccaccaugccugcuuuauuuucuuggauacagggacuuuucuuuggagcucugaaugaucuagcauugaguauguuacccauguuagucuugaauucaaggcaauccuucugccucagcuuccuuggugcugggauuaucagugugcacugcuauagcugacguaucugagaaaggagccuggucuaauuuuauagcucaugaccaucucuuggucuugacaggguucuuuuauguagcucaggcuagccuagaacccauucuguagcccaguguucccuccgauucgguuuuccugccucagggcugggauuguggaugagccucaacauaccugguuauucacuuaguuguuugugagacuuucugaggccuaaucuccuguguugggauugagacaugaaacaccacaugguucaugccacugcuggggauggagcucaggucuuugugcuugcuaaccagaguccugucaaccgaaccgcaccccagcagcugcugcuccuccuccucuuccuccccuuccuccuccuucucuucuuccuccccuuccuccuccuccuuuuuuuuuuucuucccaagacacgguuucucuguguagcccugacuguccuagaacucaugcuguagaccaggcuggccucaaauuaagaucacuuagcucuguuucccaagugcugggauuaaaggcauguacuacuacuaccuggcucuucauuuuuuuugaaacaaggucucacaauguagaucagguuggcuuugagcucacagcgauaccccgccucuuccucucaaguguugggauaaaaaugcauguaccaauauuuggcucauuuccauaaucugugaaauaaagaaauguacuggggcuggagagauggcucagugauuaagagcacugacugcucuuccagagguccugaguucaaaucccagcaaccacaugguggcucacaaccaucuguaaugagaucugacgcccucuucuggagugucugaagacagcuacagugugcuuaaauauaauaaauaaauaaaucuuuuuuaaaaaagaaaagaaagaaauugacucauccccacgcuacaagucugcucugccuggcugccccugguucagacgcaaagcaaagauagaaaggcuuggugccuauacuuggcaaggguugguuccuuucuccuaggcuggcaagugagucuggguacccauccuucccugcccauggcucaccuucacuuucugugggcgucccgugcacauggucagccgagaagauaugcacguccaucagcucaggagagcccacaaauucaaacgagauguggccuaccuugugcaguguauccacgcucagaccacuuucuuccagcagcucucuggacagguaaggaaggacgugggcauuagcuagcucaugaacauggcguccaugcuugcaagggacaggggcacgggacagcagccccaggacuugugaccugcguauuccaggaggacagcgugcagaggcauugcuauaacuaguugagaaaugacuugaacuucauaaauucagacaugggauuacacacuuguaaucccaacacuaaggagguuggagcaggaaaguuugggguuugaaaccaaccugggcuacauaauuaaaggccaccuggaauaugcagaaagacccuuuaaggaggcuagagaggugguuuagcaguugagagcacuggcugcucucccagaggacugggguucaauucccagcaccuacauggcaguucauacugucuauaauucuaguuccaguggaucuaggacccucauacagacauucaugugggcaaagcaccaaugcauauuaaaaaaaaaaaaaaacccagacccuuaaagaaaauuuaaaagccagguaugcuggccuaggccuuuaaucccagcccucuagaaguaaaggcaaguagaucuccgcgaguucaaggccagcauggucuacauagcaucggucagucuuaaggguauauuuccuacucucuugggcuucauccccagcuaggcuggcucuguggucagacuucccuucuucucaccucuuagccccauccucaauggucucuccuuccugcaccuugcccccgaagccauuccagcggccagcaccaaagccccucuucuucaugcccaggagaacucgcugaggcuguagcacuagcacaaggguauaaagccuggaggugcucaugcucuccuggguccuguuaagaggaugggaaaaugugguuugauuggucuguagucuguuagaguaugcaucauaugaguucuguuguggccaggugggagggagauacauucugggagagguggaugguaugaccugcuaaauacacagucacaggauauacacccuguggcuuagcagggcauguacaaaugugccuuugagguccccuuuucauuuauauuuuuaugcauguauauaaguauguauguauguauguauuuacagugcuggggaaagaacucaaagccuugagcaugcuaggcuaaugcucucccauugagccauaccccagccccucacugggggauucuaggcaggggcucuacuacugagccauacucccaguacugagccaucucuccagcccccagacaaagcgucuuauuuuauuguuuccuaggccucaacuggcuaaggcaguauacagaaacugggacccuccuaagaggcugcaguguauaagaaaaggaacuugaacaagggcuggagagauggcagugguuaggaggacuagcugcucuugcagaggacugugguuccauuucuagcauccacaugguggcucacgacugucuaacucuguucugaugcccucuucuggcgucuuuggguaccaggcacacauauaguauaaauguuaacaaaacuccuguauuccagcuggagagauggcugcucagugguuaagagcacuggcugcuccuccaggggcaccaaguucaauucccagcaaccacaugguggcuugcaauugucuguaauucuagcuccuggggauauggcccccuacacaaacauacauggaggcaaagcaucaaugaacauaaaaaauaaauauuuuuuaaaagcuauacaccaccucuggaugguuuuuuaaaauauuuauuuguuuguuuguuuguuuauuauauacacuguagcugucuucagacacuccagaagagggcaucagaucucauuacggaugguugugagccaccaugugguugcugggauuugaacucaggaccuuuggaagagcagucagcgcuccuaaccgcugagccaucucaccagccccccaaaauaaauauuuuuaaaacccuauacguucucgaauaaaaaaauccaacaacccuauaugugcacaauauaaguuaaaauuuaaaaacagaauaagaagaaagggaaagaaaagggacccggaagcuuaggccuggugcugagguaagucaggagaagaagugggcuuagcauuggccuguguucugacuugccugugccugagccucuggcuuccugacucagcaaagucagccaucucuuauuaagcaccggcuguauacagcugucuuucauagccacaggauauccacaggauaucuuucauauccacagauaccaggauaccuuacccuuccauggauacugggauuaaaguaugaugaaaucacuucuuugaaauggcauauuugccuguaacuuacagacauccuccggcccacuuuacaugcaaacuauguaaauuguuuucauguagggagugaugacaaauguccucacauuccauacagaugagugauuuguuuugcaaggauuuuaaacgagacagaguugugccauguucuccauucuggacuuaaacucacaaucuucccgcucaaccaccugaguguagaaugacaggcgugcaccagcgugcucagcuccuugucucagugaaaugagcagugaggacauagauuggaaucagguagaauggguguggcuauggcucuguugauuggcauugcuucaaacagaguccccauacuguuucccuuugcaauggaaaugggaguggguggguaggggagugggggggaggguaugagggacuuuugggauagcauuggaaauguaaaugaggaaaauaccuaauaaaaaaaguaaaaaaaaaaaaaaaaagacuaagaacagaguuuaagacuuacuuucuucguuucugaggcgaaaacuagugcuccgaggucaaauggcagagccuagaagcaaacaaggguguccugguagcugugauaggugguaaaucggaugugugucagggaacuuuggacaaccuuuggucugaauugaggucaaguguugcagguguuggagacaaugcacauggagugcagagcccagaaccugccugcagggggcacucugcaaaugccguucccuagccuccccucccaggggcuauggccgguacagacaggcugcaaacugcccaugcaucagcuuaccgcccagguccccucucccucucauuucugcucccuacucucuguaguuucccuggucuucccgaccucaggccugcccaguaccccaguuuuccugguggguuugaagcugcucucuaguccuucuaccccuucucuccccagauuuucccuggcaccccacucccgaccuccagcgucucucccgcacccagaucucauucgcccgggaccauccauaccuucgcgccccagccaaaguuucccggggcggagccucgcguuggaagcgagggcgggacuuccggcggcgggaggaaaccaccagcaagcagcaauggccgggugagugaguuacggcgucugccugcgcuaaaaggacgucuuugcauacaggaacggaguggaugacaguaguagggagcucagugaauuguguugcagaggggugcuggcgaccuccgucccggggagcgggacacggguguacgauguuuauucauguacagacgugagugagugaggcuugcaacauagaaauagguguaugggcuccguggauaaagcugugcauucgggaggauugggguucggauccccagagccuacaaaauacuggacaugugugcugaccaaauguaaccccagugcuggggaggcagagaaaaggggucccuggagaaagcuggcgagauagacuggcagguuggcgaccuuacaucaauacauaagguagagagcaagcgaaggggacgucccuucucuacuuuggacccccauacacaggcagacacaugugcacauacaugcuaauacacaugcgugcaugcauaucgcacauacauaugcagaaacaaaaagguugaaccaagacuuucuugccucucuguguaaugcccacccgcuaacucuuuuuucgucauuucaggcaucugaagcugguaggcguuccccuuaagguucggagguuacacacagcagugugucacuacaggggccggaccggcgcugagcaccuguggcucacgcggcaucuaaaggauccguuugugaaggccgcaaagguggagaguuaccgcugccgcagugccuucaaacuccuggagaugaaugagaagcaucagauccugaggcccggucuccgggugcuggacugcggggcagcuccgggagccuggagucagguggcagugcagcgcgucaaugccacaggcgcaggugggaccugcuggacucccagcuccucugacuacugcuagugagcagcucuuaccuagagacauuguuugaggcucuuucuaaguagguuuagagaugagaguuacagaaauacgacacaggcuggguacaggacacagcugcuaaguaaagucaggccccgcaggccuacgagguggaggcaggauuagaaguucagggucaucccagcuacaugguaugucuguacuagagaaaaaaaaaagggcagagguaggggguugggaagggagcacagggugguggugaugcuaugaagauggguuagucagcagugguucucacucugggcugugacccacuggcuuggugguugaauggugcaugccgguaaggcugacaagcuugaguucucgccccaggauuuacacuguggacgggagaauugacaccagaaaguugcuguguggacuccacaaaugugccguggcgugugcucacuugcuuauauacccucucacauacaugauuaaauaagcaaaauguuuaaaaaagaacaaagaagaaaaccacaggaguuggcggacagccuggguucgcacuaugucccuuucucuaaacaaaacaaaaagccccagaaaacuaaacaauaauggcuuccuuugcuuucuguugcugucauaagcaccauaaccagacacugugaguaggaaaagguuuccaccugggcugggggucugggcccuguaagaaagcaggcucuucgagccaggggagcaggcaggcugugcgagccaggggagcgggccagucagcagcacccuccauggccugugcaucagcagcuccugccuccaggcuccagccuugauugaguuccuguucuggcuucuuucagugacagugauauggauguguaagucacguaacccccuucuucuccaacuggauuuuugguuaugguguuucaucacagcaguagaaacuccaagacagcaggguuuggggacaggacuacuaaugugucccugaagccuaggagcucuuggaggucccacuggggccacuggauuccuuacucugggaaugugauaggcuguguacugugugugugugugugugugugugugugugugugugugugaaauggugcccaaauaggaaagagaaaaagcgaaaaaacagcugcaucugugacauugcccagcugugguggcuauaccugugacccuagcccucuggugguagagacaggagaaccaggaaucccaggccugagucacacaguucucaaagaaccaagagccaaaaaugaagggcuuggcucucagagaggacucaaguucaguucccagcacccacaucaggcagccccuagccuccgugauuucacauccaggccuugaacugggcagguaccugcacuugagugcacauucacacauauguaaauaaauaauacaucuggaagacaaaacaguagagcauggucucacaugguucuagcccuuuagaggcagaggcaucaguucucugaauuugaggcuagccugggcuauauagugagauugucucaaggaauaaaaagcaaacaaacauuaaaaaccaaaaaggauuguugggagcuggguaugguggugcccaccuguaaccucagguacucacuggguuaagucaggaacuuauuauguuuugggcuagccugggcuaccuacuaagauucccauuuuagaaccaacgcauacuaaauaaaauaaaaaaucauuuggaagaagaguccuucugugggaggggagccugggguagugaacugacagugaagugggauucagcaccuuggcugcgguucaccucggcuugucacucuccacgauggcaaggccauuuccuuucuaggucucaacuuccccagcuaugccagggggaguagaggacacccuacacucuacuacgugucuuuauuuauuuacuuauuuuucaacuuugagagacgagaucucacuugguagcucaaacuagccuugaacuugugacaguccucccgccucaggcucccaaagugcugagguuauagccugugccauuauuacaucuaacucaugugccuucauaccaaaggucuuuugcgcacauacaugcaugggugccugacugccuuuugugacuuguuuuuugguagggagauucaugguuuaauaacacauuguguuacuuccuuagauuccagcucuccugugggcuuugugcuuggggucgaucuccuucacauauucccuuuggcgggagcaacuuuucuaugcccugcugaugugacugaccccagaacuuuccagaagauucuagaacugcuucccagcaggagagcagaugugauucugagugacauggcaccgaaugccacugggaucagagaccucgaucacgauaagcucaucagcuugugccuuacccuuguggacauggcuguggacauccugcaucccggagggacacugcuguguaaaaccugggccggaaguaaaagccaccugcugcagaagagacugacccaggaauuccagagcacaaggguggugaaaccggaggccagcaggaaagagucuucggagguguaccuguuagccacccaguaccguggggggaagggcaccaggaggccgugagucugcccugccauucugggggugcuuccggaggagcguggauucaagcugccuuguggauaugaccagcaccccaaggcaccucugcuuuuaaagagauaagcaaauauuuucaagggccgugaaaaagugcuaagaaugggcagcgccauggcgcagugaggaaagggggauugcugcuaagccugacagucugagugcagcauccgggaccccagagcagcgagagcgcgugcacgcacacgcaggcugcacacaauaugaacagauauauugguacuguuaguuuuuggcaauuugucugggaagaaagaaucugacuguggaauuccuccaucggcucacaggcugagccagggagacauugaugagugacugacguggcagggcccagcccugugcgggugcugccaucccuuggcagguagccugaguuguaugagaaagcggggugagcaggacugaggaacaagccagucauccauaccccacuccccgucuccaguugcugcugccuccagguucccaccccgagaacccacuuugauuuccuucagugauggacugugguugggaugagugaggcaaagaaacccuuuccuuccaaggcuuuuaaaugcugaaaacaaagcagucuucucuaucaugauuuuauuuuucuggcuuuuguuuacuugucuguuugugagguugagugucacuauaacccaggcuggcuaugagcccacaguccuccugccuugcuucccaagugcugggauggcaaguguacacugccacaccuggcucacgccauguuugaagagaauguuaggagagugaaggauauaaaaggaaaaacaaaaaacagacaaacuaggcagugguggcacacgccuuuaaucccagcagaggcuggaggagcucugugacuugugacuuaagaggccagccugggcuacagagcgaguuccaggacagccagggcuacacuaaauaaauaaauaaauaaaugaaggagggagggagggagggagggagggagggagggagggagggagaaagaccauugauuuguugggcugggaucaaggcucagcaacagagagccugucuacugugugaaaggucccaaguauguucucucgcacccccaaaacaaaaccaaaucgaccugguauucaagggccagggaggugggaaagaacuaaagcaauggaacccuuucgcuagacugggaguguugcucaguggguagagcacuugccuggcauuuaugaagcccuggguuccuccccuagcacgccauagaccaggugaggcaaugcgugccugcaaucccagcaaagagaggaggaucaggacuuuagggucagccugagcuacagaggacagauguaccuggcucuggccuuauggaaagucuucagcuccuagacuugucaguugugaggagcaggcauugcuguggugcucucugagcacagcaaguccucugcugggcugacugguggaaagagguggaggcugagguuucuagagagggcuugcucuccuugucucuggugaaugcuggcaacaccucuguucuucaaacagagacaaucccuagagcaauuagggggaggcguguucagugugaaugcaugccuggucugggggugcuuuguugauauauauauauauguauuuuuuuuaaagauuuauuuauuauauguaaguauauguaguugccuucagacauuccagaagagggcgucagaucucauuauggaugguugugagccaccaugugguugcugggauuugaacucaggaccuucagaagagcagucagugcucuuaaccacugagccaucucuccagcccuguuuuuaauguuuuuaguggaagaauauacugcuaugauacuucugcuccaaagcccauaaaugucauugcuaaagcacgcagcaagacacuugcuccucggugaaugucagccuucuuuaggaaagaagagguugcaugguuaucaucaucugugaguguguguguguguguguguguguguguguauguguguauguguguguguguccauguacccagguucaagucucagcacucacauagcagccccaaccauuaguaauuuuaguaauuagucccaggggauccaauguccuguucuggucuucauggacacugcacuaauguggugcacagacagguacauuccagcaaaauacgcacacacauaaauaacuaaacaaaaaccauggacagaagccuguccuuauagacccagagagaggcuguggaaguugagccugcaccuuuauugucaguucuuugugcuguaaaagccccguuugcacuaaccacaggcccacugggcacucugggggaaguguucccacucgagccuggguaaaaauggcugcuggaguucacaaaggcuuuucguggcaaaaaaacaaaacaaaaaccaaacaaacaaacaaaaaaacucugucacagaguguuuuaaacaggacaguugaagcgaaauucacaaguuggcaccaagugguacaguugccauguugcuuccucaaugggucugugcaggguucacaacagcuggacugcuguggggugaggucagccuugcugacagcuaaaaugggugagggcugagggcuccuaaaccagaaaguguugaugcaaaguguagcauuucagcacuuucacaucaaaggguacgaguuuauucuggagcuggaacugaauggcuguggcuaagaaauacacauuuaguaaguuuuuauaguaacacaaaaaguucuaagucaaagcacuuuucuuucuuuucuuguuuuuguuuuugagacaguguuucuguguguagugcuggcugucuuggaacucucucuguagaccaggcuggccucgaacucauacaccugcccuuguuuccugagugcugggauuaaaggcagacacagccgccgccaccaaugccuggcugucaagccucuuuuucaaauacaccaguggaaacugcauagguggcuacagccaggcagaggaaucggggcuacacgcuuuagcuauuacccgauguccacgccuuagcuauuaccugauggcauuuauuuagccucuuaguugauagauaguaaagguugccgagcuaaugcauucagagagguuuuuaucuguuaggucggacacgggcaagugggcaaaaggaauggcuauuuaaggaggcugaauaaucaaaaauaggcucucuuuaggcucugcaucugcaaccuucccacaauaucgaggcucugauuugucagucagcaccgcacaagguucuggagaaagcacaaguucuuugugaaaguucuccuuaaaagacuguuggagcuggagaguuggcucugggauuaagaguaccuguuguucuugcagaggaccuggguucgauucccagcacccaccuggaggcuaaccacuuccgcaagcaccaggcguacaugugguacacagacauaugugcaggcaaagcacucauaugaauaaaauaaaucuuuuuuaaaaagauaaaaaaauuuuuuuaaaaagauaaaaaaaauaaaaaagauuaaaaaaagauaaacuguucuuuuuguuuguuuguuuuuuugagacagggucucuguauagcccuggcuguccuagaacucacacuguagaccaggcuggccucgaacucagaaaucugccugccucugccucccaaaugcugggaauaaaggccugcgccaccacuaccuggcuaaaauaaacuguuaagccuaaugugguggugcauguguuuaaucucaaacacuuggcaggcagaguuccaggagagucagggcuacaacagagaaacugucuugaaaaccaugaaagccaaccaagcaaccacaaaacuagauacaauguuacuagagaaaggcuuggacaggaagaauguugcuaucccuuaggguugaccugccucugccuugccuuccagaggcaagagccccgguguugcaagacaacagcagaggcgaguaugcacauuaucacauaccuauaauacaagugauuugggaggccaggacaggaugaacaagaguucaaggccaggcggggcaacuuaacgcgacucugccaaauuaagauaagagaaauucugggaaugcuccagccuugcaaacaaacaaaaagcaaggaacaagaaaauccucagcugaggaaagugauacacuucauuaguccuaacaccagggaggcagaggcagggggaucucugugaguucaaggucagucuggucuauauaguuccccgacaaccagggcuucauaaugagacuauugaaaacaucaaagccaaccaaacaacaauaaaaccucaacccccccccccccauagcuaggcacgguggcacuuugcugucccuguguuaagagaguaagugucacaggcugggucccaacaagccagacuuggccacuccuccucaauaauuucaaagagacaaguugauagcaaaucagaaaaagggacuuuauucaguguggccucacugggaagagggacucaaagcugcauccagggugucccuaggucccagugucaggggccuagcuaggguugaagucaaagguugaagagaaggcagaaggaagcugucuugguugcccagucucaucagugucucagcacuaagucuguccucaccuucagcugacaaaugaggaguucuuccugcgucugcccccuggggaggcuauccuuaggaggagucucgggcccuuugauucaauagucugauaaccaauggucaguagagggccagggccguuuugccugugcucagauggcugauggguugcugugagguccgggccaaccuaggcuacaggguaagacucuguuucucgguuugaacccaaaacacaacauucaucucaaaagggaugagagaaauuuuuaucuuuauuuguuuugaaagauuuauuuauuuuaugugaguauacuguugcugucuucagacacauuacagacagauuacagcugguugugagccaccaugugguuguggggaauugaacucagaaucucugggagagcagucagugcucuuaacgguugagccaucucuccaguccauuuuauuauuauuauuauuuucuucuagaucggguuucucuguguagcccugguuguccaggaacuugcuuuguagcccaggcugggcucgaacucacagugauacucuugccucagccucugagugcugggauuaaaaacaugugccacuaccaaccaacuggagggauuguuuauucaagccaaaaaugaaugacuaugucccauaaauacagacuuagguuacccuauauuccacauuccagucuggaagcaaugaggaaguuuuuauaguaacagaacaaagucaugagucagggcaccuuaaaaauacauuggugggggccaggugguacacuccuuuauucuuagcacuugggaggcgggcagaggcaggugggucucuguaaguuugaggcuagccuugaguuccaggacagccagggcuacacagggaaacccugucuuaaaaaaaccccaaacaaggggcuagagagauggcucagccguuaagaguacugacugcucuuccaaagguccugaguucaaaucccagcaaccacaugguggcucacaaccauccguaaugaggucugacucccucuucuggagugucugaagacagcuauaguguacucaaauguauuaaauaaauaaauuguuuauuauuuauuaauauuauuuauuaauaucaauaaauaaaauuauuuaaaaaacccaaaacaaaaacaaccaaacaaccaaagcaaaccaagccauugguggugggccagagaaauggcucagguuaagaucaccagguucagugcucagcacacacauguuggcucacagacaucuaacucccguuccagaggcucugcugaccucaucuggucucuauggacaucaugcaugcacaugaaacacccauacacaaaauaaaauaauaaaacauaaaaaaccggccuguuggaagauuuaaguaggcaguuacaccaaagagaaauaccagcuauaugcuucugaugcuguccgggggauuuugguugguagaaaccggguuuuaauuuauuccaagagguuuuuauucauuagucacaacacguuagagcugacgcagaggcaggaaagcaacggguaggaaggaggcuaaagacauagccccuagacaaauuucaucaggcucuggacccgcaacgugaaggacuucuucccaggacuucucauucacaaaagaaagaaagugaaacaagcuaaccaaucaaaacagugcccaaacaaaacaaccuguguauacaaaguggcaagauucagaggcaacgcaacuuuccaaaacuuuguucccuuuccgagcgugcccagcaguugugcggcaagccuuuaauuccagggaggcagaggcaggcacggguggaucuuugugaguucgaggcuacacagagaaacauugucucaaaaacaaaaacaaacaaaccuuuccuccugcgcggugcuauuccauacauuacggcgcaccccggggcaguggaagagcgcccugcgggacaggcagccgggcccaguuugguuccggguccccuggcgggacugcgguuuguucucaggcuacgcccguggagcacauauuuaauucuuua

SEQ ID NO: 2769 - RNA, 4227 nt, Mus musculus
ggacuuccggcggcgggaggaaaccaccagcaagcagcaauggccgggugagugaguuacggcgucugccugcgcuaaaaggacgucuuugcauacaggaacggaguggaugacaguaguagggagcucagugaauuguguugcagaggggugcuggcgaccuccgucccggggagcgggacacggguguacgauguuuauucauguacagacgugagugagugaggcuugcaacauagaaauagguguaugggcuccguggauaaagcugugcauucgggaggauugggguucggauccccagagccuacaaaauacuggacaugugugcugaccaaauguaaccccagugcuggggaggcagagaaaaggggucccuggagaaagcuggcgagauagacuggcagguuggcgaccuuacaucaauacauaagguagagagcaagcgaaggggacgucccuucucuacuuuggacccccauacacaggcagacacaugugcacauacaugcuaauacacaugcgugcaugcauaucgcacauacauaugcagaaacaaaaagguugaaccaagacuuucuugccucucuguguaaugcccacccgcuaacucuuuuuucgucauuucaggcaucugaagcugguaggcguuccccuuaagguucggagguuacacacagcagugugucacuacaggggccggaccggcgcugagcaccuguggcucacgcggcaucuaaaggauccguuugugaaggccgcaaagguggagaguuaccgcugccgcagugccuucaaacuccuggagaugaaugagaagcaucagauccugaggcccggucuccgggugcuggacugcggggcagcuccgggagccuggagucagguggcagugcagcgcgucaaugccacaggcgcaggugggaccugcuggacucccagcuccucugacuacugcuagugagcagcucuuaccuagagacauuguuugaggcucuuucuaaguagguuuagagaugagaguuacagaaauacgacacaggcuggguacaggacacagcugcuaaguaaagucaggccccgcaggccuacgagguggaggcaggauuagaaguucagggucaucccagcuacaugguaugucuguacuagagaaaaaaaaaagggcagagguaggggguugggaagggagcacagggugguggugaugcuaugaagauggguuagucagcagugguucucacucugggcugugacccacuggcuuggugguugaauggugcaugccgguaaggcugacaagcuugaguucucgccccaggauuuacacuguggacgggagaauugacaccagaaaguugcuguguggacuccacaaaugugccguggcgugugcucacuugcuuauauacccucucacauacaugauuaaauaagcaaaauguuuaaaaaagaacaaagaagaaaaccacaggaguuggcggacagccuggguucgcacuaugucccuuucucuaaacaaaacaaaaagccccagaaaacuaaacaauaauggcuuccuuugcuuucuguugcugucauaagcaccauaaccagacacugugaguaggaaaagguuuccaccugggcugggggucugggcccuguaagaaagcaggcucuucgagccaggggagcaggcaggcugugcgagccaggggagcgggccagucagcagcacccuccauggccugugcaucagcagcuccugccuccaggcuccagccuugauugaguuccuguucuggcuucuuucagugacagugauauggauguguaagucacguaacccccuucuucuccaacuggauuuuugguuaugguguuucaucacagcaguagaaacuccaagacagcaggguuuggggacaggacuacuaaugugucccugaagccuaggagcucuuggaggucccacuggggccacuggauuccuuacucugggaaugugauaggcuguguacugugugugugugugugugugugugugugugugugugugugaaauggugcccaaauaggaaagagaaaaagcgaaaaaacagcugcaucugugacauugcccagcugugguggcuauaccugugacccuagcccucuggugguagagacaggagaaccaggaaucccaggccugagucacacaguucucaaagaaccaagagccaaaaaugaagggcuuggcucucagagaggacucaaguucaguucccagcacccacaucaggcagccccuagccuccgugauuucacauccaggccuugaacugggcagguaccugcacuugagugcacauucacacauauguaaauaaauaauacaucuggaagacaaaacaguagagcauggucucacaugguucuagcccuuuagaggcagaggcaucaguucucugaauuugaggcuagccugggcuauauagugagauugucucaaggaauaaaaagcaaacaaacauuaaaaaccaaaaaggauuguugggagcuggguaugguggugcccaccuguaaccucagguacucacuggguuaagucaggaacuuauuauguuuugggcuagccugggcuaccuacuaagauucccauuuuagaaccaacgcauacuaaauaaaauaaaaaaucauuuggaagaagaguccuucugugggaggggagccugggguagugaacugacagugaagugggauucagcaccuuggcugcgguucaccucggcuugucacucuccacgauggcaaggccauuuccuuucuaggucucaacuuccccagcuaugccagggggaguagaggacacccuacacucuacuacgugucuuuauuuauuuacuuauuuuucaacuuugagagacgagaucucacuugguagcucaaacuagccuugaacuugugacaguccucccgccucaggcucccaaagugcugagguuauagccugugccauuauuacaucuaacucaugugccuucauaccaaaggucuuuugcgcacauacaugcaugggugccugacugccuuuugugacuuguuuuuugguagggagauucaugguuuaauaacacauuguguuacuuccuuagauuccagcucuccugugggcuuugugcuuggggucgaucuccuucacauauucccuuuggcgggagcaacuuuucuaugcccugcugaugugacugaccccagaacuuuccagaagauucuagaacugcuucccagcaggagagcagaugugauucugagugacauggcaccgaaugccacugggaucagagaccucgaucacgauaagcucaucagcuugugccuuacccuuguggacauggcuguggacauccugcaucccggagggacacugcuguguaaaaccugggccggaaguaaaagccaccugcugcagaagagacugacccaggaauuccagagcacaaggguggugaaaccggaggccagcaggaaagagucuucggagguguaccuguuagccacccaguaccguggggggaagggcaccaggaggccgugagucugcccugccauucugggggugcuuccggaggagcguggauucaagcugccuuguggauaugaccagcaccccaaggcaccucugcuuuuaaagagauaagcaaauauuuucaagggccgugaaaaagugcuaagaaugggcagcgccauggcgcagugaggaaagggggauugcugcuaagccugacagucugagugcagcauccgggaccccagagcagcgagagcgcgugcacgcacacgcaggcugcacacaauaugaacagauauauugguacuguuaguuuuuggcaauuugucugggaagaaagaaucugacuguggaauuccuccaucggcucacaggcugagccagggagacauugaugagugacugacguggcagggcccagcccugugcgggugcugccaucccuuggcagguagccugaguuguaugagaaagcggggugagcaggacugaggaacaagccagucauccauaccccacuccccgucuccaguugcugcugccuccagguucccaccccgagaacccacuuugauuuccuucagugauggacugugguugggaugagugaggcaaagaaacccuuuccuuccaaggcuuuuaaaugcugaaaacaaagcagucuucucuaucaugauuuuauuuuucuggcu

SEQ ID NO: 2770 - RNA, 1247 nt, Mus musculus
auccuguucaaagcucaauuuuacuaguucugacauucaguuauaaaggaagagggagggaacccgauucccgccaacuggucucgggguccaguagcagggugaacacguguguggcuccaagcagcaaagcggcacgguccagcagugggcguggcagaaggaaugagcaggaaacuccaccccugagccagcagguuccaggcuggggguggggaggcuacaccgauccucagcagugaugacauaggcaugcacggggcuggacccagccuuuuacauggucgcugaggguagggaggguucagucucagguccugaugcuuucucagcaagcauucuuccccacugggccaucugcccagcccaggaaagggcauguuuuauauggcaugucagguggcuucuuaaggaggcagcacgacacugcugcaguuccaccugcaauggagaccacccgguugcucggaagcuucagucgacuuugguguugucagugauuacauaggccugagccaucccagcagguauguaacagagaauaacaucuagcuagcccaggaugcccucagacuugcaauccugccuccccugcccaaguuaccagugagcaccacaccugccuaaacaaaaugcaauaggguuuacuggccaggcauaguggugcaugccuuuaaccccaacacuugggaggcagaggcaggcagaggccaugguggaggcagaggcagguggaucuccguaaauucuaggacagccccagcuauauagagagaccuugucuaaaaaaauguaguauauaacauuuaugcuuuguuuguucauuuguuuuguuggagacauugucucauguagcccaggcuaucuucaagcucacuguacauccacagaugauuuuguuuuuuguuuuuuguuuuuucgagacaggguuucucuguauagcccuugcuguccuggagcucacuuuguagaccaggcuggccucgaacucagaaauccgccugccucugccucccgagugcugggauuaaaggugugcaccgccacgccuggcucacagaugauuuugaacuucugauccuacugccuacaauuccugaaugcugggguugcagauguguggcaucaugccuuguuuauacauugauagagauggagcccagggcagagcaagcauucuacccccccugaaccacaccugagcccucgaacuuacaguuauagauugaauuguguucuaucuucca

SEQ ID NO: 2771 - RNA, 22451 nt, Mus musculus
gguagggaggguucagucucagguccugaugcuuucucagcaagcauucuuccccacugggccaucugcccagcccaggaaagggcauguuuuauauggcaugucagguggcuucuuaaggaggcagcacgacacugcugcaguuccaccugcaauggagaccacccgguugcucggaagcuucagucgacuuugguguugucagugauuacauaggccugagccaucccagcagguauguaacagagaauaacaucuagcuagcccaggaugcccucagacuugcaauccugccuccccugcccaaguuaccagugagcaccacaccugccuaaacaaaaugcaauaggguuuacuggccaggcauaguggugcaugccuuuaaccccaacacuugggaggcagaggcaggcagaggccaugguggaggcagaggcagguggaucuccguaaauucuaggacagccccagcuauauagagagaccuugucuaaaaaaauguaguauauaacauuuaugcuuuguuuguucauuuguuuuguuggagacauugucucauguagcccaggcuaucuucaagcucacuguacauccacagaugauuuuguuuuuuguuuuuuguuuuuucgagacaggguuucucuguauagcccuugcuguccuggagcucacuuuguagaccaggcuggccucgaacucagaaauccgccugccucugccucccgagugcugggauuaaaggugugcaccgccacgccuggcucacagaugauuuugaacuucugauccuacugccuacaauuccugaaugcugggguugcagauguguggcaucaugccuuguuuauacauugauagagauggagcccagggcagagcaagcauucuacccccccugaaccacaccugagcccucgaacuuacaguuauagauugaauuguguucuaucuuccagccccaaaaggaaagagauguuggugcucuagcuccuagugccuuagagaugaccuuauuuggagacugagccaggagaaugguaaugaaaugaggucaugggauaguccugaucuugucuggcugugcccuuaugaaaauggaaaucugggcugaaguacgcaaaagggagguaaagagaagggcuggaagaugcuccugcagggcucucugcaagaaccagccugcuugcuaccucaacuccuggcaucuggccugcagaacccuaggaaaagagcuguccauaguugaggcugggucuguguuacaguuagagcagccugagcaggucacacgcacacauggcaacccaggggacucagcuguagguuuugaauccuaguuaguaagaugggaucaucugccaccagaauauaauaaaucuuccuagguucuguccucugccauucugugucauacugcuacagaaagaggcuucuaacccuaggcacugggagagcccguuggcucggaaccaguccccugcuuugggaaggcagcucagugcugggauguuaagugugcgucaccacgcuagcuuucuuuugcaggugcaugugugcaccucaugugugauaugugggacucagaggacaaccucaggcaccuuccaacuucuguuugagacagagcuucucuuuugucugaaacuucaccauauagagagggcuagggagccagcaagcuccagacucucucucugccucccggucuugccauacaggcaagcaccacggagccuggcucacgagcaugggcuguucacagguucuguggaucugaccacaguuucucaccuuugugaggcgagcaccucauuuacccacugaauccucuccccauaccuuguuuguuuguuuguuuguuuguuuuugagacaggcucucauuaaguacggcuaaccuggaacuuccuauccuacugccucagccccucccguuccucccuccccccugccaaguagcugcggugacagcuugcaccaugccuggcucucacuaagagcuuuaccugcauggucucucuuaagccccauaaacucugacaggauugucagcuugcacagcccacguugcaaguucaaacugcgagacaggcaacgccccuugagaucagccacgcccccacuccggauugguugcugcaaaaggggcgggacgcucagggauggugggugggaccaaucucuggccguaaauaaggugccacauggcacuggcuggcgagggcaggaacggggagaagugcgcaagcgcauccagaacgggcguagucccgcucguuagcucucgcgagaggauggagggaggucugccugggggcggagccgcgccucgggcggggcugcuagcgggaggaggcgauuucggcugcagaaucagcaucaccagcaacagcagcagcggcggugacuguggcgggcgcuaggugaggagcgcaggcucgagcagagcgaggggugcguaggagucccgaguccuaggguggggcgaugguccaugguuuggcgaugcagauugguaccuccuucugccuggcuuaggcagcucccacguggucccggguucgaaucccaguucuguccagcuggcuguguaaccuuagccaagcgugcaccuucucugagccaucuucuugugcagcccugcagaaugcguggaggaagguguggccacuuggccgaccuccuuugcaguaguagcggcuggcucggagguugggaaaacaccuucccaguuuugccucuggcuguuuggguguccaggcgagaaagcaauuguucagagacuguugugcugcagugucccggccagaccuugcaggaggcugucuccgaagccagguuuuguaccgagcaagcacuggccccacaucucaccccagucuacugagcauccuccugcccugugcauugcugcgggugcccccagcagcagccucaugccuggugggccacaggaagccgcgcauuaguggcuaacaguaggaccuaucuucucuuugggcuucuggccacgaagacaucgcuggcagaccuuggguuccuuccgcacauccgccuagcugucgcacagagagcuguaauguuugcacccuucuuaaauuauuuauuuuauaaucccacgcugcgcugggagccccggaauugagugggaaugucacccucgggggagaacggggcugugagccuuccauugcugggacagcaccguguggcuccagccuagguaacaugaguuagggcccuguuuccgggugugaaggagagaaaaaagauuguugggaaacugcuaugugcuggguaugauacugcaacuucgcgaguugccuaagguggagcgaguugccuaagguggagcguggugccaguucuugugagcuuaggcaagaagauugcugugaguuugagggcagccugggccgcauagugagguucaggccagccugggcuacaggguaagacucagacuuaaaacaaaacaacacaaaaauuacaaaagggccugccuguaccuucauguuuaauuuccuugcuaggaucuggggcugagcuugcuuguacccguauugucaugucgcuuucgugggucugcaucuucaguuuccugcuguaagggcaaaccaccauauuggguggaaugcugggaaccaugggcccuggguagcucaggucguccugguucagggccacuugagugccaaguguaugaaagacguuugcgguaugcaaagagaaugccaggaaagguggcacguaccuguaauccccaagaggugaaggcaggagggucuacaguugaagucuagccugggcuacauaaaacccugucucaaagaaaccaaacaaaagaaacccuuagcauugaagacuggaagcagcuaauucaggagacguugaguugcugugcucaugagggguggggccugugggggaaagacuaguuucuggaggggcgggcaaggaguugugugcauguccauguguguaugcaggugcauuggaggucagagaauaacguugggugucguccucaggaaugccauguccuugcucuuaaacagacuggccuagagcucaccaauuggcaaggcuggcuggccuaggguuucaggcacacagcacuuaauugguucuggggaucuggacugagguccgugugcuugcguggcaagcacuguaccgacucggccauucucccagcucugggaggacggauuucugcuugagaagagccuuaugcccugcuggagaccagguuccauugcuggagauugcaguugaggugugaugggaaccaggaccaggucugucagagguaaacucgugaugcuagagggaagggcagggaagcuugggguguagggagaugcagugcaugacauuguggguguggcucagugguuaggggagguggugcagagccagaguucccccagggcuucucugggcagugaggcucucuguacgauucaguaagaacugggcagaagaaagaagcaaugcaagucugggagcagcagccagguuccugcugguccccacccccacugcacugggugguggaggagacgugggaaagugugugguuuguagacgcuaagaaucugugacauugaggaccuccagcacaaggcacgcgugcuugggcucagagucugggaaaacccgagagaagagaagagaagaggggcaggcagaagggaugcucacacuuagaugccuguggacucaguucaugaucaguaccacaugaucaccggagcuggguggggcggugauuguguucuaggaaggccaggccagaaaguacugugagggaaaacagccugguuacucauaagacugaaauaaaucaggugggaaaacaccacgcacgcacgcacgcacacauccauauacacacauacacauucacaugcacacacacacauacacauucauacacacaugcacacacacauucacacuuacacacucacacacauuuuuguuuggcugucuaggagcuugcucuauaguccaagcuggcuuugaauucagagaucagccugucucugcuucccaagugcugggauugaagaugugcaccaccaugccuggaccacuauauaguuuuuaaaacagggucucauguaacccaggcuggccucauuuuccucuguagcugaguugacccugcccuccuuccugauucuacugccugugccucccaaguccggggguuacuggcacgagccgcucuguaccugguuuaugugugcuagagguagaacccagcaugugcuaggugagccagcugagccgugcccucagcccuggacuaccauuuucagccgcuuaggucuucacuucacuuaguagccagaacauggugugugccuauaaucccuguacuggagagguggaggcaggaggagcuagaggaggagaaagagauggaagagcugaaggaggaggaggaggaggaggagguagaaggaggagcuggagaaggaggaacuggagccgaggggcuagcugugaguuucacaccccuuuaguguguaagccccugcugauggcugucgcuggcccacagauguggcuggaaauagcccgcccucucacauaauacuuccugcuguuagccagugacguugcaaaaacuauuuagaaacucugaagcaacagcagacccagugccagugggggaagggcugcccucgagccucgagcuccccagccugagcagcccacccauacugcugccggccuuucccuuuggccaagaggaugcauggccuucucagagcuggaguagccggagagaaaagacccaccagucacaguggcugguccccaguugaaacacucaauuggcgaguuucuaaagaaacucauaaaugaggcaggcaguggugacacucaggaggcagaggcagggggaucgcucugaguuugaggccaguccggucuacagaguaaguuccagaagagccagggcaacacagagaaacccugucuuaaaacaaaccaaaaacaaaccucauaaauaauuaauaacccuuuacaggaugaggugggggcgugguggcacaagcugucuucugagggaggaggcaggacgugagagccagccucuguuacaucccugucucaauaaacgucaguuugacagacccugguggcucacgcacgugaucccgacaccgggccggcugauuggugagaggggagugugaauuuaggaggaccuacaugaauauaggagugugaauagaggaaaaccagaagcucagggucaucugcuuccuaucaaguaguuugggguuaaccugagcuacaugagaaccugucucaaaaaagaaaaacucaacgaaagauuuaguggauagcucagugacuaagaggcugugcaagcauggggacuugaguuugcacccacauaaagccaagcguggccacgcaucccuccaggcccagugcuggcggaaagagggaauaagaccaggaggguccuggggcucacuggccagccacucugacagaaucagugagaaauugucucaaaaaauacagcgucacaugccaaaacaaaaguaaaugcguaaauagaaaauucccgagggaaacccuugucccccuugaacuccauccucaggcaagagagcauaggcucgacacuuaauaugcugcccaaauuuaucucuccuggacgugagggugacuggccagcuugugucccuauauaagguguugagccugaaaaaagaaagacaguugcggggggugggggguggggguggggcaacgggacagggugggcccuggagaugggcgagaagagcugugcaggcagagggggccaggggaagggcagggaccauggccacaggugcuccugaccucagcagcgcccagggcuaugggaggggauggacucacagccgaugcgcuggaacagcugcaggggacuugacacaguuggcagagcugaggcuggguuaguucuaagaacacagaaaacaaagcaaacgaaaacacgagacuguuauuaguucccgcgaaaauaaacugcugugcgggaggggagaggaaaaauaauuacggcguccugguagucccagcugcgaagagucucuccauugcguggcagugucuguaaacacgggcugcugcucuaauuggagucgugacaugccugagagggguggcaggggaggggacacacugcgaugucaccugcugagccggguaucagagcuaaagccaaggacccaguggcagcuacugagugccagcaggugcaacagaaagaaccggcaaucaaagccgaauacgaggcaacacucaggaggugaauggauuucugaguucaaggccagccugggcuacauagugagacccuaucugcaggguggggggaagaaaacugaggcagaagcagcugugaggaugggaaagagggaagggauacugguugcuaaggaacuuggugggcuccguucucauuauagacagaagcagucuccguuggcaucgaugucuugggcaagagacuucuccuacuuggcuggcuugugugcagugcuuuggguuuccuaaacccauuuacccuuauuaugccuauuguuuuuuguauccucucucagcucuggucacuggguccuuugucaaagacuccacgcugccccuuagagccaucuuuguuucuuuuuguuucugucuguuagcauguauuuuuauccgugugugugugugugugugugugugguguguggugugugugguguguguguguguguguguccaagugcucacagaagucggaaggggccauugcacggccugagccuggagcuacaggcgauuguacgcuacuucaugugggugcugaguauggaccccagguccucuggaagagcccccacccccacccgcacccccaccuaauuuaacugcugggccaucucuccagcccucacaacccuguuuucugaggcagacagagucuugcuggagcuugcuguuugggcuuggcuggccagcaaggccucagacccucuugucucccacucaccccaagagcugaggguacagguacauguguagacacguccagcuuuuuauacggaugugaggauucugauucacacccucaugcagcaagggcucuuacccacugagcccucucaguuccugcaaagggguuucuaaaaguauuuacaaguggagagagcagcagugacccuuccccaccuucagaauuaagauggcagagaauggugguagucuuccugaugccuaccucacgugggcuggugcccugagccuugaggacaugcuguggcaaauaagauggauccuccuucccagcguugcuuagugcaaguucugccagucuccacagugaugggucugagaugcaacaggucccguagagaaaaggucgaauauggccggugcuugccuagugagcagagacagaguuggggagccacguagcugugggauugugggucccagcaugaucaggauggccuuagcacagaaugagcuguggagugccccuguuaauggaccagcagagggacgucgguaaagcaagagccugccccaccgggccacugaugaaugacagggaaccucuuuggcuauacugaagugaccaagaggagagaugaacgggccuggucacuaccacggaaaggguuagaauuagaagccggaggacaccauggaucaaaggacuagggacagagauguguccugauuggcuuucgccacagcaauguggcagaaagggaggaggguagaagugagaagaggggucagggcauugaggaaugcagugagagcugagagaggccuggauggguacaggagccuggagcagggcguauggagagaccucgcaaauaaaguuggcauggucuacuguuguuuucuguucuggagauagaaccuugacucucaaacauauucuaccauuaagcuacacccuaagacccucacugggggauucuaggcaggggcucuaccacugagccacgcccccagccccucacugggggauucuaggcaggggcucuaccacugagccacgcccccagucccucacugggggauucuaggcaaguucacuaccacugagccacacccccagcuccucacugggggauucuaggcaggggcucuaccacugagccacgcucccagccccucucugggggauucuaggcaggugcucuaccacugagccacaccccagccccucacugugggauucuaggcaagugcucuaccacugagccacaccccagccccucacuuggggauucuaggcaggggcucuacuaagcuacauuucuggcccuccuuucuuggagauauggacuuacuuuguaaucuugguuggccuggaacuggcuauguagacuacucuguccuugaacucguagagaucguucugccucugcugagauuaaagguaugcacuacugugcccuggcucccaaccccccuuuuaacuuuuuauuuugagacaaaauaaaaacuuggccaaguuauucaggcuguucuugaacucaggcugcauucauguccuguguauuugaaagcuguagacugaggacucaggagagagaaagauaaugagggcucauagcccaugcacccgaggcccagcucugcagaagccuuuugaggucaaagacuggaucagagcuuaauguacacacucccccaugugugugugugcaugcaugcaagugugugcaugugugcaaguauguauguguguguauacaugcauguguguguacaugcaugcaugugugugugcacacgugugugcaugugcgagcaccugagggacaacaagaugacaaucucagauaucucuccuuaggugcuguccuccuuguuuuugcuacaggucauuuucuguaucacuagccugaggucauggauucagauaggcuggcugucauagagccccugguucuccugguucagcuuucccgcgaugggacuacaaaccgucaccaccacaccuccuagccuuuuauauguuacucaggcuguucuugaacuagaagguuacaaccaaggcuacauaguaaguccauagcuccaaaaaaggagggccagaaauguagcuuaguugagccccugccuagaauccuccagugaggggcugggggcauaagaguagccuuuuauauggauguuaaggcucggacuggggucugcaugcaugcuguccguuaaggcuuuuccucagucugccccaucucuuuugagguggacucuguaacccaggcugccuuugaauuccugaugccccugccucagccuuaguguugugagcacccaauuugcucuccauuggcagcauaaacuaauuaucaaugugaauguuuguugcauaauuuuauucgcccaugcugucugacuuagugugggggauuaacugaaaacgaagguguuaugcguucacauggauucaugugagcacggcuuugggggcccuagcagugaugucaagauuagaagauaguguugcaugucucuccucuccuuauaccuuaaauuuuuuuuuuaaauuuauguguauggguguuuugccugcauucaugucuaggcaccacaucugugcacauagugcccagggaggccagaauaguguuugacccccugauacuggaguuacagaugcuugugagcugccaugugggcucugggaacugaaccuggguccucugaaggagcugccagcgcucuacugagcuggcucuagacccagccuuccgacaguuuuaagcagggugucaucaugguugcggucuguaagguggcugaccuuugaccuccgguugccuccucuucucacuuccuauuuaucugaggagggcuggguuagagacuugugcuacugugucuggcgcugcauguguucuccucaggcccccaugcuccuguggcaaguccucggcccgcugagccaucuccgcauccuccuaaaggaaggauuuugcuaaaucagugagcccaagcccugcuguuuccagguggcuccccucacagugggacuuguagugcagcugugguauuaacagcagagcugaacagcuugcugccugcagagggcccaugccaacaccacuaauaaaaggcacugaagagguggcucagcgguuaagagcauugacugcuauuccauaggaccaggguucaagucccagcacccacauggcagcucacaacugccuguaacugcaggcucugacacccucaaacagacauacaugacauucacgcaggcagaggagcaucaaugcacauagaaacaaaccaaccucagaaccauuuuaccaagagaagccuacaacaaggccucuguacuguaugacuccaucugccaucuaaaaaacggugcagcucgccauggcugcgcaucagagggugaguguuggaagcaucuuaugguuuuuaaggcagggucucguguaacgcaagcuccuccugcugcccccagcuuccuagcgcugggaggacagacauguagcaccacacccagcuggaaauauuaauuguaguauacaugugccaaaccccauucaauuacauauugagcuacacauuaaacaagaagaggguguuuuauugccugucagucacuucucuguaugccuguuacgaaagcucagaggagcuggagugacucaguugggaaggaauuccuucccgcagggcuucuguagccccaggggcugcgagagaggacugucuucugacauaccugugucagacaguggcugguugggccuccuuccguccuuccuucucucccuccccccccucccucccucccucccucccucccucccucccagcaaagcacauugcugucugucccuucacacuuccuaugcauuucccuugaaguuucugacuguaugauuagacaaaggagcaaaccccccaguccacgugacaaggcaaaugcuggugguuagguagcauucugcggacaaacagccugugcaaggagcaaguguguacaaggggaaugagugugcagaccuggcuaauguaagcccagccugguaugcacgccagugaucucagcuacuugagagccugaggcuggaggauggcacauuccaggacugccuggcuacuuaucaaguccaaagcaauuuaccagacuuuguaucagaaugaaaaaaaacaggggaagaguucagcggcagagccccugccuagaaucccccagggaggggcuggggcguggcucagugguagagccccugucuagaaucccccagggaggggcugggauauggcucagugguagagccccugccuagaauuccccagugaggggcuggggcguugcucuguuguagggugcuuuucgcccucaugaagcaauggguuuuguccccaaugcuacaaagaagcuggaacaaagagaaaaggagagagaaugggagagggggauaagggaagauugagauugucucagugaugauaaaggccaagaagugcaggcccagauaagugucccagcuuaaagacagccacaugagaacaagucaucuugcuuugaccucugucaguucuuugcauuucacaaugauuuuuuuuuuuuuuacaaauaugucaauuuuuauaacaagcccguuggaauuuugguugauauuacugacauuacuguucaauuuuggcguggacuggauggaggacguccacugcauugauuagcgcaaucugccuuuuguguagaccaggcuagcccagaacuccaccugccucugccucugccucuuggguacuggguuuaaaggugugcacugucaugcccuaccaaucuaguaugcacacacacguguguuuauacaugugcguguacacacacgcacauacguaaugaaguugaaccuagggcguuuugcuaggugagcaccuagccauuuccagcccuuuuagcucuccuucccuucucugucugucugucugucuuucuuuuuucuuuuuguuuugagacaggaucucucuaugucacccaagcuacaccuccaacuuacaauccuccugccuccuccucuuuaugccacugcuagggugacagguguguccaccggucccagcugcagucucaguuuccccauuugaauguucaucucguccaucuucgcacacacacucagaacaaccaugugugcuugugucuguguauauguguguuaaguguguuagugacgggggagguugggauguugcagguccagagcccaguuacagucuuugacuguguuaguagccauuuguugcuuaucccugucuggccugacauccucuugacuagcaggcaaaucuuuuggcaugugcaaacagacacccagccccccacaaccagaaagcugacacuccucaguaucugaggccuacgacagagauggcuuuaauuugcugugaccgccuuugugacacuuccgccaguguauuugaaaaacaucuugauucgugacuuucuucgcucuguuacuauuaacgacuucaagcuguuaccacauuggaacauggaaucugggguaaccuaaaucugugcgggggccuggucacucauuugggcccagaauaaacuaucuuguccccuaugagaugagaguuguguuuuggguugauacacuuuacccgaguuaucuccguagccccagaauaaccuuuggcuaaauaucugggcuuccaguggccugguccuguugacacacaaaaaaaagaaaccucccauguuauuugacuuucuugccugauggucugaaaaacagauccagcccuuuaugggagugugguccugcccugugcccucacuccuagcuagggugacuagacauaauguggccgaggucacugcauauuugugcccuggcuaucuggaugggucuagcuucucauguagaugugagggugguuugaaacagucaggcaccaacauggcgccugccuucuggcugccuggcuugucuguagcauuguauguggugggugagagaagugucugguagccgcgucacaggcagcugcaccugccuggcugcuauguuggguggcgaaccugcccugauuauccgaacgcuuagaagcacaggggacccagaccugugaaaagucuccagguugugcgucuccgugagacccggcgucugagguguuccgcugacggcagagcccuggucccauagcuguggcaagucuaccugacggggguccuuuugcugagccaccccaccccgcuccucccguugcuucagagcacacggggcccuuuguugacugcuguuuugagaguuggagauuuuggacuugaaaauaacacccuuauuuuuuaaauggaaaauuacucucugaggucauuuguggucccugacuguuuuugaggccagcagggacgauggcugugguucucugccucaccacucuccgcugacucuccaacccucacagaacucagcauagcauccccccacgugucuggaaacaaggcuagacauuccuagaucgcaaacuccuuaaaaacaaaagaaaauaaagcugguuguuggugguacugaccuggcaggccuuuucuguccuuugcuacuguuccugcaguccugggaguugcgacuuuaaaguggcagagugggccccuucaaagggccgccgacacagaacgcuuuccugacucauuucuggaacugcuguuuauguggcuugucugagggcagacaugcuaagagaggccuccuugauguugaaaaugaacccuggccucucagacuagaaggugggugugucuuaguggacagggcccacagguuugucaccuuugagagggacugcagcuggcccaagucuggcuguuccaccaggacaacuccaaagcaggaugagggaacaaugggguuuggcuguccaaagggaaucuuuagauagggaauauagcucagagguagagccccugccuagaaucccccagggaggggcuggggguguggcucagugguagagccccugccuagaaucccccagugaggggcugggggcguggcucagugguagagccccugccuagauucccccagugaggggcuggggguguggcucagugguauauccccugccuagaaucccccagggaggggcugggggcguggcucagugguagagccccugccuagaaccccccagggaggggcugggggcguggcucagccagagagugauugccuguugugugugaaaccgaguuucauccacaguguggcauuaaagaaaaacuggauuuaguacuauguccuauguccuguguccugcuuccuauagacacccagaugggacuuauugauggaccuauuuucaugcauaccuucauuccacauuuuguuuguuuguuuuaaagacuuacuuauuugacauauaugagaauuuugcgugcaucuaugucuggaaaccauaugugugccugaugaccagaggccagaacuggaguuccaaggcaguugugagcuguccuguagguuuugggaaacaaacucugguucugugcaagagcagcaaaugcucuuaaccacugagcugucuccagcccgccauuccacauuuuuuggguuguuuuguuuuguuuagagacaggguagcccuggcuguccuggaacucacucuguagaccaggcuggccucgaacucagaaauccgccugcuucugccucccaagcgcugggauuaaaggcgugcgccaccucugcccggcuaccauuccacauuuuaaauaagcaggucuuucagcacugugaccuugaggacauccugugggagagugagcugccgcccccacaguccacucaguuuccucucccacucggcgcuagcccgaugcuugaaguguuuauggacagggugugacuguagaguccugucaagccagagcucacaguccuuugaucucagucaccacaguggggcacacauggggcaucaccauccuugcuuaaaagcuaggguuuugucucauggauuucuuuauuucaccuguauucugguuuacugauuucuguucuagcccuugauguuucucccugcagaauuuugguuuauuucacucuuucccaguugugagaggugggugguuuuuuguuuuuuuuuguuuuuuuuuuuuuguuuuuuuuuuuuuuuugagacaggguuucucuguguaguccuggcuguccuggaacucacuuuguagaccaggcuggccucgaacucagaaaucugccugccucugccucccgagugcugggauuaaaggcgugcaccaccacgccuggcgagguggguguuuuuaauccauauaaauagauauauaccguuuauaaauauuaucuauuuauuuauauaaauuauauaaguagauacuagauaugauaaguuauuauccacuuaucuauauaaauagauaauuacuuguuuuuguucgcuugcuuguuagacaaggucucacucuaugcaucagccugaacuugaacucacagagaugcucucgccucugcuggaauugcaggcacgagccaccgcaccuggcagaguuuagaccacugaucuguggucuccccgguuccagugccccgggcaggcccugcuggccuagaguccguguguuugagugcauuguguucucgguuuucauucagucugaaaugauguccuuuuaagucuuuccuuuaaggggcugaagaggcuccuccggagguguagcugugaugacucgaguuugaacccacauagaaagccagauacagugcugugugucucauacagcauuccuaaggcaaaacaagaggcacagagggaagaguuggccgcaaguggguaauaagcacgagaugcugccucaaaacacgagggaggggaggaccuacuccagagacguuguccuuugaccuccaccuguguguucuggcgugggcaugcaugcccaugcaugugcuuaaaacauucuuucgaggccaagccaaggccuguucguggggugcuaaggaggauggcuggcaaauugaaacuagucuagccuauauggugaagcaauaucucaaagaacaaccaauaacaaaaauucuuuagcccagagguuauuuagaagagggccguuugauucccgaguauuugaagaguucuguuaacugugucuaugcucagccuacugcguugaaugcuuuguugcucugaagggaaaagggcgaauucaguuguaucaggaagcacucaucugucagcuccauccuggccugugguucuucucuguuaccaagacuggaauguuuggugaggacuggagagauggcucagcagucagggagugcugaucucacacaggacccuagugaggacuggagagauggcucagcagucagggugugcugaucucacacaggacccgagugaggacuggagagauggcucagcagucagggugugcugaucucacacaggacccgagugaggacuggagagauggcucagcagucagggugugcuaaucucacacaggacucuaguuugauucccagcgaccccaucaauccucacauccaccugugacuccagcuccaggaacucugaagucaucugcacucaaaugcagauacccacacagacagacagacagacaaauucauguaaucaaacaaaaucaaauguaaagaaaagaagggaguguucaagucuccaacuacaguuguggauccuuccucccaaguauaccuuaaaaauauauuuaaaaaaacaacauuuuuuuuagagagagggucuuauguagcccaugcuaucuucaaacucacuauguagcccaggaugaccccaaguuccugauccuccugcuuccaccuccugaauacucugauuacaggcaugugccaccacaacuuguuuuaugcaguucuggggacagcauccaaggcucaguaucugccaacugagcuacauccccagucugauuuuuuugcuuuauguauuuugaagcuauguugugugauacauguguguuugugguuauccugucuucucuguggguugaguuuucugugaugacacaacaucuuugcuuuccuugaguucugaaguuuucuucaucugcuacuaauauaacugcuucugccugcuuuugguuagugccuguaugacuaauauuuucuguccuguuggaaaggaauggggaaaguagagugacagucagcucugccuuggucuccucugucugcccuacuccccgaguggcacugguggguucaggccccucugggucuugcugugagacuggcagggagucaguuuggcugucccacucugugccaucuaaccagcuccuccuagcgggugacuccagguagggucaaggcccgggcuaccauaccaucaggcugaggacacaguaccucuggccccuguggauggggguuggagaucagcuuucugcuuggaccccaugguugccaccugggacuuggacgcaagugggaauguaguauucacuuugccacugugaggggugaucucccaggagacccugauacgcuuucccuuuggugcugagcuuaaguggaaugggugcuacuagaucugucacuaagcuacugugagcaugaccuuggucucucaugggacagcugcacuuccuuggggaccgcugaucaugcuuuggaaccugggaaccagcccccucaccccuaaccugguuuuuaggcucaugccaucugugcgcccugacuaaugucccacugcaugcuauguagggccuggcucagcugcgcuugcucagucugagaaugcacaguggcaggguuuuaggagaagggugacuuggguugcuuuaaccuccagugagggagguucauagcgaucuccucucucagccucagcaccuccuugcaugguuauuuucugggaaauccuuuucuuuccuuucuguuuauuuuuuuuaaagauuuauguauuuauuuuauauuuauauauauauauauauaugaguacacuguagcuguacagaugguugugagccaucaagugguugcugggaauugaacucaggaccucugcucacuccugcgccgcucacuccgguccugcccccucaugcccaaagauuuauuuauuguuauauguaaguacacuguagcugucuucagacacaccagaagagggcgucagaccucacuacggguguuugcgaucuguuuuuguuuuuuguuuuuuuuuuaagauuuauuuuauaugucuguguguguaugugaaagagggggggcgguguacgaaggcgagaagccauaggucaaccgcagguaucaucuucagaaccauccaucuuggggcuuguaugugggguuuccauguggguguaugugagguauauguguaggugcacauguguguaaguuguauguguguguaggucagaggucagcugcaggcaucauccccuugggaccaugcaccuucuccuuugaaaacagugucucucucugggacaugaggcuagcucaguaggcuagccaggcuagccagcauggcccaggaaucccccugucugucucugcauccccagugcugagauuacaagaacacaccuccacaucuggauuuuguuuguuuguuugggguggggugggguaggggugguuuguagauaggguuucucuguuuagcccuagcuauccuggaacucacuguagagaucaggcuggccucaaauucagagacccuccugcuucugccuccuaaggucugggguuaaaagagugugccaccacaccaccauuuucuguuuuuugagacagggccucucuacacgguccuggcugucuuggaacuuacuauguagaccaggcuggccuccaauucccagcaaucugccugccucugcccucugguguugggauuaagggugucacgaauaugccuggccacaucuggaugaauuggauucugaggaucuaacuuggguucucauguuugcacaauaagcucucuguccccugggccaucugccuagccccuaaccuuucucuacuuacuuuggugucucccuaagauggaguaacugaagccccaaccagaauuuacacagggaggcuagagacagacaagcaagugggcugguuggugagaaguggggaagggggaccccgccacucacccaaggcccugcgugugggagaagaguccauguuguucugaaccucuaaccugguguguucuggccucuccagguccgucucccagggaccaugucccagcugugcacaaggcugaagugaagggccaggagugggcccagcccagggcagcaugaccaagccgcggcucuuccggcuguggcugguacuagggucggcucucaugauccuuuugaucauuguauauugggacaacgugggcaccgcccacuucuaucugcacacgucucucuccaggccacacauccuagaaccccuucccacccagggauugguggaggagaacguguucacauccgacguggaugaguuuuuggauacucuccuuaguucugacgcaaagcacaacgaccuuuccaggagaaaaacugagcagcccccggugcccgcccccagcaagccagucuugagccacauggaggagaacgugagaggcuacgacugguccacucaugaugcccaucagaacccugaccgggacaggcagcaggccgagaggaggagccugcugagagacuucugugccaacgccagccuggcauuccccaccaaggaccgcucuuuugacgacauccccaacuacgaacugaaccaccugaucguggacgaccgccacggggucaucuacugcuacgugcccaagguggccugcaccaacuggaagcgagugaugaucgugcugagcgagagccugcuggaccggggcagccccuaccgagacccccuggacaucccccgggaacacgugcacaacaccagcacgcaccucaccuucaacaaguucuggcgccgcuacggaaaguucucccgucaccuaaugaaggugaagcugaagaaguacaccaaguuccuguucgugcgcgaccccuuugugcgccucaucucagccuuccgcagcaaguucgagcuggagaacgaagaguuuuaccgcaaguucgcggugcccaugcuccgacuguacgccaaccacaccagccugcccgccucggugagugaggcuuucagcgccgggcucaaggucuccuucgccaacuucauccaguaccuccuggacccacacacggagaagcuggcgccuuucaacgagcacuggcgacagguguaccgccucugccacccgugccagauagacuaugacuucguggggaagcuggagacgcucgaugaggacgcugcccagcuccugagguuccucaagguagacucccagcuccacuucccccccaguuaucggaacaggacggccagcagcugggaggaagacugguuugccaacaucccccuggcauggaggcaacagcucuauaaacucuacgaggccgacuuuguucucuuuggcuaccccaagccagaaaaccugcucagggacugagcccccagaagcccucacgcugcccccaacaaauugaauggcugucccaugaggccguccuuugaggaugggacccuguggccuccuggguucucuccuggcuuccuuugcuuccuggugugacaggcagaggauuccacgccucucgcaucuggagaccgugguacagccaagacccaagcaccucacucuccagaguuuugcgcuccccacccccgcccuuuugcaaucuggauuuguuuacuccacagccuguauucauggaacacuguguuaaauacuguuuucuaagauuaauauauuucagauauauuuaauacgaaagugggaggaagcuggaguaaaguguggcacccgcacccuggcauuccugugguucuuugggucagucaggcaagaaugguacacaggaagggagccagggcugauggaauagccaagucucacaccucgcccggagguggaacaucucaaaagugucuucacuggagaagagccuaaauuugaagcuggcuggguuuuuuuuuggggggggggggagauagcgggugguuacuguaacaaaauccccugaggcucaguaacuguugaggaccugacucuugucagcuucugugaggccuucacaggaggcagcagcccugauugggggguggggggagugaucucaccauacaggaagcagugcgccugagucucacacaucaccugcuucugagagcucgggcuccuucagcuucaaacuccccuagucccccaagaacccaaacuacccagcccagccaucaugggcuuuaaaaaaaauauuuuuuaaauaauuauuuguuuuaaauaauuauuuuuuua

SEQ ID NO: 2772 - RNA, 2651 nt, Mus musculus
uggugggggagaggucaaggcuggggucagguggcccuaggagaaugugccacaggcuaggccaaugggucugacaaauugcugucugcccagggccuucugcuuccucuugagaccucaugaggcccagaacagaggcugaagccacccagcgggcucugacuucuaccaucagagguccagccucagggagagacgaaauggcuuugcucacugcccuucccagccuucuccucaccaggucccuccaaaccccacccuggggugcauuugucugggcugugccaagcuugaacacccacaaacacaugcugacuucugcucacacgcugugguuuuggccuuccggcuccagcagugaggcaccucuuccaggaagucagcccugcugaccccagaggggagggaaguucagagagggaaguugaaagcuucaacccuacccugccacccucucccagacccagcucaucucgagagaggaagcugggugccuuccugcuucugcacccucccugacacccuagagcuugcguggugugcaguguuacuuuuauugagagcugggaggggaggagcaucauucaguagguagccuaggcuggccuugaacucuuggcgauccuccugccucugccuccccaucccugagauuuacaggcacgaggcaucaguguaccuggcguuuuauaaacuuuuggaagccccaggacaggauaccugacugaguaacugaccagagaggagggcuccucgcuaagacccucacugaggcggccaggcagccagucauugguggcgcacgccuuuaaucccggcacuugggaggcagaggcaggugaaucugaguuccagaucaaccaggacagccaggcaggccuacacagagaaauucugucuugaaaaaaaaucaauuaaucaaucagucagucagucagucagucagucagucagucagucagcuugcuucccuccucaggagaaacucuuccgccugcucuaccugggaguuguugaagccacuggcuagacccuuccugggcccucccuacuuggcuucuguuucuuagaugauuuuuuugaccucacuugguaacccaugcuggcucugaucucacgacccucacaauccuccuaccucaacagccucaugaauaauacuagguuagagaccuaugccaccucacuggguuccccuccugcuccgugcugagguucugcccuccaggcucaggaccacccucuggcuccaaucagaaugggaagcucacccuggcuggggcccccagcuccaugccggcggcgagguuggugccgcuguaccacaccucuguggcugccagcucugugccagcugcaaggggcuuuugacgaccagagcagaggguagcaggccucugacucauccaggcaggaaggaggcucauggcccgugugcagacugcuccaccgugaccuuuccacccuuacaaaugucagcuuccucaucuagaaguagggccccaagccaccgccaccaggcccuguaugccaaggaccacggccaccacuggggauccccuacucugaaaaucccaggcagcugccucaggccuuaaaaagccaaacuacaaagccaagguggggucaggcucuggccagucaccccacaaggcaagagcaguuaccagcaagggccaugcccagcccacuugggggugcugaacccacagcugugagcaaugucugguggagugcaggacagaucucuaaucaaaugguguggggaagaaggcaaaggacacagggguggcagguaaugaggaccuagccccgugaguccggggucaggucagagcaggcagccaccuacagaagggcagcaggugggcagcacuagccugcuucucuguaaaggagcggaaacaaggagaccacagggaaggaguguggugaggaucccccgaucagccagccucuguggcuggauuugaggaaggucccugaagagccucagaaagauccgaguccucgccagcucuacccacgagugagcagccuggguacugcccauccucagaggauacaugacagguguaucucaugacagaugagaggccaggcagugucagcagaguugacagggaacgaagaucuagggggggugggggucauccaccucagcagccuggcugccugacuuuggucauccucauuuagccugcuuugagccucaguuuuccugucuggaaaaugggucucuggccagcccccacuagccacugcaccuccuccagaaaggucuggacacagugagguugacacagggcaugaccugaucaagcagcuaccgccaucagcccuguccaauucccaccucccaacaugguaucaacccaucagaggcacaucuacaccaagcuggccauacuucaucuauuuuaacacuaguuucccucccaagucguaaacuuguugaauucuucuucuuuuuuuuuuuuuuuuuuuuuuuuuuuuuuuuuuuuuuuuuuuuuuugguuuuucgagacaggguuucucuauauaguccuggcuguccuggaacucacucuguagaccaggcuggccucgaacucagaaaucccccugccucugccucccgagugcugggauuaaaggcgugcgccaccaug

SEQ ID NO: 2773 - RNA, 14371 nt, Mus musculus
cggggccugccuuagacaccggaaccucagcgggcgaggcgcacgcaggccgggguggagauccugguaaggcggaguucgagcuucggccaggcagucuaauggugcauuuugcacucucgggccuaauucccguagcggagggaugcgggggcgggauuagaaccccuaggcuaacucgcagucgccgagagcgcaccucuuacccggauuugggagguacggacgaugcaugucaggguccagacagcacaaaaaucauugcccuccaagaugcauauuucugucuugaagagacacuuaguuggaggccgcgggguugucacuugcagccucuaucgacuugggcugugacacccaccuuccugcgcacuccuccguggcuuggaggauugucucauccagguuucucuugaccguugggaacggauuuagggaucaggugccugggugaacagucuccugcgcaccuggcugauccccugacuguucucgcagcuagguuaauagacagcuacacccccaccccauaacaccaaacccccaaguuaacaggcuuugacagcaaaggccuuguggcucugacuaaccuguccucacccacagagcagcuucuagggcucaauccucuuguccagguuccccuggacugagcuuagcaucuuuguggacuuaagaguucugguccacagggcagugguggcuugccuuuaaucccagcacuugggaggcagaggcaggcggauuccugaguucgaggccagccuggucuacagagugaguuccaggacagccaaggcuacacaaagaaacucugucucaggaaaaaaaaaaaaagaguucugguccacgugaaguugucugggcccaucccccaguuaggcugccuguaacuaggguaguugguaucaaaucuguggcugaccucucccuuccucuguaggaacugccugccugaucauggacccagaaugcuccaggcuccucccggcucucugugcuguuuuggcagaucccagacagcugguggcagaugacaccugcuuggagaaacugcuggacugguuuaaaacagugacagaggcaggugaggacacggcuuagagaauuguccauccacguggugucuuuacuucauuuccuugaggcccuguggcuguggcugaucagggagaggggagauggaguacuagggacugaccugaacuguggagucauguagugacagucccauuggcuccgaccacaguucacauuaggaguuugcagagcacgcaccuaccuuguuuugcugucuucuauguaucuggcuugucuugaagaagucagaucucuggguggguguggugggaccugucaucuaaaagccaagacaagaggacauuaacaacgcuaaauuuggguucaaggccagccagaguuacauccuuucuguguggguggaccuuaauuuaaucacuggcauuguuguauguguuuccauuuuuuuuuucuccugaaacaggguuucucuguguagcucuggcuguccuggaaaucacuuuguagaccaggcugaccuggaacucagagaucugccagugucugccuccugagcgcugggauuaaaggagugcgcacacgacucuuuuuuuuuuuuuuuuuuuuuuuuaagugcuauacugguuuuccuugagcaugagaguuccugggcaaaugaaaauuuuaccucuccuguuugauugguugaucauguucuucagacagguuccauuagccuugucuugucauuaauuccuuccuucauuucuucuuuggcuuauucuguucuuuuucuuuucuuuugaagcauauucuaacguagccaaggaugaccuugaaccucugguccucccuuguguagaucuggaugcugggauggugcgguauauaccaucacacccuguuuguauuagaugcugaggauagagccagggcuuccuacauagcaggcaagcccuugaucaacugagcuucaaccccagcccuuaccuuuucuuuuguguuuugucucaccuguuuucuaaguuauggaauuuaaaaugauuaaaagguaacauguuaguugaauccuacaagguuuauugccuuguacuuuuguaauuagguuuugaauuuguguauuuugcuuuuugagacaugguuucucuuuguauccuugacuguccuucucucuuuauagaccacacuggcuucgaaccauugaacucugagauccuccugccuuugccuccugagugcugugauuaaaagaguaugcuaguauaccuggccucguguuuuuauauaugugugauacaugucugugugcuugcauguguguguguguugcaugcacacccagacauguacuucggaaggucagagcagggcaggaggacauuauaucuucugccauucgucuccauccaccuuauugccucgaggcaaggucuguuauuacaggagacugggccgcccaggaagcucuugggauucucuaguuaggauuagaggcuuuugcagcuaugcccagucuuuuauaugagugcugaggauuugaacucagguccucgugauugaaggacaggcacuguuacccacugaaccaucuuguuuuuuggaggcagcuuguuuuuugguucagcuguguagcccuggcugggccuggacuuacuguguagaccagacuggcuuugaacucagaggucuaccuggcucugccuccgucugccauguuuaaguguguguaccacuacaucuguccugcaaguauucuuaaacggcuuuauugagauaugauucacaugcacagaguccacccauucaaaguuuaccaguucagcggggcauggugacucaggucuacaaucucaacacuugggaggccaggacagauggguugcuacaaauuugaggccagccugggcuacauaguucagggucaaccuggguuacagaaggacauccuaucuugaaaaugcauauaaaaugaauggauaggaaaugaagugugccaguggagugggcuuuagucaaguuagggggugaauggucucauuauguaaacuuuuuguucccagcguagcuagguauccguuggcaggcaguucccaccucucucccaguuuccuguaauuuuuaagauguccaacauaauagaacugagccuauuggugcaggcuuauuagcccagguacuugggacugaggcaggaggauugugaguuuauggucucggcuacacagugaguucaaggcaaccuugauccuuuugaaagcaagagagagagggggggggcuggcagccagauauggcagagcacuugggaagcaaaggugggaggauuaggaguucauggcuagccucagcuacacggcaaauucaaggcuagccuggauuagaagaacuuguuccaaaacaaacaaacaaacaaacacaaaugcaaaaucaauaacaacaaacaaagaagcgaugggauguagcucacugggugaagccuuggguucagucccuagcaacugucccuuacuuucccaacaaaaggaaaaagccagggccaggccugguggcacaugucuuuaauuucaucacucaggaggcagaggcaggcugaucucugugaguucaaggcuagccuggucuacagaguugaguccuaggcuagggcuacauagagaaacccugucuagaaaaacaaaaaggaaaagaaaagaaaaagcuaggcauggugcuacaugcccauaaucccugcauuuagaagguagaggcaggaggcucagcaguucaaggccguccucagcuaccuaacaaauucaagccugccucaaaaccccaaaauguugcucaugcugaagggaacaguuuuuacguuuguccguuagauuggcuuccacuguucaugucugcuguguucuuggcgaccuauccauguaagugguucucagagguguguaaaaaucuaacucugagacugcaaauucaacuuuuuuuuuuuuuuggcaguguagucuuuaaauggcuccuuauuuauuacuuuucugucuuucuuuucuccuucuuuccuuuggugauacuacagguagauaaguauuuuauugcugagccacgucccacacccuagccccuccugggggauucuaggcaggggcucuaccacugagccacacccccagccccucacugggggauucuaggcaggggcucuguguggaguuacagcccuaacucuuugcugguucuuaucuuuaugagcuguuaucuuuuaucuacuguaaaguugaauuugcagucucagggcaaaguuuuuacacaccacugagaaacacauggauagauugccaagaacacagcagauguaagcagugaaagccaaucuaauggucaagcgugaaaacuguuccuuccggcaugggcagcacuuuuuuuucuuuuuuuuguuuuuuuuuuuuuguuuuuuuuuguuuuuuuguuuuuuguuuuucgagacaggguuucucuguauagcucuggcugucccggaacucacuuuguagaccaggcuggccucgaacucagaaauccgccugccucugccucccgagugcugugauuaaaggagugcgccaccacgcccagcuagcacuuuuuuuaaaagacuuacuuauuuaauguauaugaguacauauagcagaagagaacauauaucucucuucagacacaccagaagagggcaucagaucccauuacagaugguugugagccaccaugugguugcagggaauugaacucaggaccucuagaagagcagucagugcucuuaaccacugagccaucucuccagccccaucuuuguuuuuuuuuuuuuuuuuuuuuuaggcagacuuaccuguaacccaaguuauccaugaauuuguagguggcugaggauaaccuugaauucaugagccaucugccuccaccuucuaaaugcugggauuauaggcaugucgcaccaugccuuuggggucucuuuaaugaguucagguuaggagccauuguuguacauacccaucuuucuuggacuccuuaauccuaaggggaagggauguuggagccacuucuagagaggcuguccauggucacuguucuccuggacgucuuuucuccacagagucuagccuccaacuacuacaggaccaucccugcuuaauggagcuccugucccaugugcugaagccacaggacgugagcccuaggguccucuccuuugcucugcgccuuguuggggucuucgcagcccaggaagacuguuuugaguaccuucaggugagccuuugucucccacgugcuuguccccagagggcggccauccucucuucuggaguaggagccaucucagugccuggaucucaguggcuggcccugcuccuguggcuggccagcacaccaggauucuuaaguccacugucaucccacauugcuccuacuuagaaacauuugccagggacguugcuggcugacuuccuguugucacccacugugugauccuuggccaccaucugaguaucucucucuguccuagggcagugugaggccccuaggacacuccugaugcuuugucuguagcacggucauggaucgcaugggggaaagaacacaguguucuaggugaagcaacugcuugccacagucagggagcuccaggucucgggcaucugucgcccuccucuggcuuccacauucauggacauagacccacagauguguaacuagagaacuuuaaaauaacaaaaaucuuauaaagaaaggaggaagaaaagaaaugugguguucuuccucugaccucuuucccaucucaggagggcagagcggugguaugggguccgggaacaguugugugaaaccaacuggcacuuccacccauccucuugguuuuuuguuuuguuguugucuuucauuuauuauuauuacuauuacuuugacacagugucucucuauguaguccuggcuguccuggagcuugcuauauagaccaggcuggccuaacucacauagaucugccugccucugccucccagaugcuggaauuaaagaagugcaccaccacaucugguguuuuuuuuuccccccugguauuuauuuuuauuuuacgucuguggguguuuugccuauguguaugucucuggaccacauccaugcaguucuuguggagaucagaagagggcgucacaucucccggaacugggauuuauacaguugugagccaccguguggguguugggaccugagccagguuucuuuacugaagcagucagugcuccuaagcccugagccaucgcuccagccccauguguucuuucuugagaugagaucuuaccauguauucuuggcucaucuagaauucaaggagacucaccugcuucugccucugagugccaggauuaaaggauguacuaccaagcaugacucucccguccugaaaacggccaacaauaaacccugcucccuccgcauuucucaugcuuucuuugcuuccuagcagggagaguuguugcuggggcucuuuggggagucaggugcccccggcugggcagccuggagcaucccaagugugcgcagcggcuggauccagggucugugcuaccuggcacaccacccuagcgcccugcacuuccuggcugacaguggugaguauagcccauacccugucccagcucaccaacagggccuccugucucucugccugugcugugggaucuccaagaagcccaugaaccucucugaauccagucuucucagcugagaaagugguggugguccaggcuugucaguauaagcacagugacuguagggaaauguaucuuugauuccuagggucugggauggcuccugcaauuacguccugucaaauagucuugaguuuguccuguaacauagaacugguuagaagcuccauuggccccaggcggugcuggcacaugccuuuaaucccaacaccugggaggcagaaguaggcaggguucugggaucaaaggcaaauguugcuuauuuuuuucuccaaauccagcuuagguggaaauaaaguuagguaucagugcagggaggggauauuucuguguguguaaaaaucagcuguuuccagugccucggcucaacuuacuuggugugggaagccucucucccugcagcaggcuuuugucuuuuuuuaauuuuaauuucuugguguuggugcaaccuaggaggcagaggcagauggauacacacacacacacaaacauacauauauaaguucaaggcuaaccugguuuggagcaaauucuaggacaaccagggcuacacagugaaacccggucucaaaaaaaaaaagagagagaaaagaagaaagcauuggcuuuaaagccagcaugcuagaggcucaugcuggguuuccuugugagcagaggggagucucggugcuuuccaaggcccgaaggguaugauggauagguguccucugugugccuccucauccggugugaccuuuugcugcccgcuccaggugcuguggacacgcucuucuccuugcagggagaccccagccuguucgucgccucagcagccagccagcuccuaguacauauccuggcucuguccaugcaagguggagccccagggucccccgucccugaagcugcugcuuggccuaugugugcccagaagauugugaaccauguggaugagucccugcaugccaaagccaccccccaggucacacaggccuugaauguccugacuacgaccuucgggcgcugccauaaccccuggacagggguccucugggagcggcuaagucccccuguugcccgccuguuugagagagaccccauuccagccgugcacgcgcucauggaccuucuucuuaguguggccaggucagggggcugcggggacucggggugagugaccguugucugugaagcgucagagcagcugaugcuucauggggaggacccuaaggaugccuugggacagggcaucugcaggacugggcauaauugcagcuguccaguuagacucugauggaggccuggcuuuuucuuucuccaggucgccuguguugaauuuugcagccuguggccugugggagaugcuggcccagacucugagccgccugagccccauacaagcugggccucuagcccuggggacccugaaacuucagcacugguaugauugggggagcugagagugucauaauaaugguuggggaacuuuggaaaccgggagccaaaugugagaaugggccaggugggaugggcagccaggugggagagcagucaggugggaugggcagccaggugggaugggcagccaggugggaggagcagccaggugggauaggcagccaggugggaugggcagccaggugggaugggcagccaggugggaugggcagccaugugggagagcagccagguggaauggacagguauuaaagcacuggcugccuccuccugucccucucucccuccauuuucuuccccuuugucucucuuuuuccuccucaguacuugguauggaacuuagcauuuuuuauacaugcuagucaaaugcucuaccacugagccacguccuccauuuccucacugggggauucuaggcagguguucugucauagagccauacccacaguucucuuuuucuucuuauuuugagacagucuucacugaauugcccaggcugaccugaacucacucuucaggucaagcuggccuugaacuuuauaauuccaccuccaccuccuaagcagcaugggccauaccacacugagcaagagacagagcuauaucaaauaaaaguuugugguaccccagagcuaaagcuaacuucugugcugucuguagcuguccucuuaccuccgauaaggcugagccaggcuccuggaacucccuagccuguaccccauggggugugcagaggugugggcugccgaaugugggaugcagggaggaagcgugcucaguucaucagagugggccaucgcguaacguguaaagggacaccucaggucauugaacacaacaugagcgcauugggcauugcccuaggagccaggaaauucccagucagucugaucagggaguguagccagccuuucuggggccccugaggauagcagggccaagccuuggucagucccuuccuccuaccugguuccuaacuagcagcuuacagaggagcuguuucagaggagccuccacccucgcuuguacugagccaccauagacucucuaggaugcucagauuguggccagaguauaacccucauccuguacuguguccccaguccccaggaauugaggacccaggccuuuggaguccuccuacagccacuggccuguauccugaaagcuaccacucaggccccuggaccuccagguaugcagggaggguggaacccuccauucuuaggcaaagaagagugagcuacccuagucccaugcagaccucccccaacuaaugauacaggcagacagcaucccugaccagccccggcccugagcuugagagcccuugcuuggaugguggucacuaaagggaugcuguugucuuugccuuaggcuugcuggaugggacuguggguagcuugcugacuguggauauacucuuggcuucaaagucagccugugugggacuccuuugccagacucuggcucaccuggaggagcugcagaugcuggugaguauagguaugccuugugucauugagccacaugaccccggggccucugcugauuuugcuucccccugcagccccagugccccucacccuggccacaggugcaucugcugcaagcugcuuugacuauauugcaucucugugauggcucagcggaccccagcuccagugcaggaggccgucucugugggacucuggguggcuguguucguguccagcgagcagcccuugacuucuuggggacccugucucaggggacaagugagugcuguuuucucgugguccuaaguuccaacuuucucuucuuucuucuggggguguccauugggcucucagguagcccucggggagcuucugaccccugcuuccauagaguuuggaauccaugcucccuuccuggcggugggcucuggguagauguugguuugauguuucuacucauaucuguuucaggcccccuggaguugguucuggagguauuugcuguucuccugaagacccuggagagcccagaguccagccccaugguaccguaaauggguucugggaaggcuauacagcuggggaccuucucacuuaagaaugcuuccacuagaggcuaccaagccacugcccagagugaccuuuccggguguauugguacacaccugugauccccccacagaugugguacagacuggaggaucaugaguucaagaccagucugggcuacaaagagacccugacaagcuggguaugguuguacacgccuuuaguuucaguaugugggaggcagaggcaggcaaaucucuagaguuuggccagcuucgucuacaaaaggauuuccaggacagccaaggucacauagugagaccaagaggggacagagacccuugaccccagagucaacacugguagcaauggcugcaugggacccaggaucggauccaucugggugaggcuuacagcuaaaggcuucucuaauauacauauuuaaaaaaaaaauuccagugcaggggaagggggaguuucuucccacccucggcuauuuauuuucccagaugaaagacacacagucuuaauguauuguuaaauaugccuuaggcagcacaauagcugggcagcugccuaccugccacacuguuagaauccacuuugcuacugauaacuccaaguuacugcuugccaauuccuguguucuguuggggcugcuuuugacuccagucgacucgcucacgugccacguuuuaaaggcucagcugucccagugcagcaccguucuccuuuuucuuccucuuccuuguggucccaggagcccuaaaccccgccugugucucuucuucccagccauuggcugcuggcaucuuccuuuaccaaucagaauuaacugggggcaggguucucuggugucuuacacugccuuuggggcaguuuugggggacccaacuuagcauuuaguauaagcagcauugguccgacccacagcagacuucugaagcuauagaggagccagggauggagcugcaggaggggcaugacagacauacagcccaguguccuagggaguucuuuccucucaauggcuuuguuuuuauauuuuugagacaggauguuacucuguugcccgagcuggcuggccucuaguuggcauuccugcugucugcagcaugcccuaccuuucacagaauucuuaggagggagggaaggggacuaggggaagauagguucucaugcacuccccugcuccugcuccuggguguagacuuagugccaggugcugcaggcagaauggaccaaagaaggagaggcugggguggggguugggguggggguugaugucauauccacaugaagaggucccaucaccccaggcagggcuucugaggggggcaucccauccccuucagucucuaugucugagaggcuagacugcacucaacuuguguuucugugcccacgaguggcguggugcagggacggggacaugguagcaugcuacuccuacccucuagccugucccauucuagguccuaaagaaggccuuccaggccacacucagauggcuccagaacccacacaagacccccagcagcucugaucucagcuccgacgcccugcuguuucucggagguaacccuagcuccuugcagagcuguaucaaguuggagcuguggggcagggggcagcugggagcugggcagggugucccucagggaaggcagagugugacucuagaggccacugaccuccccuuccugguacagagcuguuccccauacuacagaagcgccuaugcagcccauguugggaggugagggacucugcccuggaguuccugacgcaucugauccgacacuggggaggugagcacccuggggacaggaguguguauguugugucuauguguccugcuggcuuuggggcucucacuaccugaguggccuuugaucacaucuguguggcauuugaccccccccagggcaggcugacuucagagaggcacugcguuccucagaaguacccacacuugcccuccagcuucuccaagacccagagaguuacguccgagcaagugccgugggugccgcugggcagcucuccagccagggucugcaggccgcucccgcuagccccgagaacucgcaggcccaacagguagacacagggaguuggugagcagcuagccaaaucuguagcaacugcuucugagagggggaccaccaaggaguggggggcagucgggcauagugccugugcucuuucugacaccccacccugauaagcaagggcagggcuggaggaacucagaacacaucguguugagggaccagagcagcacauggcccgugcuauggcugaguacuuacgucuccuggguuccguccuuggcucgucacuguauuaguuggauuucuugcugcugaaucagaauuccugaagaaagcagguuaaggaagugaguucguuagggcucauaguuugagggugccauccuccugguugggugagccguagugguaggagcuugaggcagcuguagucagggugcagagagauggacgcuggcaccuggcucacguucuccuuucuauucagugugagaccccagccguucugugccuuagccuucccuagaugcucuaucacggucacucagagggcggucucauagcugcauuggauccuugacaaguuaucagggucgggccgacuuuuuuggaauucuccaaccugcagggccuacucauggaccuuaugcauauccuguccacugacucagagggcuucccucgaagggcuguguuacgggucuucacggacuggcugagggauggccaugcugacgugguucgagacacggagugguucguggccacuguucuccaggcagugagccgggaucuggacugggagguccgagugcaggguuuggagcuggcacggguguuccucacccaggcacugggccagcccagccuccacugucccuauacagugggccugcccagggccuccucuccccgcccacacccggaauucuugcagacucucugccgucugccgcucuuugaguuugccuuuugugccuugcuugacugugaccgaccgguggcccaaaaggccugugaccugcuccucuucuugagggacaagacaguucccugcaguagcccucgggaggcaggggacagccccaacucagccucaguggaggcugcccugcagagguggcgggaaggagagcaggcccagccccuaggggaccuggauccugaggccaugcuagccauccucagggccuuagaccuggagggccugcagggcaggcuggccaagagcagcgaccauguggagaagagcccacagucccugcugcaggacaugcuggccacgguggguguguuggaggagaacgaagcugacugcuacuaaggcguguccacguccugucccuguuuccauccugugccagcaggaggaccccagcccaggucagcagcucaagagacccugcaggggguggaucacauguuuuaagccggguacgauaacacaccuaugaucacagcguuuaaaagaccaagggaggagaauguagaguucccggccagccuggacuagauagcaacccugucucaagaaaacccaagaaaucaaaucaaaacaaaaucuccacccuuugugugcugugcaugcagaccggaggccagccuccaguguucuuccucaggugcuguccaccuugguuuuugagaaaaggucucucacuaggacuugguacucccugaugaggcuugccagugagcuccagggaucccgccaccaccuccucagcaccgggaucauaauacuguaucccugugccugggucuacauacaugggugcugggauuugaacucagguccucaugcuugcacggcaagcacuuuacccacugaaccaucuccccaggucccacagaauccuacuuuccacguguuauuaaagagguggcuuguuuucugcucagaacagguaguacugaugucuauaaccuucaauuguguauguggauuaacaaagccccacugugaucugcauauggccuucagcucucugcuccgucacccaacguuugaaagucccauaaucuuuaaagaauucagauacauuaaaaguucaaagucacaacuguggguccuguaaaauaaaauaaaaaaaaauuuuuuuuaaag

SEQ ID NO: 2774 - RNA, 2252 nt, Mus musculus
uaggcagacuuaccuguaacccaaguuauccaugaauuuguagguggcugaggauaaccuugaauucaugagccaucugccuccaccuucuaaaugcugggauuauaggcaugucgcaccaugccuuuggggucucuuuaaugaguucagguuaggagccauuguuguacauacccaucuuucuuggacuccuuaauccuaaggggaagggauguuggagccacuucuagagaggcuguccauggucacuguucuccuggacgucuuuucuccacagagucuagccuccaacuacuacaggaccaucccugcuuaauggagcuccugucccaugugcugaagccacaggacgugagcccuaggguccucuccuuugcucugcgccuuguuggggucuucgcagcccaggaagacuguuuugaguaccuucaggugagccuuugucucccacgugcuuguccccagagggcggccauccucucuucuggaguaggagccaucucagugccuggaucucaguggcuggcccugcuccuguggcuggccagcacaccaggauucuuaaguccacugucaucccacauugcuccuacuuagaaacauuugccagggacguugcuggcugacuuccuguugucacccacugugugauccuuggccaccaucugaguaucucucucuguccuagggcagugugaggccccuaggacacuccugaugcuuugucuguagcacggucauggaucgcaugggggaaagaacacaguguucuaggugaagcaacugcuugccacagucagggagcuccaggucucgggcaucugucgcccuccucuggcuuccacauucauggacauagacccacagauguguaacuagagaacuuuaaaauaacaaaaaucuuauaaagaaaggaggaagaaaagaaaugugguguucuuccucugaccucuuucccaucucaggagggcagagcggugguaugggguccgggaacaguugugugaaaccaacuggcacuuccacccauccucuugguuuuuuguuuuguuguugucuuucauuuauuauuauuacuauuacuuugacacagugucucucuauguaguccuggcuguccuggagcuugcuauauagaccaggcuggccuaacucacauagaucugccugccucugccucccagaugcuggaauuaaagaagugcaccaccacaucugguguuuuuuuuuccccccugguauuuauuuuuauuuuacgucuguggguguuuugccuauguguaugucucuggaccacauccaugcaguucuuguggagaucagaagagggcgucacaucucccggaacugggauuuauacaguugugagccaccguguggguguugggaccugagccagguuucuuuacugaagcagucagugcuccuaagcccugagccaucgcuccagccccauguguucuuucuugagaugagaucuuaccauguauucuuggcucaucuagaauucaaggagacucaccugcuucugccucugagugccaggauuaaaggauguacuaccaagcaugacucucccguccugaaaacggccaacaauaaacccugcucccuccgcauuucucaugcuuucuuugcuuccuagcagggagaguuguugcuggggcucuuuggggagucaggugcccccggcugggcagccuggagcaucccaagugugcgcagcggcuggauccagggucugugcuaccuggcacaccacccuagcgcccugcacuuccuggcugacaguggugaguauagcccauacccugucccagcucaccaacagggccuccugucucucugccugugcugugggaucuccaagaagcccaugaaccucucugaauccagucuucucagcugagaaagugguggugguccaggcuugucaguauaagcacagugacuguagggaaauguaucuuugauuccuagggucugggauggcuccugcaauuacguccugucaaauagucuugaguuuguccuguaacauagaacugguuagaagcuccauuggccccaggcggugcuggcacaugccuuuaaucccaacaccugggaggcagaaguaggcaggguucugggaucaaaggcaaauguugcuuauuuuuuucuccaaauccagcuuagguggaaauaaaguuagguaucagugcagggaggggauauuucuguguguguaaaaaucagcuguuuccagugcc

SEQ ID NO: 2775 - RNA, 37329 nt, Mus musculus
uggcggcacccguugaagugacacgagcgugccuggcgguguguggcaugugugcgguaagugagggcuuggguaggcacauaaguguuugugugaugugugucagagguggucugggagugugugcucuugugugugcauacaugugcaugugugucaacagggugaacuguggccguaugcaugcgcucugggugugauggcugcugggugcgcacagugaugggaaauagaggacugauggggaugugugcacuacaggcugggugucacuaggugaaggaccagaccaaggugcccugcaguugcuguccccacccucgaaguggaccuccuagccaaagacagccacggcucagguaauuauccgucagaaggagugcaugacuggagggcuucugggaggcggcagcuacugggagucaggcaggugaaggggagaagagcaguuaucuagguacagccuggagucugggagugaugaagaaagacuggaaaagaggagagacagccaguagggaugaauaagguuggcuugcacucaaauuuuaaaaggccaucuuccuagaaugggggugccagaaaaggcacccacagagguggcacauggggugagaggacaaacggcugggacagacagagccagguggcuaggaagcuuugaugcuccagggacaagauggggcuuucucgugagacuaagggacaccugaggaucuugcugugcaggaggacugggcuugaacggagagaggucagguggagccagcugugcugggcagucgggagaaaaaaauauauauauauauggagguugaccagauguuucaaagugagugcaagccuguggguaggguagaggagugucugggaggcaugcaacuucugcagugugagagcauauaaagagaaguuuggguccccagggucuuguccccaggaucugaggacaguaccaugcucuccaugugcuacuuguucucuauccuuguagccccccaccccagcucuuuuaucuaugugggggaugaagauacuuuggugaccccacccuccaggugccuagagccaccagaagccccagggugggcuguucccuggcucccaggcccaugcucuccugaagggaaugccugugccucauccugcccccccccuuagggugcauggacugccaaggugacagagacagaugucacugggcaugugguggacacgaggaacaaaccuccauuugggggucuugcucagaucccccucucaggugucuucccacacugggggcuaccuggaugccacugcaggggucuguugcugccaggcugcgccuugguuccuuacaagccuguccaggacaacccugucuucuggggguuccuucucccgcuagcacccacuccuacuauacucugugucuccccugggugacgcuucccaccuacaaaaggauuuaaaaaggcuuucuccaugacagggcacagcuaagacucugaagccccuugucagccagcaccuccccucccugccaggaggagguaagauaaggugcaaugaaugagggggcuggugcgugggacaccccucuuucugcagccuacucugggcacccugagaugacuuugccuuuuuaaguuguuggugucucagugcaaggacuuuggggacauuuucaggcaguucuaaaucgaggggaacugugacagggacugaugucgcugggcaugugguggcaugaggaucaugucucaaccccuccucugugccugccuucgauggacgauuucuagcuaggaaacaacaggugggcucucuccccaccccuaagcacauaaaauggaggagggaggggaggagggaugaggccagaccugggcagagauaagacagagacgagaggcuaaacagccuagucuuaaugcccaagccauccugcacccaagauuuggucuagccuugggaaucccuaggagccugucuucauaguuggcagcucccuauccugucccuauccuguaaagccuucacuauuuguugagcauaacuuuccauugagacacucaccccgccucccagucuuagucacccuggcugcugucuggggggaacaagggaucucagaacuggggggaccuggugugaauacuaauuggacugcucacagggcggcuucacaggcugaucguagauggcuggacccuggccagggccggcugggccugcuuuggagcccugugcacccccaccauugaaucaagaugcuucuaaugccuggggacuucuguuccucucucaggcuugggaaggguccucagcuguuccaggaugggguggagacuggagacccagagagcuggggucccugguacccagucccaacugacccugagaaggggcuuuagucacuccaagaggggguaaggacuggagacucagaggguacccagucccagcugauccuggcugggccuucuauaaaaugcuuccggaaauauggcugcccucaucagacagaggggagggcucuucucaagaugguagauaggggugugugugugaaacugggggauagauaaggauaccucuuggcuuaaaggaguuuaaaggacuucaaggagcuuaaaggacucuagucuucuauccaauuugagcaugccuuaagucaguccccucccccgaccccccagauaggguuacguguaacccaggcuggccagauagggucacauguaacccaggcuggugagauaggguuacauguaacccaggcuggccuccaauucucuauguagcuaaggauggccuugaacuccugauucuccugccuccaucuucugagugcuggguuuaugaugcuauggcugguuuacagcucuggggacagaacccagagcuugugcuacuucccugcugucugcggcuggaucccauugccaccgucucaaugucacuugccucaccaaccucugucgcugucagauggccuuggugcaaggcagugggagccccucagggucauggcugacuccgcacagcccagccuaucauguggcuucguucacacucugcucccacaacuuguuuggauccguccgcccaaagccccagcacacucugucuuuugcucacaccagcuugucccccgggaccagacccuucccuacccuugguuguggcucauccugcuugcccgucugugugacacuggccucaaaugcugucccuggaucucgucuuccucugcacccucuucacugcuggcgcugucucuagggcagccugccccaccgcagagcagcaccuggcacacacuaugucugcugcucaaagggcugcccgacugggaacuacuacugcgccaagaacauggcuccucuccucuaauccuuccaacacuugcugugaggcaguuuccucuucgccagauggaaugagcuccugucacuacuuaucuuacagcagcacacauguauugucacuucugcaguccaaaguccaagacucaagugugggguacacuguguucccccugcagugguucucaacuuucgaacgcugugaccccccaaccacaaaaguauuccauugcugcuucauaacuguaauuuugcuacuguuaugaguuguaauguaaauaucugauaugugauccccaggggguugcgacccauaggcugccuauggccauauuguuccuucucugcccugcaggguucagcuguguaguccuggcuggccuggacucacuauguagacuaggcugguuuugaacucagaggucugcacucagaagguggaggcaggaggaucagaaguucaagauaugggccagugaaaugucccagcaauuaaaggugcuugccaccaaaccugaggaccugaguucaauccccgggacccacacaguggaaggaaagaacugacuccugcaagcgguccccucccuuguaaagaugcgccacggcgagcuucugccgcccugcgagccacacuaauaaaaagcucaagggccucuucagcuauguaguaaguucaggaucaccccagacuccaggaggccucauucuccuuuucauaaaauaggcuucacugagcuggacaguggugacucaugccuuuaaucccagaaccuaggaggcaggggcagacagaccucugaguucgaggccagccuggucuacagagcaaguuccaggacacccagcacuacacagaaaacccugucuugagaaaccaaaaaaaaaaagaaaagaaaacaaaaaugccucauuguaccucagguaggguguucucaucucugcaacuuuuacuuguagagacccucguuccaaauaagaccccuauccugagggugugggugaacccaucuuuuuuuuuaaaauacuuauugauuuauuauauguaagugcacuguagcugucuucagacaccccagaagagagcaucagaucucauuauggauuuuugugagccaccaugugguugcugggauuugaacucaggaccuucggaagggcggucagugcucuuaacugcugagccaucucuccagcccaagggugaacccaucuuuaaggggacuguuuaacugacucuggagaagcggaggcacgggaaauacagcaccgucuuacggcagugagcccuaggugugccuggcucagaggacagggauccaucccauuucuagaguaugcuagaagucuggagaccugcuuggguagagggcagugugucucauugcauggggcgagagacuggcaggcaauggccuaggcuggauguggcuucauccaggaaguccuggccuggggaccacuugccucaggggucaggaggucccuuccaguucaucaaggccccgcuguggacuuguucaucuagauuuccaaguucaaguuaugaggccuggcuuuuguggcuuugguaucuccuagcagugacaagaauaggcagucuacaacgucauuuauguguguucaugccggcggugaaucucaggcauuggucucaauugcucucccugcuagguuuuguuugguuuugguuuuuugcaauaggguuucucuguauaguccuggcuguccuggaacucacucuguagaccaggcuggccuugaacucagaaauccgccugccucugccuccugagugcugggauuaaaggcaugugccaccacugccccgcccugcuagguuuuuauggcuuuuugagaaagguucucaagauguaucccuggcuggccugggauauguagaccaggcuggccuggaacucacagagauccuccugccucuguuuccugaacacuggaauuaaagauguacacacauaucuagcaucuacccugguuuguuuguuuguuuguuuguuuguggcuggaucuuguacugaaccgguggcuuaggcucccaguggugagacugagaucaugggccugugccucugugccuggcuucuucuuggcugcuggggcucagauggucaguuugcagggccggcacuucacccacugagccgucuucccagguccucaaagcuucuucauaauagaacauggaucuuucccuacagccuuguucuugcccuaacaaagugcaccagaaaacacuugucagaaguguguggcauucuagccaguguucacugcaugccugugauaucagcacuuggaaaaaaaggcacagaaacuuugcgaguuugaggucagcuuggacuauauagcaagaccuaaaucuuuggcaggagggaaggagggaggaagaguggaagacgaaggaaggaaauagccucuagcagagaguauguggacaaucccuuuaagaugguuuuaguugggcagugguggugcaugcuuuuaaucccagcacuugggaaucagaggcaggucagucccugugaguucaaggccagccugaucuacagugacuuccaggacaggaagggcuacacaaagaaaaaccaaaggggggcuggagagauggcucagagauuaagagcacugacugcucuuccugauuucaauuccccgcaaccacaugguggcucaugacuaucuguaaugggaucugaugcccucuucuggugugucuaagacaacuacacuguagucuuauacauaaaagaaguaauuuuguuuuuguuuguuuuuuguuguuuuuuuuuuuguuuuuguuuuuuguuuuuuucgacacaggguuucucuguguagcccuggcuguccuggaacucacuuuguagaccaggcuggccucaaacucagaaauccaucugccucugccucccgacugcugggauuaaaggcgugcgccaccaccgcccugcuaaaagaaauaauaaaagaaagaaagaaagaaagaccaaagcaggguugggagagaugguuuuaaauguggaggaaaaaaauaacagagguuaggaaagagcugggauccugggucagucacccaucgcccuuugcuuuuuuuuuuuuuuaaucucccacauuucucuacauuggauguuuacaguugaaucauuauuucuuaaucguuuuuuuuguuuuuuuuuuuuuuuaaggaaaauuccuuugccccuggaaaugaugaggaugcauggcucugccacucacgggugggggggggggguguuggggggagggaccgggcuaucucacggugggggggagggcguugcugaggggagugggcuaucugcagaggucccaggaggcuggugauuuccaaucaggaaggaaccugcuauucuaaagacgccaaggagaaagugcaguuuagagguuuaaccgggacagcaaugcuugggugaggugguacaaagcccuucuucccaacucuguggaggcugaagcaggaggauggaguuaaaggccagccugugcuacacaugcaaacccuaccaagggauaaccaaaaauacaucaaugguagcaaccugcauggcugaggcuagcacagcuuggcccugcacucagagccauucuuccucugguggcuuucaggggacugugggcacaaauaagaggccauugaccaccugugggaaccagacacgaaucugaggcuagggaaggcaggguuccccauucgugucuagagaucgaguuccucuagucuagaugguaucaccagccugccuaacccuugauggugugggaaggggaaacagacacuucccuuuuuuugagacaagguuucuuuguauagcccugguugcccuggaacucacuuuauagaccaggcugccuugaacucacagagauccgccugccucugccucccgagagugugggaucaaaggugugcgccaccacggccuggcucagggaccccuguuuaggcggcaguucuuugcagggcuagucaggucaacacggaggcccuuccacuucccaaauacaagcuuggcacauuggggaagcuccucugugaacugggccaggacagguccccucagguucuuucuggccacccaggugacuuuaggaaugaugucuccaccuaacacuggcuucuagcacacaguaggguuuguugccccuacuaggugagaaaaucgaaccugggcuuaugguuugguaaugguagauauggagucuccauugcucugauacuugugugucaauuucucagucuagauggcauucaagccugucuuaccugcucaucauugguaguugugaugggcguggaugccccucuccccacuguguugccuguggauuagugagcucucaggcucuggggaagaaacauaucucucucucucccuuucccccuuuccccucccuucccucccucccccucccuuccccuaccccucuuccucuccccucucccucucuuccucccccuuccuucccucucccucuccuccucccccucuccuucucccuauuucugucucucucugaccuggggacuucugagacaggaucucacuauguagcccugucucuccugggauucgcggcauaaaaucggcuggccuugaacucacagagaucugcuugccucuacuuccuacauccuaagugagauuaaagacaugcaaagaguccaggagcagugugaccccugauguuuuuuaugaauuuuuuuauuuuuauuuauuuauuuuuuuuugagacaggguuucucuauauagcccuggcuguccuagaacucacuuuguagaccaggcuggccucgaauucagaaauaucaggccugucucugccucccagggcauguaugugcaguaccuacagaggccagaagggggcguggguaauuuuguuuccccuggagcuggacuuacaggcagugagcccugggugcugggaacuaaaccaugcucuucugcaaaguccucugcucuuaacugcugagccgucucuccaggcccaguuugccugaguuggggucugcuugcuuaucugcugucuauaggagaggcagagcugaugcccagucugcccgaggccuauggaggcucagaggucaugugacaucccuugaccuuagggugccucugaccuauaccguuuguccuaugccagcagcucccaagggcccaggacagggggauguagugggagagcuacuguuuccagguggccuuuuuguccugugaucccugugagagcauuuaagcaguuggcuccugagcccacaccuggguugaguggaacagaggcccugggcuccuggcacuguggucagcagcccuucuccguucauuguccccuccuagguggcucuuuggccuuguaacccauggccugagugucugaaguauuucuuucuuucuuuucuuuucuuuuuuuuaaaaacauauuugugggguggggaugggguggagucaguuaaaguauaugcaggucaggggacaauuuugugggcaacagcucucucuuuccaccuuuacaugacuucuaaggaucuaacucagcuugccugguuuuaguggcgagcaccuuuguccacugaaccgucuugcuagucccucuuugacccacuccugaguuccacacaaaacguaucaguucauuagcagccucccaggcaggugguguuggcaacgccuuuaaucugagagcuauacagaggcaaguggaucucugaguuccaggccagccugcucuauagagugaauuccaggauagccagggcuauacaggaaaacccuguuuggaaacaaauaaaaagaaacaaaguagcagucucccuccccugucaccgcuuuuaaaucagaguucccagccaugggagcuaacaggaagccccccccccccccagugcucugugguaguuuuguuucuguugcugugauacaaugccuugacaagaaaaacagcauagcaggaaaguauuucuuagccgacaguucuagguuacagaucauuacaguagggaagucaagguaggaacugaaaacggcugguugcaucauagccacggccaggagcaggaaccaauacauaugugcuugcuuaugcuuaacuuaaacuucucugcucuuacacagcucuggaccccugccuaaggaaugguaccacccacacugggcugggguuucagcaucauucaauuuauaugaccacacaggccaacucaacauagacagucucucacugagacucuucuugggugaucuaagggggugagaaguugacaaagcuagcuaucccagacuccaggccuggcccugggauagggaguggggguccugguccugccuauagcccagcugagaccuaggccaggcaugagagcucagauuucagugaccugcugaagggcccugggaggagaacaagagauucacugcuagcaggugcuaaaguuccuauggguggccuuuggggaacccucgccagcagauccagggcuccuugagggacaacccagauggcugguuucagagaugaguccaggagcagugugaccccaaaaugguucgucucuggguggcacauaguccucucucucucucucucucucucucucucucucucucucucucucuuccugucuagaccucagugaaacuuuguuaagccauugaacaggaccaugugacacucagugaaugguccauaccagcuuaagauaauuuauuuuaaucaauuuaauuugagauaauuuggcaguuaucagucuuugcacaggccauauugaaugccuguuccuaccaggaccuguuuuuggguccagagcauggacuuuagauacaauaugagggauaggcaaaccccugauguagcauccuccaggaauaacaggugucacaggagguugggggagccuccugaggucccuaucagagcaauguauuugggggaaagaauguucuagaagaggaauaagacgaacauaagaacuugaugagguugggaggcccuuagcugggcuucuagucuguggcuccaucauuuuuaccugcuuaucccucaguuuuuuuguuucuaagauuuuuguaaaauuuuauuuauaugaguacauuguagcugucuucagacacaccagaagagggcaucgauccuauuauagaugguugugagccaccauaugguugcugggaauugaacucagagccucuggaagaacaaucagugcucuuaacugcugagccaucucuccagcccagcccucaguuuuucuauaagcaaaaugggaacaaacaaccuuguggguagcuguggcaagaauguucuggaagcauucggaauacugucugaagcuagagauguggcucaguugguagaguacuugccuagcgugcaaccauguuguagguucaguccccagcacugcacaagugggcguggugguguaccccucugacgacggacgccaccagcacucaggagguagaggcgggagagucagaaguccgaggucgccuugauuauguagcaaguuggaggccucgaguuacagguaugcacuaccacccugguuucugaugagcugcguuuccaaugcaggcuucuugcccgguuuauuuuguuuuccuuuuguuuuuguuugguugguuuuuuuugguuuuuguuuuguuuuuugcuugugcguuuguuuagcugguuuuggcuuuuguuguuugagacagauucucacuauauacagcucagauuagcuuggagcccucaaucuuccugccucagcaucaguuguaggauuacaggaaugccccgcccccauccacccccacccccacccccaucccguuugacuuuuccucugguguccuaggcuggccugggauguuccagcuuccucucucuccucgagcuaugagaugagcucugaagcacgcguugcugggagugucagugucccacgugcuccugagcagacaggcaucagaagucugagagucacuggggaggguguggcaccguuuccuaccacccuccucucgcacuuuccacccgaucccgcuucagucccugccucgcgugcugacgucacaccaggaccgguuugguccccgugacccgcacaccaagcuucucuggggcaguuccggagggcuggggcugcgagguaggggccgcguggaaagcaaccacaggcgcggggagcugauggccggggugggugcggguggugcugcggaguggggguucuagccagcgcaagccagggggacgucugggugguggcggcggcgugcuccugugccacgagaccacgggaugugcucgguguacuuggguagagguuuaggugagucucaacgacugggauuucauaccuguuacgcuggcggucagguuccagauagcugggagcugggucccaaggggcacuccccgguagcagcuccccagguccaggcaacagccuugucaucuucagaugggggugaucaggcuuugggaaagcgcuugaaggaagacauuuccgagcaaggaccgguggacuguugugggaugucccggcagaggcaggcaaagucucuggcuaccccgcugcucccuagccuguaucagggagggggagugagugaccgccaggugaugucacagcucuaggaagguaaagccaccugucaaugcaaacagcugguucagguagacuccgaacuugucccaagcauagcugcuucacugauuggagggaaauuggguuggaauuugggguucauaagggaggauggggucugcucggcggggggggggggagggaguggcuuccuccccacgcggucugagccgguuccccuccccaaccccuuugcaucuugcauuuccuucucccuggggcugcucaaaccgcccucaagcuucagcccucaguaaaugaaccgcugcagcugcugcgcuuuuugugcagccuccagaauaaccagaaacagagcgcgauucuuguccuccacagccaggcgucugccuguaaucccagcaacugggaggcugaggcaggaggauugcugcaaguuugaaggcagccccgaacuacaugauaaaucccugccucauaauaaaaacauaaauaagagauaugaacgaguacucugggaguuggggaaccugaccuuggucaccuuagucagggugucucuacagugggugacagagccucucuggagaaccugagcccaaguaagggcaugcgugcugucccaggcucugagcaaaaggggcugaggggaggcagcacaaagaaagggagucuagcagaggcuagaagaggauuucuuuggagagggcgauacgugucuccucaucacuacacggccuuugucuagaacagcgguucucaaccuuccugaugccucagcccuuuaauacagucccucaugcuguggugaaacccccaacgaaaauguuauauuuguugcuacuucauaacuauaauucugcuacucucacgaauuuuaacgcaaauauuugauaugcaggcggccugacaugcuacccccaaagggauugcaccccacagguugagaaccacgggucuagaaucaugccaggaguuccugccucucccugugacccaugaccaaucauuaguguuccugugccucaguuucccgaugugaaacagugguaucucuagcucugugacgucucaaggucugugggaugacggcaggcuacuggacagcuacugucaugaucauuagcaggguggcggcagccaggacacacacaggggacagcucgggggccaucuccgaggaucuggcaugucugagaggaugggcgggagugguggagaggcccucacaguuccugcaguuucuccugcggcugucaggaccacuuccuccuccagcuucagccucugcaugaagugugguccugugaagacuugccauacaggguggaaacucugagcuaguagcggagagugggggauaggagcguccuaaagaucccccgagggugaauauggccacagaggcugcuugagaggaaaugcugucuguguagacauccggguuaccagaccucagacaaggacuugaggagggacagaggggcuugcuuacucuggugcccaaacucagaccuugucaaaccaaccuccgguccauguuggaaggugaguccuuuggucaucacuaccccuccccccauaucccaucaugcucuguugccauuuguuuuccuacuuguuuggcuugcuugugugugugugugugugugugugugugugugagagagagagagagagagagaagggggagggggagagggagauaggaguucacuauauagcccaggcuggccucgaacucauggugauccuccugccucagccacccaaguauuggauuugcaggcaugacauguagcauccagugucuucuggagcugcugugucuaguucuucuaagcccuggguuagcuggguguaugcaacauucauggaacagcguggaggaggcucuugguccaggccugggcugcagagugagacccugucucacggacuacaaacauuucucauggcuuugccugagcagggguguuuagcagcaguggagucccugaccacuauguguggcaguaaaagggaauugagugcccauggggaagacccuauggauagcagagguuccacaagucgggauuagagggagggaacuaaacuagcuaugcaaccuuucaaauauggcuuugcccuucugagccucaguuuauuuagcaauuaagauggguaaauacgacaaccacacuuuaagauuguucuagaaguugaauaaaguguuggagacggucuugggcuggagagauagcucaguggcuauuauacaacucagugggcaggaguagugguccacaucuguaacugcagcgcuguuguggggagauggagaugggagggaggcuccuuggaacucacugcacagccagucuagcugaauuagugaacuucagguuuaaccagacauccugucucaaaaaauaauguggcaugugacugaggagacugcccgacauugaccucuggcuucugcauguguguuacacagacacacaggcacacacagacacagacacacacacaggcacacacacagagacacacauacacucagacacauacagaugcacacagacacacagagacacauagucacacagagacacacagacagacauacacagauacauacacacacacaggcacacacacagagaugcacacaaacauacacacagacaaacacagacacacacacaguuacacacauauauacacucggacacacacauacacuuauacacagaaacacauacacagacauacacucagacacacacagacacauguacauguacauagacacacacacacagaaacacacaaacacacacaccuaucugacucacaaagugaucuugagaauuuucuuccuuccuuucuuuuuuccucaguguuuugagacaggguuucucuguguagcccuggcuguccuuguucugaacucacucuguaaccaggcuggccuggaacccagagaugccucugccuccugaggcugggauuauaggugugugccaccacuuuccagcuucuaaggaauuuucagaguggccaauauggugggcaagauuaacaucugagggguucaggaugucugugguaucagggccucccuuuuuuucuccuuuugaagaaguugugaaguagacccuccugggcuacugcaaagaaaugacacaauuccaguuacagagagguaauucugggaguagucguguggcucagugguagagccccuuccuagacucccccaaggaggggcugggggaguggcucagugguagagcuccugccuagaaucccccagggaggggcuggggguguggcucagugguagagcuccugccuagaaucccccagugaggggcuggggguguggcucagugguagagcuccugccuagaaucccccaaggagggcugggggcguggcucagugguagagcaccugccuagaaucccccagugaggagcugggguguggcucagugguagagcuccugccuagaaucccccagugaggggcugggggguguggcucggggauaggcuuuacucaacuuaggucaggccacagguucuaucccuagcacugaaagaaagaagaaagaaaaaaaagaaugaaagggagagagagagagagagagagagagagagagagagagagagagagagagagagaagcugacauagcuacaacccugaagcacaauucagaggucaccguaagacagcacggccccugggcuucagcuuggggugcuuugcuugcgugcaggccuggggcagagcguggagucuaaguagguggugugauuggcuuccagaaacaaaaauaagcuggugggaugugugaggagucaggugcuuagccgccugcagggccuccauggcuccgcacuuccuccucugcaggagcugggugugggugcgugcgagggcagaggaggcaagcggcgccuugccucccguggucuguguuauguguuccugucucgguugacuucccugcacugagaugcaauaggaagcuccaagcagccaguugcuggagccaagcaugaccugaaagaaacacucccaggagggaggaugcugguaggcacugaguaccacagcgggcagucccuccgccugucuaccugguugcuugccuacaguuccagguugcuguggucagcaugcuggcuccugacuguuagaacuguaucuuagaccauguucacacucuagaaaccagggucugggagacacuggggcggcgucuuccccagaagacagccccugggugcacacgaugcuccugcaaggaacccuaugguuugggaggagggucuggguggcucugugaggggacagggugggucuugugaucauaaaaggcaggaggagcagccucugccuuccgugaaggaaccucccuagccuugaaggguagauaccuccuuauauaugccuggcuucucugggcucagagcagggguggaguccuauggaaaugcacguccauacucaauucuggaaugaggagauggcucaguggguagaacguuaccacauaagcauggauaagggauucauaaguuugaaucccgaacacccauaugaaagacugagguggcagcucugugggccugaugaccagccaggcugguuggacuuuuaagcucuggguucaguuagagacucuuuuuccaaaagucagguggauagcgauagacuugacaucagccucugcucuccugcccccaacacacacacacacacacacgcacacgcacacacacaccgcacaccgcacacacacacacacauaaaugcauacauguccacaccccuuuauacuugauuuggguuguaguguguguagaugagaucauucugacuccaguucacaggaaaacuguguuuugucugagagacagucaugugugcucagagcagugacugggccccauguguccuccacagggggucagcaggcuuuuuucugcucaccuugcugagaaguuucagaagaggcagaauuaagccucguggucucucaguccagccuccaucuucugggagcccugagcggguacucucuaagccugagagaagguucuacaagagaccguggcuguccccugggagauucauggcccggaaaaggaaaucaaaggaguggccagcggccaaacacacggcauggugcagugcaaaccaccccaggaguucagcuucgggccccgggcccugaaggaugcccugaucuccugugaccuggcccugaagcagauguauaccucagccuuuuccccgucggagagacucuuccugucugaggccuacaacccuaaccggacucucuucagcacacugcucauucacucagccuaugacuggcuccugagccgcccugaagccccugaggauuucgagaccuuccaugcuucuuugcagcuccggaagcagagccuggcccggaaacacauuuaccugcagcccauagguaggagagaugggcuggagucaucuggacuccuggggguguggcucagugguagagccccugccuagaaucccccagugaggggcuggggcguggcuuagagguagagccccugccuauaaucccccagugaugggcuggggugugggucagugguagagccccugccuagaaucccccuagugaggggcuggcucagugguagagcaccugccuagaaucccccagugaggggcuggggcauggcucagugguagagcaccugcccagaucccccagugaggggcuggggcauggcuuagagguagagccccugccuagaaucucccagugaggggcuggggugugacucagugguagagcaucugcccagaucccccuaguaagaaacagccccaggcagauuuggcuugaaggagauggucugggucagcuagguacucagauuggcagagugacuugucuuuuuagcauccugcccccuacuggucuauacugguuauauagugugugcucucauuccuggccaugaccuaguuauaacacacacugcccuagaccugugcuugaugcucagaggaauacucauuuuacaggcuggaaagcugagguuggaaguaucuaggguuugccugaugguagagauggauucuggaggagguuugaaggcaaaucuuaacuggccuccugcucucuuggaagacacugggcugggcauugaggggacuuggggauucacagugagucucucuaggucucuucaucaggaagagacuggcagauuuggagcaacaagggcuuagaaaauggcucagccagagaugcuagggagggaggagggagaaucuggucccuguauucucaguauaccacaguuaggagggccauaccuggcagagggccacacuuauggauguuagcuucagaaugguggguggaggguauggcuccugagacagugacauacccugcuuuucauggcccuuugaaugguaccucaguggccagucugggguuuucuuucuuucuuucuuucuuucuuucuuucuuucuuucuuucuuucuuucuuucuuucuuucucccuuucuucuucuucuucuucuucuucuucuucuucuucuucuucuucuucuucuucuucuucuucuucuucuucuucuccuccuccuccuccuccuccuccuccuccuccuccuccuccuccuccucuuccuccuccucucuucuuccuucuucuucuuaaaauuuauuuauuuuauguauuugaguccacugucguucucuucagacacaucagaagagagcaucagaucccauuacagaugguugugagccacccugugguugcugggaauugaacucaagaccccagugcuuuuaaccgcuaagccaucucuucagcccagccuggguuuucugcagcagcuacuuacugcuguuaggaucaggguucuacugugccuccugcugcccagcaccccacagccuugcuccugugugcuuuagagucagucacucuauccacgucauuggcugggucuugguaggaggaccagguuggaccuagaaucugucuucuccccucccucuuuccaucccucccuuccccucuucuuuccauccuuuuuaaaauuuuuaauauguguauuuguaucuguguguacucuugugcaugugagugccuaugcccuuagagacgagaguugucuucucuggagucacacgcaguuguaagcugcccaacaugggugcugggacuugaacuuguguucuguacacgagugaguggucugugcucggaacuguugugcgucucuccagcccucuuaguauuuuuuuuuuuuuuugauaugggggauuucaugcagucugggcuggcccugaacucauuauuuagccaaagaugaccuuaaacucccgcccaccuccaccuccuggguccugggaugauaggugugcaccaccaugcccagguuuacagugaggggguagauccuggccaugugcaugcucuguaaacguucuaccaacgcagccgcauccccagcccccaagccuggauuucuaacagcuuuggagaccaugcaaccacagaccccuuguugccauccuagaucuguacccuguccaaguagcacaggauaagcuugugccccucccucugguggcuguucccugucgcagauuuccugacuuaccacugucaaccgaugccucuguccuagcccagcuguguuucucuugguauagugccggcuagcuucugccuaugccagcuggccaagcuuacaugccuuugucuaccuagaguuaccacacggggcugccugcccuguaaggaaacuggcuuguuucacccaaggggccagcauggauuugcccacugggcaggaggccacaucaggcugaugggcucuuguguugcuagaucugagcgaggggcuggcgggaugcccccugcuggaccaccuucggagcugcgccgaggcuuucuuccugggccuucgcgucaaaugccugcccucaguggcugccgccuccauuaacugcugcucaagacccagucgggauacugaugggcuucaacuucacacagguaagcgaggcgggcuguggggcagccuggggcuccgcugugcagcagaagacccuuccagaaggaaaaguugagaagaaggagcccugggaaaggggaggaacauuuccaauguuuguuaucuaugcaggcguguguguguguguguguguguguguaugugugugugugcagggccagaggacaaccuuggauaucaguccucaguagcuguccacuuuauuuuauuaagacaggcucucucacugguuuggaccuugccaaguuggcuaagcugauuggccagugagccccagagaugcagcuggcucuaccuccccagcucugggauuaaaaucacaaacuacugcgacugauuuauauaauuaagacuuuaaaagauuguucacuuucuucuacgugugugaguguuugucuguguguaugcaugccuggugccuguagaguucagaagagggucuuggaucccuuggaacuggaguuccugacuggugugagcugccauggaggugcugggaacagaaccuggguccuccgcaaaggcagccggcacucuuaaaugcugagccaucuccuaucaccucuccuagcuuuaaagcuaaugaucauguuuacccacgugcauauuaauaugcuucuguugauguauguggaucaaugcgugcggggccacaggcuggagggcguuguaggcucuggaacuggaguuacaggagguugugagacuccacgaggguggcgggacugagccacacccucugcuccucuccaccuuugugggcuuuuuauuaagacaggagcccauguagcccaggcuggcuuucuccuugugauccuccugccucagcuccuggcuugagugcugagauuaacagugcccagaaacuuacuaguuuugaucauuaguccaaggcuuuuuuuggaagacauuuccaggugaucuugguccugggauaguuuuccuucagaaggguuuucucuuccccuuacacagccacgugugaugaaggcaugauucuauucugggcuguucugugacccuuggggagcaaucugaaccccguggcagcaggcagaguagggaccugucucuagggucuguguccugccuuaggagcagcccagcuucucugcacuguggccggucuucucguggcucugcuuucucagcagguaucugguuuagauauaauucauugaggucagcugaaggaguacagagcucuuagccuaauuacuuggaggcuaaggcaggaggauuuaaaguuuuagguuugccugcacuacaaaguaaguuugagaccagcuuaggcuacauauggagacccuguuuuaaaaaguaaaaagagggcguggcucagugguagagccccugccuagaauccuccagugagggcuggggcguggcucagugguagagccccugccuagaaucccucagugaggggcuggggcguggcucagugguagagaacaucuguauaggauauucagagcccugaaaacacugaaaaaaaugucuguaggguaguuuuguuuacaucaaauauuuuaucaaaaucaguuuacuucuuuuuuuguuuuacaguuuugagacuuuuauuuuuuacuuauucauuuccuuauucaauuuugagacugggugucaguagguagcccuggauguccuagagcucacagaggucugccugcugucugccuucagagagcugggauuaaaggccuaugccaccagacuggccauuuuuuauuuaugguucuuuuuuguuuguuuguuuuuguuuuuuguuuuuaguuuuuuuuuuuuuuuuuuugagacaggguuucucuguguagcucugacuguucuggaacucacucuguagaccaggcuggccucgaacucaggaauccgccugccucugccuccugagugcugggauuaaaggcgugcgcaaccacugccuggcuaauuuuuauauuuuuauauuauuuuauaaaaaaaguguuuggacuuuuauauaugugcccuuccuuccuuccauccuuccuuccuucccucccucccuccuuucucucucucucccucucuuccuucuuucuuucuuucuuucuuucuuucuuucuuucuauguauggaugcucugucgcauguacaccugcacaccagaagagggcaucagaucccuuuguagaugguugugagucauuauguaggcauugaacucaggaccucuggaagagcagccagugcucuuuaggacggagccaucucaccagcccuuucuaaaacguagggacagugguacaccccacauuucuguaaccagcaaccacaucaccugcacuuuggacugugaacacguccuccugacaaccccuccaucccucacucugccucugucuucccaacuaggauggucucaagcuggucacauagcccugugcucuuacccucucugucucccugugucucaguccucucccacacuugacagcucucccuuacccaccacucccuguaucauccccgaguuccauccuccgagugggaugcagcugggacauucuccccagagaugccugcccuuagcgguacucgcaaguccuuggccccccucuccuucacuggccugccucuguuccagugcgcucuuuccccucuguacugugucacaaccgcggagaggcuccacuccaugcuuuguuagcagcgccuagcagacccagacgcagcugcuucccucucucgugcuguucuccaucuugaucuucaccaaggcgcuccuagucccauugccuuccuucucugccucuguccacagcagacuuccuugggcagcucuuuugucucguguccuuuccuccucuguggucacuccccuggcuuuccagggccccacuggccacccaggucucccucuucucccuccuucuucccugaguagcucagguuccuuguucugaccuugacucucugggcgaugcagagccacgauccucuucacccacagucacagcugagggaccucucacugggccuaggggucuggguguggguauuuuuuggguaacuauucaggugccuguucuuuccugggcucuuuuugccauguguguguguguaugugcaugugugugucuuccagugugagagaguaugugugugugugugugugugaaugugugugaguaugcaugagagucuaugacuguguuaauaugugugugaaugugugugugaggcuaugugaaugugugugugcgaaugugugaauuugagaguguaugagugugcgugaauaugugugugugagagaguguguaugugugugagagaguacaugagugugagaauauguguauaugagagaguguaugugugaguguguauauguauguguguaagagaguacgugugugugagagaguacuuguggggguggcaggggggaugucauaggucuggucuuccucauucacugauaucccuuuugguuuucuugaagcaggucccucacugcuaugggacucacuaaucugcccuggcugaccagugagcuccagggaucuagugguuucugccuucccagugcuggaauuacaagccccugggacuggcuuucuuaccugggucauggggauuagacucgggcucugugucuguauggcaaacacuacacucaccucagcccucgacugccccuucggccuccucauauggaaggugagggccuuguuauagccagaucggcucucauggcucaggagacagagacccaggacgugacuggcccuagggauccauggccucacucucaggccagguccaugcuccuuggucaucuccucuuuagcugaucuggguuccgggucucaccacagauguggcuugcugcauccagcuuugagaggggcuggucccagaccaagggauggaaugggaggcucaucugcuugcccuaccuucuuccugcagauggcaucuuguccuucuugaagaacaacaagccaggggaugccuugugcgugcugggccucacgcuggcugaccuguacccccaugaugccuggaccuucaccuucggcagauuucuuccggggcacggugagcugagguccuagcaacuguugccuaggaggcagaaugauguggucuuagcacaccagugcaggacaugcauauauguucucuccuggggguggggguggggguaggggugggguggggguggggguaggggugggguggggugugugcacaagcuugaggcuauguucucacgggcccugggcaaggggcugguccccagagucaacugcauauggcagggccaggggaccacuuccucuucuggcuguccugggcugcaggaagugcuggggugguuucacccuagauuccugagccauggcuguccuuuggacuacuucuucuggcuucuccccagaaguggguguguguagcuucgcucgcuucucuggagaguucuugcaggccggguccaguguuccugacucagcucugcuggaggcagcagcagcagguggccccgagacgcugccucgugagcgaggacggacccugugcuucagcgcccugggcaugguucagugcugcaaggugagcacaggagacaggaaggcucagaggccccuugcguagucagugcuaaaaggggucccuaacuuuaaagagugagcgauccaagacuaaaagaccccacggcucaagaccacaaagagaugacccaaaggguucuggggucuggcccugggucuggcuggcuucuaagccuccucaugcuguguggccucuuagagccacuacggaggacguaguaagggggaugcuuggaucacugccuagggauccguuguuacccaggguguuggacuucuuccaggguugcccaguggcuuggggaucccuaggugggaguuccaggaugcugagacugaggcgaggcuugguaccuugucccccuuaggucaccugccaugagcucugccaccuccugggccuggggagcugucgcuggcuccgcugccuccugcagggggcgcuuagccuggaugaggugcuccgucggccccuggaccucugucccaucugcuugaggaaguugcaucaccuccugggcuucaggcuccuggagagguacaaggugaggcggggaagccacacagaggaagugagaggggacagaguguguguguguauagagagagacagagagauagagauagagacagagagaacaccaaaugacaugcaugcaccaucauuccagaggguagggugggcugcgggucuuucuggcagauggaacacucaggcugguggcaguagcaguggcaucaggcugcucuguguggaauagugcaggagagcaccccuccccuccauaagugcuauauuuacagagcauugguaaggcuccuucucuacauguccauguccucuuuccuccccucggcuccgugguggacacgggagauccuguacccagagguagugcagcuccuaggacaaaggggaaguugguguccagaggggcagccagccacagagccucucuuggcugagcugaagaggaggugcugcccucugcugucagcaugaaguguugcuacaaguaaccuccagccuuuaucucuguaggaaggcucguuugcaaaccaugacauaggcucaggguuugaggucagauacaaaugcugcuuauuuuucucgaaauccaccuuagguugaaaucaagcuaaagguuucagugcauggagggcauaucccuguguguguaaaaaucagcuguuuccagugccuaggcucaacuuacuuacuugugggaagccucucuccccacaggcauuuucuucuuugauuuugugguguugguucaaccuuuaaucccagcacuccaguggcagagccaggcaucucagugaguuugaggccagcauggucuacauagugaguuccaggacagccagaacuacauaggaagacccuguuuugaaacuaacaaacaaaaacaaaacaaaaucaacaaaccagaaagaaaaacggcaaagcuuuuuauuuuuauuuguaugaguguuugccuacauguauguggaccaugugugugucugguguccauggaggucagaagagggucaggucccuugagacuggagucacagaugguugucagguaccaugugguugcugggaauugaaccugcguccucuggaagagcagacagugcucuuaacuggugaaccaucucuccugcucccucucaguuuuauaagguuuguuauucauccaucuguuugugugugcaggugccauggugugcauauggagcugagaggauguaagucaccaggaguuagguuggcacccugggguggccagguccuucuggggguagggcaugggaauuagcagggcucuagcugcugcaggagguggggucagcucauugucacuaggacagucccugaggaucugacagggggcgcagagcuaagugagaccuagccucaaagcuauaucuugucacacaauauauagcacaucugggcaugugcugugucacacaagggcauccaucuggggaugugcuuugggaagcucaugucacaggacagcugaugguagguggcauuuaggggcagaaaaugugauuuaaaaacauuugauuuagccgggcgugguggcgcacgccuuuaaucccagcacucgggaggcagaggcaggcggauuucugaguucaaggccagccuggucuacagagugaguuccaggacagccagggcuauacagagaaacccugucucgaaaacccaaaaaaaaaaaaaaaaaaaaaaaaaaacauuugauuuaaaaacauuuuacuucagaguuggagggaugacuuaagaauaguuugguuucaguacccaugucugguagcucacaacugccaguuaacuccugguuugcaggaucugacgcccucuucuggccauuguggguacuacauguacaggauauauauauuacccaguggaaacaaaguuugaacuguaggggcugggaagauaucuuaguggguaugaggaugugaauuugguuuccuggcagcuaauaaaaaguuggguguggggcaggcauaagcaacccucaugcuggggacaguagggucuaagaagcucucuagccagucagucuaaccauggugagcucucggcucagugagagacugucucagaaaacaaggugugagccgggcgugguggcgcacaccuuuaaucccagcacucgggaggcugaggcagucggauuucugaguucaaggccggccuggucuacagagugaguuccaggacagcuaggacagucagggcuauacagagaaacccugccucgaaaaaaaaaaaaacaacaaaaaaacgaggcaugaaaugaggaugcgugguauugaucucuggccuccacaugcacguguguguacccuacacauguacguguguguacaugcgcacacacacaaacacauaaaaguucagauuaacuguaaucgucauguacuuuaacucugagcaguggcuggguuaacagccaucuugccaaguacgugugaaaggugggcuucugggaguuggaaaguccaguucggcuguggccuggacuccaguccucagacccaccuccagggaccucauggcuccagcuccaugccggcuccuggggugguccucagugacuccaucgccaaccuuagccuauauuucuucccgcagagacuccaugcuuggacucgggugaugguggagauauggucuggucaagaggcuggggagccaucugugucggaggacaccuuacccuucagugcugacucaggcaugggcugugagagugacacggagccugucaccagcccgucagagccugucaccccugauggguggagucaucccuucccugacggaccugaaccaguaucugaggaugggcugggcucucucauggccucagaagugucgcugacccucggggggccgguggacgccauggaggaguauggacaguggcugacugcgugcauccagacccuggagagggagggagcugaagaggagcugcuccagguggaugcggcuguggaugcccugagccggugggagauguucacagggcagcucccggugaccaagcagcacgugcccuguggcaaggauaaugugggacugcgcaggguccugggagacaaguucucuucccugaggcgccggcugagcucacgaagauuugccaaggccaguucuucccacugccgcuggggggcagagaauuaaccuggcaagauggaccagccaaugccgagaagucagcuccuggcauuauuuuuuuuuuccucugaggauacucaccaaccaggggugcccagugacugaggguccucugguaucugcaggguuaaaacaaagguuccccagaagcuaaagaaaugcucuuugggugcuugcccacaggguucccauguuguguggccugcagaggacgcugagaggcaggagguugcuacaugguuaauuguacccugcaggagggggcucugggccacccugcagcaugggcuauguggcuguguaugucuguuucuaucucugugugucugugcacgugagugcaguugcccacagaggccagaagagggcagcagaggccauuacaggaaguuguaagccaccuuacauguggcuuguuugcaauugaacucagguccucugcaagugcagcccacaucuuuaaugucugagccaucucucuggcaccaacauuugauguugaccuguguugcuaacacgggguucuucuccauggcuagaaugccuuucugcucaccagggcuggcacaggugccauugagaagauccugaggacauuugugcccugugaagcuggcagacgugggggugauggggcuggcuguggaagacagaggccacuucucuaacccuggggcugcugcugccaccaguuaggccaguguggugguuggggcugagcucuuuugucuuugaugacauuuuuccugucucuggcuauaucaauuccugacauaggauguuaaaauuauacauccacagcugugcuguguucuaccuuuguuucugugucauguauuguugaagcucuuacacacacacacacacacacacacacacacagauuguuuuccugaagugacucucauuguucucaaacgccagcaacgccagucuccugguccugaggcaggaggagggcgggcugugggcgcucuccauuguggacagaggcaguaagggacagaggcaugugcaucguuaggugagugacuguguucccuuuucaaugcugugaaaaacacccaagcaaaucaauuucaaggagggaagagugguuuuggcucaggcuuccaggguuucacuauggucaggguccauggcuuuuaggcugugguaaggaugagguagagcaucaugcuaggaacggugcccguggagcagaggccgugaagcaaagugggaggggccagugaacuaucuauccuguaagggaaaauucccacugcuuccuuccgguuaggcuccccuccugguucuuaccgcuaccccaccuccucguuuuuuuauuuuuuuauuuuuuaauuauuauuuuuuuaauuucuguuuuucuuuugagcuaaagugucaguagcccagguuggucucuuguguagccaaagaugaccuuggagugucuugucugcuuagcuucgugcugcugagucuccugugcccccuguguugcuaggacggccagcauguguuuccuuuucuggcuuuauuggcagggcagcagagccuggaccaugccucuucaggugcccugauguccccuccucuccccagagcccagacuccugucagaggagaaggcaggccagcauuuugugacacagacuguuggggacagaagauuugaguuucaccucaugaccaggaaggagaugcuccugggacagagaccuuuguggauggacagacccuccaauguuaaaagcacagacaugcagugguuuagcuggggagccagggguaaagcuaaaguucaaacuucgaucccgcugagguugaaggggaugcuagaacauucuagggauguguccacauacagaaggucugugagcagugcuaaggugagccacucuggauccaacaggcagagacagccagguucuagagggacagacagcucuacccaagccugccaggaaggucaagaaagguuugaaaagcaacgugugugugugucuggugugugucuguguguguaccugugugugcccacauguacagguuugaggccccccuuagauguuugauuuuuuuuuguuucgaugagaucaggucucucuacauagcccuagcucucccagaacucacuaguagacuaguuugaucuugaacucagagaucuaccugccucugucuccccauugcugaaauuaaaggugugugucaccaugccuggcuucaucaacuauuuuuaaaaacuuaaaaaaaauuauuuauaugaguacacuguggcugucuucagacacaccagaagagggcauuggaucccacuacaaaugguugugagccaccaugugggugcugggacuugaaccugggaccucuggaagagcaaccagugcucuuaacugcugagucaucuguccagccccuaaaaauaauauuuuuauuggguuuuugaguauguccaucuugcuuuuugagacagagucucuuacuagcuuggagcuugccacguaggcuugacugacuggcuggcuggugagccuuucccuucuuagggaguugccugucuucaccuuuucaaaacugggguuaugggcaugugcuacugugucuaguaauuuuuuuuuuuucaagauggguuucucuauguagcccuggcugucucagaagucacucuguagacuagucuggcuuugaacucagagagauccccuugccucugccuccugaaugcugggauuaaaggcgugcgcuacuaccaccugaacaagcuuuacuuauuuuacguguauuuugcuaagugcaaagauaugugcagcacaggcacgccugugccaugaaaacccuggcacuggagucacacaggugagcugccauguagguacugggaauuaaaccugggcccucuaggggagcagucaaugcccuuagucacugagccaucuuuccagucccuauacacagcuuuuuaacuuggauuuggggaucaaacucaggucccaaacaacuuuacuggcugaggagguaucacucuaucuucuugcuggacaucuugaucagccucccaugagccgagacuauagcugucccucaccaugcccugcuaaacuuaagucucuaagugcaggggaaugugucgugucugcuagcucacuucuuauuaaaaucuuagugugugugagagaugcaggcuagugaaguacauguguguuguggcaugugcguggauuucagaagcgaacuuuuggaagugaguucaccuguggguucuggggauugaacucaggucaugaggcuuguauggcaagcacguuuaucgguucagccaucuugccagucgcacaccaggacccccaccuuugcucaccguguucucucaacuuugcaggaaaauaggcagaauaaggggaugaugcacaggcgguggggaccugcacccucacucuugggcagcccccagucagcucuguugaagcuucuggaagcuuccacacacuuaccucuccccagggugggaagcuggagguacacucaggugcaaacacauagguagaacaaagccaggccagugagaggguucaauggguaaaagugcuuucuaugugaaccugaccaccugagugugauacuccugaaccaagguugccgucuggccuccacauaggccguggcacauuugcacacacaggcaauaguaaaguaaaacuaacaaaacaaagacccccgaggaaucaaucgcuccgcagccugaagcagggagcuuguaaccugccaacuaucacagggaacacggcaugcuggguggggcugaacccacagugaccccuagacguuucuuggaaauugccuuuuaaaacaagccucuugacuuaaagcuuguuuucauuugccucuuacccaagaagcugagcucaaaaauaaaccugaguuauuuuaggcuccagccggcaaugagaggugaugcuagggagggcugagccggggaagggcugcagccaccguccacugguccucugcauuucuuguagcagauuucagaaggugggcucuugggcuggggauguggcucggucgucagagugccugccuagccuacaggaagcccucaauaaucccagcaccaaggaaacugaggcaagaauggcuggaaucauauucaucaaagaaauaaagcaaaucuauugcuggugagaaggugccaagguggcaggugggaacaacacccuuuacucugcccaccagcaccagggcuagaaaaggaagccccuaaccaccacacugcuuggcauugcucauggugcugcugacacaggcuggagccuguauucuuuuuuucccccaacaaaccacuuggugugacaaaagccuccacuacaaccaacucaugcagcacuuggcugguucuuggugucucugugaaacaaguaacuccuuuguuauuuagcuuguguguguguguguguguguguguguguaugugccuaagcagaggccagaggauggacauagcacccugccugaucacucucuuugcccauuuuuuuuuguggcagaguuucucacuaggaguuacacagguggccagcaagcacuagugacuuuccucucuguccuccacagugcuaguuacaaggcuaugcaacuugacauuuuauaugggugccggagauuugaacuuggguccuaauguuugugcaguaaggguugcuguuacauacuccaugucccuggccucuugugugugcuuauuguugagacagaguccugugcaucucaggcuggcuuugaaugcucuuucuguuucugccuccuaagaccacugugccuggguaagggugcauuuuaauguauguacacagaucaugugauuuggagacuuucaucgaaaaagacauuugugauggcucucugacgugccaggcucagguauguggaguuaaaauuugcaaugaacaggugaaucuucaaacugaaggaggcugugcuuuugggauggaaaaugagcaagugaauguuggcuuugagugguaaaccugaauuuuguuuuguuuuuuguaaagauuuauguaugugaguaccagcagcugucuucggacacacaucccuuuacagauggcugugagccaccaugagguugcugggaauugaacucaggaucuuuggaagagccauccguacucuacucuuaacugcugagccaucucuccagcuccugaguuuuauauuaagcaaaggaaaaccaagaacucacaccaacaucuagagguguaaagcucaaaucuucaagccagccccacccaaucagugacaacaugguguuaaguggggagcagguagcccugggcuacugcucuggugaaacccuaacaaaccgaagugguuccagagcccugagcuggccagucacaacccaucagcuuggccggacagugcuauuucugugugugugugugugugugugugugaaggcuuccuugaggcuguccucaggcucugcacacuguguuuacuuagacggcaaggugucuuacugggggccugcccucugcaugcaccacacccggauuuuuauggauuuugauguggguccugggagucaaaccccgggccucaugcuuguaugcaaagcauguuucugaccgagggaucuccucagauuuuuuuguuauuauuuuuuuaucuucucaaaguagggaaaucagaggacuagaaauccuagugaccugugacaucacagagcgggucaggaacugugaaauaauccuagugaccugugacaucacagagcgggucagaaacugugaaauaauccuagugaccugugacaucacagagcgggucaggaacugugaaauaaucucuguacagaggagagaagagugcauuucacaacgccccaccccgugcccacucucuaacaugcuaggcaugaagcagacugguuuuuaucacauuuauuguuacauuuauuuaauuuuuuuugcaguaauagaugaggcacaaacaccuccugcuucuccaucacugcaacagaaaggacaauagucaaggguaacagugaaauuaaaauuaaaaaaaaaaauacaaacgccuaaggucugggagaaaccugacuacaaucuacguggagaaacuuguaaaugacuccagccuggucuuccgauugcaccacuucacagaccacagaggaggggugucccagcagaaaggacacagccaggcucagcucgccaggguggugggccucugcccauccaccugcguucugcucagcuagcucaaguucacaucuugcuacucacaugcugccuucugguuuucaaagugacugguacaaacggucagucugucagagggacagcgcucuccuggcaaccccacacucaccuuggucacaguggcccccagcagcggcugggaacagguugugucuguuuggggucucagcacugacagauccacagggcaccuggugagggagcccugaaagguugcuggccgcugguccuaaccuggccacauccccucggcuugugaagacuuggugaggcaggcagaacggcugcucucucuccacaggaaagagccagaagcccagcaagcacugauacacaccacugagcacagagagcaagaacaagugagcgagaggcugacggcuauuucccagucagagcacugcaauaacgagggcucuaagaagcggucccacccugucuccuggccuagcaucuacuccacaaauccuacaugucugguggcugaaaugagccaagaccaggaugcaacagggaucaagugucaggagcaguuugguugcagacagggcccuuagagguguuagugagccaaagaacacucgggggaaguugugagccacaccccagcucccagaaagucacuaauguacagaggggcaggucuggaaugcaauauacuguaaaacagugcgacgccugccaguaggcuggccagggcuuagcagguugugcugaugucccggccuucugcacccucauggaccagggcuagcagggugccggcuggcuuugcgugcacagcgacuauguggccugccagcuacccugagaucagagcgcacugugugaaggcaauggugaggguggugugcagagcccagggcugcuccugaaggcugcuggcuggggcccaccaagcagucgaggcaagaagaugcucuugagcugcagagcaucucugguccaccuucagagcccagcacaggggaugcuacaugccaccaacugucaaguaaggcaaccuacaaggccacuugguuaugugucucugccaugggcuguggagggacgggugaaggaguagagagcaccacuacguguacacaggcuagccagagcugcacggggccaccuuugcacacuguggcccgaugggcauggagacacggugagugucuccugggcacuaaagcagguuccuucucuaccguggggaguguggacaccugaccccgccugcgccuuugcgagacucggagggugcuggcacgaugcuaaggcuguguguucacucugggagguggcacugaggccugggcuuggacacggugagcuuagcagcaucgcaugcucuuuacagccuagugugaggccaagcucccgaguuagugugacucagugagaaccugcacggcagaggggagagccggcugcaaggccagcugggguuggguuucugucauuaaugagagcacgcgugugucugcguacaccugaaccuugguuaacugugucaacaaggaagaguuucuguagagaggcgaaagcuguguccccagguuuuacagaucaacagcagagugaugguguggauucaguagucucacaguccccgauucaguagcuaucacugacacucccgcguccucuugcccggagcucgcugguguggcugguaguccagcacucuugagccagguauuagaugguguggauucgagaugcccacugcagguccaugcaggcggcagacacaccagaaccacgugggcggccacagccccagaggccgagaggacagcagagggaggggcugucucucacugcagcaugaugucuuucagguucuccugcaggaucguguccuucacagcaugaaacacgaagcggauguucucggugucuauggcgguggugaagugguggaacaggggcuugcugcgguuccugcgcuuccugucgaagcacugcaccagguagcgcuggacguccuccagccggugcgggucgcccuugaaaucugggaagugcuucuuaaugcucacagacuucaccuucuccaccaggagguccaucuuguugaggaagaggaugauggagacguugaagaagagcuuguuguugacgauggucucgaagauguucauggacuccaccagccgguuggugcgccuguccuccaugaggaccuggucauacucgcucgaggacaccaugaacaggauagaugugaugccgucgaagcacuggaaccacuucuggcgcugugaccucuggccgcccacauccaccaucuuaaaugggauuuucuuuauaacgaagucauguuccacgauucccuugguggccuuucuagccagcaggaugucuugcuuacuggggaaguaguucuggaaaacaugaggaagggagacauuugagaaggaaggaaaccaggaaggaugagcacagggaagcuggcagagagacagacugcagggcaaagacacagggacccgugcaagaacauuuaaccaaaagcaaaaagcgagucucacugacagaacuuuaaauccaucuugcaacaaaauagcaggacugaacaccucauuucuuaaugaauacaagcuugagacaggauggucagaaccuucagcugggucucauguaaaaucucauccagucuucuucacuagaagaaauuaaaaauccucuucauuuguuucuguaucau

SEQ ID NO: 2776 - RNA, 1404 nt, Mus musculus
ggcaguuucugcucucugugccuucucuucugacaggugaacuuggcagucuaccagggcagccuggaaccaagaaaggugaugucgucagugucguuaaaugcucugucuccuccuguccccauccauaacugugacuuggcuuuuuguuuuuuuuguuuuuaaaggagagucuauagcuacuccaauucccaaaaaagcacaaagguguaagaugcuaggucagggucagccucugcggaccuggagcaguggugucugccagaggcucuccucccuccccagacauagcagagaguagaggggccccucccccucccagggaggcggcaggagauucccucccggggugaugugccuuuucuuuuggucuuacaagggcaggaaagugaggucagaugucagugcugcccugugccugucugcuuuugauuguuugcuauuuggggggaagguguggucucacacuacaccccaggcccuggaacucacuauauagcccaggcuggucucagacucaaaguagucccccugccucaacuuccugugaguuggaauuacagguacugcugugcuaggcuccauucucagcucuauagaauaaaaaguugagguccucaaaucugcauucuaaagaacagagccuaacaguggagcccaagggcguggcuguggcuucugcaugacuauggcuuuaggugcagggguuuuggaguaggaaaucuggauaauguugggguaccagguuaauccagccggauaagagggacuacagguagcugccuucaggccugugugguuaugucugguagaguauaucugcagggugccuguagcuaaaucugcugagguucccuguuucugcuguucaaggauagcuaaucacauaauugggguuugaggggcgcccacuguuagcucuggcugcuguuggcaccugugcccuggagcauccgaggagccaaacaguaugaggcaggguuaggcugcgugugcuggacuuuaaacuaugaauuuucuggacccuaauaacaugggaccccagccuguggccuaguucagugacugcuucacugggagacuaaaacuggccuucacaggaaccgacugugggaagcacacggggcugauugggagccgggguuuccuggaaccaaagaguguggcuguugugcuggugaccuuggcuuugugcucuggguuuggagcucagcucccucugcugaggccucucuagggagcuggggucucacagacaguggaguucacgucucccuaaagcauagguuuccucacuuggaaacuugguuagaaaaaggccgcuccuggggucuggggcugugccuuccaucaguggucuugccaggcugugcaaauuuggugagccuuccucucuugggacag

SEQ ID NO: 2777 - RNA, 67225 nt, Mus musculus
uagauccagcgagaggaacuugaaagggggguuguguaauguaccuuuuccaaucccgggcuguauauggagauuugggauucuuuaaaccggcgcuaccuggauuuuauuaaaaagcggggagcucggcgggaggaaagcuggcuuuuccgggggcugcgggagcggggccgcgggagggcggaggaguuggcgcgccgcgcgcccggcccggggagcgguuuucuaccaaaaaaaggaaaggcgggcaaaaagugugaggcggcugcggguggcggaggggagcggcggccgagggauggcgggcaguacgggcgccuagccgcgccaggaaccgcggcgguugccggagucgccgucggagccuggagcccggagccccgccgcgccagguacgcuccgggccccgaugcuccccgaacuugugcagcguaccccuuggguccgcaaagcagaagguccccgaaacagucgggguccccagaagggaagcggagggcagggaucagggggagaggacgcaucgcugcgccuuggacucccacccgagcucucagucugcagcaccgccgagggcggcgguucccuacuugguucccggcaggcggcgggcuagcccggggacgccgagacgguuucgauuauaggcuguuuuuaauuaaaagccggaauucagccauuuuagcugcauuuaagaggggaaaaguagagaaggacgcaguggaaccccgcagauagccacgccagcuucucgaccauggcaaaggcugcuccguagggcuucaccccgacuuccuuaaaguggggcgccugggcucugccuuuuucaaaacgcugccuuuaaugaauauuaucuuuaaguguaugcgggaagcuccuggcgccuuugagacaaguaucccgggcugugacgauccuagauuuuuucaaaaguaaacgcgauucugguaaccagagccugauaaagagcgagggcgggcgagaggaagaggggguguuguaaccaaagccacguuaaaauaggcguccuuagcaaaguugggggaagaggacuuuugggucugggcguagggcggcuggucacccgggagcuguggcuuagucuccgucugcuagagcgccccgguucucccggaaccagggggucuagaguagccuggggcugguagucagggagggaagggugggcucucugagaccucccuacccccucgggaacaggaaagcgacagaucuuuuaaacaaacagcuuaaauaggacuuacaggaggguuuacccgaugcuggggaggcgccccuccgcuggcccgcgcuguuaaguuauuuuuuuuccuuuguagguuauuuugggggugugugggucacaaagcuaggguagaauugagaucuuuggagaccccuucuuucuucucugaugauccccaaauccuccacaccaagccacguucuccgggcaucgguauucccaggcccgggcguuggaaaaugaaaccaaaucuuguuuugaaggagucuuuuuccaguucacgggcgagaaugccacgucucggggacucggauucugcgacucccaauggcccaacgggggcagcaggaggggggcggugaucuuccuuuaaaaauaaacccguuucguaucugaccuugguaaacaacaacaaaaagccccuaaaccgaacaccccuuuuauuauuauuauuauuauucgcggcucacaaggagaaaaaaaaaagggagacgagggcccuaaaaagguuaaacauuaaacuuugcgaaucagauaguugguauggcguuauggacacauuucaaccaacucaaaagcauucgaaguuuuaaaccuccagagcuugugacgccugaaaaauaaacuacggguuuggauuuagcugaacgggcgcggucuguugaguggccuuccccaguuagggagaacuucguaggcaagagacggggcugggacacagcgagccgggccgcuucccugagccacgucccugggaacccugaacugcuggaggaaggacccuagguuuucgcauuucgaggagagggggcggcuacucccgauuuuauuucuggccaccagcucgguucgcuacucuccuacccugaagggcgaggcgacuuucugaaacuuguuuucuuuuuuuucucuuuccccuccccuuuucccccuucccucuucugugucuuccgcggucuucccucaccaaagauaccguguacgccuccuuccucaucuccgcucagccgcccggaggggacucaccgcgggcgguucaugcgccccgggccgcgggcccgugguugagcgcaagccccgcuggccgccgccaugcacgccgcggagcgcccgccacccgaggacacuaggacuacaucgaggccgaacuuuuaagucccacugaagcaggccggcgggccggguggggaggcugaucgcggcacucccgcggaggauggauggccgagauuucgggccccagcgguccguccacggccccccgccgccgcugcuguccggcuuggccauggacagccaccgcgugggcgcggccaccgccggacgcuugcccuccucgggcuugccaggucccccgccgcccgggaaauacauggccggucucaaccuucacccgcacccggguaaguguugcgcacugugcuagcacccacccuccagcuuugauggggauauuagggcgggagcccaggucaaaccuaggcggcuggagcugggcgucucuguccgguuucaccagggugugcaggaggcucgcucagcugcuagcgcagaggucggucuccaggaagacagaccugucccuaguguaccagauagucucaguccuccugaggcucaagugucugcagucacaaccacucugggggaucccaguccgagggcucuugaggaagaggaguuugcaaaaauaaaauaaaaauaaauaaauaaaaaccuguaggcgcgaaaacagcgugucagcuccacaccccaggagacagacagccgcucccguaugggucuuuuucuuggcaagcacuggugggucuuggguuaugucccuguguguagccgcguccccggcgguuccacgccuccaagggugggugugggagaaugaaggagaauagugaccacaguuuuaggagccugaaucuguggugaacccuuaagaucuuagggacgcugguuaucuggggaagauauaggucggugcaacccagccggcacucuagcagagcccgacuucaggggguaccccauggugacacgcaggaggugguggcugagaaggcccaaucccuuaccguucccugggcugcacagggaaggagcagagggacaggcgggacugagccaagucuuggucaccgugcgccggaagacagggagucugggaccugcagaucugccugguggcggcuucguaagccggucccuccuccccggcugcuccucacuucuacgcuuggcuuaaggagaacacuucagcucuuccuuuaaaaaacaaaacaaaacaaaaccuggucgauuuccccaggaacucgcucccucguccuuuggaacaagacuuggacacccugggggcucagagccaccacuuuaguaucuuccccugcccgccaggaugaccacggcucgccgaauuagccucugccuuugauauuuuucuccuggaacuuuucuagaauugggaguccgggacucagcgggacaaagggccuuugugaagcgccggcgggggaggggcgagcagagauccccgccggcgggggcgcggggacccgggucaucuccccuggugugcgugugccccuugagaacuagaggcgcguccgcuuggggcuuagggguggugacaagaccagauucauacaggaauggugcccugcgacccagguggggcaucagaccauucccaaggcaggaauuggggagggcuuugggauacaaaggccauuugggccaaccccguuugagaggggccuuuggagguuuauggguguguguauuuuuggacuuuugggaucucuggguuaguugguuuagcuggaaguggcggcagggguuccuccuguggccugggaaucugaccucaggguguuccuggcuggcugaaucucagcuugucgccugcuccaggucugccugggaucuggcccaggcuuggcugagagcagcguugauagccauuccuugcugcugucguucuaagugcacagcauuuuccaaccuugguggcguagcauagucagacugccuuccaugcuuaaccccucaucuaguggaugaugugacagaggcauagacuaggcaauccagcuggaagcagccuuggaauccugugucauggccuucucugcuuggagcuguucgacuucuguacaggguagcucgagggccuggaggaaaugggaggaaagucacagcagucguccccuugaggccuugcuugcccgagagggaagaguggaggcccucgaagcucuaugacuucccacucgucccaucugucccccaccuccagauggggcagauagaccggaccgcaggucaaggcccagagcugaagccguacuuaaucccauuaaccacgaaaugggacugcaccccauucaaaccggaggagcuggcggggauggagacuccagacaccccucccccaccuggcuuucuuugcagggggugcaggugcuagaccuuugcauaggggcaccacccagugcuuuuuuucuggcugccagcuccuuagaucuuggcagccuuaucagaccggcagaccggucuuuauuuguuuacuuuuguauaaaaugucagagaaacugagcgauuugcuagggucacgcagccuagagggaagaggguuuuuguuaccucugggcugguccgguuggaggaugccccugcccguggcugcuggggugcagaaguccuagugaaaguucaguaggcagggggagcuuggccuggugaccucaggggagcagcacuguugggugaggguccguuguaggcaaagcuuucuacguugauguggguuuguaugagggcucuagccccuuccucaggugaaauuaaaaauaaagaacggggugucagcauggaggcucacaccuaccuaugcagcacucagaggcagagauagagggagcagggguaauuggggcagcccagccuagaaaaucuagaaaacacacacacacacacacacacacacaccacaccacaccacaccacauacuacgcaaacacaccacaauacauacacaccauacauacacauacaccccaacccuuacaccacacacauacacccgucagauugaagcaggggugacgacuucuuucuuuccccuugcuguaagguccggcuguaguuugagcagugaauauucacagcuugucagugagacuucauuucuggaguuggggggcccugggaaggauccaucuuucagugugaaguguggcuaucgagaucuuguaucuggaugcuuguuuucucugaacccacacccuggacugaaugaggggcgggacgcagggauguagacucaggagguacugcacuuugaccuggcccuuggacaauaggcaaccagccuugggcucccaacucuggaauccacccugucagccuccugggauugauuuagaaagauuaaucaguuaggacuggcugcuggagacgagggaugagaagauaaggcuguuuguuuguuuuuuucuccuugaacccucccuuuggucagaaggcaguaaaggaaggcauggagaagguucuagaaccuaggagggcccguuggguucccugguucuuaacgugaucaccuccuguuugucuucuuuuuuuuuuuuaaauucuauuuucaauguguguguguguguguguucgagugugcgcgcacaccgcacugcauuguguacacaccagccugcauugugcacacaccugccugcagaggucugaggaccacuugcuggaguugguucucuccugcccaguggggagguccugggaucagacucagguguggccacaggucacuuuacccucuggcucaucuuggcggugccuuuuggagcuucaccaguccaagccuugcuuuuuccuuccuucuucgaucgacccguucauuugcuuggcaaaugguuucuaagagccucucugcucaccagggaaccgcacugggccccggaacuguguaagggaaccaaacacacugaaggcuuugcgccuccuuggggcuaacuuucuagugugggagccaggcaauaaacacacaaaucaugaggacacaggccauguaggaaauaaaacgcccugggucuggucuggcccuuggggugaagggccaggucagagggcuugaccucagccauccccagaaugaacucuuuugugugucugaagagcagaaaguugacagaaugcagagacagugcugggugagggaucagagguuugagagcccagugggagauagacuggaugggguggggcggaucuugcccggucccugaaaaccagcaaugaagucuuggaauuuuaaacagccauuuuacaaaacuggcauggacuuaaaaaaaaaagucagugguguguaaggcgaagguaggcagggagcuguuaguguuuuaggagaaacggaaaaacugacuguggcuacaggcaguguguagccgagauuaggucuugguuuaagggaaaaaccgucucaaaggaucguggaggcaauuggaaagauuggaauaugagccgcagaucagcccacagcggugagucaguacaguauccccagacaccagucgcuaccucggcuguuuaaaugcuguucuuauuuccugggaauaaggacucagaauuuaggggccagggacaccaugucugccacugucuugcagacggcuggggcaaguggggaaaaaaaaaagaauacuuucaauauaagugucccggcaucgucaagggagacggcagguaacagcagauaacaaacuaagaggugugacuagagccugcgaaggugaugguaguucauuguaacuauuuugagcuucucuaaaguugaaauucuuccaaaauaagcauacaaggggaaggauguguguguguguguguguguguguguguguguguguguguguauaagauggcucaguggguaaaggcgcuugugaguaaacugaggaccugaguuugauuuugauucccugggaucuacaugguggaaggagcugugugugugugugugugugugugugugugugugugcguguguguauguauauacacgcacacacacacauacauacaaagaaagagacccuggguuuuggucagagauguucauagggugggaggaacagggacaagguggguugaggcaccuccauccccuuucuauuuuuuuaaacaaagccucacuguauagcucugacuggccuggacuucgccgggcuguguagaccagucugaccucagucucaaggagaccaccugccucugccuccagagugcugggauuaaaggcgugcaccaccacgccugacuuuuauuuuucccuuuuaggacaagaguuuuauggagcucaggcuggccuggaauuuaugguucgauucucauccucuuaaaugcuuggaauuuaggacuguauaugauaaucgcuugggguggugggguguuuuuguauuuuguuguuguuauuguuguuguuguugauauaaauagacacgugcacacacaccuguauguacacauagauaucauauuuagaagacagggucugcuauagccccgguggacugucaguuuccugcauaucugagaacauaaucuggaacuuaagauccugccucagucuacaagugaaccaugugacuuagcuguggccaguuagggauggucuugacuccuuuugguggacuggcugccaaaucugauucugcuuccacuccuuuuugccaucucggcaggcauuccaaccccaacuaaagggaccaggacuuucacuucacuugauagaauguuuacuaaccaugcauggugaaacccuugguuugauccgcagcccugcauugguagcauagaccuguagucuuggcucacggguggacugucucaaaaacaaacaaaacucaucaacaaaagaaaaacccaccaucuaaagcugagccuguuuguuuguuuguuuauuuuuguguugcugacagugaaacccagugucaugugcacaugucacugagucagauccccagccaggagccagggguccuugccaucccucuugcccagagaagcaucauaucugccuuugguggaaguaaaagcuaucacauagugaggugcugacugaagauaaaaaguaggaccgcugagaugcagcucagugguagagccccugccuagaaucccccagugagggggcugggggcguggcucaaugguagagccccugcuuagaaucccccagggaggggcugggggcaugguucaaugguagagccccugccuagaaucccccagggaggggcugggggcauggcucagugguagagccccugccuagaaucccccagugaggggcuggggcguggcucagugguagagccccugccuagaaucccccagugaggggcugggggcguggcucagugguagagccccugccuagaaucccccagggaggggcugggggcguggcucagugguagagcucugccuagaaucccccagggaggggcugggggcguggcucagugguagagccccugccuggaaucccccagugaggggcugggggcgugacucagugguagagcucugccuagaaucccccagugaggggcuggggcucaaauacccuuucuaacaauuucacacauuccuuagcaguucugaaccuggaauccuuugauaagaagcuacuuuaucuggaggcugccuguucuagggcugaugguuauuuccauuuauuuauuuauuuauuuauuuauuuauauuauuauguuuuuuaaagauuuauuuauuuauuuaugagugauuacaauuauagcugucuucagacacaccagaagagggcgucagucagaucccauuacagaugguugugagccacuaugugguugcugggaauugaacucaggaccucuggaagagcagucagugcucuuaacugcugagccaucucuccagcccuuauuuauuuauuuuuaaugaguuuguuuguuuguuuguuuuuccuggaacuugcucuguagaccagggugaccucaaacucacagagagcugccugccucugcuuugugagugcagggaugaacggcguucaugaccaaucacuauuuggauuccucuuccuuuuuucuuuucuuuuugccacuuauugugcauguguaugugugaaugcgagugcuucugugugcacauguguauaugcuucagugcauauucaagaggacaguuggugugacucaguucucuccgaccacuuggguccagaggacugagcuuaaaccaucagcuugcccugugaccuaucacaccugcccaagccugagacugaagucuugauuuucugccuuugaugagucugugagucucaauuuucccaucuacaaaguggaccaauuaauacugaacgcuaccuugccuugugacauuugaugaggcaggcugaggccaggugccugacccaggcccagcccucuggaagucacugaaaaagugauugcuguaauuacggacaucauuagcgggugacucacagaucccucaggcccguccacaccucucccagggcuuuggaauuuccuucuaacgcucucugguuggagcauaguccuuagccaccgggggucaaccuacgcuuuuauuuuaucuugggacugguggaucaaccccagaggccuuggagcuaccucugagcaguaccccaggucuucauugcuuuucauuuguaccccccuuuuuuuuuauaauagccagacuaaaaugcuuccauguuauguagcucagucuagcuuugaauaccugaucccccgcccccccccuuuuuuuuuuuugugaguacauuguagcugucuucagacacaccagaagagggcaucaaaucccauuacagaugguugugagccaccaugugguugcugagaacugaacucaggaccucugcaagaggagucaguguugguaaccacugagccaucucuccagccuggaacuccugauccucuugccuucacaucucaaaugccuggaucacgaguaugucuaccauccccacacacccagacuugguugcuuucaucucaaguuucugguuuauuugacuuuuuaagggucuuccuguguggcccagguugggauucaguagagcucagauuugccucaaacuuguaaucuuuaggcuucaaggcugccacacccagugggguaggccuuuagucccagcccuugggagacagggaucgcuauugaauuggaggcuagcauggacuauauaaugagagaguuccagugccacuaaauaaugagacccugucucaaaaaguucaaaguacaacaccaaccaaagcaggaggagcauguagcucauagcaugcaugaugcuuuggauuugacuaagucauauuaacugucaugguggugcguaugugccuguaauuuuaguacuuaggacgcaaaggcagauggaucucuugacugaguagugcaagagcaugaucccuuggguauauagugaguucagguuugccugugcuauguaaucacagaaacaaaacaaguuaggugugguggccuauaaucucagcucucaggaggcagaggcaggccgaucucugaguucugguccagccuggucuacagagugaguucaagcauagccagggcuacacagagaaacccuguccugaaaaaagccaaaggauuuuuuuuuuuuuaaagagaauagaaaagaaaaaaguguagcauugaaaaaaugaaaugggugggcuggagaaauggcucggcggguaaagagcaucuguugcucuugcggaggaucuggguucgauuuccaacaccuacacaagagcucacaccauuuugacuccuaguucugcagagucugacucugugucuggccucugcagacccuguaagcaugugacacaugcauauacacgcagaaacgccuauagugcacauaugcaaagugaaauaaaaugggguaugauaauaggauacucggagauccgguucaaggauuaaguguugcaaauaaagcauuuaacacugcgucugauaugcaauaggggccuugcagauguuuauuauuaugguaagugagguuucuuuaaccucuuacccgguucuauucccuucucuugauauauaugagauacaagggaaauuuuuguuuuauuuuaauguuuuaagagacaggcuuucucuguguagcccuggcuguccuggaacuuacucuauagaccaggcuggccucgaacucacagagcaucccucugccucuucaucacuggaauuaaaggagccucggccggcaacacuacuguuuuauuuaagccaguuuuuuuuguuuguuuguuuuguuuuguuuuguuuuguuuuuacuauggcuuuguaaguuuugugccuguugugccuagagucaaugguguaauaaaaucaacuuauauuuucuggaguuuucaagguuuuuguuuuuuuggaucggauuguguuuuagacugucugccucccguucuguggauacaguuuauaauugggaacgucucccgcccagaucuccuuugucuuuucuugaagagucugguucuggaugguuccaucggccuuuaccugguugccagcgacucuguuccuuggaucugguaccuuccugucuccuggguuacggccgugcuucugggagcauguucagcaguucugccuggucacgucggugguuagugcuuuccagugucccucugccuuuuucugaaggcugugaugcugugccuaccccucccacugguggggcuggggaccaaaccaguacaacguaguauuauuauuuguuuagcuugugaguggcuguguauuuauuugugugcauggacaguuucauucauguacagagugaauuuuaguauuuuauccccccccccccccagugcccucucagcugcuggcugucuuuugaaguucaucuuccucuuaguuucauggcuguuuugugaaugacccacucaguguauuagaguuucucucucucucucuuuuaguuuuuugagacagagcuucucuguguagcccuggcuguccuggaacucccuguguagaccaggcugaccuugaacucaaagauccaucugccucugccuccccagugcugggauuaaaggcugccccacuagcaucucuuucuuucuuuguuuuuuuuuucauuaugggugguuguaagccaccaugugguugcugggauuugaacucaagaccuucagaagagcagucagugcucuuaccugcucagccaucucaccagcccuagcaucuguuucuuaagcuugguugucaggucccuucuuggagcaugaacaacuuaaccaguggccauaucucugcagaaacacuaacccuccaguaacacuaacugucuacaaacccucagagccucacucgguagcccuggaacucacauggggaccaggcuagcuuugaacucacagugcugggguuaaaggcaugggccaaucacuuugaaucuugaucaccauaugccaagugucuguccucugugaccccccccccccaacaucuuuuugauaucacaauagugacagacauggcuacagggacccaggggacagcuuggccucuuccuugcuguguggguuggacauuuugucugacugacccucuguuuuuuuuuucuccgcugaaauggcugguuaauagucgcuuuucaugacugugugaaggguaaaugcggcuaggcccugaagcuccuagaggguugcgugacucaaagaaagccugagcuaccauuagggauuuucucgccauccuagcugucuugagauucugugcaggagugucugcuguggccuccuuuuguguuugcugugcugggugccugucaaucucaggauucaauccuuccagccugaaauuguuuuugaguuucuauuuuuauucauauuugaucauuuccugucuaccauucuuucuuuguacgaguagugagauaucuugaggccuuugcuccaauaaacacaucuucuguaucauuuuuuuuuccuuucucuuuuuuuuccccugaguuuuuccccugagacagggccuugauacauagcuggaacuccugacuaggcuaaccucggacucacagagauccgauccgcugguucugccuccugagcacugggaucaaaggccuauaccagcagcuccagcuuuacucuuucuuuuauuuuuacuuauuuauuuuuuugguguguguguguguguguguguguguauuucagaggacaacuuuugguuuugcuaagaucacccuuacccacugagccaucucaccagcccacaccuacuuagcuacaaucuuucuagauaucuucaguggaauuuuauagcccuuuaacccuucacuauaguuuuagaaguugucugucauucaucuauagaguguauauuaagaaugugggggggaggggagcuggagagaugacucagcaguucagagcauuggcugcucuucuguaggucaugaguucaguucccagcaacaugguggcucacaaccaucuguaaugcgagcuaaugcccucuucuggugugugucugaagacagugacaauauacauaaaaauacauaaaauaaauaaauaaaucuuuuuuaaaaaguguguguauguguguguauguguguguguauguguguguguguauguguauguaugugugucugucuguauguguguaugucuguauguguguuuguguguguauauguguauguguguguguaugugcauguauguguguuuguguguguguguguguguguguguguguaauguagcccaggcuggccuuaacuuaguauguaggugagggugacuuucaacuucuaaucuucccaugucucuccagagagcagugggauugugaguuuauaucaccacagccagugcuggggauggaacuagcacccuaccaacugagccgccuucagcccuguuaguguuguuguucuuacugucaauagagcacucuguuuuucaugccugucuguucucauggccugggugaucaugacuguguuguuuucuuuuugggcucucuguauucucuggcucacuggucuuuucuugucuucugcauuuugggaaagaaaagaacacuuacccaucgagcacuugggugguggaagcuggaagaucaggaaagaaucuaaggcuagccuuaggucugcaaugaguuugaggauagccugugcuaagagagacugugucugugaagagccacugcuacuucagcaugagguuuggguuccccacccaccugagaagcagggcagggccuugugugccuccaguagcuggagugcuuuggggcguggagacaggaggauugcuggggcuugcuggccuccaguuuagcuccagguucagggaggguuggauagugagggcuggacuggauggacaccaaaccgguguuaucgcuguauaaagguauuucuuuccuuuuucucuuucucucuuucuuuuucuuucuucuucuucuuuuucccuuccuuccuuccuuccuuccuuccuuccuuccuuccuuccuuccuuccucucucucucucucucucucucucucucucucucucuuucuguauuuuuuuuuuuuuugagacaauuguuauguggcugaccuugaggucuacucugccucagccuucuccugccgagugccuggaccgcagggccaggcauaucuggagccuggcuuugauacuuuucuuuuuugccuugggugagaguacuguagccauuuaagcacuuggguuuccgccuagcuuugcccucugccuaaacccagcccagacaagucucauuccuuuaaaagugaauucacuaauuuaagcggacuauuguuacuguuugagauaugaccauaucucuuuguggccuaggcuggccucaggcuuaaaguuuagccucuguaggugaggcuaaccuuggucuuccuccaucuggagcuacugccucagccugaggggcagagcugggaugagggaagagggccccuccaucgccccaugaauuccagccucaucucuguuagcaaagggcuugugggagacucugaauucuucccuagugaaaacagcuccccagguauagcaggacagcuugcuuggcuugcaagaugccuuguuccguccccagcacugcagacaaaccaaaccaaccccucccccccacaaucagcuggcacuugagcaccucccugcccucuggguuuuagagauaccaggguuucuaaauuggagggaccagaaauauucuaauuugauugucuuaucuguuugguuugagacaggaucucucucagugcaugcuggccuccaauuccuuggcuuccucuugucucugcuguucaagugcugguguuaggggcaugagccaccacaccugacuagguuuuguuuuuguuuuuguuuuuuuuuuuuaauuuuuuauuuugcuuugcuuuggugcuagggauggaacccagggcuccauauaagcugcugaaucuacagucugccacugagccauagcccagcucaguuaguguguguacaugcguauauaugcaugaauguguguguguguaugugagagugggcaagcaguaaauucauguguguguguaugugcaugugugugacaguuuguaugugugugcuguguguguauauaugugcaugugugugacaguuuguaugugugugcuguguguguguaaggguagacaagcaaggaauucauggagagaguguuugugugcacacauauauauguauguguaugagaguuuguauguguggugcauguguguguguguguguuuguaagaaugggcaagcaagaaauuugugcauuugagugugugugagagagagagcgcgcacucgagcgugcacacacuggcauguacaggguacacacacauagaggucagaggacgaguugaggaguugagguaugggcauuuggguuucuccuuccaucacacgggcuccaggggucaucugugcacaccuuuaugugcugagccaucuugucaacucagaaggaauuccuuuuuauauaacuuauuuguuucuauuuuaugugcauuggggauuugccugcaugucugucugugugagggaaucagguugaaguuacagacgguugggagcugccacgugggugcugggaguugaaggacgaugggucuuaaccaucucuccagucccaguagaaggaauucuuaacucugaaguugugcuguggcuuuagguguccaggcgucagcuccaguauccagcuccaguaucguuuuuuguuuguuuguuuguuuguuuguuuguuuguuuuuggcuggcuuaccucucuuucugaacauuuuccuuuguccuuuguccguggaaguccauccaucccuaacuccaccacucuugugcugcagugguccuuaggggauaaauuccuuccagagggaagucccccuguaauugccuccugauugugaccuaucuggagccccaagggcaggacccaggcugagugggcuuauuugcauaucacuggcuaagcuggucuuuacuggucugggagcccuugguauccuuuuuaauuuaaauuuuaaggauguacuuuugaggauaaggcgucugcuggggguaagucaaagcccgcgggccgguucugugaagauggaggggcuuggauuuggucaggcgguguccugcugaccacuuguucuaggaacaguggggucucuucugggaaccugugcacccuagguagaucggggagacuggagaugagaagggugggugggguuugcgguuguuggauugagcuggaggggugggugggugggugggaaagggaggcgaggcuccaauggguuuuaucucccuggggccggccuuuaggacuuccuccugcguguggggcuggcuuuuuuuaaggcuggcuuuugccucagucccuccuugcaccuacccagcugccuucacuagagcccagaggaggaggcagccauuagucccugccgcugugcccagagaguacugaguaagguuccacaguggcuccgcaggugcucagucugucacguggugagugucagaaggccagggauggagaguuacaggggccuugccuucuuaugcgcucaguuauauuaugggagugggaaggcacagagagguuggguuguugucuaaggucacacagcuaguaagugaaacacccagaagccaggcuuuagcugucugcugcaaagcuggggugugugugugugggggggggcaggggaugguaagagggagucacuuaaaagaaaacauuacuuuuuauuuauucauguaugugugcgugagagcgcacaccugaggaugugugcccaaggugcacacauggaggucagaugacagcuuucaggagccaguucuuuccuucuaccgugugggucccugggauggaacucaaaucaucagacuuggccgcaagccccuuacucauugagccaucucaccagcugacuuguguuuacugaaaaauuuguauuguguguguguguggaaugaagggagggagggaaggagagagauggauucccagcugcugugcaaagguucuuaggugcugaaucugagguggagucuugcaggggaaggcuucccagauccucugugugugcucgagacucugagauugugaguagcauuaaucugaauauggccuguggguuuacuuuccuuuuuguuguugugguggugaugguggugauaguuuuuugagacaagguuucucuguguagcccuggcuguucuagaacccagaccugauggccucugccucuuaaguccuggauuaaaggucugcagacucucuuacauauccguaccuccgauuaacuguaagaacaaacacaguaagagcugagugauggugguaauuaacugcacaauacaaugaucagggucgggaauggggcuccuucugauagguguuugucaagcaugcaggaagcucuggguuuucccagcaacacagcaaccaggcgugguggcauaucaccuguaaccccagcauucaggagguggaggcaggaggaucaggaguuuaaggucaccuucugcuacauagggaguuuuggggucagccugggauccaugagacccugucucagaaaugaaauagggucuagggagacugcuuggcaggcaagagcaguugcugcguuugcagaggaccuuacuuugguucccagcagccaccuuggauagcucagaaccacuuguagcuacaaggcaccuuugaucccaugcacaaacccacagaguuaaaacaauaaauuuuuucgaggccagccuggucuacagagugaguuucaggacuacacagagaaacccugucucgaaaaaaagauaauaaauaaauuuuuauaaaagacagcugucuuuaacagcccccccuccccccaggguuucucuguguagccuuggcuauacugaacucacucuguagaucaggcuggccuugaacucagaaauccaccugccuuugccucccaagugcugggauuaaaggcgugcgccaccaccgcccggccuaacaggcauacuuugagaagugguuucccuuuucuuuauuguguguggacgucuuguguguguaugcaugacaucucguacggguguaggucagagggcaacucuguaguucucucccaccaccaucuaggugcgggagguugaacuuagguugucagcuugcugggaggcuccuuuuccugcugagccgucuugcuggcccacaagcauguuuuaauacaaguagugugacugguuucucaaaauaccuauuaccuaugucugucugucugucugccugccuauucgagauggacuuacuuuauauucccagcuggcuucauguugagucacccuucuccuuuugagauggucucauggagccgacaacacaaucauuuugaugaccuugaacuugugaccccuuugccuccacuuuugaagggcugggaauccuagagcugagcucuacauccucacccuuuugugaaugagaggagacaagaguguucgacaagaugaaguguucggaauggcugggugccggugaugagugagccgagcgagcguggcauacgcggcuuacaugguguuggaaagagagaugguucgcuuacgagcagaauagaucagaaggguacaagcaaggucccaucaagccguucguucagaauggcacgagauuuaaaacucagccaguuguuuauuucuggaguuuauaccuagcacuuuuggauuauuguugaaagcacaaguauggucacaaguaggcuuucuccugauuucauccauagcacaggcgagaugcuacuggugccuacaguggcauccaggucucugagaggauugcaccccaaaucgccacagauagugucccuugccauccgucuguugggguauggucgacgacaaggaagugucuggauuuccccgcccaugcaugaugaccggggcaagccacacugucuuugcuuucuccuuccuaacugggcacagugugacuaacuccuuccgugaugggcaugggguuacaggagccggugagguaugcgcuuggcacacagccuguuguggaggaaaacggcucgggaaaguugggaguuuuaugaaugucauuaaaucuuugcccaagaagcagagacaaccaacugcgugcucuuccugacucugagcaggcggccccuugcuaaccccaaacuuuuugaagacuugcuucguucuugaaacaguggcgauagagccagggcuucauccauaauauucagaugugcuuaugauuuuuuuuuuguuuguuuguuuuuaagaguggguauaugagugugugggggggucagguaugcuuguggaggcuggagaauaacuuugggggacauuauucaggaagcuauuuucuuugaggcagggucccagugguauggaauaggcuagacugacugagcccuagggaucuugucugucucuacuuccugagccuugggaugacaugggcgugucccuucuugugacaggguuucucuguguaguccagguugaugaggagcucucucuguagaccaggcuggucuugaacucagagaucugccuucccuugucucccaaguuguggggauuaaaggcauuuguucaugucuuuaauuucuuaauacgcagaaugaguaacaaggucccugggccccagggcuucaggauagcaagccaggauccggaaaggcugcaagacuugugggcaaagaugccugagguuuggaaagcuuggagauuuaauucagcuuuggaugaauguccugaucucggaagcuaaacaaguuuaggccugcucagugcuugaaugggaucauuuggcuuuuuuuuuuuuuuuuuuuuuucuuuuuccuuggggcgggggaggguggagaugacauuccuagcaucaggacuugacugauauucagcacccuugugaggaaacacaagaggcaugcguuaccugccuggaauccagguccuggggaggcugaggcaggaggaugccuccagcucgcuagccagccauucuaaccauaugagagcuagaacgugguugaggaagacaucugaggucaacuucagggcucugugugccuaggcacacaugggcacaaacacauacacacauguacuauacaguuauaugauuugcagguguaauacacagcucagcgaugcuuaauguguuagugaccuacaagugcucacugcuggggaaggguuaacuguguagguagggcaagcggaccccccucaaauccugguccuggaguugucacuuagccagucauuugugacaacagcuggcauuacauagcacccugugggcagaccaagcucagaucauuuuacaaacagaagugucuugaaucuuuccauacaucaagcuggagggagaagauaaauguguuauguauuucgcauagccuagggaaacuuacagaauggccagaaugacagucaugaguuagaaguggugguaugcgucugcgaucuugucacucagaaaggcuaagucaggaggacugcuugacaugggaagccagccugggcuauauagugagggcuaggauaaccugggcuacauaguaagacuuugucaagaggccauggagauggcucagcggaaagauguuugcuauacacaggcaaggacaugaguucagauccuagcacccacauuaacagguggguguggucggucaggcuguuucugggccuugacauccaucaguuuagauccaggcccaguagagaugcugucugaaguaaguagguuggaggcaggcaucccacauccuccuggcuucuacaugugcauacgcugaaugcacacauacacaugugacacacguaugcacacagaaaugagccugggagcuaagauguggccuuugcucugucuaaaaaucucauuguguccccagcucuuccccacagagacucacgguucauguccacuucuuccauuucuagccaggaaaagaccuucagccuagaacauggcugaauuaaaucuaaaugaauugagauuuaauaaaauagaacaaacaguucuucaguuuccaugguugcaauucugacuuaggagcgacacgcggucaguggcuaccaugucccacagcauggagcgucugcugcuccuuggucuucucugucgguguauguuguucauuuauccaguccuguaccugacagaugcagcuaugcuuguggcuuugcugaggaugucaggcagggucauagacuugacgugacuguuauguaggagcuauuuaagguucuguggauggaacccagagccuugauugugcuaggugugugcucuaccacugggccacaccccagccccucacugggggauucuaggcaggugcucuaccacggagccacaucccagcccuucacugggggauucuaggcaggggcucuaccacugggccacaccccagcccuucacugggggauucuaggcagggccucuaccacugagucacacccuggcccuucacuggggaaugcuaggcaggggcucuaccacagacaccccaaacaccuuauugaggaauucuaggcugggucuuuauugcugagcuguccuucccagcucuuucuaccuuuuauggagacugucugaguuugcugugacuagcguugacucacuccaguccagagugguucugaacuaacuuuccauccuuuugccucagccuccugaaguaguucuagugacuguccuaugccaccacuccugguuuugugccugcuuuaggacugcaacucugugaccagagagcaucaucuauggcuugccuggucgcugggacccccagcuaucacuacccccagccugggaggagguaguugaggccacuuagagccccuguggugacaggaaucguugguggcauccgggccucaacgcuucuuuggacuggagugcugcuugcuggguuucacaagcccaggcaggggcaggccugggcccucugcuuccgcacagcccaggcaggaagaacugguggcugacguaagccuuugcgcaaaccccuggcuauuggcuuccggagccuucuaccggccgucugccacaucaaggaggaagccuaggguuuggcagggcccagaggccuuaccuucccaggcuuaggcuacauggaugugcugaccggcuacaagggcccuugggccacgggcguuggugcuggauucuggugagggacugggcuucagcgaugguggcugcauaggccauggugacaggcaugugauccgagggugugugugagaucucuagcuucugcucuuacucaguuuacccaugugugcccccaagggccugggggcauauuuuggaguccuaucccccuagggaggcagucaguggacacuuuguauagggcuuacaugggagggcucucaggaacucagaaacugaagugcauauguaugugggcagagucugugagaucucuguggcuuagacccgcugcuggcaucugagccacacauccugucugcugcugucugcaaacagugcccaccucuuagggacuagagaaggcucuggagaacuuaacacagcuuuccucuggagaccaacuagaaugggcaccuggugggugcuuggcuagagugcuggacccagccauguguucagggcuccacacccucuccugcugggugcccuggagagaguuugaaucacccauggaacaucuggccuauuuacuauuauuauuccuaaaacuagcgaaaacuagcguaucuguuauauaauuccuguucaauauaugccuccguccuaccuuguuuuuguuuguuuguuuguuuguuugggggugcuaaaguuugaaccuagucccucaugucuccuaggcaggcacucugcauccccagauugacuuuggguuuuuuuaauaacagauucgggguaucaugauaggauccaucuuuuuuuauaaaccgggcucaccucauaguccaggcuaacuuagaacuuucagcccuuuggccucagcuuccaaggcugcuauuuauaugcuugucagcuguccuggcgucuucuguuuucuuuuuccuuugugauucgcucuaccuaucaucaggcuuguuaugcugggcucugagaugcccugcucggugugcugggaguugcuccucagcugagcugaggcuuuuccuugcugggccucuguugcauaucugggcaucugcagucauuagacacccagaagcuccuccacauccugggugaccgugagcuccuuggggacgcuggucucuggacaguguccugcauugagcucagacuaugagcucuuucucugugaccauugcuucccuuacucuggccugggcaguccuuaaaggugccccccaccccccauccugacugacucaggcuuucuuccaucugcagccacaguauuaaaagcguucucugggguucugggccuuggggcccagggagucuggccuucuuucuuggucacuauggugauuagacccauagggugugucugggguuggccaaguggugccucuugaucucucugugaagacuuuaugcaguggagggccuugggaugaugguccagguagcauggccugguuuacuggcugccugacagggacccccucccuuuucucugcaggcgaggccuucuuaggcagcuuuguguccagcgggauggggcccucggccucgucucaggggagcccgguauccuugcccucugaccucuccuuccacucccccacucccagcaaccugcccaugguacagcugugggcugcccacgcccaugaagguaaggagugggccagcugggaggggccgagggcugcugggccacuguccucacggugauggcaauuuaaugucuccaacaccauucucaacaccuuuuuucaccauggcauccagguguccccucuagcacuuagcgcuuauuuuguuaccacagggccuuugcacaagccauucaugccucugccugcagccucucaccccagcccacuggcuccuccuccucugcugcucaguccuguucccaugguuacuugguaaaagacaaaagccuuaccugugugguuguucccugaucuuguggcgugcacuuugagggcagggacugguguauauucaauggaauaccuuccuuccuacacacuuacuccuaccuaccuacacacacacacacacacacacaaucacacuuuuguggggagccucuggccuggguacucuaggcuugccuuuuuuuuuuuuuuuuuuugguuuuucgagucagguuuuuucuguuuaguccuggcuggccuggaacucagaaaucugccugucucugccucccaagugcugggauuaaaggugugugccacuacugccuggcuccuuuuuuuuuuucuuuucaguacugagaauugaacgaaccuaagacuccccuccuccaccucugucucugguggauuuggaguguugguugacauuaggguccucuuacaucuuguggaucuucugggcucaccuugaacccaggacauuguagcucugggagaccccuauugccugcuuuugacugucugggccauucccuacccaguggaguuggaggcagaaugaaugcccacccggacaggggugugggaugcuugcuguaucuugcuuggcuguggcuagaagugucagugucaggcauaacagaguggucuuuccuguacagagaaaguuacuaaagccauuuuucuugggccucucaggacaggcaugugaauccaggaaugaguguauagaugucuugcaugaaggcuguguugccucugcugggugucugccuugggcugggaugaugguugcuggugugggcuggugcucugccugagcuccucccacugagcugagcugggugagcguugagcacaggcuaccucuacugugucauuggcucauuccucaguucuucccgagaugcucauagccacagcaaacauacaccacagacauggccugcuccugggcgguguucuuaggucuccugccaccuuugcagcaucuggggcuggggcuggggcuggggcuggggcuggggcuggggcugggguguccgucuuacgcacgacagaccugcagaggaccagcuaccugcagcugagcguugguuugguguuuaacugugacgcuguagauugggcgucuguuuuguucugugacuugcauaguggguucuuuugccuuguuuuguuuuccucaagauagucuugcuaaguagugcuggcugaccuggaacucacuguguugaccagaauggccuuggguuugcagcaauccuccugccucugcuucucaagaauuagaauuacaugugugaagccauauuucgggacaacccccauuuguuuguuuguuuugugaugaagggucuuacuguguagcccaggcuggccuuaaacucauagggauucaccugccucugccucugccucuggaaugcuaggauggaaggcaugcaccaccauaccuugugggaagccauuccggacucccuggccacaauaccugaccuuaguuuuuauuuugugguagguucucacuaaguuucccaggcuagccuugagcugccagcccucagucucuuggguagucaggauuacuggucuguaccaccagagugcacuuguguagcgucuauuuggggucaugaggacucaaauucaggaguucgugcaugucaggcaagcauccggagugccaucuguagcucugucugguaguuuguauguaucaagauggagaaaaggacaccaguucucagggccagggccagaccgcagacgaggaccaggaauagugugucccuugugacuuuccaguaggaccccagucccaggcucugccuggccccuugugcccugugugcauucucagcuugccgauaguugcccaugcuugguuugucaccuguggccacaccccuuuugaagucacagcacucucucucuuuggacuucacuguaagacugggcagcuagagaugcugacuugaguguucagagacggcaagcagucaguccugaggcacacagcagagaggagacucaugacgacuguccauccagaguucguacucucccgagguugcgucugagcuguaggguccugugacuucaguucaaagucagguuuagcugcacuuugaucuuuuagucaguggucuacucugacucuguuguuuuguuuuguuuugcuuugcuuugcuuuguuuuuaaucuguaaaaugagaggacaggaguguguggucuucucaggguugcuuuaaauagcgccuugagucuucucuugguuagguccauucugacuuugauccuggaguguuugaacuucuauccaagcccuuguggauuuucugggccucacgaaaggcuugaaguggcaggguuuuuuuuuuuuuuuuuuuuuuugggggggggggucaguuguugccaugagaaccgguguugaccaaucagcuucuuguaccaggggacugacaggccaccgaggcuuuuuccaaagagaagcaaaugcuagaggggcauguguggguaaacaugaguagcauagaccucucucucuucuuuucuccuuaggcuucucccaccugcccagugggcuauauccauccuaccuccaccugaaccaccuggacccccccagcagugggagcccccuccucagccagcugggucagcccagcaucuucgauacccagaaagguaagggggcagaaaagggugggacuguuguuagccagggaggggguggcagagugauuuccuggggguuuuucuuggggguccagguaucuuauaugcaguauuuaccucuuuauuggagggucccuaagauggagcccugugcuaggaaagggcucugccacagagcugcucccuccagccccuucaccaaaguuuccuuuucagggguucucuuuguuaagccaggcuguccuggaauucaccauguggagcaggguggccuugaacucaaaaaauccaccugccucggccuuccaaauguugagauuaaagaugugcaccgucauuucugacccuucgugaauauuuucuuaacucucuuuaaaaucaauaauugaaucaucuuccuuccucccugcuuugugugugugcagaucagaggacagcuuuuggaguucugucuuuccaccugauaggcuggagaucuuaccaggucugacaacgcuugacaacaggcguuguuacugaggcguccuauaggucuguccucccuuccucucccuccccuuccuuuaguccuuucuccccuccccccucucuugccucauguaguccacaguggacuagaccuugguucauagcuaaggauggccuuaaacuuaauauccacuugcauuuaccuccugaaugcuaggccucaaaaaugccuugucuuaguuaggguuuuacagcugagcagacaccgugaccaaggcaagucuuauaaaggacaacauuuaauugggccggcuuacagguucagagguucgguccaucaucaucagggugggagcagggcagcauccaggcagagcugagaguucuacaucuucaucugaaggcugcuaguggaagacugacuuccaagcagcuagggugagggucuuauagcccacacccacagugacacaccuacuccaacagggccacaccuucuaauagugccacucccugggcagagcauauacaaaccaucacagagacgcagccccaaaggccccucaccugucugugaauuuacccacagccuuuuaacuagcuccgauagcucugaaaacgaccuuuggccuuucuucuuuuaccaaugaggagacaggccugggaggauaagaugguuaaagccagguuucuauucacuuuccagccuugccuggcuucucuccgaaggaccaggccccugcacguucucucucugggguacaaugcacccuugggugaagggaggacgucucgggguuaggaguggguaaugauccugauucacuauguccuuuucucccuagauggcuucuaccugcccgcaccggggacccugcaugcucacacgcccucguccagaacucccaguggccacuccucaggugguccagccaaaggcuccucccgggaagguacagggaaggaucgugcaggccgugguggagacccuccuccguuguuuggcaagaaagacccucgggcacgugaggagguguccgggccccgaggugugguggacuugacccaggaggcccgagcggagggccgccaggaccgaggauccucacgccuggcugagcgccugucucccuuucuggcagaggucaaagccaagggugcacugcagccgucggcccugagccugugcaauggugugguggacgcggggcugguggccgaguugggccguggaggugccaaggagguagccaggcaggaggagaaugcucggcugcugaggcgggcugaggcccugcugcccgcugcaaggcccuguggguccccacuaccgccgccaccuccacugccccccaagggucccccugcacccccuuccucuacaccagccgguguguacaccguguuccgugaaccaggccgugagcaccgcgugguggcacccaccuuugugccuucuguggaggccuuugaugagcgggugggacccauccagauagcaucccaggcucgcgauguccgggccagggagcgugagccgggccguccugggguccugcaagguccacccggaucuccacgccuggagcggccagagguucugcgggagaaaagcucggucauccgcucccucaagcguccgccuccauccgauggacccccagcagcccgcuccucccgcuccuccccggaugcgcgagccuaccugccccccaaggaacuacucaagcccgaggcugauccgaggccuugcgagcgcgcaccccgaggcccgagcgcuucugcugcccagcaggcugcuaagcucuuuggccuggaaccaucccgaccccccgggccggagcauaaguggaaacccuuugaacugggcaacuucgccaccacgcagauggcuguccuggcagcccagcaccaccaugccagcagagccgaagaggaagcagcugucgccacagcauccaaaaaggccuaccuggaccccgggggcgcaaugccccgugccucggccaccugcggcaggccaggugcugaccuccacucggcagcccacggacccggagaggccucugcuaugcagagccucaucaaauacagcgguagcuuugcucgggaggcgguggcagugcgcccugguggcugugggaagaagagccccuuuggaggccugggcaccaugaaaccugaaccuacgcccacgucggcgggucccccuagagcccaggcccggcucacacaccccggggucccuacagccggagggggccggcagcugaaacgggacccagagagaccugagagcgccaaggccuuugggagagagggcucuggugcccagggggaagccgaaguaagacacccgccuguuggcauugcuguggcuguggcccggcagaaggacaguggaagcaguagccggcuggggccugggcugggagaccaggaacgcacuuugucacugaacaaugucaaagguaggugcuggguccuguuauuguuuuggugguggugaugguuuuaaaaacauaggaucucaugcacaagauaguuaagugcucugcuguuccaccccuccuuuuauuuuuggggggacagucaucuauagacuauauauagcucacucgcuuuguagccaacaauggucuugaacuuuuauuucccuuuucuccauuuccugagugccggguguugugguaacaguacgugcccugagacaccgguucaugcaguguugagaugggucccaggaugugugugccgggcaggccuucuaacaauugacccacacccccagcucccaguucuuguugaguugcuauguagucugauggguuuugaucucaccaucucucuccuuaauaguugggaauuagggcuggugagauggcucaguggguaagagcacccgacugcucuuccgaagguccagaguucaaaucccagcaaccacauggugguucacaaccaucugcaacgagaucugacgcccucuucuggugugucugaagauagcuacaguguacuuacauguaauaaauaaaucuaaaaaaaaaaaaaaguugggaauuaaagcaggaauaguccccacucuccuuaaauguuaauguuuggguguggguguggggacagguguuacgugcaaguguagaggucagaggacaaccuuggguguuuguucugucuuacuguguuugcucucucuguguguguguguguguguguguguguguguguaucccacacagccaugagaaugcaccacagugcacauggggaagccagaggauaacuuauaagaaauggcuccuccucuagcacguggguuuugggguuuuggggauggaacccaggucuucaggugccuuuacacacggaguuacuugacugucuggggacagucucucucgcuggggcugcagacacagauucuuugccucauaucuggcccuuuuuguuuuguuuuuuuuuugcuuuuuguucuuuuugguuuuaugagauagggcucuucauguagcccuggcugcccuggaacucacucuguagaccaggcuagccucaagucacagaggucugccugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccuccugagugcuggaauuaacagugugugucacacugccuggcccaaucccuauucuugucucucccugccucuggcuuccuauuuuguuuuuauuuauuuauuuauuuuauguauguaaguacacuguagcugucuucagacacaccagaagugggcaucagaucccauuacagaugguugugagucaccaugugauugcugggaauugaacucaggaccucugcaagagcagucagugcucuuacccacugagccaucucuccagcacuguuuuguuuuuuuaaagaugggcuuucacaguauaguccuggcuagcucaaaaccuacuauguagaccaggcuggcuuugaacucagagaaauccccucaucucuaccucuggagugcugggauuccuggcugguuucuuggucuuuucucccaauccucccauccucccucacucccucccuuucucccucccuccuaguacugcaugccuguuccccacuugcccaucguggcugcuauugaaacuuugauugccuuucccauuauccacauagauguguagagugcaggagaggagaacgaagaaaaagaccauuauuguuuccccagcaccccaaacacuuucccggcucucccugaauucauuuucccaugcaauuugugucuaccuguggagcggcuagcguggcacagccuuggucuuacgcucgcucccgcagcacaguguggguuguuucucccgagaugucagaaucuuuacaaguaucauuuuuuuuacggccuuuaauauucuguggagagcacacagcagcagguacuguaguuaggucuccauuccccggugggcauuuucagucuuugccugcucucuuuuguguggagaacgcuguguggaauauuuuugcacguaagcaccucugugcuguguugagucgcuuuguucuguccuagggauuccuaggaauagaccaaccguaagccuuccagugggguagagcccgguguugacucauucagugccucuugggguccagucagcgcggggccuggagcauggagggugcuggggaaccaggugaaugaaugaaugaaugaaugaaugaaagaaugaaugaaugcuuuugaauaguaagaggcggcuuccugacaggcuuuagugaaucuuuuuuaacuggaaaacaaaacaaaacaaaacaaaaaccaaaaccacaagaaaacaaaaccaaaacuguaugugcaugugugucauaugugugucacauguguguuagugcccacagagcugagaaaugggccucacaucccuuucaccugcugagccaucaauggcacccaacuugcugcugcugcuuuuguaaaaugauuguuuauuaucaguugugugugcgcacacgcaagcgggugugcgcaugggcaugagugucugaacgugugcuugcugugugcagauagggaggacagagaaaaacuuccuaaaguugauucuccuccugcagggcucagggggccaaauucaggucggcaagcuuguguggcaagcaguuguggccaccggauuauuucgcucagcuuacuuuuuuuugucccuuucauuuuccugucugucugucugucugccugucuggcuauuugucuaccugucaugucuuugugugucugucuaucgugugugugugugugugugugugugugugugugugugugacagacagacagacagacagacagacagacagaguuccugugaguaucugggcauuugugugccaugugccuauuuuaaggucagaggacaaucugggugucaguccuugcugucuaccuuguuuacggcagggccucacacaguuucuuacuguguccaccaggcugccagguuugugggcuuuugggggacuccccagccuuugccuccuauuucauuguaagagcuccgacaugggaucugaacugcuguccuuggccaugcacagcaagcacuguaucuguugagccaucucccccccccgucccccuuuuuuuuguuguuuugagaugaggucuuguuauagccaaggcugaggcaaacuacccucaaccuuguuacccuaagugcugccguugcggguuuuagcuaccacacuggacuuguuuguuuguuuuuuucuucaagacaggguuucuguguauaucccuggcuguccuggaacucacuuuguagaccaggcuggccucgaacucagaaauccgccugccucugccuccggagugcugggauuaaaggugugcgccaccauacccggccugggcuuguuucuuuuaauucacagugagguugaaucuuuccccagagcuugguaaguuggucgguguccuugaguccuuguguauuuuggagacugaucuucaacauguuuauugagcccuguaccgugucagcuaagggcagagccugcugccgugcugagggccuuguggguccaggcauugaaacugcucggguguacccuggugaugucauggcaggcugagugacggcccagaaaagaucacguccagcugguccuugcuugugcaacaucucaagccaggcaggcauuguuccauguccccagccucuuagaccacagcccagggucaccuaccaggaaaagaugcucccaugcgauuuccagacuagacacccauaccuguaucuccugccaucuccuggguuccuccccucuccuccccuccccuccccugccugccuccugcugccuucuggguuuuguggucuuugcuagcagccccuucuguggccucuccccuggaauccucuaaggcuuauuucccagacaaccuagcaaggccagguguucugucucacucugacccauuuguaaugucagagcaggcuucugggacacgcccugcccccgggaggugcagugcugugccugggucuauuugccugcgcuauuguuauuuuucuggagauggggguuucauuauggagcccugaugaggaaaaaacucacuacacagagcagguugggcuugaauucacagagacacuccugucucugcacaaguuaaaggccugugcugucacuccccucccccucccccccauccugcucagcucagcggugucucucuuugcaucacccagugcuccagcuggccuaugccuguuuccugguagaacacuccuuauccauuguugacugugcccaggugucccuaaggcgucugagacuuuggacuuugaaucaggauguguucccugugugcccugucuuugaauucccccagcguggaagucuaaggaacuggugcugaguggauguuugcugacugacuaaccgauccuuuugcuuugggagggauaccuagccccggaagcugguccucugaugauggggguuugcagcagcaccugguuauucugggauugaaugacaggggacaaguuuucuagucugaauaggguucugugacaugguaggguauuccuuuguauuuagggugguucaugacuuaguguccagaauaccugugcccaaaagagucguaagugcauguggaaagagaagaggaugugguugacauuugggucgaggaaguuauuuguuaucugaugcuuuuuuuuuuuuuucccacuguugggaaugaaaaccuguuucauguaugcuacauacuggcuauaauuuugccaguauccagccccucaccagggauucuaggcaggggcucuaccacugagccacgcccccagccccucauugggggauucuaggcagagcucuaccacugagccacacccccagccccucacugggggaaucuaggcagagcucuaccacugagccacgcccccagccccucauugggggauucuaggcagagcucuaccacugagccacacccccagccccucacugggggaaucuaggcagagcucuaccacugagccacgcccccagccccucacugggggauucuaggcagagcucuaccacugagccacgcccccagccccucacugggggauucuaggcagagcucuaccacugagccacgcccccagccccucacugggggaaucuaggcaggggcucuaccacugaaccacgccccagccccucauugggggauucuaggcaggggcucugucacugaguucucuuuucugauuccuuucuuguuuaucccagcucuuguggccuucucucugcucccgggugcuuuuucuuuugcauaucucacucuucagacagaugucuguccuuccuggcauuuaccguuuauugauugaguuuguguagagaggagauggcugaggguccugcuucgaaccugagcuucgcagugcguacguucugaugcagguaguuggguggugaaccagccacagucggucaugcugugaucaacgcagugagggggguaaaugaggaaggugauggaggagagguggucagggcaguuccuuccuuccuggaggagacggaagcugaaguuguauugaaugguccaguggaagggcauugugugugcagggaagagaguguacaugccccuagggaagagauacaugugacucguaugaagagacuggacgggacaucuggaccucacagcaugagcccagagcaggggcuuggcucuucauggcgacugugagcagagccuagaggcuauagggagcuacagagcaaugugguuagacguggagccccuuggagcauggggucaggugccgcagucauguuacguuuccuugggagccaaccaguucgcagagagugaccuggagcucugccuacuggcccugggcaugaaggcuccucugaguuguuggugucuauugacaggugacacgugggacaagaaguaacccagggcaauucagucaggguauacagugggcuuguggcccugagcuuggucuacauuccaggcgccuccccuuucugaggccccagcagcaagugccauacccacagcuggucucagacacagagacugguggcacgugcccuucccauauggcugagcccuugggagugugugagccugguugauguggcaucucccccgggacaacgaagcucaggcucugguuuccaggcacagcuguggaacucuggguggcucucugugcuugugcccugccuuaaaccugcuguuccccucugagcugcacuuucuccugguuccuaguauagccuguucuagaucuaccauugguguguguggggcugugguguggguugugugugugugguguggggugugugugguguauguggggcugugguguggggagugugugugguguguguguggguguggugugugugugcgagcacgcaccugucuguuugucugugucuagagguauuuguauguauaugugucuguguucauaggggugugugucuauaucuagaggccagaggugugucuuccucaguuucuucuacccuuuuaagguguguauguauguauguauguauguauaucuauguauguauguauguauguauguauguauguauuuuggagacaaguuaccuuuuuguauccugaaacuugcucuguagacuaggcuggccucaaaaucauagcgauccaccugccccuguuucucaaggucuaggacuaaaggcaugcacuacccaugucuggcuuguguuuuuuuuuuuuuuuuaaauauggguuguagagauucaaacucaggucuucauauucucucucucucucuuucucucucuuaaagauuuuuuuuauguauaggaguacacuguagcugucuucagacacaccagaagagggcauuggaucccauuuacaaaugguugugagccaccgugugguugcugagaauugaacucaggaccucuggaugagcagucagugcucuuaaccacugagccaucucuccagccccauuuucacaguaaccacuuuaccaauccagcugucaucccagcuucugguuagaaccugcuacucuggcuguuacuaugcuuaaggguguguguguguguguguguguguguguguguguguguguguuaguucucugguugcucugauggaauauccaacgaaaauacuuaugaaaggaaggaagggagggagggagggagggagggagggagggagggagggaggaaggaaggaaggaaggaaggaaggaaggaaggaaggaaggaagggagggaguuuauuuuggcucucaugguuuggagugcaggcuaucaugguggggagguuguggccgcgggugccuggggcucauucacggagcaugggcgcauguguggucaggaagcagagaguguggaugcuggggcucaguguacguucuccuuuaaaaauguauuuacugaucugugcacacguaucugugcauauacguguaugcaggugcaugugccugugcgugugugguguguguguguguguauauauauguauauguauguguguguauguguggagaccgaaagaggguguuggaugucaccuuccaguccucuccuauaugucuuugaagcggggucucucuccagagcuggagcucgagucuuccuggcucagcuggcagacaggcagcccagcugucuuccugucuccugucccuuggagcuguaguuacaggugugugccagacgccuggcugguuacguggguguugggaccuaagcuguaguucuuagaauguugaaacagguucucuuaacugcugagccaucugugcaaccacucuuuaaaaaaacaaaaaaauuaucuaucaccugucugucugucugucugucugucugucugucugucugucuuguacacgucaaggucagaggacagcuuucagggauucuucucucuguuuaccaucuaggucccagggaucaaacuuaggcugccaggcucgcuuacaggagccucuaugcacugagccuucccuggccggccgugcgcuucucacucagccugagucagcaagggaccuagggaaccgucacaggagggaccagucagagcgagaacuccagggccccagagucaagggguguccuggccgggccgccccuccucugcccccaucugcagguggcauugcuccugcuuccguuuccccucccucacuuuccuuuccucauccauccugucacuguaaccuguaaguuaagagcuugauggcuguggcucuggggaauaggacccuuggggaccagagccaccucccucccugacccacuucuguccgcucucaccacuuaacauuggucgggguucuccuguguuggccugguuuuuaggcgcucuaggcaacccugagcgucauuucaggaagacuuccuggcccuacucucucugccucuggggacuggcccugucccauaggagccgcuuggcugucucucuagcacguuugauucugggcugucuaggcugucugggcucucucucagcucccaucccccgcuuauguggcuacacucuauccuagcucuucugaggcucuggauggcugcaucuccaucuuccccaggagaccagaaggcucugucagacucugagcuugucuugggcggggacagugcucuucaggacucugaaguuuuuggggcacagggagauagaugggggugcaggagcucaguugcugcaucuuaaguggggccaccugugaggguccugaauauggccuacuguagacccugucaagggugcccagacaggguccucagugggacuccgaagccaucuguguuggcggucucugucaccugagacauugcugggccaggcuaaggcugacuacauguaugcaggugcaugugccugugcguguguguguguguauguauguguguguauaaacuuugaucaguuuauuuauuuacugagacagaggcucacaacguagcccaaauuggcuuuaauuugcuauguagccaaggauaaccuugaauuuaaaauccuuuucuguguguauacuuggcgucccucuacagggguguagaaccucgggcugcuagguaagcggguuugccagcugaacugcauucccagcgucuucucuauaccauuuguuuguugauugcaugcauaugugugugugugcgugcucguguguguguguguguguguguguguguguguguguguguguguguguggacauguggacauguuaccauguuaccuuauauguggcaaggacagaagacagccaguaggagcugguuccccuccuuccaguacgugaguuccaggaauugaacucagguccucaggcuuggccgcaagcaccuuuuuuucuugcugagucucccugucaguuuuaauuuuuaaguacauuucuuugggcugcagagaugguucaguggccucuagggcuuguuguggaggaggacccaacauccuucucugggcuccucuagcacaucacacagacauggguguagcauauacauacacacauaggcacgccacuuacaugcauaaaauaaagaugaaagagaauggcaugagcuuuguguguucauguacauguauggguauaggcaugggagcugcacacguggagaucagagggcaucuuguaggaguccaggucucucccagaggguuuagaugauuaaacuugaacucuggucuucagccuccucuuugucccccucccccuuuuuuugcugggguuaaaggcaugcaccacugugccuguucgauagauuuuuauuguguuuaaacuugugucugcuagugugaucacaggugagagugacagacaugcuucuggggugggagggauaguugggaaguuuuggggccaaagaucccucagugggguucaaggguccuaaagggcuguuguugggguugccagaggguuucauaggauauacguggagggcgggguggggggagagguugugagaggugucauugggaguccggacuacugcuggcuggggauucacugccaccuuuggccuccagggcauggccggacugaugaugagugugaucgagccaggcaucgggaggaucggcugcuagggacacggcuggaccgggaccaggagaaguugcuccggugaggacuuuggggcccgagagcgcgggcugggggcuucuggaguagggguguugaggugaccucugcgcucccucuaccaugguccucgaucaccuuaggcuugucuguccgcgugacucaaggucccuccagccacuguugaagacccuuagcuguucccaggcgcuacgugccugucagcucccugggcuguggcucucguucacccccccccccccaucccuaggcuaccagcuguucccauacuguuucucuuugcagagaaaguaaggagcuggcugaccuggcccgucuacaccccaccagcugcgcucccaauggccugaaccccaaccuuauggugacugguggcccaacgcuggcaggcucgggacgcuggucugcugauccugcugcucauuuggccacgaaccccuggcugccacgcucggguaguacauccauguggcuugccggacacccuuauggugaguguagcuugagggaagacugggaccaaguuagucuuucucugacucccaguaaggugggagugacguauguguccccagucugccugaacucuuaagguuccuucugggauucucaguggacaucacggacuauggugcugucagcgggcugagacucuccugacauuuguauaaauuuggcuuucucccccuaggccugggaccccccucuuugcaccagggcauggccccugcauuuccaccuggcuuagggggcuccuugccgucagcuuaccaguucgucagggacccccagucuggccagcuggugguuaucccuagugaucaccugccucauuuugguaagugacccuugagucacagccagggacuuuccuggccacccauagggauggaacagcucuguauaugggguggggacaaggggguccagggaagccugaaccucaguugugucuugggaauuucaugagaauuuaguuagggucaccugggugucccugucccuuuuggggcucacucugcagaccacggagugugugguucccaugguggcagguuggcaggcuccauucuauguggggguucgggcagcgcugcggugcccaucaguguagggugaggggugguguuccuuauccucaguguaggcugaggaagccauguuuguugugucugcauuggaucgcagugucucccucugaaaacugggugggagccugcacaggaauggaggcuaugauguagcucccuguugucugucuccgcagccgagcugauggagcgcgcggcggugccgccccucuggccggcccuguacccaccaggccgcagcccacugcaccacgcucagcagcugcagcucuucucucagcagcacuuuuugaggcagcaagaacugcucuaccugcaacagcaggcggcccaggcccuggagcugcagcggagcgcacagcugguggugaguccuggccccguggugcccaguggugggaggcagaugcccuaaguaagccacacugccugaagauaguggcagucaggaagggcucccugugggaggaagcaucugagcagagacucugguugucauggaugacacccagcacagcaccccaugagcaguggaaaaaaccaagacaagaguugaccuguggggcuggugagauggcucagcgcucaagagcacugacugcucuucuggaggucaugaguucaaaucccagcaaccacauggugacucacaaccaucuguaaugagaaacauaaaaaaaucugugggccggagugagccgggccagagugagcugggccagagugagcugggccagagugagccgggccagagugagccgggccagagugagcugggugggggacaagagggagaauggaaguggaguagggggaguugaccuguggauuagagauguuuguacugggaacacccaaggggucucagaggguccucucugucuuuggauaguuacuuccauggucuagaagguucugcuuccaggaaguaaggguacuaguaguuaguuacucaguccuuagguccagggggccacgggaguggcaagugugcggaguggucuuguguuuuggguaguagcugcugggggcccuguaaguacugcuuacccuagagcuagguuucucauguugcugucaaauaaaugccccagugauuuccuguuccccacugaggugcuugcaugaugagacuuaguacugaguagguacuaagcgcuaagugccaggguauggguucucccauuauuguuaauugcuuuuacugugaggggcccagcugggccaggguccugauggaaaucucugccugcauggugucaaggaguuuuaggccaugguuccuccucguaccacccaggacuccguggguucuauagaaccugcucuccggguucuguagaacaucacguuuauuacaugcgcaccaugguagaauucugugguggauugauuaccuuggggaggggagggcuggguggccuggaccucggaucucgccugauauuuucuggaguggaaagcaccagggacugggcaggcgaugguucccgccaugccgaccccacccauucucccguuccucagcaggagcgguugaaagcacaagagcaucgaacggagauggaggagaagauuagcaagaggagccuggagaccacgggcaaggccggccugagugccgcaggcccugggcuccugccucgaaagucugccggccuggccaacggcccggcaggcagccacggcaaggccgugagcccacccccgucuccccgagccucccccgugaccucucugaaggccaaggucauccagaagguggaagaugugucuaagccuccagccuauaccuaccccgccacaccuagcucgcaccccagcagcccaccaccugccuccccaccuccuaccccugggcucacccgaaaggaagaggcucccgagaacgugguggagaagaaagaccuggaguuggagaaggagacgcccaguccguuccaggcccuguucacaggugggaauguaggacaacggcugccuugcccugggacacugcguuuccgaguguuuauuggcuugguuuccccuucagcuugucuguucauaugcucguucauucauucauuugcuggcucacucauuuauccacuggauccauucauucauucauucauucauucacucaguccuuuuugcugaguacucuguagagcccacugcccaacucugaaaugaaugcaacugagauuucuucuuggucccuuguaaguggagugcaggagacauaggccugauaguaucccugcaggaugcucagggcacagcaaaaagccagaccugggaacuccguauguagucacccugggaacaucagcgguucccaucugggcagccuccuugacccucacacauguuguuccagcgccugguagucaucaggacuagccgcagguggcuuuuggguauaugucugcauuucuggggaccauaaagacugugaaguuguauuugggaggauuuggguucagugccguguugcacggggacuggccugcucuggagcccuuuggugugaugcuaugcuaaggguugacgcaugccuggccuggagcauacgccggcacacgugugcuccguucccuaggcuccuccugcugggcacugcccaggugugugucaggcuuaaagcugccucggucauuccagccggcccugacacugaggcuuaaacuguauuacugugaaggauuuugcucuguuguguuuugagacagugucucccuauguagccuaggcuggccuugaacucacagugcuggaauuaaaggcaugugcugccaugagaguuuugaacacaugccuuauuggugugagauacagccugggcugacugacagaucuucauagagcuuguuuaagcuucugguucaguuuuuuuuuuuuuaaagauuuauuuauuauuaugcauaaguacucuagcuuauuuacuucagacacaccagaagagggugucagaucucauuaggggugguugugagucaccaugugggaauugaacucaggaccuuuggaagagcagucagugcccuuaaccacugagccaucucaccagcccccuucugguccagucuugauucaucuucaugaggacaagaagguggcugcagacuuugcucucaaggcucagucggacauguagaaggguccuggguuauuucagagggcaguggaggugaggcaggggaccacugcucccuacccugcagcuugucuagcagggaacagagccuuggggagccuccuucacugacaucuucuguccuugacagauauuccucccagguauccauuccaagcccugccgccgcacuacgggcgacccuaccccuuccugcugcaacccgcugcggccucugaugccgauggccucgccccagaugugccacucccagcugaugggcccgagcgccuggcacugucuccugaagauaagcccaucugccugucacccuccaagaucccagagccaccucgggacagcccagaggaggagcagcuggcugaccgggaggugaaggcugaaguugaggauaucgaagagggccccacagaacugccuccccuugagucaccauuggcccugcccgucccagagaccaugguggccgugagccccgcagguggcuguggagguaguccucucgaggcccaggcguugagcacagcagguccgggcugccgggagcccucugaaguuucagacuuugcacagguugccgagccgcagauagaacuaccgaguaagacagagcaccgcaugacugcccuggaguuggggacacagcugacacccgagccacugguagagacuaaggaagagccgguggaggugccccuggaugugccgauggaggagcccaccacagaggcagggccugaggacagucugccccagccaucuuugacugagccucagcccagccuugagcucucagacugugauuugccugucccagagggccagugucucaaccuggaggcccaggaggcugugccugcuccugccaguaccuguuaucuggaagagacccacuccgaaucccuccugccuggccuggaugacccacuggccggcaugaaugcacuggcagcugcagccgagcugccccaagccaggccucugcccuccuuggguccuggagucccagccggggagaagcuggauacagcccccagccucguccuggaacacagcuuucugcagggcaucacccucuugagugagauagcugagcuggagcuggaccggaggggccaggaggcugcagguaagcauugggcugaaggcuuccaagacucuuauucaguggugggggugcaugccuuuaaucucagcauuccugaacuaugacuugcuuguuccagagcucagugucugaaccuggaggcccaggccuaucucugugguucuaguaaggccaacuuggucuacgcuacccagaucuucagaguagauuuacacauuuagguuguuuuuuguuuuuuguuuuuuguuuuuuuuucuuaaaaacuucaaagauugccagaauauguuuuauucacagauuuuuuguuuuguuuuguucuguuuuugcuuuuaauuauaaaauaaggcuugguggcauaggccacccauccaucccagcuacaugggagccugaggcaggaggauugugaguuuaaggccaguuggauuagagaauagaaggccagccaaggcaacuaaucaagacccuguucucaccauaaaaaguaaaaagagggcugagguguggcucagugguagagcaccugccuagaaucccccagugaggggcugggguguggcucagugguagagcaccugucuagccaagagggucuugguaucauccccagaagugcaaauuaaauaaguaaauaaauaguccccuuucugguucaagugucaguugggauaguagagugcuugcuuuagccauugaccauggguuccauguccaguauugaaguggagcuaggagcugugagaaacguguauaaccagagguuccauugugauggacuuaagcccccaggcccacccccuccccccugugucuuaugaaagcaagaguuuugagcaggugggugggauguuggcagcaagaggggugacucuguggguaaaaaggcaccuaucuugagcccuggaacuuauguaguagcagaggaaaacugauucgcaaaagauguucucugaauuccacaugugugcugcggcuauguuagauccucugcaauucccccaacccacccauccccccaaaaaagagaauuuaaaugcucuuggaaccgaaguugagcaaucaggaccuaacauuaaguagagucuggguacuuaagucgucuugagucuuuuucuccugugauuauccgguugguucuuccuuuuucugccucugucuccuguucuacuuuucucuguugaccucguuuuuugccaggcucguucuccucacuggggcuuccaggaguuccucccaugccuucuggccugcucagcugggcugagucuguaucuuucccagaaauucuaggaagaacucugagacaccucauccugggcccacugggguucaugcuuuuuaguacaaaaagccuggggagucggcaccaaggguaacgcccuguugcgugagugugaagaucccuagaacccaucugaagcuagcuaggcgugcaugccucugaaauuccuugguugcuccaacagaauuggaggcagaaggagaagcauuccaggaauucaguggccuuugagccuguugucuacacaagaacaagacauacuuucucagauaaggagggagacugacaccugacuuguguguucuguagggguggggccacucaccuaugaaugcacacaugcacacacaaacgcacacacaugugugcaugcacucacaugcaugcaccugcacacauguacacacacacacagaggaaguccuuuuguuuggggagcagggacugcuuucaugcaccucuacacuggaccccuguugcuuuuuugaggaaucucucccaauucuacuagugacaaacccccaaaucaaaggccagccaugagcaacaucuggacccaucucucagucacccccuaguagugacagccacaagcugaugugugugccugggccccuuugacuagagaguuucuuucauucuuuuuauuauuuuuuauuuuaaagacagauaugaagcccaggcuggucuaggaguuagagcaauuccccugccucgucuuccugagugcugggauuguaaauaugcuguagaccuauccagucauuuuucuucuguuuguagaugccugaccuuugccugucuuuguuuuuagacuuugacucccucuggaagguucguucucguucucucucucuuucucucucucucugucucucucucucucucucucucucucucucucucucaaguuagggccugcccuaauaaucucuacccucuguagaaaccauuguacauaggccacacccccuugcgccugguuggucggaaugucgcauaccugccgugcugguauuuagcaggcugcagcaggaggcucucaagaugacuaggauucacauccaauuugcuaaguuaggggucuggcuuggaaugugucuucuggugcgcuuuggaccaaccaggcuggcugugugaagggagaaggagcaggcaaacagccguccccuucuguaauuuggcuuccaccauccucugcccccauggggaugcugaagccauagggguggggcagaacaggcuggcccacuucagucugaugugcuaggaaccugguggguucacugcugcauggaguucauuuauuuuacaaauaaaaccugggcuggagagauggcuuagcucacaagccaacauacaagcauaaagcccucccgcuggguggcacagggcugucauugcagcugugagagccagucugaagaacuguuguaaagcaagaaggucugaagcuguagcucaggguacagugggugccacacagagcccugguuccaucucuuguucuguauaagccagguguggugggauagccugucacccggcagaacccagagugucuggggcucaaagucacucucuuguguccaggcuagccuugacacaugaggugcugucuuaaaaacaaaaaagaaauggagacaucuuuaggaguccaaggccagccuggucuaccuaagugagucccaggucagccagaguaaaacaaaauaaacaaaacaaaauaaaaauucaaugauuauauaaauaaaaauaaaaaauaaaaccccaaaccacugauuuuucaaugagcgaggaggagguuuuuuuuuuuuucuucuuuucuuuuuugucaccucuguuggcagcaguaauucugguuguaaccgguucaggaagacacuguugccaucuaguggggagagucagggaggcuucagugauugauggagcuuguacaggacaguccccagcagaguccaucccgcauuaggaacagggcugcggagccugauuauuguuaagggcugggauuacucacgcucacccucuaggccuucagacacggggggagguuugcauuuuuuuccucaagcacgcaaaacugguuaacuuugagacuggaaaaaaauaucaguucgaaaaugcaaagugaaccaacgagacagcucagugagggaggugcuugcugcuaagccugaagaucuggguucgauucucuauaacucaggaugcaaguagagaaccaauuccuggaaguuguucuuugaccuccgcauacacacuguuguguauauagcacauuuucuuucucucuguuucucuuucaaacacauacacgugcacauacacacacgcacgcgcguguacacaugugcgcgcacgaacacacaguaauaaguuaaaauaaaaauaaaauuaaaauaguaagacacggugguugcaagucucuaauccuagcgcuucggaggcugaagcaagaggccugugaauuugaggcagcccuagcugaauucagccaggcauggucucacagagcucaggaagccccaacuccuuaugcaacaaaggauaaccuugaacuccugacccccccugccucugcuucugggguacugagauuacuguugugggccaguaugccuuuuuacauggugccgggaauugaaccucaggcucagugcuugcugggcaagcacauuaucgacugagccaacauccccagcccuacacuguguuuuaguguuuauacgggaggcuggguguguuaggaauauuggaacacgagaguacauuccugaacucuagcacacacggggucacauccucccccagaggagaccugugcguguuggggcauuacaccuuucuccuugauuucugcuuuuuaagauacacguuuuuguguguaugugugugcaggcacauguguguuaguguuaggggcacaugccguggcacguguguggaggacugaaaacaaucucuggggucucuuuucccaucacacccugcuugccacaggccaugccagguagcugauuaggacuucuggaaaauuuccucugccugccuccugccuccgcuuaggaacacugcaacuguaauguguuacugugcugggcuuuacccacguccuggguauuugagcacaguaagccuuucucucagccaccuacuucucuagucaaguuugugcuuuuuauuucucucucuuuuauucuucuuccucuucccccuccccaccuccuccuccucaaaggguuucucuguguagcccuggcugugcuggaacucacuuuauagaccaggcuagucuugaacuacuagagagccaccugcuucugccucucaauacacacacacacacacacacacacacacaauuuuaaguguguguguguacuguguguacgugagugcugguacaggaggcuuggauuucucaggagcuggaguuacaggcggcugugaggugccuaagugauggguauuaaacccagauccccuuuaagagcagaauguccccuuacccgcugagcugucuccagccauuugugcuuuccccccucccuggaauuuauuuguuuguuuggaaagagggucucuauauagccugaacccaguccuccugcuggggugacgggugugaaccacaccugguucccuagaccuguuuucugaugugggacacaacauauucacuaaggagaaaucaaguagagacgcguggggauauccauuguccugggaaggaaccucugcuaguguuugguuacucagaaguauuccuggccuuucacacacagugcacuagaccacaaugcuguguggcuguguggcccagagccagggcugacuauaguaucugggaguuuaaucuggccucuugauggcuggcugcauggguacggccaucuugcccguggucaggucccagcacugacuucccugaccucucucccuuccccagauccagagccaaaccugguggugcgacccucccucgaaagccugcuggcagccagcagccacauguugaaggaggugcuggagagccccuucucagacccgcucaagaacuugcggcuuccgcgugaacugaacuccaauaagaaauauagcuggaugcagaagaaggaagagcgggugagcccuuguccucccuuccucccggaggccugagaggcagaggcagaugggcaggauccgaccauccagcuaccuucaccuuuuugcuauguggcccucaguuggucaucuccccucucuuggcuuuccuauuguucucacacggugucaggccuguccuguggguacugugugauggaucagcaugaaagcauaauggaaaugaggccugggacuacccuuuucugccuuuguggucucagguagcuugaaggacagacuucgaaccuguguguguaaauaacgcacuuguuauuuaucucauuagaccauuacuucuggguaguguuuagucgugucaucuuaagugugggugccacucggcaagguuggcauuaggcaacagcaagugcaaggcuaagacaggaggauaugagaguuccaggccaggugaugcuacuuagugaauuccacaccaaccugaacucccaaguguaaugccagaaacccuagguuugagcucagccucggagaaacugcacauggugguguucaccugugaucucaguacucaggaagaagagacuggaagauuagacguugaaggccagccugggcuauaugagacauugucucugaagcaaaccaagcagaauagggggcagcaaugggauucaagcaucagcagacagcauuccccuccucauuugucucccucucucuccucccgggaccccuugcagauguuugcuaugaaaucuuccuuggaggacauggaugcgcuagagcuggacuuccggaugcggcuggcagagguccagcgaagguacaaagagaaacagcgggaguuggucaagcuccagagacgccgggacucggggugagugucucucuccccaguuugugccccauccuggauagcugguccguaggucgacuuugguaguggucaggugugugcguggacccaagugccccacuccgcuucccgcccaccccagguuccuagccgagccugugaauucuuuuuaagggacaggcacgaggaugcccauagaagccuggcacgcagaggcccuggcaggccgaggaaacggacccacacccugagcgcccugucgccccccugcaagagagggaagagccacagcaguagcggaaaguaaggcuggccccuccccucgguggguugcggacugacugguacccagcucggaggggaggagcagggccccccuggacggcgcccaccgcugggcgccaggggaccuggucgugccuggcguucugaucccugaacggcagcucccagggagcccggacugcugcccuguccaggagggugagccaagaggagauuggaaagacccucaguggcuuaacucuaacccgaacucuuggccccgccuucugccccaaccacuuccucaccauuggagacaaacuucugcuucuuuccauggcuccucccuaccggaaguaccauccaacuccaggcuucuaggacagucuggauacaacacuguccuccugggauuccacaggagaccagggcugcucucuggggacaagguccucuuggguggcacugcagccauuucagagggguccuccugagguugucuugauugcuggcugggaugagggcucuuuuucuccagggcuaggcaucugccagaugggcucagccccccugcauacguguaagcaggccagauguggugcuuaaggaaagggguugguacaucagaguggguggauucuaggugcuuguuucaagugcuuggaaacaaaaaguugucuuggaguggccacaggcagaguaguaggauggucguggucuugucaugagagaauggcccccgucuugcggcaucuuauaguuaaccuuggauguuccugacuggaagaagaacaagaggugaacauauguccaucgccagcagcaggagacggugaacaagaaaugauggggaauagauaaagcagcccgggucaucagcagugcaggcccaggaacccgaaauguguuacugauuauacuaagcuuacugauggggucccggccccaccccuccugugacuuuggacaggcauuagcuuuucugagccuccaguuucagcuuccucauguguuucaaaaaaaacaaaaaaaacaaaaaaucaaaaccaaaccaagaaaaaaaaaaaaagccccaaaccccaaaagccagucaugaguacucuggggcuagagcgugccagguacagugacuggcuagcgugcacaaagcgguggggugcgguggcccagaccugucaccccagcauuugggaaucaaggcagauucacaaauugagagacacuugucucugugucccugcucuuuagacaagggggcuaaugcaggccuuccccuuccucccaucucucuguguauagauuaccuuaagauuucccaaacuuagcuuuuggugcaauuuugguaaagauaugacuuacucugugugugugucugugugugugugucugucugucugucaccccaucagggagaggcugauggaggaugcugacuuggaaguuuuuuuuuucuuuuccccaucucucugugcacaccauucacuagcauuaaccugucuccccacacugauuauccuggcauccaccacccuuucuucuuuuuacccggagagcccaacccuucagggccacauggguacauuggccuucccuguugcccgugaccuggccgaggugcugacccucaugguguguuuggcuuucaggcugagcagcaaguccuugcugacaucagacgacuaugaucugggagcggggauaaggaagagacacaaggggcccgaggaggagcaagaggcccucaugggcauggggaaagcccgcagcaggaaccagagcugggacgaucacgacuccucaucugauuuuaugagucaggucaguaaacagcucagccuuguggauuuacuuacugggacaaaggucucaacuuggaggaccauagguccuaccugaagaacucaaccuucuccaugggggucucuugagcccugcuucuguagagaacugguuagaguuagcuuccucacugcugggagaaaaagaaggcccaaggaagaucaaggaccuggcaaaggaacagggggaggagguagggcuaaaagcuacaucaucggguugugugcgcugagacuucugcuucggcaggcgggagguuagagcacacgugcguaaccaaauagcgguagcuccguuguuuagcaguguaauuguuuaaugagcaccuugcuguugcacuugggcucgaugccauugugauucaggcugacuucugcagggguaauuucucaucgcuacagagccuugagacugugugcucacggaccgugauucugaaugcuaauguucugccucgugaagccuugugggaaggggaucuuuugauugauuuuugucaucagaggggaaaugucacguaaaaggacuggaugggggagguagucaguuugggggcuacggagaggcucaguggguaaaccauuugauguucaaguauaauaacuggaguuacuauaagcacugguggguguggggguugaucugugauuccucaucuuaggagguuggcuccugagagcaggcaggacagcuggcuccggaucuuguucuagcuugaaugagaaaccccgccucaguguauaagguagagagagggaaggaggaauauacccacugguacucuccucucugccugcgugcauucaaugcauguauguccccugcgugcgcaugcaugugcacauguacgcaccccccccacacacacaccauacauauauacaaaaaaauaaaauuaaacuaaaaaagauaucaggucaugguggagugugcagguccagccuggucuacauaacaaguucagccagggcuuccuagugagacccucuuucagaaaaauaaaaucuuaaauaaaucagaguguaagauaaaggcauaaaaagauugcugguuuuuguacaccaggaucucuuuucuucucaggucauggugagagacgcuuuuguuaauuaucucaacaacaccaucccagccucuccccugccuccugcaaucgcugccugauuaaagauacagagcuagcgcacagaaauggcagagcguuaaugccuuugaaacugcacauuucauuucaacaaaugacuaccguuggcgauaaacgugcaaggagaaauuuaaucugugaaaucucuaaucauucucccugguccaggcauccaaggcacacuccgggcgggcguuuucuuggcagcucugaccuguucaguuggacaggcuggucccgacugagcagcagccuccggcagcugccgugggaagcggagacggaaagcagaucugccccacucugggcuguuuccagcccuggcugguucauccagcuaccuucuccaacccaucuguagccugcuucuucagaguucuauaggcacugucaggcagggcuguggaaagccaggaugggaaggcgggugccagccaggauuguugccauggcaacagcuuuuaauaagugauuacuaggccaggcaucuuuaaaaccuuuaaauuuuauguguauggguguucacuugcauguaugccuguguaccacguguguucacggcccguggagaccagaagagggugucaucuccuggaacuagagucauagaugguugugagccaccuugcgggcgcuaggaaucgaacgugggaccucuugaagagcagccagugcucuuaaccauguaguuauuuuuccagaccccagacaaggcauuucuaguaagugcuuuuauuuauuuuauuugugguuuuuuuuucgagacaagguuucuuuguauaucccuggcuguccuggaacuuacuuuguagaccaggcuggccucaaacucagaaauccgccugccucugccucccgagugcugggaucaaaggcgugcaccaccacgcccggcuguauuuguguuuuaaaaagacuuauuucuguuaucuauaaauuagugcauccuaugggagugucauguccccugaagcuggaguuacagggggcuguguguugggaacugagcuuggguccuuugcaaaaagauuacaggaucuuaaucucugcaccaucuaacuccucacuuuguuuauuugugugggggaugguggugcagucguggguguggguaugagugugggcauauguggguguauggggccuguguggguguguggguauggguguauaugggugggugaaugcggguauaguagguguguaugggcaugugggggugugagcguauauggauguguguggauguggcaguguguugugaguggguggguguauauggguguguguguguagguagguagguaugggcauauguggguggguguggguguguaugggcaugugugaguggguggguauauguguuggggauguauggguguguucauguaugcaugugugucagguacccucagaagucagagucuguuuucuccauuaucuggguccuagggaauugaacucgggucaucaggcauggugaccaguaccuucaaccugcugagccgucucacuggcccuaauaccuguuacauggaccuuacuucccugguugucuaucuucacgauggccucgugaugcucagacacagccccauuuuagauggaagggcugaggacuaguuaagcaguuuaccacgucuaaaggguaugggaugguaguuagcccagucuccuaagcaucucaaccugagacucacuuugcuauuugguuguaugucuuaaacugugaccuuccuuccuuccccagcuaaagauuaagaaaaaaaagauggcaagcgaccaggagcaguuggcaagcaagcuagacagagcccucucccucacaaaacaagacaagcugaagucacccuucaaguuuuccgacggccccgggggaaaaccgaaaaccggugggggcuguggcagguucuugacacaguaugacagccugcugggcaaggacaggaaagcacuggccaaaggacucggcuugucucugaaacccuccagagaagguaaacacaaaagagcuuccaaagccaggaagauggaggggggcuuccaggccagaggccagcccaagucuguccauucuccauuugccucggaagucagcagucagucuuacaguaaguacagccuugcgcuucaccgcauggugaacacucgucuuaucugcuccuaaucucucuugcccuccucugagggacuucaggguuucuugcagcuuugcccugugccugaggcuagaugaguggcccccaaacugggaauuucgccauugaguggcagauguauugcuggacagauuggugaucggugggcagaagcagauguuagucucuggccuuccacuggccuacuggaagccaucguugugaagaccuugugccaucgaguugguagccacuuagcuuagaguccuggagaguaacuucuuccaugggcuagagaugauggguuccuuugccuguaggacgcgggucauuugugccauguguguccccguucacgugucuacacacccauacacauguacauagccacacacguguacacaccuacacgucuacacauccacacacccauacauccauacaugccuacacacccacacaugcguacauacccacacaucuacacauccacacacccacacauguauacacacccacacacguguacacauccacacacccauacauccauauaugccuacacacccacacaugcguacauucccacacaucuacacauccacacacccacacauguauacacacccacacacguguacacauccacacacacccauacauccauauaugccuacacauccacacacgcguacacccccacacgucuacacauccacacacccacacacguguacacauccacacaugccuacacauccacaaaugggagaagaaaguaugagccuaaguaggaagagaugaacuggaauggaccaggcccuguuugauccacuugcccauuacagcuggcugucguggccagauguguucucacuuggccuugucuacuacaguagccaugugugacuagggagcaagggauauggagaagccuacaggaccaaggggcugacugagcuuuuauuccaucuaugccuguggguuuuuaaagcaaggcaacucuccuuggccugugugugcccuggcccucugcuugacaggggaauggguacacaccuguucuguguggacagguaucugaugucucaggcaggcaggaacaaggagggcaggaguggcuucucccaucugguccgugucacagagguugacuugguaucugcaggguuugcauauauugcgucagauucgcuguguuuuagacuuggcuggacccugguuccugagagguguguguguguguguguguguguguguguguguguguguguguguaugaguuugaaugucaacugaaaaaaaaaauaacacguguguuucuucuccguuuuuugcugguagugcugggaaguugaucuggauagagcuggaucuagacauugccaaauaggagugcuucucuagccccgaguuucccucuugugucucccacuccuaacaguugcuggucugaacuugaguuuucaaucugcuugccuccaccaccugagcugggauagcggaugcgcgccaccgcgccuagcuuccuuugugugcuuugcuugcuuuuugaaaaaugauuugugugugugugugugucuguacaugggugugccugaaggucagaauaggguguuggauucuuuagagcuggaguuacaggcgacugugaguuaccuaccacgugguugcugggaacagaacaaggguugucuagaagaacagaugcuuguaacugcugggccagguccucaacucagugcuuccucuucuuucccuccccucucccuucccccgucccuccuccuccuccuccuccuccucuuccuccuccucucucccucucucccccuucucucuccccccuuccccccacucuuuuuccagggucucaugguguagccuugaauucacuauauagcuaaggcuggccuugaacucccagagcucucugccugcgccccaccccaccccaagugcuggcacacaguuuaaacucaugguuuuaugagcuuuggaguugagacauuguucuaggcuucccgggugugaguagcucauauucagagaggugggcugugcuggccauaggguuaaguugcuguguugugugaaucauguacuuuguuuuuuuuuuuuuuggggggggugucuuugaccugugggucuucaggaccaaugaugcuccaauggguaugaggcccacccaccccucagccuuaugcaccaggaacauguuagauggcgauagcggcagugccccucacauccagauacaucuggauggcuuggucacuuagucucugguccugaacaggugcaaggagagaaggagcuggaaaggcgcguggcaaaaguggaagggaacaguggccucuugcuuuuccaguuggggcuggaagacaugaacgucaugucauaccugauguauuuuuauggaaggccagguugguggaaugucacuucuagcccucccuggccuuggaaggaacaaguuagaacacaugagaggggauggugguucagugguuggcgcuuaagguguaaacuugcgaacuugagugcagugcacagaaccuacaauggaaggagagccaagaaccaucucacuuccacguguguguugugaugcaugugagugugcccgcuaaaacacacacauacacgugcacaugaacauggggagauauuaugguaaaggacuggugguuuggugagcacccccugaaguugggguccugguugugguggagaguggaguuuaucgguacagugguguuagggauaccccugcccuugcauguuucucuuggacuugaagauguuaggcacugccaggcuccaacuguauguguucgcauuauuuuguucuguguggguuugaagcagaucaaggauuucugucuugucuuuggggcccuuucuucucgccuuggucagcagcccagcagcagaucaagaugguguacauuugggguugaaguuggaagggaccaagagucucccuuucauugggcucauuucccaauccugguaacacagcggugcguuuagaccagagccuuagagaaagaaagccaucugcagucaacuggucaaccugcccuccgauggaaaggaggggcuagggaggggcggggcuggcuacgcaguaaugccaugggugugagugagcacccucaccugcagcccggaucgaucugcucuugcugagaagcugaacaaggggcugagaagaggugccuagaauuggucccugucaacugugucuucucaaaacagccacugggcuguaugaaauguaucugcaggguggaggcaagcacgugcucucagccaguagguaucguaggguccuccuucugaaugcugcucgaauguuaguuuucccagcccugugauuggagaaguggauguacccagggcaggugacagcagcagcggaaagggcccgguucaccucugagcagucaauccaagcugugcacgucagaucagaggagagcugggaugccacacaugcccaggguucuaacacauuuguggcccaggcuacugacaggaagaaagacccagguucaauccucagccccagcacuuacauaaaaggcaagcggggaggugcaugcuucugacaaggaggcuaugggggcucccuugcacggcaagccccaggucccaucgagagacugucucacaaaacaagguggggucagugagaaggagaaaaggcgcaggccaccauagccgaguucaauuccugcgacccauaaacuagaaaaagagaacagacucacucaaguuguccucugagucucucguguguucccuggcacaguccuguccccagacauaaacacaggcacacagaacaaauuaaaacacagcaacauuuuuaaaaagaugguggguacuugaggaucuaaggucaagguugaccucugguucccauacucauucaugcaugaacacacacacauacaaacacacaugagaacaccuacauacacacaaauaaacaaauaaaaccuacuuuaacugcagauacggacucugacgaagacgaagacuuccugaagaaugaguggucugcccagggccccuccagcuccaaacugaccucgucccuccuguguggcauggugcccaagaacagcaagccagccacaggcccuaagcugaccaagaggggccuggcaggcccccggacuuugaaacccaagguggucaccagcaggaagcaguccuucuguuugcugcuccgagaggcugaggcccgcuccuccuucagcgacucuuccgaggaggacuccuuugaccaagguuacuagugccaaacacaaaauaaccuuccauguuuuuagagcgagagugggugggagagagagagagagcaagagagcaagcgagcgugcgagagugugugcgcacagcagggauggcuguagccgucuagguuuuuggcagcguagccugcccuauccgccuauauuuuugguuuguguuugcuuuuuauuuuuacuuaaacuugugauaacacacuagccagcccuuagggagcucuuacacggacuuguuuuuuagucucccagaauuucucacccuccucccucugcacuccacuaguccuccccaagggcccccacccccccaccucccagauccaaaagcccaaccuuaccuucuccauaccccaggccggccuggguuuucucuuggcaugagccuggcggaggcuugcccaaggaacauuuuguauaaaaacaaaaaaacacaaaaaaacaaacaaacaaaaaaaccccacagaaaacaaaaagggacuucucgugugggacuuggcgugugacuugcuguuuguacgcgguuuugguaaugccaagcuucauuaaacauaccgaguucauuuuuaacuaaacugugugccucguuucucuugcuauguccuuaacuagacguuagguugccguccccccuccguucaucccucccucccccuccucucuccccgcucuucguccccacucuggaagccacgggcaugguggacugccuuucuguuauuccaauaucccugguaucuccggcacucauuccauuucucggguguacaguccaguguuguaucaucuaucuguuuuguuuuuuuuuccuuuuaagcugcuugucuguguuuuauuuuucuggaagcuucugcuacuacccaccugugguuuuuuuuuuuaaauaaaaaaaaaacacaacaagaacaacaauuaacuuaucaguacuuguuugcuaacacaucuuucugcuuugaagggcaugcgggcagucaaggccuauuggccgucuccuugauuuugguguuuugggguuuuuguuuguuuguuuuuucucuuccuuguucaauuuugaaaguguuggcucgguugccauguugagggucaaaaaugcuauuucuugggguugcuggacugaggucugucuggccucagcucagccuaggggcccaacaccaaaagaacauucuggcucccacuuuucuaacaccagaauuguagcccacaguuagaaauucgagagcccgcagacccuucaaucagaaaaugucccugcaagggaagaaacugggcaucaccccuuagccaggggcugcuucaggguaacucguuagagcuagaguuugaaaguccccagauggauagcaccgugucacuguuccauguccugaggggaggaggggucauagcaaccugggaugggaccauaacuuuguuugagcccucugggaccaggacucugcucuuauuggccagucuuccuucaguucccaccuccucuccucgcacaccagcaguccaaauuggcagaggcgaguuuuggggugaccgagugacgucacacggggaccuggugccuuuugggcuguuccuguaauaccggagccaagcacaaccugggccaccaagaggcugucugccuucuguggaugagucugguuauuccccuauucccuccucaugaucuggggugguuaccucuacccuugccuaccagcccuuagagucagggucccagccuugaaguuuuugagcugcuucuguuccagcauagaccacacagaaucaagcaucccuagugcccucuagucaguaccaagggaugcuagcccagccagagcauguggagagaugagggccagggcauggcucccaccccuuugguacuaaaacacuugauuggcguggcuuuucuaguaugucugcuuucuccucccagcagcuugaccaucccuccaacccuugaccccuacccaugaugcuuugagugucuguuucggucucucgcauuugcucucacgcugcacuuggacgcaaagcgaaggcugggaguagggcagacggcguagcggguuacugaguuugaguccgagccuggcucguugcuccguagguaggcaaaaaccauuuuccuuuucuauucucuguuuaccucccccuccucggggucugcccccaccgggucuggcagcagcauaucacuuugacuuuuaucagguuuugggaacucaauuacccucgcccugagccaggauuuaaaagaauauuuauugacaugaaaguuuuuuucccccuccuccugcauucccuugagucuuuguugggacuuuucucccccucuacgcuuggcaagcucuguggauccagguauagacaauuccagaaauucuugaaacccugaccugcaaggucucucaggucuccuuguccucauagaugcugguccagucagagacacugcaugagucuugucaagcaccucauccugagggccacaggagaccucaggauaauucaguuucccucuugaggaaaaaaauaccccaacucuggguuucugccuucgcaucaaauugcugagaccagcuugcuccuggcuuucugggaucugacaauggcccucagaaacccagagcagggacucacacuugccucccugccgaugaagccuaccgcccaagcguccucauggaaagaaugguuaggacuuccacagccgagcagccaggacagagggggagucuuuagaaaggggaaauucccgauccccaaucccagccagccacccuucccauccccugcccacccuacccaaauuggccaacuccagggagcccugaugugagauuacccaggcugccggaaaaaaaaagucugccuacacuuagccugcuuugccgcuguggcccacuggggcggagacagaaccaugugacgucgcaaugugauugaucgcaagugcgcacugccugccugccccugccugccccgcuggcauccccagccugcuucauccaucgcucugggaacaccucccuccucgcacccucuuaaccaacuucccccaccucucccucucuccccuucucucuaucuccuacgcagaccuuccuuagauauucccaccucccgucccaagcuggcuggccuggcaaaagcuaggauucccugucauagacucgcugguuagaacucuauccucugcacagcuggugccaccuuggccgcuagcuuaucuaaccaagccguggugugggccuuagcaggaaaagcaguauuugaucaccuuuguccagcccucacaccuaagauguguguaucuuaccauggcuuaccagaccagaguagccucucagcccuaccugggccccaguguacaagcccucaagguagaucacagcugguguuuaccugcuccuggguacugcuucccuugaaaccuuaggguauccuuaccaucuggcggagaguuagguugcaugccuaggggagugcugaguguuguuuucugugagccagccccauugcccauccuagcagggguugccagccuuugagccaguggggucaguugcuggagugacacuggccucugccccagcagagaccuggcuggacgacuuuagucuccagugcugccugaggguuuggucuuagggagccucccuauugcugagugagcuggucugcccuccccccagggcagucugagcucacucgugguauuguuucucuuucuuucuuuuuucucucuuuucuuuucuuuccuuuucuuucuuucuuucuuuuuuuuuuuaaagguuuauuuguuuuauguaagaguacccuguaacuaucuucagacgcaccagaauagggcaucagaucccauuacagaugguugugagccaccaugugguugcugggaauugaacucaggaccucuggaagagcagccagugcucuuaaccucugagccaucucuccagccccuuuuuuauuuuugaaguagggucuuacucuguagcccuggcuggccuuaaauucacaauccuccugucucagugcuuagaccacagacaugggccaccacaccaggcaaugccacguaggaugcagacccucuuagcuggguuggaggguuagaaggucaccuaugcucagagaggcucccuagcaugggggggugcuagguucugccucugcucagggauaagacuuugguggugguggugggggggucccuagucuccaggaagagaucaaauucugcuuucugccaacagcccuaugaccucuggcugaucaagacacuccaggccccuugucuagacccccuagccugaccccagcccucccuccuccuuccccucuucugccucucuucuuuccugcuuccucucucagccuccacgucuaugucgggguguguguauguguguguguggaccgugacgagcgcugucuccugucuuuguccaucugugugucuguccuccccaccuacagcacaggagcaugucggugcugcccucccagaagcccauccugauacccagagcuaccccucucccuuccccaggcugccccugugugggugacugguagaggccuugggccuugggugggacugugggcugguucuggacccuucccccggcgacccuuggugaagacagagacuggagccaugguggguggugggaggagguggggggcaguacgcacccaagucaagacucucacucguuccuuguuuucugcaugccagaugacagcucagaagaggaggaggaagagcuagaggaagaggaggaagacgaggaagaggaaggcauugguagcuauaggcugggugcuggggaacaggcccugucgccaagccuggaggagaguggacuggggcugcuggcccgcuuugcggccagcgcucuccccagcccugucguggggccgcccuugucugugguacagcuggaagcugagcagaaggcccggaagaaggaagagcgacagagcuugcugggu

SEQ ID NO: 2778 - RNA, 1326 nt, Mus musculus
uuccggcgcacggugaccaagacuuggcucagucccgccugucccucugcuccuucccugugcagcccagggaacgguaagggauugggccuucucagccaccaccuccugcgugucaccaugggguacccccugaagucgggcucugcuagagugccggcuggguugcaccgaccuauaucuuccccagauaaccagcgucccuaagaucuuaaggguucaccacagauucaggcuccuaaaacuguggucacuauucuccuucauucucccacacccacccuuggaggcguggaaccgccggggacgcggcuacacacagggacauaacccaagacccaccagugcuugccaagaaaaagacccauacgggagcggcugucugucuccugggguguggagcugacacgcuguuuucgcgccuacagguuuuuauuuauuuauuuuuauuuuauuuuugcaaacuccucuuccucaagagcccucggacugggaucccccagagugguugugacugcagacacuugagccucaggaggacugagacuaucugguacacuagggacaggucugucuuccuggagaccgaccucugcgcuagcagcugagcgagccuccugcacacccuggugaaaccggacagagacgcccagcuccagccgccuagguuugaccugggcucccgcccuaauauccccaucaaagcuggagggugggugcuagcacagugcgcaacacuuacccgggugcgggugaagguugagaccggccauguauuucccgggcggcgggggaccuggcaagcccgaggagggcaagcguccggcgguggccgcgcccacgcgguggcuguccauggccaagccggacagcagcggcggcggggggccguggacggaccgcuggggcccgaaaucucggccauccauccuccgcgggagugccgcgaucagccuccccacccggcccgccggccugcuucagugggacuuaaaaguucggccucgauguaguccuaguguccucggguggcgggcgcuccgcggcgugcauggcggcggccagcggggcuugcgcucaaccacgggcccgcggcccggggcgcaugaaccgcccgcggugaguccccuccgggcggcugagcggagaugaggaaggaggcguacacgguaucuuuggugagggaagaccgcggaagacacagaagagggaagggggaaaaggggaggggaaagagaaaaaaaagaaaacaaguuucagaaagucgccucgcccuucaggguaggagaguagcgaaccgagcugguggccagaaauaaaaucggg

SEQ ID NO: 2779 - RNA, 1326 nt, Mus musculus
cccgauuuuauuucuggccaccagcucgguucgcuacucuccuacccugaagggcgaggcgacuuucugaaacuuguuuucuuuuuuuucucuuuccccuccccuuuucccccuucccucuucugugucuuccgcggucuucccucaccaaagauaccguguacgccuccuuccucaucuccgcucagccgcccggaggggacucaccgcgggcgguucaugcgccccgggccgcgggcccgugguugagcgcaagccccgcuggccgccgccaugcacgccgcggagcgcccgccacccgaggacacuaggacuacaucgaggccgaacuuuuaagucccacugaagcaggccggcgggccggguggggaggcugaucgcggcacucccgcggaggauggauggccgagauuucgggccccagcgguccguccacggccccccgccgccgcugcuguccggcuuggccauggacagccaccgcgugggcgcggccaccgccggacgcuugcccuccucgggcuugccaggucccccgccgcccgggaaauacauggccggucucaaccuucacccgcacccggguaaguguugcgcacugugcuagcacccacccuccagcuuugauggggauauuagggcgggagcccaggucaaaccuaggcggcuggagcugggcgucucuguccgguuucaccagggugugcaggaggcucgcucagcugcuagcgcagaggucggucuccaggaagacagaccugucccuaguguaccagauagucucaguccuccugaggcucaagugucugcagucacaaccacucugggggaucccaguccgagggcucuugaggaagaggaguuugcaaaaauaaaauaaaaauaaauaaauaaaaaccuguaggcgcgaaaacagcgugucagcuccacaccccaggagacagacagccgcucccguaugggucuuuuucuuggcaagcacuggugggucuuggguuaugucccuguguguagccgcguccccggcgguuccacgccuccaagggugggugugggagaaugaaggagaauagugaccacaguuuuaggagccugaaucuguggugaacccuuaagaucuuagggacgcugguuaucuggggaagauauaggucggugcaacccagccggcacucuagcagagcccgacuucaggggguaccccauggugacacgcaggaggugguggcugagaaggcccaaucccuuaccguucccugggcugcacagggaaggagcagagggacaggcgggacugagccaagucuuggucaccgugcgccggaa

SEQ ID NO: 2780 - RNA, 3374 nt, Mus musculus
uggcuuucuaaaucaaguuccauuuauuagagauuuuccacaugcuacagauuuacauagaaacacccauucagaauguaguuugucagcaccauagugacaucugucacugccagauaccaaccacaggcaguucucccagcuggacaggagucagggcggucagucaucaaaagggagggaauggucacuuagcaccuggucucaaggccuuucuccaugcccccaaacaacacacugaacucaguuggugcucggggaagucacgugcaguagaucacagucaguaguagcgaagaggcuucgagcugacaggggcuuuugacaggggcuucgagaggacaggagcucuugugcacacacauacagacacaccuacugaggcaugcccacuccuccugcuguggaaacccuggcucguacacacaugccuugcacagcaccccaugaucgaucacagagcuagugcucccccugcucccucccaaccccaccccaccccaccccacccugcuccaccccagguuccaaguucugaagcagaucccaggccagcauuagcagaggcagccucagggacccuggccucucugaacagcagcccuaugaagccugccaggucgggcagggguugggguagggugggagguacagccaagcuccgggucugaugaugcucacucgcuggugauccuucugagggauguaggugcuaccacuaagcagcuaacguaggagcuaggccuagucuagaaucucaugcagcauuaacacugagccugcagaccucuaucauauccuacaaccccaaacacagaugagaccugucacaaaaacccaacaacagggcauuggauacuacuaauaacuucagguaccaaugaaugggucacauucacaggaagaggucacagucugggacucacugcugguggucauacuucaugccccauucaaaauuucuugucuccuguuucuuuauaccccauucaacaccaacacacacacacacacacacacacacacacacucucucucucucucucucucucucucucucucucucucucucccacuacccccacucugaucuuuauugacauagugucaucucaggaagcccaggcuagcuucaaauucauuacauagcugaagcuggccuugaacuccugacccccugcucccaccuccugcagucugggaugagaugcacaaucacacuuggcuucucuuauuuuucccuuagaagaguucagcagcucccagucuucaaagggguagguagcaguggacgcuggagagagaggcggcaugcuggccccucuuggagugggcgugaggguggcgguccauccugcuugaggccuggccuuuggcaccaacagccccacugcuuaggcccaucuuucccucagaccccuacggcccuagacuggcccaaccccaucaucuugcuaaguauuggcuuuuaacucugggccugauacaguagauagucagagaaucugcccuggaugcccaaacgugaagcuaccgguggauucaagugucugggcccagcccuuccuagucacagccugggccuggaccucguggcccuauuacagggccucuaggggccacuggcaggucagagccugucccugucauaucaaagcagagcccucuucaaucuggccaguaagaguccucccuauaaaaaucaggaaaauggguugaggacccagcucuauggauagagaacuuguuucucgaggaccggagcucagagccccagaacccacaugaagccaggcaugguagcuacaucugucaucauugaaugcccaucgagggacggauggguggagacagcagagucccugguaguucaugcgucagcuagccugguguauacaacagcgaacaaaagacucugucucaaacaagguggaggugagaagagacacccaagauuguccuuugcucucuauacaugugccauggcacacacagaccugcacacacacgcaugcgcgcaugcacagaguuuuaagaagaaaacaggaaagucacucagugagccugguuugcugguuugcgccgagcaagaggguugggagacauggcaucaaaggcagcacacaaagcacagggucuagccaggcagugguggcgcacgccuuuaauccuagcacucggaaggcagaggcagacggaucucuuugaguucaaggccagccuggucuacacagugaguuccaggacagccagggcuauaccaggaaaacccagucucaaaaaaacaaaaaccaaaccaaaccaaaccaaaccaaaccaaaccaaaaacccacaaggucuggaaaaggaagcaaaaacagccaggggugggccaaggcagggauucaggcagccuugggaggucaggggcuuucuguuuacaaaggaugaauucccccaugucugacccuccuuaaugugaaacacaccaccagaagaugcaggcguagacgcaugcacacaggcauacacauauacauguauacacgugcagguacaaguacacacacgcucgcgcacacacacacacacacacacacacacacacagaggcccaagcgcucaccgugcucucagcaggcagcauauggucugccacuuaacagcccaguccugccaaucagggaccauuaggguggguucuuuucccagcgucaaaugcugcaggcuauaaauuucgauuaacaccagugccaaaauagcacuuagcgaaaauaagcacgcuauugacaucugguggauccuguccccaguggaggaggagagaaaauucucgcuugaagucgaaggagacgcugagaauacaaggccuacuaguugggggugcuuccucaggcagucugcacccccagccuccugugcccaggccccucccugucagcccaguuucugggcauaaaaaaugccagaggcuagcacugcugguccuaagaacugccuauccacaggauugacagaauggcucuggcuuuuugaauaacaucccaggagaaaagugauuuccugucugaacggggcugccauuuguuuggguuuuuguaguuguuuuuuugagacagagucucuauauagcccuggcuagacuagaacuuacuaugccgaacaggcuggccucgaacucacagagauucaccugccucugggauuaaaaccuucaccacuacuggccgggugugguggcacacaccuuuaaucccagcacucgagaggcagaggcaggcggauuucagaguucgaggcuagccuggucuacaaagugaguuccaggacagccagggcuacacagagaaacccugucucgaaaaaccacaaaaaaaaaaaaaaaaaaaaaaaaa

SEQ ID NO: 2781 - RNA, 3374 nt, Mus musculus
uuuuuuuuuuuuuuuuuuuuuuuuugugguuuuucgagacaggguuucucuguguagcccuggcuguccuggaacucacuuuguagaccaggcuagccucgaacucugaaauccgccugccucugccucucgagugcugggauuaaaggugugugccaccacacccggccaguaguggugaagguuuuaaucccagaggcaggugaaucucugugaguucgaggccagccuguucggcauaguaaguucuagucuagccagggcuauauagagacucugucucaaaaaaacaacuacaaaaacccaaacaaauggcagccccguucagacaggaaaucacuuuucuccugggauguuauucaaaaagccagagccauucugucaauccuguggauaggcaguucuuaggaccagcagugcuagccucuggcauuuuuuaugcccagaaacugggcugacagggaggggccugggcacaggaggcugggggugcagacugccugaggaagcacccccaacuaguaggccuuguauucucagcgucuccuucgacuucaagcgagaauuuucucuccuccuccacuggggacaggauccaccagaugucaauagcgugcuuauuuucgcuaagugcuauuuuggcacugguguuaaucgaaauuuauagccugcagcauuugacgcugggaaaagaacccacccuaauggucccugauuggcaggacugggcuguuaaguggcagaccauaugcugccugcugagagcacggugagcgcuugggccucugugugugugugugugugugugugugugugugcgcgagcguguguguacuuguaccugcacguguauacauguauauguguaugccugugugcaugcgucuacgccugcaucuucuggugguguguuucacauuaaggagggucagacaugggggaauucauccuuuguaaacagaaagccccugaccucccaaggcugccugaaucccugccuuggcccaccccuggcuguuuuugcuuccuuuuccagaccuuguggguuuuugguuugguuugguuugguuugguuugguuugguuuuuguuuuuuugagacuggguuuuccugguauagcccuggcuguccuggaacucacuguguagaccaggcuggccuugaacucaaagagauccgucugccucugccuuccgagugcuaggauuaaaggcgugcgccaccacugccuggcuagacccugugcuuugugugcugccuuugaugccaugucucccaacccucuugcucggcgcaaaccagcaaaccaggcucacugagugacuuuccuguuuucuucuuaaaacucugugcaugcgcgcaugcgugugugugcaggucugugugugccauggcacauguauagagagcaaaggacaaucuugggugucucuucucaccuccaccuuguuugagacagagucuuuuguucgcuguuguauacaccaggcuagcugacgcaugaacuaccagggacucugcugucuccacccauccgucccucgaugggcauucaaugaugacagauguagcuaccaugccuggcuucauguggguucuggggcucugagcuccgguccucgagaaacaaguucucuauccauagagcuggguccucaacccauuuuccugauuuuuauagggaggacucuuacuggccagauugaagagggcucugcuuugauaugacagggacaggcucugaccugccaguggccccuagaggcccuguaauagggccacgagguccaggcccaggcugugacuaggaagggcugggcccagacacuugaauccaccgguagcuucacguuugggcauccagggcagauucucugacuaucuacuguaucaggcccagaguuaaaagccaauacuuagcaagaugaugggguugggccagucuagggccguaggggucugagggaaagaugggccuaagcaguggggcuguuggugccaaaggccaggccucaagcaggauggaccgccacccucacgcccacuccaagaggggccagcaugccgccucucucuccagcguccacugcuaccuaccccuuugaagacugggagcugcugaacucuucuaagggaaaaauaagagaagccaagugugauugugcaucucaucccagacugcaggaggugggagcagggggucaggaguucaaggccagcuucagcuauguaaugaauuugaagcuagccugggcuuccugagaugacacuaugucaauaaagaucagaguggggguagugggagagagagagagagagagagagagagagagagagagagagaguguguguguguguguguguguguguguguguugguguugaaugggguauaaagaaacaggagacaagaaauuuugaauggggcaugaaguaugaccaccagcagugagucccagacugugaccucuuccugugaaugugacccauucauugguaccugaaguuauuaguaguauccaaugcccuguuguuggguuuuugugacaggucucaucuguguuugggguuguaggauaugauagaggucugcaggcucaguguuaaugcugcaugagauucuagacuaggccuagcuccuacguuagcugcuuagugguagcaccuacaucccucagaaggaucaccagcgagugagcaucaucagacccggagcuuggcuguaccucccacccuaccccaaccccugcccgaccuggcaggcuucauagggcugcuguucagagaggccagggucccugaggcugccucugcuaaugcuggccugggaucugcuucagaacuuggaaccugggguggagcaggguggggugggguggggugggguugggagggagcagggggagcacuagcucugugaucgaucauggggugcugugcaaggcauguguguacgagccaggguuuccacagcaggaggagugggcaugccucaguaggugugucuguaugugugugcacaagagcuccuguccucucgaagccccugucaaaagccccugucagcucgaagccucuucgcuacuacugacugugaucuacugcacgugacuuccccgagcaccaacugaguucaguguguuguuugggggcauggagaaaggccuugagaccaggugcuaagugaccauucccucccuuuugaugacugaccgcccugacuccuguccagcugggagaacugccugugguugguaucuggcagugacagaugucacuauggugcugacaaacuacauucugaauggguguuucuauguaaaucuguagcauguggaaaaucucuaauaaauggaacuugauuuagaaagcca

SEQ ID NO: 2782 - RNA, 3312 nt, Mus musculus
uauagauuuauuuuauaugcacgaguguuuugccuuuauguaugucugugcaucauguguguacuaggugugggcagagguucagaggagggaguuggagcuccugggacuggacagcggugagcaucauaacccagguacuuucucagagcagcucugugcuucuaggugcuaaaacccugcaguccggccucaggccccggaccgcuguugugcuuucuggcucggggaaucggauggcuuagaguagagugggcauccgugcuggacacugagcccccaggucucccguggcucacggagcacugugccuucccagcuguguccucagcucacaccccguuaacggcugaccucugguucaguuuccaggccgagaggcccgcguugaacgucgucaucuucccccugcuccacgagggccugacagaugucauccgagauguccccaugcugcaccuggaugagaucaccuuguucaaaagccguguggcugaggaaccgcccaaccuaugguggugagaggacccuggccagcccgcccaccacuccugcuaccacguccaccacuccugucgccagagccucuucugucugagucuccacgagggugcccggagccagcagacaguaaggccuuguuccgugacaggaagaaaguuuccaguucuccugagacacucaccccagucccccgggauucucucugucacucucaugaguacagugacaagaaguaaucuggugagccauggacgaaugggccguggaugagccaggcugcccuucagggccuggcugugcuggggguggggggaggauuugugggcugcgguccccaguccucucgcuugcuucagcuuggggacucucgccugcuccuuuguucauggccgucuacacuuaagcucagucaugugaccgcacccacgugcagucagggugggccgggcugucacugugaaauucucgaauguugucugugagccuguggcuccuuuuccuguugagcuccauuuagggugugggccaguggcagagcuagugugugcgaggcccuggcugccauccccgccacaaaaaaaaaaguuuaacccauugaugucuccaggauguuuucagcucagugauacuuguaccagagaguccccugaagcagggacugugggguggcuucacccccaaacugagccugaggaguugagccugugucucacaaguggucaccucuccuuacagucggugcuguggugcucugaaugccuuccaggaacacugcaaccgcuggccccauuaagauagcugaauacgguaaaagccagcguuggguguagguuggagcagggagcgccuaccuguuuaguccuuacaaaauccaccaagagcacugcuuuaguuagugugugggcauggaccccagguuccauccccagaauguggugccagcacuccagaagucaggacacaagugugagucacccucagcuacauaacugauguagaggcuaaccugggcuacauaagacccuguuucaaucucagcaaaugaaaaacaaaggccagacaaagcuagaggaggagccagugucuguggcuucacgccagcgagacugagccaguagccccuggagggacgucugagagcguguggugugugggagcgugugguggcaucgauccacugacucccaccugggccuccccaggacgggcuccagcacguguggacauugauccaggugguuuccagccuagaccaccucaguccgugccgugccgcccaccaggccucacucacugcuggugaccgccccagacccagccugcccucacaucuccugucucccggucagcaucccuugcuggugaggagcagcgcuagacugugccuggggagacccagcucuggggacaguguuagggaaacagcccucaggcccaggccccaagaacugugccucugucuggcccuuggcauucuagcuucaguguuuacauggggucuccagugccaagcccucuccccucagccagccucuugccugagggaauccucgauucucuccggagcccacagugcucuucccuguccuguggcugagcgaucuuaacuccuagccagagguauuggucugucugcaggcugaucccagggacacccagcccacacccagagcucuuacccucccagucggagaguucuaagccuucccugucccuuccugccacugcaggccauuggacugacugccaagguuccagggggcagacugaagucccacauggcuguagacaagggacccaaagauaguggaacccacuucuuccaguugagaagaagggugagcaugucuuuagaacauuaagcuggcaccugaggaccacccauaggcccuccaggacccacugcugcuuguccuuaagaugagaauguggcuggucccagccugugaugggagcaggcugcuuggagguaucuggucccaagaauccuugcgaauacuuccuuuaaaggcagccccccucagcuggcugugguggugaagggguuuuuuguuuguugguuuuuuuuuuuuuuuuuuuuuuuuuuugugguuuuucgagacaggguuucucuguguagcccuggcuguccuggaacucacuuuguagaccaggcuagccucgaacucugaaauccgccugccucugccucucgagugcugggauuaaaggugugugccaccacacccggccaguaguggugaagguuuuaaucccagaggcaggugaaucucugugaguucgaggccagccuguucggcauaguaaguucuagucuagccagggcuauauagagacucugucucaaaaaaacaacuacaaaaacccaaacaaauggcagccccguucagacaggaaaucacuuuucuccugggauguuauucaaaaagccagagccauucugucaauccuguggauaggcaguucuuaggaccagcagugcuagccucuggcauuuuuuaugcccagaaacugggcugacagggaggggccugggcacaggaggcugggggugcagacugccugaggaagcacccccaacuaguaggccuuguauucucagcgucuccuucgacuucaagcgagaauuuucucuccuccuccacuggggacaggauccaccagaugucaauagcgugcuuauuuucgcuaagugcuauuuuggcacugguguuaaucgaaauuuauagccugcagcauuugacgcugggaaaagaacccacccuaauggucccugauuggcaggacugggcuguuaaguggcagacc

SEQ ID NO: 2783 - RNA, 12851 nt, Mus musculus
ccgccgggcuggcuuuguggagaacugcagcgggcuaagccguguugaacaaaggaggucgggcacagcuauccaagcucccggggccaccgggccgcccuccgccaccaugaccgccaacggcacggcagaggcugugcagauucaguucgggcucaucagcugcggcaacaaguaccugacagccgaggcguucggguucaaggugaacgcauccgcuaguagcuugaaaaagaagcagaucuggacgcuggagcaaccucccgaugaggcgggcagcgcggccgugugucugcgcagccaccugggucgcuaccuggccgccgacaaggacggcaacgugaccugcgagcgcgaggugcccgacggcgacugccgcuuucucgucguggcgcacgacgacggccgcuggucgcugcaguccgaggcucaccggcgcuacuuuggcggcaccgaggaccgccuguccugcuucgcgcagagcgugucgccggccgagaaguggagcgugcacaucgccaugcacccgcagguuaacaucuacagcguuacccgcaagcgcuacgcgcaucugagcgcgcggccggccgacgagaucgcgguagaccgcgacgugccuuggggcgucgacucgcucaucaccuuggccuuccaggaccaacgcuacagugugcagacguccgaccaccgcuuccugcgccacgacgggcgccuuguggcacggccggagcccgccacgggcuucacgcuggaguuccgcuccggcaagguggccuuucgcgacugcgaaggucgcuaccuggcuccguccgggcccagcggcacccucaaggcuggcaaggccaccaaggugggcaaagaugagcucuucgcccuggaacagagcugcgcucagguggugcugcaggcggccaacgagaggaacguguccacgcgccagggugaguuggggacauguccccucccuuggguccugacccagugcacaaaagcaucucugcacuccuucuauuucccuauuuccuccugggcucccuuuaggcucacaggccucugggcuccgccaugaggaggugggcuucuauuuugaaagaucugaucucaccagauagccuuggcuauccuggaacucgcuauguagacugggcuggccccgaacucgcagaaaucuuccuuccugucucuugugcugggaauaaaggcauguaccaccccucuguucaggacguaggcuucuucugcugggagaaggugacguggggaaguggguaaggccuaacacauucuaaagcaauacuguccaccaccaccccccccccccccggcugggggcgugggacuccauagaccuagcuuagaucuucuccguuuccucuuccuucccagucugagccauccccauucaugagccgauucuuuaggauaggcugucccaggucuuggagaggaaggguucccccuacacccccccuuguucauuuccucgugcguccucucccguuucgcgggccuuuggcuggagggccaggggacagucaccccugcccuccccgccuuaaauggcgagauagaggagguuggaggggcuuuugaucccggcggggugugcugggcggggucggcccugcgacucuuggugguggugggguuguccguaggggcuuccccucccccacuccaucuccccucgcuaaggccuggcgcuccgggccgcggccuuugugagcaggggggcgggucgccacggcugggcccucccucguccccuuuguccugcuaaggcucugcagaugggaaaaccagaugcggcggagcugggggaggggaucggcuuaggcgggucccucugcggaagagccacccccaacccuccaggcguugucccugguccaggguucauugagaaggcgcggagugaagccgccuggcucuuccuucgcaccccggcuggcaggcggcguggcgcggguggcugcgcgccaggcgcccucccugcccuccuaugcacgccuugcgguccggcacucggcggagugucccuccaaaagccucuacucucgagugaaccgguccccaaggccucucuggcugggaacaaccguuugcagcucuauuuguccccauccagggccuccagcaggcuggcaggccauuuccgaccggcaugggcaugguacaaguaggcgccuccuuucuggcguacccccgacucuucaaagggucuuugcugccugcugguaggggcuugugagaucucgcuuccuugguugggaaacugaaccccaggcuuuggagauagcuggaugggagccagucuguggggaggaagaccccccucccccaaugcagagggcaaagccuuggguggggccugcuugaguuuggcugaauaacgcucagaaaagugcgaccauuugcuuacuguuacacaguaagucagcaccaugcugaacuggguguacuugaugccagaauguucucucauuauacacacacacacacacacacacacacacacacacacacaccaaugaaccauggccucucuuguuucacagugcugggcgagggggucagaguucccaccuguuuagcaaacauugagauacgagcugcgguaaacgucucuugggaaugugacugguauguaaagcagaagauuggggguacaggaucgggguaguagauuauaaagaucuggggucccuucugaggacccaggagcugccccaggagagugaauagaaaugagcaugcaccaaguuuauggacugguuuugcaggcaggggccucagcaaaggcccggaggcagggaguugcaaauagagaagcccugcauagcuaggaggaaggcugggauuggagggaauccugcagaugacgaguacuccagagccuagagagaccagcucucugcuuacagagcuguggccgaggcuugugcccuggggaagguuaggcaaggcacaggugacuugggcccuuggggccugaaaggagcuagaggguguguuuugcgagccuggacagguacccuuuucugagggugccaugauugugcaugauucacacugaugcggcaggagggggcgggaauugaaggggugagaaucugaugggaacuuggggucacacacagucagaccucuucugcccuccuaugucuggguccaagucucauucccaagucagccaacuccucccccggcuuuuugagggugagcuguugggugggugugccggggaggccauuuugggcaggcuugcguggcagggaggcggggcugggcuucggggaaacacguguugaacugcuagccaggaguagggagagggaaggcucaaucuggucugggguugugaaucuuccaugcagauuugcugcuuccggcuuccuggccucaguuuccccaucugaaagcacagagguacauugagccaggaucuuccugggagguggagauccuaugagaguaggaugggggguaguggguagggucuuuuccuccuugcuucucaugacccucccaagccccugcuggcucaaggagaccccgugcuaugucuccccacacugcccacccuggcuuacuuguuggguucuaaugcuuucaaagaauuuuguccccaucauuucuagggcggcuggcuaagaaugagugacaggugaggcugggcuuuguaggguauccuuuugacggcuucccucuugggucgaggaauggcuuaguuuugagcacuguacgacuuugggcggugaaguccuggaggguucuaaacuaagccgccuucuggguugugaggauugcuuauuucgaacaacaacgcuagggagucuggcaaacagcuaagcccaggaaggggguugcggguuagaggacccucugagucaccgcagagacgccuaggaagcuggaagacagccacgcccccuccgugggcuccuaggagccagugacucagguuuucugugcugcugcugcugaaaaaaaaaaaaaaucccacagaaaaccuguuaccauagcaacgcagcuccaauaugauuccaaggccaaguggggccuuucccccuggcugagccuuagagggcccauucuggaagggggcuaacuucccuuuccggcugaggugggagggcccaccaucuccuuggcaacaggcccucacguccuuucacggucccaacagaauugagaggcgauucuuuuuggcaagggagggaaacugaggcagagagcggagaagacauuccccgaagggugccuggaguccaccuuuggugccuugguggccucuuuauuaaaaagugguugcacaggccccuuuguuccaguaccuggagaugagacccacauggugaggcccuuuuuguucucugucuggacgucucauuuuucagagguacugggagguugaagguugguguauguccacagcacugugcugucuugaacucagugcgcaugacaucuugggccagggccucuccuuugugugagggaagcuagcaugcugggaaacuccgacuccuuuaguccacccacuuuaguuguaguuuuugucuuguagcccaucuggcuuccaacucuccauccuccugccucagucuccagggugcggcgaugacaggcauaggucaccacaggcuucuggccuccacuugaugguugccggaguggcugggaguggcuuuucuuuucuuuucuuuucuuuucuuuucuuuucuuuucuuuucuuuucuuuucuuuucuuuucuuuucuuucuuucaggcaggguuucucuguguaguccuggcuguucuggaacuauguagaccaggcuggccucaagugcugggauuaaaggcgugugccaccaucucuuagugggguuuuuauuugugggaauguggggauaaaaccugaggccugggcggugguggugcacgccuuuaaucccagcauuugggaggcagaggcaggcggauuucugaguucgaagccagccagggcuacacagagaaacccugucucuaaaaccaaaaaaaaaaaacaaaaaaccccaacaaccugaggcuuugugcaggacacaugcucuaccacugagccacaccccagccccucacugggggauucuaggcagggguucuaccacugagccacaccuccagcuccucacugggggauucuaggcaggggcucuaccacugagccacgccccuagccccucacugggggguucuaggcaggggcucuaccacugagccacgccccuagccccucacugggggguucuaggcaggggcucuaccacugagccacgcccccaaagccaguuuuucuuucuuuuuaaaaaaaaauacauuuuaaaucuaauuaccuuuaucagugugugugugugugugugugugugugugugugugugugugugugagagagagagagagagagagagagagagagagagagagagggagagagggagagagagagagagagagagagagauugggacugacuggucccaguucuggcuuucccugacuguuccauuccccgcagugggcacgguuagaucagguggggucacuuaggcucgcuagcauuggguguggcucuuuucugcccaguaugcugugcuaacucagcugucccugcacguggcaggucaauuacagguaggcugaggggacagugggugacacccuguauauguguagccaauuguucucuuaauauuuagccaucccuagugugggccaggggcaggagagccauuucugccugagaagguugaacagacuacagcccagagcuguggccuugggguggcugucuagccugggauggcccuccuacucuccucugugcuucagugguagauccuguggaggcacugggccaggguccuuggggaccuaucauggaagccaugucugcugauccauaugucuagaaggggaggcaucuguccauccccacuccugaagucaagggaccccuuggucuugcagggugaccuugggccaaggccagccaccucugagcuccaucuucugcuuugugagguagagguaagagccuuuggcauugacaacacagauagagacucgguugggucaggguggcauuggcuggcauacucuuggguguagugucaacuaaggaugaguuccuaggggcaaggcugaagguggcaucuaccaucccauaccacguucugcugccuaaggacgccugaagacaacugugagacuggcaguguacacugcuuccaagcugaggacauuguuagaaucccagauccuugaaacaaugaguuuaucuuguuaggacccaagaucccacuccuagguggagucaaagccuugggagcggcaccuuauuggggcucagugaggucaugugacauggaaaccauguaguguuacuauguagcaagaaguuagaaagccaugcaacaaaccuguaauuccaacuccugaggcagaggcagguggaucucugauuucaaagguagcuccagauacacugugagaccuucucaaaacaagacaagcagacuggagagauagcucagagguuaagagcacuggcuacucuucuagagguccugaguucaauucccagcaaccaguugguggucacaaccaucuguaaugggauucaauacccucuucuggggugucugaggagaaugacaguguagucacauacguaaaauaaauaaaucuuuaaaaaaagaaaagaaaaaugaaaagggaggggggugauggagacauggcucagacaguuuuuuguuuguuuuggcuuuuuggugucuuuucuucuuucuuucuuucuuucuuucuuucuuucuuucuuucuuucucucucucucucucucucucucucucucucucucucucuuucucuaucuuuucucuucuugucuugucuuguaucuguguagcagcccuggcuacccuggaacucaccuauaggucaggcuagccuugaacucagagaucagccugccuuugccuuccaaugcuggguuaaaggugugcuccagcacuguccacucuggaccacuuguucuuguauucaccuaguucucacaggguggcucaugacaguuccaggcgaccugaccucuuagggcaccaggcacaugugcgcauauucauacacacaggcaagacguucacacacgauacauacaauacaagacguaucuuucuaaaaauuaaagaaaauaaaugagaagcgagagggaaaggagggagagccacuguuuggacuggaccaccacuggcagggaaaugccagaagguucagacagcauucaggguuuguggcuggugggggcagggauaaaggaggaguuuucuaaaggaacauguggucugugcguguguguguguguguguguguguguguguguguguguguguuacuagggguagacuccagggccuuccaccaugcugggcaaacaauuuacacugagcuauauuuucgacccccucuuuauuuuauuuuuauuuuauuuuauauauagcucugacuggccuagaacucauuauguaaacuaaggugaccucaaacucacccauacucaaaugagauucaccugccucugccuccugagugcuagagacagucaugaagcaccacgcccaccuucucuuuaaaaaaaaaaaaaagccuauugcuuuuguuuuuauuuuugucuguggaggguggugcccacacccaguggugccaguuuggaaucaguucuccugcccuauucuaccuagggaucgaacgcagguggguagguuuggcagcagcugcuuuuaccccacgagccaucucgcuggccuguagcccuuugugugucugucugucugucugucugucugcauggaguggagucucauguagcucaggcuggccugcgaguuaugaucuuccugacccugguauccaagugcggagacugcaggcucacucugccacgcccuuuuacacaguucugggauggacucugcaugucaagugaguuauagccacggcccuauuuuauuuuauuauuuuugagaucgggccccacucaucauggaggcuaaggucggccuccugaguggugggaugacaggcgugggucgaugugccuggcuccuacucuauucuuuuacuuucacacauacccacuacaggaagcgaguagcgagcccccuuuuaccagcaccccgccaugugacauuccgcagaaccagcgccaucuguguguuuauucaaugguuuugguuguauuuaaagcaaauuccccacacuggugcuucuuacccagaaacgccuccaucuguagcuacaaaaccaggccauuccuuacauaacggcagcguugccuaacuggaaccgaucuuuaagacccaauccaggcccacgggagaguucugcuaggccuuagaacaucuuugugggugguucguuugaaguuugauggcuuccuuccuccccugcuccccuuucuccuugccauuuugggcacuagaguuuaaagaaacccgccugccacugaacuaaauccccagauuuuuuuuuuuuuaaguuuuuuucgagacaggguuucucuguguagcccuggcuguccuggaacucacucuguagaccaggcuggccucgaacucagaaauccaccugccucugccucccgagugcugggauuaaugucuuauguaucccagacuggucuugaacuuguggucaugccuggaguauccuauuuugauuguuuauguguauaccccuaauauggaugucagagauucauaucauaugugccgucuuuggucauccuccauacuuuugggggauguaugggggcagggauggagucuagccugggcugugguaacacacgcuuuucauuccagcauuaaagcagagauaggucgaucucugaguucuaggacagccugggcuacacagggaaauucugucucaaaaaaaaaaaaaacaaaaagagagaaagaaaggaaaagaaauaagagucucccuauauagcccuggcuguccuagaacuuauuauguagaccacgcuggucuuggacucacaacagagauccaucugccucugccuccugaauguccacucucugcuuggagacaagaaucgcucaguggcccggauucagggauucagcuaagcuggcuggucccugagcuccaggccuccaucugucuuggcuucccugugacaggauuaucggcucaugccaccgcgccuggcucuuacaccauuccuagcgaucugaauuuaauacucuauggucaagccauccuucaaugcucccuccccuccuguugagacagagucuuacucacucgguagccuggggucccagaacucacaguuagucucccguuuguuuccugaguggugagaucguuccuggcuagccuuggcugcugauuugguagccuggucccgcccacugcuuaggauuaucacugaggaguuuaagccacacuucaggaagcccuguggauccuggaaucugagugagacaagggucacacaguggccugaccggcucuggucucucucugcaggaauggaccugucagccaaucaggaugaagagaccgaucaggagaccuuccagcuggagaucgaccgcgacacaagaaagugugccuuucgcacccacacgggcaaguacuggacacugacggcgaccggaggugugcaauccacugcguccaccaagugagugacacccuacaccccuucaucaccuggccuggcucuucccccaggacugggcagccugcucgaugcccccacguugccagccccucuucucuuccccaggaacgccagcugcuacuuugacaucgaguggugugaccgccggaucacucugagagccuccaacggcaaguuugugaccgccaagaaaaauggccagcuggccgccucgguggagacagcagguagucacuugggggcacguacccuaagccuguuucccuaguaccccguggucaaccaucagucccaccuggaccucucuguguguucagggaaucccuguaagcugguguacccucaggccagcagccugugacccuuagcuucuugguaucccucucugcugagccauucccugacuggcccaucuuuguugcugugaagcucacuggcucccuuucccuguggcaggggacucggaacucuuccucaugaagcugauuaaccgccccaucaucguguuccggggggaacacggguucauuggcugccgcaaggucacgggcacucuggaugccaaccguuccaguuacgaugucuuccaguuggaauucaaugacggcgccuacaacaucaaagguggguucacugggugaggaugcaccuggccauucaaagccgacauuagggaacggguguccuaugaccgccugggguagccccuccccccuugucuuagaacuuuccuggcccaaccugggcagacagcgaaggugggaagcagcuagggagaguggucguggcuccaaucugggaaucggagacaggagaauuaucuuuuuuuuuuuuugguguugaggacagaacccagggcuuugagcuuauuaggcaagcauucuacugcugaguuaaauccccaaccccaagaaucaucucaaaaagaaagaaagaaaagggaaaaagaagguggagccuggugguggugguggcggcggcggcggcacacgccuuuagucccagcacucaagaggcagaggcaggugggucucugaguucuugccagccugcucuacagaauacauucuaagacagccagagcuaugcagagaaacccugucucaaaaacaaacaaaaaaaggggguggggagagaagauagaagauaaggauauuccuucuuagcuagcugugggaccaaaaccagugagaggacacagcaauccagaggugucagucagaaucagagcccugugcuguguguggccuuagcaaggcaaacgggacuccuuucuuacagugcugaggacuggacucagagcuaagauccagccccucccugggggauucuaggcaggggcucuaccacugagccacgcccccagccccucacugggggauucuaggcaggggcucuaccacugagccacacccccagccccucacugggggauucuaggcaggggcucugcugcugauauauguccuuuuuguuuguuuacuuguuuguuuguuugucuuauuguggcccuagcuguccuagaacuugcuuuguagaccagagauauaccugucucugccucccaaauguuggauuuaaaggcaugugccaccaugccccacccuagccuagcccucuuauguuuuguaguuugagauggcaugucaguagauuucccaggauggccuugaaucuagguaauccuccugccucaguuucuugaguauuugaauuaugggacuguaccuuacauccagcugagcccacucaguucuggaagcugacagcgggagggaguguuaauccuuuggggacugacaaggugggguuaacauguagucucccuccucagacuccacgggcaaguacuggacgguggguagugauuccucggucaccagcagcagcgacaccccuguggauuucuuccuugaguucugugacuacaauaagguggcucucaaggugggcggccgcuaccugaagggggaccacgcugggguccugaaggccugcgcggagacuaucgaccccgccucacucugggaguacuagggccaccugcccucugcaggccgcucucgucagucccuccuguuauccuuacucaucggguggcccugcagcagguggcaaaccccuugccuuucaaacuggaaacccaagagaaaacggugcccuugcugucacccucuguggaccccuuuucccuaacucacugcuccccaugggucgguggcugcagacuguccccaggagggacucugguucccucuguccccuucuuuccauggggaacucuggcaccuuucuucugaccucagucaacucugagccuuauuuccccccaggaaguggccuaggagaagcuacagggccuagggacuuacccugagcuuguaacuggaagaccccgucccuauccccgcucccgcccccaccccaccccaccccugcucuggccccagccucuggaggccagccuuuuggcgggacugaagccgggcauggccaaccuugcccacaaguguuuuucuggaucuuggcuggaaggcagucugucccauccugcaguguuugggccuggcucuuugacucaaagcuagcuagguggcacuccgugucgcuccugcacauucuggaaggggcgggccucucacccaccucauuccuuuucccccuggccugacuggaagcagaaaaaugaccaaaucaguauuuuuuuuuuuuucuuuaaggaaauguuacuguugaaaggcccuaggcaagccugcccuguugguuguagucgugaguggucuuggggggagaugcuuggcuccugucccugccuccccagcggguucccucccucccuccugccugaccaccccagcucuggcucugugauuggugcuccacgucuucccagacaccucggggcuccugggcgggagaaagccggaugugccccucccugggagcccuggaguaaaccucagggggcccuuucccaaucacccccuuccaccgaccccucaacaccaugcaucucacucugggugucucgcuccuuuauuuuuuuguaacugucauuucuauaacucugaagacccaugauaguaagcuuugaacuggaaaauaaaguaaaaucaagucugcggcccg

SEQ ID NO: 2784 - RNA, 8592 nt, Mus musculus
ccgcgcuugcgcugggccacugcgccguggugacuuccugcaggucuggugugucgaggcuaccuucccucccgcagccuuugcguucgcuaagcuggaguugccgagccugcagggccgaggccggagcuuccggggcggcagcgaacagacucggcugugcgggcuagggaggccuagcgagagcucggcgcggaggcugacaggggcagcggagacgccugcucggugaggcccgagggcgcagagcgaucggggcugcgggagggaugcugggcacagauggugcccagucaguucacccgggcaccccgcuguccccagcuugcggcgccugggagggucgagguggucgggcugacagcgggacagcugcaucgcuuugggcugcacggucagucccgaggacagagugcaggcacugaagaacucaagggcuccagauucccacggugucacucagcguccaucagcucucuugcucugucuguggucccccccccccccgagucugcccuugaggcaucguaauggucuagugcucaaaaucugcuuuuacuucuuucugcucgugaaggaagacugagucugcgacaggugugagacuuaaucaagguuguguugaaaugagugccauuguuuucuaguuucuucccuuagucccuuuuuaagauaugcagcaguaaccaaguuuaguuggauaguuugaaaacaaaccacgcuuuaucccuguuugucggacgucuauccaucuggaccauuuuuccuuuuuguguuuuaguuuuuuugaggcguggauuccuuguggcacauauuguucugguagugggugauccucccgucuccgccuccagagaguugggauugcauguaugucaccucauggaacauggaucccagauauauauauauauagugcccagaauccucauucacugugacauauuuugcaacaguuugaauaggaaauaaaauaaguacccuuguuucccccaccuuuacaccaaaugcccguggauaaaaagaaggcagcguaguguucaucauagaacuguacccgcccccccucgccucccaccccccauuccaccuguuggaguuagguuugugauuuccuuccuaucaccucugcaguguguauaagcugcgauuucacuuggugguucccaggcgagagacaugucccuguguagaccaguuaaucuccgauuucagcgagcuuuuccuccagcaggucagucagcagugucuacaguucccccaagaggagcagaacaugagcagaucaaagguaaguuuuucccguuuguaauuuuuuuuuuucugacuccuuuguaauguauuuuggaagacuuacucaaaggucuguucuugaaugguaguggaguggucucuaaagggaucugacgcccucuucuggcaugcagguguacaugcagcagagcauccauacauagaauaauuaauaaguaaguaggauggucguggagaaaggagugaauaaaggugauuguaauauaaaauacacccgaguggcaggcugucaugaccuguuguguaggcagucugauaacuuuaggcuaauggaguuacuuggcagaguuagaaaaaggaaaaucguauccaucccaucaccugcagcugcucgugggaggugccguuuuuuguaccuuauaggaggcaaagacuugcuaggauuuggacaucuuccuuuagucagguugggaugauuuuugcauuuugaaaauuuaccuugacaagagcagcuugagggagaaagggcuuauucugcucacaguggcagaguacaguccaccacggugggaagggcacagaagcuuacuuugaggaagcugaaaauguauauauuuucugaagucaggaagggaagaggaaagcaugcccaccaugauggacaguacucuggaacauagagucauagaaaaguuacagagaaacaaaagaauuauacaaagaaaucuuucauuccguuugcuccaaaguugcauuuuuuaaacaguuuuuaaaaaauuuguuuuguaugugccuacaugugugcaugugugugguccaguaugcacgugaaggucagagcacaacuugugggaguccguucucucccuccauacagguccauagaacuauggagucauacauagaauuauaaagucucauacauagaaucauagaguuucauaugcagacucauagucuuguacacagacucauagagucucauacauagaaucauagucuuaugcauaaauaaaucacaugguuucauacagugagugcucagcccaccuugucuuuguaugguccaagaucuaagccaagggaaugaagccgcacacagugggcaggcuuuccugccccaguuuaccucaucaagagaaucccccacaagaaugacugacuagcccuuggucuauuucuccagcaauucagagucucaucacauugaccacugagaugaaccaucaguagagguggugaguucacagaggggaguacuuugcucaacuuagggaaacaaaaagccuguccaguguggauagcguugaauggauguccugguuugucugaugcagucuugaauuggaucuauauuccuaauaauuccauguagauggucuuuuauuucauacagagguuuucuuuuaaacagugcaucugugaucuuaucacacagcuguccaagaaauccuguacuuuaaccaugagccccaugagauagcucugcaaggacucugcuggagagucugcuguuuguuuuggcugcagaccaguauccccuagauaaaguuauaugacucaaggcugugguuucucuucuccauaacucuucucuguaccuaaaagguagcacugagaaauuccugugacuggaaucugccuuccacugcucuuagaagaauggaaugugguuuucuguuucuuuuuuuaaauauguauuuauuauuuuuguguugauaauuugugugccuuuuugaguuucugugucccgugugcauguaggagcuaacaggccagaagagggcgccagagcucuauaacuggaguuaccaggcaguuguaagcugccaaacaugggugcugggaaccgaacucagguccucugcaagagcaacaagcacucuaacaugggugagccaucaugcuaaccccaggacuuugguuuuugaauugggaagauaaucauaugugguuaguaacuccuaauuuaaaguuggcccucccugucacugucagaagcugccugcaggaaagugccaccuuggugucuuuccaccucccuuucugccccaccucuacguccuggugcuugucagucugucccuuuucugaggccccaccuuuccuuguaugucuuacucuaguaacaccuuugggcuucgauucuauucucuuuuuuuaauguuacauguuauuacauguuugcguugaaagcugaaauaaacucuacaaaugcuuguugacuuucagacgaaauaugcagagcucaaggaggugaaaucugggccagcagaugacucagcgaguaaaggcccaccaccaccacaccugacaacuugaguuuaauccccuaaacccacacgguggaaugagagaaccgaaccgcugugauaaaauacccugagaggcaaccugagggagaaggguuugcuuagcgcacaguuccagguuaugacccccaacucuggaugucaaggcagcgacguuaagcagcugcucauguuacagccacagugaagagcaaagggcacugaacuaaugcgugcuugguagcgcucagcuugcuuucucuacucuuacagaaugcaggaucucuguccaggggaugaugccacccacagugggugggucuucccaccucaguuaacauaagaaacacucugccacaggcuaaccugguuagacagucccuauugcaccccguucccagaugacucuagguuaugucaaguugacaguuaccugucacaucagagcuuugcuuuugcuuuuguuugccaagacaacguguuuacaauacgaugcugagauuuacugcaacaauacgguuuguuucccuuccgggcuuuguagcauaaaguaagguaugcaguguuaaugguuaacuggaccagugagcucgggugcccgcucugugugaucuaucugauucugaucaugucguugcagggcccacugucauucaaggauguggcuguggccuucucccaggaggaguggcagcagcuggacccugaggagaggaccacauacagggaugugaugcuggagaccuacagcaaccucgucuccgugggugaggaccacuugcuuccuaaacacugugaauuuaaaaugauuugucuuugaguuugaaggaacaagugcugacacuucguccuuucggguagauaucagguaucuuuacugcuccacugaaagauccuacaucuuucccccuugugguacuggaaauugaacccagagccuccugcaugugagcgguguuagcuacagcccaauacacaaaaggcucugguuuuacuuggcaaacacaggcaaaguguuauguaacuugugguggagcucccuauaccacagcgguucugcagccagugaguccaaacacuucuccuuuuccuguuaacaggguaugacguuaccaagccaaacaugauuauuaaguuggagcagggagaagagcccuggacaguggaaggugaccgccaugcucagaggcauuuggguaagugaauagagugaaauuuuagaaaguguuccuuuuuaaauuaauuuuguaggggaagcuucugaaaccuagugcuuuacagcaaaggaaauccagaaacgugcagguuuauuuguauuuggaauuaagagacaauuaaggaaaaaacuaugagggaagaagacaguagguuagggaaugugagucuccccagcagaaagaguggacagaaaggagauucaagacugaccggagugagcguucgcuuuauaucacaaaugucugagccacgguggaggggcaugaaacuuucauaauguuuuuacuaauguguggggucaaaaggcaaagauuucacugaaugugguggcucaggucuguaguuccaaaacuccagguaaggcaggcagauugcugacaguuuaaggccaaccugggcuaaauagaaacacacuguuucaaacaaaagcaaagauuucagaagugacuaagguguaaucucccaugagacguagacccauggacguaaaugcagaagugucuaagguauaaucucccaagugauggguuacuauuugauagaaauagcaaucugggucucccaaacacaggccauauuaaaacauuucuuuuucauauguccaauaauuauuuccccugcuucccuuugcugcgaguccucccacugugcguccucugugucugucugugucuggugcccuuucaguaacugugcuuccugcucaucauuucuuaggucaaaguuguaaagguaauauuuguaacguaaggugcuugcuuccauuguaaauugauucucuucccauuucuuacccacccugcauauacacacucagauuacagauuauaaaugaaaggagaaggagaccugugcauucauaauugcuuuuacucacagauugucagaaaauccgacauuuagguagcuuguauacucaugcugacagcauuuguuccaucucacuccuuuucagaaaucaguaaaguuuaugaccccagagaaggaauugaggaaauuggcgagaaacaucugcagugcgaugaugaucccuacugcuggagagcugagaagggggcugcuuuugaugaagccuacacccucgaaacagcccucauuucccccagcucaggugcucacagcugugucuccuguggggagacccuggagucuguuucagaacugauuagcagugacggaagcuaugcacuggagaagcccagcauguguuuugagugugggaaagcauacggagaaagccuugaagacuucaaccaagaugaggguaacuccucucaacacgaugaaaauauuuugcagaaagucaccauuuuggagaaacccuuugcuuaugagugcauggaagccuuagacagugaaaguguuuucauggcucgugagagagcuuacaugggggagaagcccuaugacuggggagacucuggaccagacuucauccagaugucggacuucaguacauauccgagaucacaaauggaacugaagcccuucgaauguacacagugugggaaguccuucuguaagaaguccaaauucaucauccaccagagagcucacacaggagagaagccguacgcuuguaguguguguggaaaguccuucagucaaaagggaacccucacuguacaucggagaucgcacuuagaggagaagcccuauaaguguaaugagugugggaagaccuuuugucagaaguuacaccucacacagcaccagaggacucacucaggagagaagcccuaugaauguagcgagugcgggaaguccuucugccagaagacacaccucacucuccaccagaggaaucacucaggcgagaggcccuacccguguaaugaaugugggaaauccuucucccggaagucugcccucaaugaccaucagaggacacacacaggagagaagcucuauaaguguaaugagugugggaaauccuacuaccggaaguccacccucauuacacaccagaggacacacacaggggagaagcccuaucaguguagugagugugggaaauucuucucucgggugucguaccucaccauacacuaucggagccauuuagaagagaaaccuuacgaguguacagaaugugggaaaaccuucaaucuaaacucugcuuucauuaggcacuggaagguccaugcagaagagagaguccaggaguguggcgagugugggaagccauccccgcugcagugugccccugaucacacaggcgaccuaggagagaagcgcuaugaguguaaugaguguggaaagaccuuccuugacagcucggccuuccauaggcaccaguccgucccugaaggggagaaaacuuacgaguguaauauaugcggaaaguccuucucggauucgucaugcuacacugugcacuacagaggucauuccgaagagaagcccuucgggugcagugaaugugggaagaccuucucucauaacucaucccucuucagacaucaaaggguccacaccggcgagaagccguacgaguguuacgaaugugggaaguucuucucucagaagucguaucucacuauccaucaccggauccauucgggagagaagcccuacgagugcagcaagugugggaaaguguucucgcggaugucgaaccucaccguacacuaccgaagccauucaggagagaagccguaugagugcaacgagugugggaaagucuuuucucagaagucguaccucaccgugcauuaccggacucauucaggagagaaaccuuaugaauguaacgaaugugggaaaaaauuccaccacagaucagccuucaauagccaucagagaauucauaaaagaggcacuguaaauguacucacuguagaaaagcucugacaugccaagguuuuuaaauuuuuuuuugguuuugguuuugguuuuuuugaaacaggguuucucuguguagcccuggcuguccuggaacucauucuguagaccaggcuggccucgaacucagaaauccgccugccucugccucccgagugcugggauuaaaggugugugcaccaccacugcccagugacaucucaguucuuaagaaaagcauuugguuauagugaacauuggaaguccaacagguagucaaggguggaccccccucaacccccccccccaauuuucaauauauguggugcugggauucugggccuuuugcaugcuauagacauucugcaagauucacgagcugagcauccacgcucuugaguguggaguccuaaaacaaaguccauuuuaacuugagcuuucagagaggaaucugugaagcaacccaugaccguaugacuuaugggacacuaggucaucuuuacaggagugaaccuuugaaaguauuuaauauuuauuuuuauuuaaaucguauuuacauaucagggaguucugcugugagcugucagcuccugaguauaacucgccuuggaaacgcacacuaaaagccauauuucugaccgacguuaccacggguguucauggaaaagaugcaagaagcuaugaguuccgaauaaacuuauaaaaugaagucaugaagccagcaguugagcaugagggugacugaaacacggcacuucugcuguucuagacacgcaauugaacagucucuaugcaauguuucgcaaucucggcuuugaaucauuugugagaacaugucagcaaggauuaaaaugacuguuacaguggguacaugggugggaugugcuagcugauagggaaguacauagcuuucuaugucggugcuuacccguagagugguuuuuguaaaaauauuuucaacuggaauugagcaaaaaaauuuuuuaaauacuauuuugauaaacca

SEQ ID NO: 2785 - RNA, 5212 nt, Mus musculus
gauggagcugggcccagcaacccagaccuuuguguuggagcuucgaugucuugaggauggggguccagggccugacacccucucaggugaggguugagguauggagacaguagggcccccagcaaggauucuuuaguugagucgcaagcuggcacaacccagaccaccacggagggaccccauguguguccagcauauuuacgacugcuaaccccagcuaccuugaaacuuagcguaggaccuguugagguggcugccaggccaaggucuugcuggagaaagagacaccuugacaggauucaguagccucagcccugacccccacaccugggcuggcucuaaccugcuuuucccaugugcaccccccccaucucccaccuggaacuggaggguguuucucugucucuagugccucagacaguggcuaaauggcuucuuuccuguccuucccucuacccuugucucauuuccucaacaucugucuccuuccccccaccugccacacgggcucccaggguguggaaccucccagaccccucucugagccccaugcagggauggggcagccuuuaaggguggacaggaguccauuuucacacugugcuuuaaagcacagugacagggaggggcaggcuugaacagagcugagagaaccaggaugagcugggcguggcuggaaucccagaacuugggaggcucaguuugaccuguguagugagcuccaagcuaggacuauauacaaugagacacuauugcacaucgagaauauauaucaggaauauuagaauagaaggaucaaaucgggcccuaccaauugaacaaagacucuuuccgcuuguaaauuuaacucuagcaggcauaacacuucaggugacaucuaacuacauggucaauagaaugcuucuguggaaacugcugucccaggaagucagagugaccacgugaccaagcuagaaaugaggcgauucacaccgaggugaggucugucccugcagaggaggcacgagaacggagugugugagagggugcugaucuuacccucgggacguguucccucaggugucugcacccacugcccaacacccagcugcucuguggaagcggcucuagaaagaaaaaaaguguuccaggggcuggggagguggcucaguggggagagcauucgcccuucaagcuugaggacaagaguuugaacccccagaguucaaguagaggcagaguaguucauugucugaaucggagcacuucuguuaugagaggggagguagaggcaggagaauccguggacacuccggggccagcuagccuggcaggccuguacagcggcagacaggagacccugucuccaagugcaaggucaggcccaacacccaacuuguccucugaccucuauaggugugcugugguaccuauguucccacaagcacacgcauggacacacaugcccauacacacaagacacacagauuuuaaaaaugcauuuaacaaaggugauuagaaagcuugguuuuguaaaauauaauuacacacaacuaucugugugugugugugugugugugugugugugguauguguggugugcauguguguauucauguuucuugucugcauuugggugcucuugugcguggguguggauggacaugugugcacaugcauuuggagaccccagacugaugucaagucauacuugaucauucuuccaccuuauucaaugggucagggucucugaaucgcgcucaaagcuugccuauacggcuagucuucccagccagcuuccuccagggacccccucucuccacucucugaggguggaguuauaggugugcugcugugccugacuuuucaguuaacuucugaaguacagacuccauaccugaccccccuggcuuccuugaugcgucaaugcuuucuagaaauggcuugcuguauccuuauagaaauggcuuguuauucacagacaaggcaaauuucacuuauuuaaagugugagcguuaucuggcggugguggcgcacaccuuuaaucccagcacuugggaggcagaggcaggcagaucucugugaguuuaaggccagccuggucuauagccugggacagccagggcuacacaaagaaauucuguaucaaaaaaccagauagauagauagauagauagauagauagauagauagauagauagauagacagacagacagacagacagugugugaccauaaauggguucagagcucagccacuggaauagcuggccucccugcauggggaaaaagagcuagacacauuucagggaauggugucaggauccccaagagcuaagcaugggacucauuugaagggggcucagugggagucugaacagggugaucaggggacucugggaauguuuguucugucaucguugucacuugcucucacauuuuuuggguccccgcucagagccccuuaguguauccugaaugcauccuucuggggguuugguccggauccugccuaucacuccuucucgccuggcuuccugccauuuccacuacagguggcaguggugggaaggaaagccaggaggaagaagagguccaggaggggagcagccacccacagcagccagugcuugcagccucauucggggccuauuacuauauugagccagagcaggaggaaccgcaggacuugcgagugcaccgaguuaagcagcagccagagcagaaacgucagcccgagcacaggcaguugcaagagcagcaaccgcagcaucagcuguuaggaucccagccagaaucgcagcagcagcagcaagauggacaacagcagcugucuccgccccagcaagaacagcaggaaaacuggcccaugcagcaccagcaaccaaaaccacagcugcagguggugcagcugccaagacuuggacaagagcaacauuuauugcugcagcagcaccagaugaugcagcuuccacaccaagcacaacagauguuucaacagcagcaggaacagcugcaacugcagcaaauucaacagcaguaucuugugcagcagcaaguauaugaaccuguaccgcagcagcaagugcugcuacugcagcagcugguacagcagcagcaagugcaggaacaacugccauuacagcagccaacgcaagagcagcaacagucacagcacccacagcuucuccaaaagcaacuguuacaacagcagagacaguugcugcugcagcaugugcaagaucaaguauugcaguuacaacaagugcaagagcagaagcuguugcaacaggagcaguuucagcagcagcugcuccaacagcagcaacugcugcagcagcagggacaguugcaacagcaacacuuacagcagcagguacuggugcugcagccacagggacagcuacagcagcaacuauugcugcagcagcaacagacacaguugcagcagcagcuguugcugcagcaacaggcacaauugcagcaccaacuauuacugcagcagcaggaacaguugcagcagcaguuauugcaacagcagcaggaacaguugcagcagcagcaguuauugcaaaagcagcaggaacagcuacagcagcaccagcagcugcagccucuuccaccagaggacgaggaaguggaacuugagcucaugccgguggacguggggucugagcaggagcuggagaggcagcaagagcuggaaagacugcaggaacagcggcagcugcagcuaaaaaugcaggagcagcuacgucagcuagagcagcaccuggagaagcagcagcagcuggagcagcugcagcagcagcagcagcuggagcaacaggaggugcaccuggagcugaccccgguggagcuaggcgcccagcagcaggagcugcaacuggagcugaccucugugcagccagagcugcaacuagagguggugccagcuccgggagguucagcgccagcuccagccaccguugugguggccccuccagguuacguggugcugcaagagcucauggugcugcccgcuguggccacauccacugugguagcuaucccgggccccgcggggagugcggcucugacucccgccaaacagcggaggaagcggcgagcccgggacaggccgaccaucugcagcgaguguggcaaggguuucagccgcagcacggaccuggugcgacaccaagccacacacacuggggagaggccguaccucugcagugagugcggcaagagcuucucacaacauuccaaccuggugacccaccagcgcauccacacgggcgagaagcccuaugccugcaccuacugcuccaagugcuucagcgagagcucggcgcucgugcagcaucagcgcacccacaccggagagcggcccuacgucugcggugacugcggcaagcgcuucagcgucuccuccaaccugcugcgccaccgucgcacccacucgggagagcggcccuacgugugcgaggacugcggcgagcgcuuccggcacaaggugcagauccgcaggcacgagcgccagcugcauggggcaggacgcucccgaggccugggacuccugcgguccuccaggcccgggccuucuacaagggcccagcagaacucugcauccgggaagcacugagagguguuagcgccauccacacacacaccucaacccuagguccuggccuuaaccccaucuugaggucuuucuggguaucuugaauuauccuuaagaaaggaagacuuccaucccgccugugacccaggccgccccacccccaccccccaagcaccaaguucacagauuucucaucccuccccccgccccccccccaaaccaucuccaggucggugaaagagacugcccagcuuugccugggaaaauaggacugagaacuggcuugguagcaaacaacucgugagauuugauacaaccaaacacuaaccagcaaaugaaauauuuagugugugugugugugugugugugugugugugugugugugugugugugugaacuggaaaaggaauggaucauucugaauacuuaaggagaaacuggaaggggaggggcagaggauggaguccagccuacuguaaauugcuugccuagcagaaagcccugguuuucaucuccagcaccauacaaacccgguguguggacccagauagucccagcacuugggagguggagacaggagacugaggcuccaggucauugucaggcacauagugaguuggcagauag
